(12) United States Patent
Radakovits et al.

(10) Patent No.: US 8,709,766 B2
(45) Date of Patent: Apr. 29, 2014

(54) USE OF ENDOGENOUS PROMOTERS IN GENETIC ENGINEERING OF NANNOCHLOROPSIS GADITANA

(71) Applicant: Colorado School of Mines, Golden, CO (US)

(72) Inventors: Randor Radakovits, Denver, CO (US); Robert Jinkerson, Golden, CO (US); Matthew Posewitz, Golden, CO (US)

(73) Assignee: Colorado School of Mines, Golden, CO (US)

( * ) Notice: Subject to any disclaimer, the term of this patent is extended or adjusted under 35 U.S.C. 154(b) by 0 days.

(21) Appl. No.: 13/654,347

(22) Filed: Oct. 17, 2012

(65) Prior Publication Data
US 2013/0102040 A1    Apr. 25, 2013

Related U.S. Application Data

(60) Provisional application No. 61/548,157, filed on Oct. 17, 2011, provisional application No. 61/578,110, filed on Dec. 20, 2011.

(51) Int. Cl.
| | |
|---|---|
| C12P 7/64 | (2006.01) |
| C12N 9/10 | (2006.01) |
| C12N 1/13 | (2006.01) |
| C07H 21/04 | (2006.01) |

(52) U.S. Cl.
USPC ..... 435/134; 435/193; 435/257.2; 435/173.5; 435/470; 536/23.7; 536/24.1

(58) Field of Classification Search
None
See application file for complete search history.

(56) References Cited

PUBLICATIONS

Armbrust et al., "The genome of the diatom *Thalassiosira pseudonana*: Ecology, evolution, and metabolism", *Science*, 79-86 (2004).
Atsumi et al., "Direct photosynthetic recycling of carbon dioxide to isobutyraldehyde", *Nature Biotechnology*, pp. 1177-1180 (2009).
Blanc et al. "The *Chlorella variabilis* NC64A genome reveals adaptation to photosymbiosis, coevolution with viruses, and cryptic sex", *The Plant Cell* (2010).
Blüthgen et al. "Biological Profiling of Gene groups utilizing Gene ontology—A statistical and software framework", (2004), Gossip software, http://www.microdiscovery.de/.
Blüthgen et al. "Biological Profiling of Gene Groups utilizing Gene Ontology", Genome Informatics, 16 (1): 106-115, 2005.
Bowler et al., "The Phaeodactylum genome reveals the evolutionary history of diatom genomes". *Nature*, pp. 239-244 (2008).
Chen et al., "Conditional production of a functional fish growth hormone in the transgenic line of *Nannochloropsis oculata* (Eustigmatophyceae)". *Journal of Phycology*, pp. 768-776 (2008).
Cock et al. "The Ectocarpus genome and the independent evolution of multicellularity in brown algae", *Nature*, pp. 617-621 (2010).
Conesa et al., "Blast2GO: a universal tool for annotation, visualization and analysis in functional genomics research", *Bioinformatics* 21, pp. 3674-3676 (2005).
Gobler et al. "Niche of harmful alga *Aureococcus anophagefferens* revealed through ecogenomics", *Proceedings of the National Academy of Sciences*, pp. 4352-4357 (2011).
Götz et al., "B2G-FAR, a species centered GO annotation repository", *Bioinformatics* (2011).
Götz et al. "High-throughput functional annotation and data mining with the Blast2GO suite", Nucleic Acids Research 36, pp. 3420-3435 (2008).
Gouveia et al., "Microalgae as a raw material for biofuels production", *Journal of Industrial Microbiology & Biotechnology*, pp. 269-274 (2009).
Hu et al. "Microalgal triacylglycerols as feedstocks for biofuel production: perspectives and advances", *The Plant Journal*, pp. 621-639 (2008).
Karpowicz et al., "The GreenCut2 resource, a phylogenomically derived inventory of proteins specific to the plant lineage", *Journal of Biological Chemistry*, pp. 21427-21439 (2011).
Kindle, K.L. "High-frequency nuclear transformation of *Chlamydomonas reinhardtii*", *Proceedings of the National Academy of Sciences*, pp. 1228-1232 (1990).
Le Corguille et al., "Plastid genomes of two brown algae, *Ectocarpus siliculosus* and *Fucus vesiculosus*: further insights on the evolution of red-algal derived plastids", *BMC Evolutionary Biology* 9, p. 253 (2009).
Li et al., "Chloroplast-encoded chlB is required for light-independent protochlorophyllide reductase activity in *Chlamydomonas reinhardtii*", *The Plant Cell* 5, pp. 1817-1829 (1993).
Li et al. "Chlamydomonas starchless mutant defective in ADP-glucose pyrophosphorylase hyper-accumulates triacylglycerol.", *Metabolic Engineering*, pp. 387-391 (2010).
Marchler-Bauer et al., "CDD: a Conserved Domain Database for the functional annotation of proteins", Nucleic Acids Research 39, 225-229 (2011).
Matsuzaki et al., "Genome sequence of the ultrasmall unicellular red alga *Cyanidioschyzon merolae* 10D", *Nature*, pp. 653-657 (2004).
Merchant et al., "The Chlamydomonas genome reveals the evolution of key animal and plant functions", *Science*, pp. 245-250 (2007).
Oudot-Le Secq et al., "Chloroplast genomes of the diatoms *Phaeodactylum tricornutum* and *Thalassiosira pseudonana* comparison with other plastid genomes of the red lineage", *Molecular Genetics and Genomics* 277, pp. 427-439 (2007).

(Continued)

*Primary Examiner* — David T Fox
*Assistant Examiner* — Matthew Keogh
(74) *Attorney, Agent, or Firm* — Dorsey & Whitney LLP

(57) ABSTRACT

The present disclosure is directed to novel polynucleotide sequences for use in *Nannochloropsis gaditana*. The novel polynucleotide sequences include control sequences and coding sequences. Also disclosed are novel gene expression constructs wherein *N. gaditana* promoters/control regions are operatively linked to *N. gaditana* or non-*N. gaditana* coding sequences. These novel polynucleotide sequences and expression constructs can be introduced into *N. gaditana* and can recombine into the *N. gaditana* genome. Expression from these polynucleotide sequences and expression constructs can enhance *N. gaditana* biomass and/or lipid biosynthesis. Also disclosed are methods for modifying *N. gaditana*, for example by stably transforming *N. gaditana* with nucleic acid sequences, growing the modified *N. gaditana*, and obtaining biomass and biofuels from the modified *N. gaditana*.

13 Claims, 198 Drawing Sheets

(56) References Cited

PUBLICATIONS

Pal et al., "The effect of light, salinity, and nitrogen availability on lipid production by *Nannochloropsis* sp.", *Applied Microbiology and Biotechnology*, pp. 1429-1441 (2011).

Radakovits et al, "Genetic engineering of fatty acid chain length in *Phaeodactylum tricornutum*", *Metabolic Engineering*, pp. 1-7 (2010).

Radakovits et al., "Genetic engineering of algae for enhanced biofuel production", Eukaryotic Cell 9, pp. 486-501 (2010).

Samstag, Antisense Nucleic Acid Drug Dev 6: pp. 153-156 (1996).

Steen et al., "Microbial production of fatty-acid-derived fuels and chemicals from plant biomass", Nature 463, pp. 559-562 (2010).

Wang et al. Algal Lipid Bodies: Stress induction, purification, and biochemical characterization in wild-type and starchless *Chlamydomonas reinhardtii*. *Eukaryotic Cell*, pp. 1856-1868 (2009).

Work et al. "Increased lipid accumulation in the *Chlamydomonas reinhardtii* sta7-10 starchless isoamylase mutant and increased carbohydrate synthesis in complemented strains", *Eukaryotic Cell*, pp. 1251-1261 (2010).

Zaslavskaia et al., "Transformation of the diatom *Phaeodactylum tricornutum* (Bacillariophyceae) with a variety of selectable marker and reporter genes", *Journal of Phycology*, pp. 379-386 (2000).

Zou et al. "Production of cell mass and eicosapentaenoic acid (EPA) in ultrahigh cell density cultures of *Nannochloropsis* sp. (Eustigmatophyceae)", *European Journal of Phycology*, pp. 127-133 (2000).

| Supplementary Table 3. Chlorophyll (tetrapyrrole), carotenoid and sterol biosynthesis genes ||||||
|---|---|---|---|---|---|
| Enzyme | Description | EC number | N. gaditana model[a] | Transcript Support[b] | Gene Location[c] |
| Tetrapyrrole Synthesis ||||||
| GTS | glutamyl-tRNA synthetase | 6.1.1.17 | Nga04989 | Y | N |
| GTS | glutamyl-tRNA synthetase | 6.1.1.24 | Nga02834 | Y | N |
| GTR | glutamyl-tRNA reductase | 1.2.1.70 | Nga02604 | Y | N |
| GSA | glutamate-1-semialdehyde aminotransferase / glutamate-1-semialdehyde 21-aminomutase | 5.4.3.8 | Nga30045 | Y | N |
| ALAD (HemB) | 5-aminolevulinic acid dehydratase / porphobilinogen synthase | 4.2.1.24 | Nga00585 | Y | N |
| PBGD (HemC) | porphobilinogen deaminase / hydroxymethylbilane synthase | 2.5.1.61 | Nga03248 | Y | N |
| UROS (HemD) | uroporphyrinogen III synthase | 4.2.1.75 | Nga00807 | Y | N |
| UROD | uroporphyrinogen III decarboxylase | 4.1.1.37 | Nga04120 | Y | N |
| UROD | uroporphyrinogen III decarboxylase | 4.1.1.37 | Nga05706 | Y | N |
| CPX1 (HemF) | coproporphyrinogen III oxidase | 1.3.3.3 | Nga05151 | Y | N |
| CPX1 (HemF) | coproporphyrinogen III oxidase | 1.3.3.3 | Nga04278 (partial) | Y | N |
| PPX | protoporphyrinogen IX oxidase | 1.3.3.4 | Nga03873 | Y | N |
| ChlD | protoporphyrin IX Mg-chelatase subunit D | 6.6.1.1 | Nga30773 | Y | N |
| ChlI | protoporphyrin IX MG-chelatase subuint I | 6.6.1.1 | Nga40092 | N | C |
| ChlH1 | protoporphyrin IX Mg-chelatase subunit H | 6.6.1.1 | Nga30995 | Y | N |
| ChlH2 | protoporphyrin IX Mg-chelatase subunit H | 6.6.1.1 | Nga06242 | Y | N |
| PPMT (ChlM) | Mg-protoporphyrin IX methyltransferase | 2.1.1.11 | Nga04808 | Y | N |
| AcsF (ycf59) | Mg-protoporphyrin IX monomethyl ester (oxidative) cyclase | 1.14.13.81 | Nga40091 | N | C |
| DVR | divinyl protochlorophyllide a 8-vinyl-reductase | 1.3.1.75 | Nga05945 | Y | N |
| POR | light-dependent NADPH:protochlorophyllide oxidoreductase | 1.3.1.33 | Nga04959 | Y | N |
| POR | light-dependent NADPH:protochlorophyllide oxidoreductase | 1.3.1.33 | Nga00683 | Y | N |
| ChlB | light-independent:protochlorophyllide oxidoreductase subunit B | 1.18.-.- | Nga40089 | N | C |
| ChlL | light-independent:protochlorophyllide oxidoreductase subunit L | 1.18.-.- | Nga40044 | Y | C |
| ChlN | light-independent:protochlorophyllide oxidoreductase subunit N | 1.18.-.- | Nga40045 | N | C |
| CHS (ChlG) | chlorophyll synthase | 2.5.1.62 | Nga31097 | Y | N |

FIGURE 1 A

| Enzyme | Description | EC number | N. gaditana model[a] | Transcript Support[b] | Gene Location[c] |
|---|---|---|---|---|---|
| GGR (ChlP) | geranylgeranyl reductase | 1.3.1.- | Nga04895 | Y | N |
| UMT | uroporphyrinogen III C-methyltransferase | 2.1.1.107 | Nga05160 | Y | N |
| SirB | sirohydrochlorin ferrochelatase | 4.99.1.4 | Nga00339 | Y | N |
| FC (HemH) | ferrochelatase | 4.99.1.1 | Nga00748 | Y | N |
| Carotenoid Biosynthesis | | | | | |
| DXS | 1-deoxy-D-xylulose-5-phosphate synthase | 2.2.1.7 | Nga02203 | Y | N |
| DXR (IspC) | 1-deoxy-D-xylulose-5-phosphate reductoisomerase | 1.1.1.267 | Nga30771 | Y | N |
| MCT (IspD) | 2-C-methyl-D-erythritol 4-phosphate cytidyltransferase | 2.7.7.60 | Nga06198 | Y | N |
| CMK (IspE) | 4-(cytidine 5'-diphospho)-2-C-methyl-D-erythritol kinase | 2.7.1.148 | Nga04584 | Y | N |
| MDS (IspF) | 2-C-methyl-D-erythritol 24-cyclodiphosphate synthase | 4.6.1.12 | Nga02651 | Y | N |
| HDS (IspG) | 4-hydroxy-3-methylbut-2-enyl diphosphate synthase | 1.17.4.3 | Nga30806 | Y | N |
| HDR (IspH) | 4-hydroxy-3-methylbut-2-enyl diphosphate reductase | 1.17.1.2 | Nga05308 | Y | N |
| IDI | isopentenyl diphosphate:dimethylallyl diphosphate isomerase type I | 5.3.3.2 | Nga03838 | Y | N |
| IDI | isopentenyl diphosphate:dimethylallyl diphosphate isomerase type I | 5.3.3.2 | Nga10002 | Y | N |
| GGPPS (CrtE) | geranylgeranyl pyrophosphate synthase | 2.5.1.29 | Nga02636 | Y | N |
| PSY1 (CrtB) | phytoene synthase | 2.5.1.32 | Nga02957 | Y | N |
| PDS (CrtP) | phytoene desaturase | 1.14.99.- | Nga05064 | Y | N |
| ZDS (CrtQ) | zeta-carotene desaturase | 1.14.99.30 | Nga07310 | Y | N |
| CRTISO | carotenoid isomerase | | No Homolog | - | - |
| LCYB (CrtL-b) | lycopene β-cyclase | 1.14.-.- | Nga00640 | Y | N |
| CYP97E | cytochrome P450 enzyme related to CYP97A carotene β-hydroxylase | | Nga30077 | Y | N |
| CYP97F | cytochrome P450 enzyme related to CYP97A carotene β-hydroxylase | | Nga00100 | Y | N |
| ZEP | zeaxanthin epoxidase | 1.14.13.90 | Nga01534 | Y | N |
| VDE | violaxanthin de-epoxidase | 1.10.99.3 | Nga02700 | Y | N |
| NSY | neoxanthin synthase | 5.3.99.9 | Nga10001 | Y | N |
| Sterol Synthesis | | | | | |
| ACAT | acetyl-CoA C-acetyltransferase | 2.3.1.9 | Nga20998 | Y | N |
| ACAT | acetyl-CoA C-acetyltransferase | 2.3.1.9 | Nga30830 | Y | N |
| HMGS | hydroxymethylglutaryl-CoA synthase | 2.3.3.10 | Nga06246 | Y | N |

FIGURE 1B

| Enzyme | Description | EC number | N. gaditana model[a] | Transcript Support[b] | Gene Location[c] |
|---|---|---|---|---|---|
| HMGR | hydroxymethylglutaryl-CoA reductase | 1.1.1.34 | No Homolog | - | - |
| MVK | mevalonate kinase | 2.7.1.36 | No Homolog | - | - |
| PMK | phosphomevalonate kinase | 2.7.4.2 | No Homolog | - | - |
| MVD | diphosphomevalonate decarboxylase | 4.1.1.33 | No Homolog | - | - |
| GPPS | geranyl-disphosphate synthase / dimethylallyltransferase | 2.5.1.1 | Nga02865 | Y | N |
| GPPS | geranyl-disphosphate synthase / dimethylallyltransferase | 2.5.1.1 | Nga01978 | Y | N |
| FPPS | farnesyl-diphosphate synthase | 2.5.1.68 | Nga02874 | Y | N |
| IDI | isopentenyl diphosphate:dimethylallyl diphosphate isomerase type I | 5.3.3.2 | Nga03838 | Y | N |
| IDI | isopentenyl diphosphate:dimethylallyl diphosphate isomerase type I | 5.3.3.2 | Nga10002 | Y | N |
| SQE (SQP) | squalene monoxygenase / squalene epoxidase | 1.14.99.7 | Nga01590 | Y | N |
| CAS | cycloartenol synthase | 5.4.99.8 | Nga30790 | Y | N |
| CYP51 | C14-demethylase (sterol 14-demethylase) | 1.14.13.70 | Nga03733.1 | Y | N |
| FACKEL | D14-sterol reductase | 1.3.1.70 | Nga00758 | N | N |
| SMO | Sterol methyl-oxidase (C4-methylsterol monooxygenase) | 1.14.13.72 | No Homolog | - | - |
| HSD-D | C4-decarboxylase (sterol-4-alpha-carboxylate 3-dehydrogenase) | 1.1.1.170 | Nga06114 | Y | N |
| SMT1 | sterol-C24-methyl transferase (sterol 24-C-methyltransferase) | 2.1.1.41 | Nga05943 | Y | N |
| SMT1 | sterol-C24-methyl transferase (sterol 24-C-methyltransferase) | 2.1.1.41 | Nga02534 | Y | N |
| HYD1 | D8-D7-sterol-isomerase (cholestenol delta-isomerase) | 5.3.3.5 | No Homolog | - | - |
| DWF7 (STE1) | C5-desaturase (lathosterol oxidase) | 1.14.21.6 | Nga02795 | Y | N |
| DWF5 | D7-sterol reductase (7-dehydrocholesterol reductase) | 1.3.1.21 | Nga03254 | Y | N |
| DWF1 | D24-sterol reductase (24-dehydrocholesterol reductase) | 1.3.1.72 | Nga03764 | Y | N |
| DWF1 | D24-sterol reductase (24-dehydrocholesterol reductase) | 1.3.1.72 | Nga05293 | Y | N |
| CPI (CCI) | cyclopropyl sterol isomerase (cycloeucalenol cycloisomerase) | 5.5.1.9 | Nga30196 | Y | N |
| DET2 | D5-sterol reductase | 1.3.1.30 | Nga00656 | Y | N |

FIGURE 1C

| Gene Name | Guillardia theta | Odontella sinensis | Phaeodactylum tricornutum | Thalassiosira pseudonana | Emiliania huxleyi | Ectocarpus siliculosus | N. gaditana |
|---|---|---|---|---|---|---|---|
| acpP | + | + | + | - | - | - | - |
| atpA | + | + | + | + | + | + | + |
| atpB | + | + | + | + | + | + | + |
| atpD | + | + | + | + | + | + | - |
| atpE | + | + | + | + | + | + | + |
| atpF | + | + | + | + | + | + | + |
| atpG | + | + | + | + | + | + | + |
| atpH | + | + | + | + | + | + | + |
| atpI | + | + | + | + | + | + | + |
| cbbX | + | + | + | + | + | + | + |
| ccs1 (ycf44) | + | + | + | + | + | + | + |
| ccsA (ycf5) | + | + | + | + | + | + | + |
| cemA (ycf10) | + | - | - | - | - | - | - |
| chlB | - | - | - | - | - | + | + |
| chlI | + | + | + | + | + | + | + |
| chlJ | - | - | - | - | - | - | - |
| chlL | - | - | - | - | - | + | + |
| chlN | - | - | - | - | - | + | + |
| clpA | - | - | - | - | - | - | + |
| clpC | + | + | + | + | + | + | + |
| cpeB | + | - | - | - | - | - | - |
| dfr | - | - | - | - | + | - | - |
| dnaB | + | + | + | + | - | + | - |
| dnaK | + | + | + | + | + | + | + |
| ftrB | + | - | - | - | - | + | - |
| ftsH (ycf25) | + | + | + | + | - | + | + |
| groL | + | + | + | + | + | + | + |
| hlip (ycf17) | + | - | - | - | - | + | - |
| hupA | + | - | - | - | - | - | - |
| ilvB | + | - | - | - | - | + | + |

FIGURE 6A

| Gene Name | Guillardia theta | Odontella sinensis | Phaeodactylum tricornutum | Thalassiosira pseudonana | Emiliania huxleyi | Ectocarpus siliculosus | N. gaditana |
|---|---|---|---|---|---|---|---|
| ilvH | + | - | - | - | - | + | - |
| infB | + | - | - | - | - | - | - |
| minD | + | - | - | - | + | - | - |
| minE | + | - | - | - | - | - | - |
| pbsA | + | - | - | - | - | - | - |
| petA | + | + | + | + | + | + | + |
| petB | + | + | + | + | + | + | + |
| petD | + | + | + | + | + | + | + |
| petF | + | + | + | + | - | + | + |
| petG | + | + | + | + | + | + | + |
| petL (ycf7) | + | + | + | + | + | + | - |
| petM (ycf31) | + | + | + | + | + | + | - |
| petN (ycf6) | + | + | + | + | + | + | + |
| psaA | + | + | + | + | + | + | + |
| psaB | + | + | + | + | + | + | + |
| psaC | + | + | + | + | + | + | + |
| psaD | + | + | + | + | + | + | + |
| psaE | + | + | + | + | - | + | + |
| psaF | + | + | + | + | + | + | + |
| psaI | + | + | + | + | + | + | + |
| psaJ | + | + | + | + | + | + | + |
| psaK | + | - | - | - | - | - | - |
| psaL | + | + | + | + | + | + | + |
| psaM | + | + | + | + | + | + | + |
| psb28 (ycf79) | + | + | + | + | - | + | + |
| psbA | + | + | + | + | + | + | + |
| psbB | + | + | + | + | + | + | + |
| psbC | + | + | + | + | + | + | + |
| psbD | + | + | + | + | + | + | + |
| psbE | + | + | + | + | + | + | + |
| psbF | + | + | + | + | + | + | + |
| psbH | + | + | + | + | + | + | + |
| psbI | + | + | + | + | + | + | + |
| psbJ | + | + | + | + | + | + | + |
| psbK | + | + | + | + | + | + | + |

FIGURE 6 B

| Gene Name | Guillardia theta | Odontella sinensis | Phaeodactylum tricornutum | Thalassiosira pseudonana | Emiliania huxleyi | Ectocarpus siliculosus | N. gaditana |
|---|---|---|---|---|---|---|---|
| psbL | + | + | + | + | + | + | + |
| psbN | + | + | + | + | + | + | + |
| psbT (ycf8) | + | + | + | + | + | + | + |
| psbV | + | + | + | + | + | + | + |
| psbW | - | - | - | - | - | + | + |
| psbX | + | + | + | + | + | + | - |
| psbY (ycf32) | + | + | + | + | + | + | + |
| psbZ (ycf9) | + | + | + | + | + | - | + |
| rbcL | + | + | + | + | + | + | + |
| rbcR (ycf30) | + | + | + | + | + | + | - |
| rbcS | + | + | + | + | + | + | + |
| rne | + | - | - | - | - | - | - |
| rpl1 | + | + | + | + | - | + | + |
| rpl11 | + | + | + | + | - | + | + |
| rpl12 | + | + | + | + | - | + | + |
| rpl13 | + | + | + | + | - | + | + |
| rpl14 | + | + | + | + | + | + | + |
| rpl16 | + | + | + | + | + | + | + |
| rpl18 | + | + | + | + | - | + | + |
| rpl19 | + | + | + | + | + | + | + |
| rpl2 | + | + | + | + | + | + | + |
| rpl20 | + | + | + | + | + | + | + |
| rpl21 | + | + | + | + | + | + | + |
| rpl22 | + | + | + | + | + | + | + |
| rpl23 | + | + | + | + | + | + | + |
| rpl24 | + | + | + | + | - | + | - |
| rpl27 | + | + | + | + | + | + | + |
| rpl29 | + | + | + | + | - | + | - |
| rpl3 | + | + | + | + | + | + | + |
| rpl31 | + | + | + | + | + | + | + |
| rpl32 | + | + | + | + | - | + | + |
| rpl33 | + | + | + | + | + | + | + |
| rpl34 | + | + | + | + | + | + | + |
| rpl35 | + | + | + | + | - | + | + |
| rpl36 | + | + | + | + | + | + | + |

FIGURE 6 C

| Gene Name | Guillardia theta | Odontella sinensis | Phaeodactylum tricornutum | Thalassiosira pseudonana | Emiliania huxleyi | Ectocarpus siliculosus | N. gaditana |
|---|---|---|---|---|---|---|---|
| rpl4 | + | + | + | + | - | + | + |
| rpl5 | + | + | + | + | + | + | + |
| rpl6 | + | + | + | + | + | + | + |
| rpmC | - | - | - | - | - | + | + |
| rpoA | + | + | + | + | + | + | + |
| rpoB | + | + | + | + | + | + | + |
| rpoC1 | + | + | + | + | + | + | + |
| rpoC2 | + | + | + | + | + | + | + |
| rpoZ (ycf61) | + | - | - | - | - | - | - |
| rps10 | + | + | + | + | + | + | + |
| rps11 | + | + | + | + | + | + | + |
| rps12 | + | + | + | + | + | + | + |
| rps13 | + | + | + | + | + | + | + |
| rps14 | + | + | + | + | + | + | + |
| rps16 | + | + | + | + | + | + | + |
| rps17 | + | + | + | + | + | + | + |
| rps18 | + | + | + | + | + | + | + |
| rps19 | + | + | + | + | + | + | + |
| rps2 | + | + | + | + | + | + | + |
| rps20 | + | + | + | + | - | + | + |
| rps3 | + | + | + | + | + | + | + |
| rps4 | + | + | + | + | + | + | + |
| rps5 | + | + | + | + | + | + | + |
| rps6 | + | + | + | + | + | - | + |
| rps7 | + | + | + | + | + | + | + |
| rps8 | + | + | + | + | + | + | + |
| rps9 | + | + | + | + | + | + | + |
| secA | + | + | + | + | + | + | + |
| secG (ycf47) | + | + | + | + | + | + | - |
| secY | + | + | + | + | + | + | + |
| sufB (ycf24) | + | + | + | + | + | + | + |
| sufC (ycf16) | + | + | + | + | - | + | + |
| syfB | - | - | + | - | - |  | - |
| tatC (ycf43) | + | + | + | + | + |  | + |

FIGURE 6 D

| Gene Name | Guillardia theta | Odontella sinensis | Phaeodactylum tricornutum | Thalassiosira pseudonana | Emiliania huxleyi | Ectocarpus siliculosus | N. gaditana |
|---|---|---|---|---|---|---|---|
| thiG | - | + | + | + | + | + | + |
| thiS (ycf40) | - | + | + | + | + | + | + |
| tsf | + | - | + | - | - | + | - |
| tufA | + | + | + | + | + | + | + |
| ycf12 | + | + | + | + | + | + | + |
| ycf19 | + | - | - | - | + | + | + |
| ycf20 | + | - | - | - | + | - | - |
| ycf27 | + | - | - | - | + | - | - |
| ycf29 | + | - | - | - | - | - | - |
| ycf3 | + | + | + | + | + | + | + |
| ycf33 | + | + | + | + | - | + | - |
| ycf34 | - | - | - | - | - | + | + |
| ycf35 | + | + | + | + | + | + | - |
| ycf36 | + | - | - | - | - | - | - |
| ycf37 | + | - | - | - | - | + | - |
| ycf39 | + | + | + | + | + | + | - |
| ycf4 | + | + | + | + | + | + | + |
| ycf41 | - | + | + | + | - | + | - |
| ycf42 | - | + | + | + | - | + | - |
| ycf45 | - | + | + | + | + | - | - |
| ycf46 | + | + | + | + | + | + | + |
| ycf54 | - | - | - | - | - | + | + |
| ycf55 | - | - | - | - | + | - | - |
| ycf59 | - | - | - | - | - | - | + |
| ycf60 | - | - | - | - | + | + | - |
| ycf65 | + | - | - | - | + | + | - |
| ycf66 | - | + | + | + | - | + | + |
| ycf80 | + | - | - | - | + | - | - |
| ycf88 | - | + | + | + | - | - | - |
| ycf89 | - | + | + | + | - | - | - |
| ycf90 | - | + | + | + | - | - | - |

FIGURE 6 E

| Supplementary Table 9. Gene clusters |||
|---|---|---|
| GO-term | GO-term description | Contig |
| N. gaditana model[d] | Gene model description[e] | Gene #[f] |
| GO:0042967 | acyl-carrier-protein biosynthetic process | merged000123 |
| Nga02737 | phospholipid:diacylglycerol acyltransferase | 1 |
| Nga02743 | serine palmitoyltransferase | 9 |
| Nga02741 | pyruvate dehydrogenase component x | 10 |
| GO:0006807 | nitrogen compound metabolic process | merged000138 |
| Nga00713 | guanine deaminase | 1 |
| Nga00717 | cytohesin-1 isoform 2 | 3 |
| Nga00702 | serine threonine-protein kinase tousled-like 1 isoform 2 | 5 |
| GO:0008610 | lipid biosynthetic process | merged000154 |
| Nga00818 | monogalactosyldiacylglycerol synthase | 1 |
| Nga00817 | fatty acid desaturase | 3 |
| GO:0046394 | carboxylic acid biosynthetic process | merged000212 |
| Nga05525 | anthranilate synthase | 1 |
| Nga05530 | cystathionine beta-synthase | 5 |
| Nga05522 | dihydroxy-acid dehydratase | 11 |
| GO:0006778 | porphyrin metabolic process | merged000288 |
| Nga03876 | protoporphyrinogen oxidase | 1 |
| Nga03879 | protoporphyrinogen oxidase | 2 |
| Nga03873 | protoporphyrinogen oxidase | 5 |
| GO:0006397 | mRNA processing | merged000340 |
| Nga20580 | rrna processing protein rrp17 | 1 |
| Nga30171 | u4 u6 small nuclear ribonucleoprotein prp3 | 2 |
| Nga30821 | u4 u6 small nuclear ribonucleoprotein prp4 | 3 |
| Nga05511 | prp4 pre-mrna processing factor 4 homolog | 4 |
| Nga30351 | u4 u6 small nuclear ribonucleoprotein prp4 | 6 |
| GO:0016070 | RNA metabolic process | merged000438 |
| Nga03294 | tfiih subunit | 1 |
| Nga30114 | protein | 2 |
| Nga03302 | polyadenlyte binding protein | 3 |
| Nga03296 | b chain structure of the mlle domain of poly-binding protein in complex with the binding region of paip2 | 5 |
| GO:0006810 | transport | merged000462 |
| Nga31189 | abc transporter | 1 |
| Nga03486 | abc atp-binding permease protein | 3 |
| Nga03479 | atp-binding cassette superfamily | 6 |
| GO:0034641 | cellular nitrogen compound metabolic process | NODE_3127 |
| Nga03304 | s-adenosylmethionine synthetase | 1 |
| Nga03314 | glutamyl-trna amidotransferase subunit a | 2 |
| Nga03312 | cytidine and deoxycytidylate deaminase family protein | 3 |
| Nga03305 | rna pseudouridylate synthase family protein | 4 |
| Nga03303 | carbamoyl-phosphate small subunit | 5 |
| Nga03313 | dihydropteroate synthase | 6 |

FIGURE 8A

| | | |
|---|---|---|
| Nga03316 | aspartate aminotransferase | 10 |
| Nga03306 | thymidylate synthase | 11 |
| Nga03310 | dihydrofolate reductase | 12 |
| Nga03311 | threonyl-trna synthetase | 13 |
| GO:0006139 | nucleobase, nucleoside, nucleotide and nucleic acid metabolic process | NODE_4378 |
| Nga30490 | polymerase (dna directed) epsilon 2 (p59 subunit) | 1 |
| Nga03669 | uv-damaged dna-binding | 2 |
| Nga30761 | gtp-binding protein | 3 |
| Nga30709 | dna damage-binding | 4 |
| GO:0006139; GO:0006310 | nucleobase, nucleoside, nucleotide and nucleic acid metabolic process; DNA recombination | NODE_5200 |
| Nga30978 | deah (asp-glu-ala-his) box polypeptide 8-like | 1 |
| Nga03202 | dna mismatch repair protein msh2 | 3 |
| Nga03203 | dna mismatch repair protein msh2 | 5 |
| Nga30317 | dna mismatch repair protein msh2 | 10 |
| Nga30528 | protein | 13 |
| GO:0006810 | transport | NODE_521 |
| Nga01558 | chromate transporter | 1 |
| Nga01560 | translocase of inner mitochondrial membrane 13 homolog | 4 |
| Nga01563 | lipid a export atp-binding permease protein msba | 5 |
| Nga20851 | at2g36910-like protein | 6 |
| Nga20388 | atp-binding sub-family b (mdr tap) member 10 | 7 |
| GO:0042967 | acyl-carrier-protein biosynthetic process | NODE_5292 |
| Nga04041 | dihydrolipoamide acetyltransferase | 1 |
| Nga04043 | branched-chain alpha-keto acid dehydrogenase subunit e2 | 3 |
| Nga04040 | branched-chain alpha-keto acid dehydrogenase subunit e2 | 6 |
| GO:0006260 | DNA replication | NODE_5379 |
| Nga30513 | dna replication licensing factor mcm3 | 1 |
| Nga01778 | dna replication licensing factor mcm3 | 5 |
| GO:0009081 | branched chain family amino acid metabolic process | NODE_5711 |
| Nga04063 | dihydroxy-acid dehydratase | 1 |
| Nga30327 | dihydroxy-acid dehydratase | 3 |
| Nga30644 | methylmalonate-semialdehyde dehydrogenase | 8 |
| GO:0006536 | glutamate metabolic process | NODE_5865 |
| Nga30142 | glutamate--cysteine ligase catalytic subunit | 1 |
| Nga30765 | glutamate-cysteine catalytic subunit | 2 |
| GO:0006732 | coenzyme metabolic process | NODE_653 |
| Nga02623.2 | molybdenum cofactor synthesis 1 | 1 |
| Nga01769.1 | 5-oxoprolinase | 2 |
| Nga01765.01 | cystathionine gamma-lyase | 6 |
| GO:0010467; GO:0016070 | gene expression; RNA metabolic process | merged000024 |
| Nga00538 | small nuclear ribonucleoprotein associated protein b | 1 |
| Nga00552 | translesion dna polymerase-rev1 deoxycytidyl transferase | 14 |

FIGURE 8B

| Nga00540 | ash1 ( or homeotic)-like | 15 |
| Nga20782 | 50s ribosomal protein l9 | 17 |
| Nga00535 | histone-lysine n-methyltransferase | 19 |
| Nga00543 | ef-1 guanine nucleotide exchange domain-containing | 20 |
| Nga00558 | ribosomal protein s16 | 21 |
| Nga00583 | cg9383-pa | 26 |
| Nga00593 | polyribonucleotide nucleotidyltransferase | 27 |
| Nga21110 | polyribonucleotide nucleotidyltransferase | 28 |
| Nga00596 | rna helicase rnase | 37 |
| Nga00595 | dicer-like protein 2 | 38 |
| Nga20178 | dicer-1 | 39 |
| Nga00568 | cdc2-like protein kinase | 43 |
| Nga00562 | 5 -3 exoribonuclease 2 | 63 |
| Nga00557 | glycyl-trna synthetase | 70 |
| Nga00581.01 | dna polymerase v family | 73 |
| Nga00566.01 | protein bud31 homolog | 74 |

[a] Gene ontology term that defines gene cluster.

[b] Gene ontology term description.

[c] Name of contig that gene cluster is found on.

[d] N. gaditana gene model.

[e] N. gaditana gene model description.

[f] Gene location in cluster.

FIGURE 8 C

| N. gaditana Gene ID | Gene Name[a] | Conserved Domain ID[b] | Conserved Domain Description[c] | Algal group[d] | Found in GreenCut2[e] |
|---|---|---|---|---|---|
| Nga00879 | | COG0618; cl15354 | Exopolyphosphatase-related proteins; cystathionine beta-synthase (CBS)_pair superfamily | BD | |
| Nga01062 | | cd00353; cl00349 | Ribosomal protein S15 (prokaryotic)/S13 (eukaryotic); S15/NS1/EPRS_RNA-binding domain | BD | |
| Nga01241 | | cl00999 | YCII-related domain | BD | |
| Nga02101 | | cl05363 | Oxygen evolving enhancer protein 3 (PsbQ) | BD | |
| Nga02601.01 | | cl14643 | START/RHO_alpha_C/PITP/Bet_v1/CoxG/CalC (SRPBCC) ligand-binding domain superfamily | BD | |
| Nga02755 | | cl10900 | Axonemal dynein light chain | BD | |
| Nga02799 | | | | BD | |
| Nga03348 | | cd00204 | ankyrin repeats | BD | |
| Nga03586 | | cl12031; pfam00561 | Esterase_lipase superfamily; alpha/beta hydrolase 1 fold | BD | |
| Nga03779 | | cd04301 | N-Acyltransferase superfamily | BD | |
| Nga03868 | | | | BD | |
| Nga04312.01 | | cl10460 | Sulfatase superfamily | BD | |
| Nga04890 | | cl12031 | Esterase lipase superfamily | BD | |
| Nga05077 | | cl11394 | Glycosyltransferase family A (GT-A) type superfamily | BD | |
| Nga05710 | | | | BD | |
| Nga05790.1 | | cd06174 | Major Facilitator Superfamily (MFS) | BD | |
| Nga05820 | | | | BD | |
| Nga05889 | | PRK00107 | 16S rRNA methyltransferase GidB | BD | |
| Nga06056 | | | | BD | |
| Nga06213 | | cl10460 | Sulfatase | BD | |
| Nga06321 | | | | BD | |
| Nga06681 | | cl12381 | GDP-fucose protein O-fucosyltransferase | BD | |
| Nga06717 | | cd09271 | Ribonuclease H2-C | BD | |
| Nga20030 | | cl10638 | Protein of unknown function (DUF726) | BD | |
| Nga20064 | | cl02660 | TAZ zinc finger | BD | |
| Nga20089 | | cl02576 | bZIP transcription factor | BD | |
| Nga20138 | | | | BD | |

FIGURE 11 A

| N. gaditana Gene ID | Gene Name[a] | Conserved Domain ID[b] | Conserved Domain Description[c] | Algal group[d] | Found in GreenCut2[e] |
|---|---|---|---|---|---|
| Nga20219 | | cl14780 | Crotonase/Enoyl-Coenzyme A (CoA) hydratase like superfamily | BD | |
| Nga20313 | | | | BD | |
| Nga20943 | | cl03381 | von Hippel-Landau (pVHL) tumor suppressor protein | BD | |
| Nga21039 | | cl12207 | MgtC family (unknown function) | BD | |
| Nga21144 | | cl09931; COG0644 | Rossmann-fold NAD(P)(+)-binding proteins; Dehydrogenases (flavoproteins) (FixC) | BD | |
| Nga30278 | | cl00161 | Dihydrofolate reductase (DHFR) | BD | |
| Nga30454 | | cl12011 | S-adenosylmethionine-dependent methyltransferases (SAM or AdoMet-MTase), class I superfamily | BD | |
| Nga30564 | | | | BD | |
| Nga30653 | | cl14643 | START/RHO_alpha_C/PITP/Bet_v1/CoxG/CalC (SRPBCC) ligand-binding domain superfamily | BD | |
| Nga30880 | | cl14603; cl09931 | C2 superfamily; Rossmann-fold NAD(P)(+)-binding proteins | BD | |
| Nga30943 | | cd00051; cl07216 | EF-hand, calcium binding motif; COPI associated protein | BD | |
| Nga40029 | | cl03567 | Ycf4 superfamily | BD | |
| Nga00093 | | PLN02584; cl00303 | 5'-methylthioadenosine nucleosidase; Phosphorylase superfamily | BDG | GreenCut2 |
| Nga00146 | | COG5070; cl01037 | Nucleotide-sugar transporter (VRG4); EamA-like transporter family | BDG | GreenCut2 |
| Nga00382 | | | | BDG | GreenCut2 |
| Nga00539 | | cl10013 | Glycosyltransferase GTB type superfamily | BDG | GreenCut2 |
| Nga00957 | | cl01977 | Ferredoxin thioredoxin reductase catalytic beta chain | BDG | GreenCut2 |
| Nga01759.01 | | cd03407 | band 7 domain of flotillin (reggie) like proteins | BDG | GreenCut2 |
| Nga02012 | | PLN02518; cl00938; cl14643 | pheophorbide a oxygenase; Rieske [2Fe-2S] cluster binding domain; START/RHO_alpha_C/PITP/Bet_v1/CoxG/CalC (SRPBCC) ligand-binding domain superfamily | BDG | GreenCut2 |

FIGURE 11 B

| N. gaditana Gene ID | Gene Name[a] | Conserved Domain ID[b] | Conserved Domain Description[c] | Algal group[d] | Found in GreenCut2[e] |
|---|---|---|---|---|---|
| Nga02567 | | cl00938; PLN02518; cl14643 | Rieske [2Fe-2S] cluster binding domain; pheophorbide a oxygenase; START/RHO_alpha_C/PITP/Bet_v1/CoxG/CalC (SRPBCC) ligand-binding domain superfamily | BDG | GreenCut2 |
| Nga02700.01 | | cl06253 | Violaxanthin de-epoxidase (VDE) | BDG | GreenCut2 |
| Nga02877 | | cd03407 | band 7 domain of flotillin (reggie) like proteins (lipid raft-associated) | BDG | GreenCut2 |
| Nga03047 | | | | BDG | GreenCut2 |
| Nga03349 | | COG1141 | Ferredoxin | BDG | GreenCut2 |
| Nga03361 | | cd06660; COG0667 | Aldo-keto reductases, Predicted oxidoreductases | BDG | GreenCut2 |
| Nga03364 | | cl01154; cl09109 | CreA superfamily; Nuclear transport factor 2 superfamily | BDG | GreenCut2 |
| Nga05945 | DVR | PLN02657; cd05243; cl09931 | 3,8-divinyl protochlorophyllide a 8-vinyl reductase; atypical (a) SDRs, subgroup 5; Rossmann-fold NAD(P)(+)-binding proteins | BDG | GreenCut2 |
| Nga20955 | | | | BDG | GreenCut2 |
| Nga20977.1 | | | | BDG | GreenCut2 |
| Nga21190 | | | | BDG | GreenCut2 |
| Nga30820 | | cl13479 | Protein of unknown function (DUF3529) | BDG | GreenCut2 |
| Nga30882 | | cl10080 | Retinal pigment epithelial 65 membrane protein | BDG | GreenCut2 |
| Nga40028 | psaL | cl03651 | Photosystem I reaction centre subunit XI | BDG | GreenCut2 |
| Nga00206 | | cd05243; cl09931; pfam01370 | atypical (a) SDRs, subgroup 5; Rossmann-fold NAD(P)(+)-binding proteins; NAD dependent epimerase/dehydratase family | BDRG | GreenCut2 |
| Nga00244 | | cd07560 | C-terminal processing peptidase, serine protease family S41 | BDRG | GreenCut2 |
| Nga00352 | | PLN02679; cl12031 | hydrolase, alpha/beta fold family protein; Esterase lipase superfamily | BDRG | GreenCut2 |
| Nga00432 | | PRK13474 | cytochrome b6-f complex iron-sulfur subunit | BDRG | GreenCut2 |
| Nga00448.01 | | cl02879 | Chlorophyll A-B binding protein | BDRG | GreenCut2 |
| Nga00462 | | cd00207 | 2Fe-2S iron-sulfur cluster binding domain (fer2) superfamily | BDRG | GreenCut2 |
| Nga00522.01 | | cl02879 | Chlorophyll A-B binding protein | BDRG | GreenCut2 |
| Nga00631 | | cl11841 | photosystem II protein Psb27 | BDRG | GreenCut2 |

FIGURE 11 C

| N. gaditana Gene ID | Gene Name[a] | Conserved Domain ID[b] | Conserved Domain Description[c] | Algal group[d] | Found in GreenCut2[e] |
|---|---|---|---|---|---|
| Nga00640 | LCYB (CrtL-b) | cl09931 | Rossmann-fold NAD(P)(+)-binding proteins | BDRG | GreenCut2 |
| Nga00679.01 | | cl12011 | S-adenosylmethionine-dependent methyltransferases (SAM or AdoMet-MTase), class I superfamily | BDRG | GreenCut2 |
| Nga00694 | | cl10080; COG3670 | Retinal pigment epithelial 65 membrane protein superfamily; Lignostilbene-alpha,beta-dioxygenase and related enzymes | BDRG | GreenCut2 |
| Nga00774.01 | | cl02879 | Chlorophyll A-B binding protein | BDRG | GreenCut2 |
| Nga00782 | | cd02947; cl00388 | TRX family; Thioredoxin_like superfamily | BDRG | GreenCut2 |
| Nga00807 | UROS (HemD) | cd06578 | Uroporphyrinogen-III synthase (HemD) | BDRG | GreenCut2 |
| Nga00818 | MGD1 | PLN02605 | monogalactosyldiacylglycerol (MGDG) synthase | BDRG | GreenCut2 |
| Nga00935.01 | | COG0534; cl10513 | Na+-driven multidrug efflux pump (NorM); MatE superfamily | BDRG | GreenCut2 |
| Nga00964 | | cd05265; cl09931; COG0451 | atypical (a) SDRs, subgroup 1; Rossmann-fold NAD(P)(+)-binding proteins; Nucleoside-diphosphate-sugar epimerases | BDRG | GreenCut2 |
| Nga00965.01 | | cl03326 | Manganese-stabilising protein / photosystem II polypeptide | BDRG | GreenCut2 |
| Nga00983.01 | | cl00197 | cyclophilin-type peptidylprolyl cis- trans isomerase | BDRG | GreenCut2 |
| Nga01068 | | cl00484 | NifU-like domain | BDRG | GreenCut2 |
| Nga01167 | | cl11228; cl00381 | Protein of unknown function (DUF2470); Pyridoxine 5'-phosphate (PNP) oxidase-like proteins | BDRG | GreenCut2 |
| Nga01264 | | TIGR01292; cl00388; cl09931 | thioredoxin-disulfide reductase; Thioredoxin_like superfamily; Rossmann-fold NAD(P)(+)-binding proteins | BDRG | GreenCut2 |
| Nga01344 | | cd07560 | C-terminal processing peptidase, serine protease family S41 | BDRG | GreenCut2 |
| Nga01483 | | cl00484; cl15257 | NifU-like domain; GIY-YIG nuclease domain superfamily | BDRG | GreenCut2 |
| Nga01705 | | cl01535 | Domain of unknown function (DUF477) | BDRG | GreenCut2 |
| Nga01771.01 | | cl09611 | Domain of unknown function (DUF1995) | BDRG | GreenCut2 |
| Nga01898.01 | | cl02879 | Chlorophyll A-B binding protein | BDRG | GreenCut2 |

FIGURE 11 D

| N. gaditana Gene ID | Gene Name[a] | Conserved Domain ID[b] | Conserved Domain Description[c] | Algal group[d] | Found in GreenCut2[e] |
|---|---|---|---|---|---|
| Nga01936 | | cl11587 | FKBP-type peptidyl-prolyl cis-trans isomerase | BDRG | GreenCut2 |
| Nga01968 | | COG0546; cd01427 | Predicted phosphatases (Gph); Haloacid dehalogenase-like hydrolases | BDRG | GreenCut2 |
| Nga01980.01 | | PLN02824; cl12031 | hydrolase, alpha/beta fold family protein; Esterase_lipase superfamily | BDRG | GreenCut2 |
| Nga02139 | | TIGR00745 | 2-dehydropantoate 2-reductase (apbA/panE) | BDRG | GreenCut2 |
| Nga02243 | | cl00337 | UbiA prenyltransferase family | BDRG | GreenCut2 |
| Nga02246 | | PLN02775; cl09931; cl04965 | Probable dihydrodipicolinate reductase; Rossmann-fold NAD(P)(+)-binding proteins; Dihydrodipicolinate reductase, C-terminus | BDRG | GreenCut2 |
| Nga02340 | | TIGR00225; cd00988 | C-terminal peptidase (prc); PDZ domain of C-terminal processing-, tail-specific-, and tricorn proteases | BDRG | GreenCut2 |
| Nga02348.01 | | COG1092; cd02440; cl00607 | Predicted SAM-dependent methyltransferases ; S-adenosylmethionine-dependent methyltransferases (SAM or AdoMet-MTase), class I superfamily; Pseudouridine synthase and Archaeosine transglycosylase domain | BDRG | GreenCut2 |
| Nga02385 | | PLN02679 | hydrolase, alpha/beta fold family protein | BDRG | GreenCut2 |
| Nga02586 | | COG0317; cd05399 | Guanosine polyphosphate pyrophosphohydrolases/synthetases (SpoT); Nucleotidyltransferase (NT) domain of RelA- and SpoT-like ppGpp synthetases and hydrolases | BDRG | GreenCut2 |
| Nga02777 | | cl05142 | GUN4-like (involved in plastid-to-nucleus signaling) | BDRG | GreenCut2 |
| Nga02785 | | cl02879 | Chlorophyll A-B binding protein | BDRG | GreenCut2 |
| Nga02790 | | cl02879 | Chlorophyll A-B binding protein | BDRG | GreenCut2 |
| Nga02810 | | COG2267; COG1075 | Lysophospholipase; Predicted acetyltransferases and hydrolases with the alpha/beta hydrolase fold | BDRG | GreenCut2 |
| Nga03075 | | cl09931; COG1233 | Rossmann-fold NAD(P)(+)-binding proteins; Phytoene dehydrogenase and related proteins | BDRG | GreenCut2 |
| Nga03116 | | cl02879 | Chlorophyll A-B binding protein | BDRG | GreenCut2 |

FIGURE 11 E

| N. gaditana Gene ID | Gene Name[a] | Conserved Domain ID[b] | Conserved Domain Description[c] | Algal group[d] | Found in GreenCut2[e] |
|---|---|---|---|---|---|
| Nga03131.1 | | cd05243; cl09931; COG0702 | atypical (a) SDRs, subgroup 5; Rossmann-fold NAD(P)(+)-binding proteins; Predicted nucleoside-diphosphate-sugar epimerases | BDRG | GreenCut2 |
| Nga03355 | | cl00388; cl01729 | Protein Disulfide Oxidoreductases and Other Proteins with a Thioredoxin fold; Vitamin K epoxide reductase family; | BDRG | GreenCut2 |
| Nga03454.01 | | TIGR02009; cd01427 | beta-phosphoglucomutase family hydrolase; Haloacid dehalogenase-like hydrolases | BDRG | GreenCut2 |
| Nga03465.01 | | cl12031; COG1075 | Esterase lipase superfamily; Predicted acetyltransferases and hydrolases with the alpha/beta hydrolase fold | BDRG | GreenCut2 |
| Nga03470 | | COG0534 | Na+-driven multidrug efflux pump | BDRG | GreenCut2 |
| Nga03545 | AOX | cd01053 | Alternative oxidase, ferritin-like diiron-binding domain | BDRG | GreenCut2 |
| Nga03581 | | cl02879 | Chlorophyll A-B binding protein | BDRG | GreenCut2 |
| Nga03884 | | cl12011 | S-adenosylmethionine-dependent methyltransferases (SAM or AdoMet-MTase), class I | BDRG | GreenCut2 |
| Nga03886 | | cl11414 | Cytochrome C superfamily | BDRG | GreenCut2 |
| Nga04175 | | cl02879 | Chlorophyll A-B binding protein | BDRG | GreenCut2 |
| Nga04177 | | cl02879 | Chlorophyll A-B binding protein | BDRG | GreenCut2 |
| Nga04484 | | cl04786 | SOUL heme-binding protein | BDRG | GreenCut2 |
| Nga04536.01 | | cl02879 | Chlorophyll A-B binding protein | BDRG | GreenCut2 |
| Nga04565 | | COG1748; cd00590 | Saccharopine dehydrogenase and related proteins; RNA recognition motif (RRM) | BDRG | GreenCut2 |
| Nga04644 | | cd07560 | C-terminal processing peptidase, serine protease family S41 | BDRG | GreenCut2 |
| Nga04808.01 | | PRK07580; cl12011 | Mg-protoporphyrin IX methyl transferase; S-adenosylmethionine-dependent methyltransferases (SAM or AdoMet-MTase), class I superfamily | BDRG | GreenCut2 |
| Nga05064 | PDS (CrtP) | PLN02612; cl09931 | phytoene desaturase; Rossmann-fold NAD(P)(+)-binding proteins | BDRG | GreenCut2 |
| Nga05492 | | cl05808 | Protein of unknown function (DUF1092) superfamily | BDRG | GreenCut2 |
| Nga05523 | | | Ribosomal protein S1-like RNA-binding domain | BDRG | GreenCut2 |

FIGURE 11 F

| N. gaditana Gene ID | Gene Name[a] | Conserved Domain ID[b] | Conserved Domain Description[c] | Algal group[d] | Found in GreenCut2[e] |
|---|---|---|---|---|---|
| Nga05636 | | COG0317 | Guanosine polyphosphate pyrophosphohydrolases/synthetases (SpoT) | BDRG | GreenCut2 |
| Nga05671 | | COG1357 | Pentapeptide repeats containing protein | BDRG | GreenCut2 |
| Nga05697 | | cl02879 | Chlorophyll A-B binding protein | BDRG | GreenCut2 |
| Nga05732 | | cd03041; cl00388 | GST_N family, 2 repeats of the N-terminal domain of soluble GSTs (2 GST_N) subfamily; Thioredoxin_like superfamily | BDRG | GreenCut2 |
| Nga05831.01 | | cl02971 | Pentapeptide repeats | BDRG | GreenCut2 |
| Nga05995.1 | | cd01924 | cyclophilin-type peptidylprolyl cis- trans isomerases (cyclophilins) similar to the Spinach thylakoid lumen protein TLP40 | BDRG | GreenCut2 |
| Nga06121 | | PLN00049; cd07560 | carboxyl-terminal processing protease; C-terminal processing peptidase; serine protease family S41 | BDRG | GreenCut2 |
| Nga06454 | | cl02879 | Chlorophyll A-B binding protein | BDRG | GreenCut2 |
| Nga06512 | | cl00197 | cyclophilin-type peptidylprolyl cis- trans isomerases | BDRG | GreenCut2 |
| Nga06539 | | cl11228; COG0748 | Protein of unknown function (DUF2470); Putative heme iron utilization protein | BDRG | GreenCut2 |
| Nga06745 | | pfam01458; cl03223 | Uncharacterized protein family (UPF0051); cysteine desulfurase activator complex subunit (SufB) | BDRG | GreenCut2 |
| Nga06853 | | cl02879 | Chlorophyll A-B binding protein | BDRG | GreenCut2 |
| Nga07310 | ZDS (CrtQ) | PLN02487; cl09931 | zeta-carotene desaturase; Rossmann-fold NAD(P)(+)-binding proteins | BDRG | GreenCut2 |
| Nga21031 | | cl00508 | YGGT family | BDRG | GreenCut2 |
| Nga30083 | | cl09931; COG0451 | Rossmann-fold NAD(P)(+)-binding proteins; Nucleoside-diphosphate-sugar epimerases | BDRG | GreenCut2 |
| Nga30145 | | cl01792; cl12011 | Uncharacterized protein conserved in bacteria (DUF2256); S-adenosylmethionine-dependent methyltransferases (SAM or AdoMet-MTase), class I superfamily | BDRG | GreenCut2 |
| Nga30371 | | cl09931 | Rossmann-fold NAD(P)(+)-binding proteins | BDRG | GreenCut2 |
| Nga30374 | | PRK00122 | 16S rRNA-processing protein RimM | BDRG | GreenCut2 |

FIGURE 11 G

| N. gaditana Gene ID | Gene Name[a] | Conserved Domain ID[b] | Conserved Domain Description[c] | Algal group[d] | Found in GreenCut2[e] |
|---|---|---|---|---|---|
| Nga30421 | | PLN02578 | hydrolase | BDRG | GreenCut2 |
| Nga30571 | | cd07560; cd00988 | C-terminal processing peptidase; serine protease family S41; PDZ domain of C-terminal processing | BDRG | GreenCut2 |
| Nga30762 | | pfam01593; cl09931 | Flavin containing amine oxidoreductase; Rossmann-fold NAD(P)(+)-binding proteins | BDRG | GreenCut2 |
| Nga30773 | ChlD | cl09099; TIGR02030 | P-loop containing Nucleoside Triphosphate Hydrolases; magnesium chelatase ATPase subunit I | BDRG | GreenCut2 |
| Nga30837 | AOX | cl00264 | Ferritin-like superfamily of diiron-containing four-helix-bundle proteins | BDRG | GreenCut2 |
| Nga30961 | | PLN02578 | hydrolase | BDRG | GreenCut2 |
| Nga31097 | CHS (ChlG) | cl00337 | UbiA prenyltransferase family | BDRG | GreenCut2 |
| Nga40001 | petF | cd00207 | 2Fe-2S iron-sulfur cluster binding domain (fer2) superfamily | BDRG | GreenCut2 |
| Nga40006 | psaE | cl03585 | Photosystem I reaction centre subunit IV / PsaE | BDRG | GreenCut2 |
| Nga40042 | psaD | cl03639 | PsaD superfamily | BDRG | GreenCut2 |
| Nga40047 | rbcS | cd03527 | Ribulose bisphosphate carboxylase/oxygenase (Rubisco), small subunit superfamily | BDRG | GreenCut2 |
| Nga40072 | sufB (ycf24) | cl03223; CHL00085 | cysteine desulfurase activator complex subunit SufB; putative ABC transporter (ycf24) | BDRG | GreenCut2 |
| Nga40087 | psaF | cl03627 | Photosystem I reaction centre subunit III (PsaF) | BDRG | GreenCut2 |
| Nga40092 | ChlI | cl09099; TIGR02030 | P-loop containing Nucleoside Triphosphate Hydrolases; magnesium chelatase ATPase subunit I (BchI-ChlI) | BDRG | GreenCut2 |
| Nga00022.01 | | cl03831 | Haemolysin-III related | BDG | |
| Nga00046 | | pfam12697 | Alpha/beta hydrolase 6 family | BDG | |
| Nga00157.01 | | PRK13557; cl02576; cl09965 | histidine kinase; bZIP transcription factor; Motif C-terminal to PAS motifs (likely to contribute to PAS structural domain) | BDG | |
| Nga00185 | | cl06868 | Ferredoxin reductase (FNR like superfamily) | BDG | |
| Nga00317 | | cd00130 | PAS domain | BDG | |
| Nga00379.01 | | | | BDG | |

FIGURE 11 H

| N. gaditana Gene ID | Gene Name[a] | Conserved Domain ID[b] | Conserved Domain Description[c] | Algal group[d] | Found in GreenCut2[e] |
|---|---|---|---|---|---|
| Nga00763 | | cl14813; pfam03152 | Peptidase Gluzincin family; Ubiquitin fusion degradation protein UFD1 | BDG | |
| Nga00791 | | cl00524 | Transmembrane amino acid transporter protein | BDG | |
| Nga00897 | | cl00927 | Formate/nitrite transporter | BDG | |
| Nga01225 | | cd07751; cl11964; cl02238; cl09954 | Polyphosphate(polyP) polymerase domain of yeast vacuolar transport chaperone (VTC) protein VTC4; CYTH-like (also known as triphosphate tunnel metalloenzyme (TTM)-like) Phosphatases; SPX domain; Domain of unknown function (DUF202) | BDG | |
| Nga01418.01 | | COG0665 | Glycine/D-amino acid oxidases (deaminating) (DadA) | BDG | |
| Nga01437.01 | | PRK14875 | acetoin dehydrogenase E2 subunit dihydrolipoyllysine-residue acetyltransferase | BDG | |
| Nga01497 | | cl12031; pfam12695 | Esterase_lipase superfamily; Alpha/beta hydrolase family | BDG | |
| Nga01527 | | cl01018 | YeeE/YedE family (DUF395) | BDG | |
| Nga01585 | | cl02988 | Glycosyltransferase family 10 (fucosyltransferase) | BDG | |
| Nga01597.01 | | cl00447 | Nudix_Hydrolase superfamily | BDG | |
| Nga01790 | | COG0654; cl09931 | 2-polyprenyl-6-methoxyphenol hydroxylase and related FAD-dependent oxidoreductases (UbiH); Rossmann-fold NAD(P)(+)-binding proteins | BDG | |
| Nga02655 | | cl00218 | glycosyl hydrolase family 16 | BDG | |
| Nga02821 | | PLN02378; cl00388 | glutathione S-transferase DHAR1; Thioredoxin like superfamily | BDG | |
| Nga02918 | | cd04301 | N-Acyltransferase superfamily | BDG | |
| Nga03200 | | | | BDG | |
| Nga03278 | | | | BDG | |
| Nga03403 | | cd04730; cl09108 | 2-Nitropropane dioxygenase (NPD)-like; TIM phosphate binding superfamily | BDG | |
| Nga03436 | | cl02813 | Mitochondrial carrier protein | BDG | |
| Nga03614.01 | | cl03589 | Chalcone-flavanone isomerase | BDG | |
| Nga03952.01 | | cl09954 | Domain of unknown function 202 superfamily | BDG | |
| Nga04174 | | PRK09525 | beta-D-galactosidase (lacZ) | BDG | |

FIGURE 11 I

| N. gaditana Gene ID | Gene Name[a] | Conserved Domain ID[b] | Conserved Domain Description[c] | Algal group[d] | Found in GreenCut2[e] |
|---|---|---|---|---|---|
| Nga04243 | | pfam12697 | Alpha/beta hydrolase 6 family | BDG | |
| Nga04411 | | cl02813 | Mitochondrial carrier protein superfamily | BDG | |
| Nga04754.1 | | cl07118 | RAP domain superfamily | BDG | |
| Nga04844.01 | | COG0654; cl09931 | 2-polyprenyl-6-methoxyphenol hydroxylase and related FAD-dependent oxidoreductases (UbiH); Rossmann-fold NAD(P)(+)-binding proteins | BDG | |
| Nga04864 | | cl01544 | Bestrophin, RFP-TM, chloride channel superfamily | BDG | |
| Nga05116 | | cl03951; cl07248; cl07247 | Cdc37 N terminal kinase binding; Cdc37 Hsp90 binding domain; Cdc37 C terminal domain | BDG | |
| Nga05302 | | cl00447 | Nudix_Hydrolase superfamily | BDG | |
| Nga05344 | | cl01544 | Bestrophin, RFP-TM, chloride channel superfamily | BDG | |
| Nga05424 | | cl00473 | BAX inhibitor (BI)-1/YccA-like protein family | BDG | |
| Nga05532 | | COG2850 | Uncharacterized conserved protein | BDG | |
| Nga05999 | | PRK13559; cl02576 | hypothetical protein; bZIP transcription factor superfamily | BDG | |
| Nga06125 | | | | BDG | |
| Nga06186 | | cl00456 | Sodium:solute symporter family | BDG | |
| Nga06677 | | cl00927 | Formate/nitrite transporter | BDG | |
| Nga06705 | | cl09109 | Nuclear transport factor 2 (NTF2-like) superfamily | BDG | |
| Nga06712 | | | | BDG | |
| Nga06740 | | pfam08449 | UAA transporter family | BDG | |
| Nga06994 | | cl02879 | Chlorophyll A-B binding protein | BDG | |
| Nga07089 | | PRK11752; cd10292; cl00388 | putative S-transferase; Glutathione S-transferase (GST) C-terminal domain family, YghU-like subfamily; Thioredoxin_like superfamily | BDG | |
| Nga07273 | | cl00447 | Nudix_Hydrolase superfamily | BDG | |
| Nga20078 | | cl06253 | Violaxanthin de-epoxidase-like protein of unknown function | BDG | |
| Nga20139 | | cl01206 | 2OG-Fe(II) oxygenase superfamily | BDG | |
| Nga20168.1 | | | | BDG | |
| Nga20308.1 | | | | BDG | |
| Nga20591 | | cl02776 | Glutathione S-transferase (GST) family, C-terminal alpha helical domain superfamily | BDG | |

FIGURE 11 J

| N. gaditana Gene ID | Gene Name[a] | Conserved Domain ID[b] | Conserved Domain Description[c] | Algal group[d] | Found in GreenCut2[e] |
|---|---|---|---|---|---|
| Nga20879 | | cl12011 | S-adenosylmethionine-dependent methyltransferases (SAM or AdoMet-MTase), class I superfamily | BDG | |
| Nga21269 | | cl00938 | Rieske [2Fe-2S] cluster binding domain | BDG | |
| Nga30150 | | | | BDG | |
| Nga30186 | | cl02144 | TLD superfamily | BDG | |
| Nga30196 | CPl (CCl) | | | BDG | |
| Nga30242 | | cl11587 | FKBP-type peptidyl-prolyl cis-trans isomerase | BDG | |
| Nga30516 | | cl00731 | Domain of unknown function (DUF179) | BDG | |
| Nga30567 | | cl00042 | Caspase, interleukin-1 beta converting enzyme (ICE) homologues | BDG | |
| Nga30598 | | cl00524 | Transmembrane amino acid transporter protein | BDG | |
| Nga30679 | | cl00042 | Caspase, interleukin-1 beta converting enzyme (ICE) homologues | BDG | |
| Nga40030 | psbE | CHL00064 | photosystem II protein V (psbE) | BDG | |
| Nga40063 | atpH | cl00466 | ATP synthase subunit C | BDG | |
| Nga00901 | | | | BDR | |
| Nga01689 | | cd00552 | RaiA "ribosome-associated inhibitor A", also known as Protein Y (PY), YfiA, and SpotY | BDR | |
| Nga01690 | | | | BDR | |
| Nga02056 | | cl09931 | Rossmann-fold NAD(P)(+)-binding proteins | BDR | |
| Nga02342 | | cd08255; cl14614 | 2-desacetyl-2-hydroxyethyl bacteriochlorophyllide and other MDR family members; Medium chain reductase/dehydrogenase (MDR)/zinc-dependent alcohol dehydrogenase-like family | BDR | |
| Nga02943 | | | | BDR | |
| Nga02945 | | cl11446 | Rhomboid family | BDR | |
| Nga03038.01 | | | | BDR | |
| Nga03117 | | | | BDR | |
| Nga03879 | | cl09931 | Rossmann-fold NAD(P)(+)-binding proteins | BDR | |
| Nga04065 | | cl01139 | Protein of unknown function, DUF399 | BDR | |

FIGURE 11 K

| N. gaditana Gene ID | Gene Name[a] | Conserved Domain ID[b] | Conserved Domain Description[c] | Algal group[d] | Found in GreenCut2[e] |
|---|---|---|---|---|---|
| Nga04422 | | | | BDR | |
| Nga04641 | | cl02879 | Chlorophyll A-B binding protein superfamily | BDR | |
| Nga05526 | | cl00933 | ATP-dependent Clp protease adaptor protein ClpS | BDR | |
| Nga20136 | | TIGR02352; cl14881 | glycine oxidase ThiO; Malate:quinone oxidoreductase (Mqo) | BDR | |
| Nga20468 | | cd04728 | Thiazole synthase (ThiG) | BDR | |
| Nga20657 | | cl08232 | Ribulose bisphosphate carboxylase large chain superfamily | BDR | |
| Nga20670 | | cl08224 | Photosystem I psaA/psaB protein superfamily | BDR | |
| Nga20759 | | cl08232 | Ribulose bisphosphate carboxylase large chain superfamily | BDR | |
| Nga20849 | | cd09294 | Small protein B (SmpB) superfamily | BDR | |
| Nga20900 | | cl08223 | Photosystem II protein | BDR | |
| Nga21024 | | cl08232 | Ribulose bisphosphate carboxylase large chain superfamily | BDR | |
| Nga21037 | | cl01024 | Putative small multi-drug export protein | BDR | |
| Nga21157 | | | | BDR | |
| Nga21279 | | cl08232 | Ribulose bisphosphate carboxylase large chain superfamily | BDR | |
| Nga30886 | | cl02526 | C-terminal processing peptidase family S41 | BDR | |
| Nga30899 | | pfam06514 | Photosystem II 12 kDa extrinsic protein (PsbU) | BDR | |
| Nga40021 | psbV | cl11414 | Cytochrome c | BDR | |
| Nga40082 | thiG | cd04728; cl09108 | Thiazole synthase (ThiG); TIM_phosphate_binding superfamily | BDR | |
| Nga00068 | | cd05685 | Ribosomal protein S1-like RNA-binding domain (S1 Tex) | BDRG | |
| Nga00223.01 | | TIGR01172; cd03354 | serine O-acetyltransferase (cysE); Serine acetyltransferase (SAT) | BDRG | |
| Nga00251.01 | | cd03013; cl00388 | Peroxiredoxin 5 like; Thioredoxin like superfamily | BDRG | |
| Nga00361 | | cl10013 | Glycosyltransferase GTB type superfamily | BDRG | |

FIGURE 11 L

| N. gaditana Gene ID | Gene Name[a] | Conserved Domain ID[b] | Conserved Domain Description[c] | Algal group[d] | Found in GreenCut2[e] |
|---|---|---|---|---|---|
| Nga00482.01 | FABZ_2 | cd01288 | beta-hydroxyacyl-acyl carrier protein (ACP) dehydratase (FabZ) | BDRG | |
| Nga00950 | | cl12022 | Ribosomal protein L18e/L15 | BDRG | |
| Nga01002 | | cd03467 | Rieske [2Fe-2S] cluster binding domain | BDRG | |
| Nga01031 | | cl00630 | YdcF-like superfamily | BDRG | |
| Nga01037 | | cl01132 | Fatty acid hydroxylase superfamily | BDRG | |
| Nga01210 | | | | BDRG | |
| Nga01230 | | TIGR03156; cl10444 | GTP-binding protein HflX; Ras-like GTPase superfamily | BDRG | |
| Nga01305.1 | | cl03940 | TLC ATP/ADP transporter | BDRG | |
| Nga01316 | | cd00320; COG3435 | Chaperonin 10 Kd subunit (cpn10 or GroES); Gentisate 1,2-dioxygenase | BDRG | |
| Nga01515 | | TIGR00841; cl09117 | Bile Acid:Na+ Symporter (BASS) Family; Membrane transport protein | BDRG | |
| Nga01605 | | cd03013; cl00388 | Peroxiredoxin (PRX) family, PRX5-like subfamily; Thioredoxin_like superfamily | BDRG | |
| Nga01793.01 | | cl09807 | Conserved hypothetical protein (Lin0512_fam) | BDRG | |
| Nga01805 | | cl03940 | TLC ATP/ADP transporter superfamily | BDRG | |
| Nga01914 | | cl10468 | Integral membrane protein TerC family | BDRG | |
| Nga01942 | | cd03013; cl00388 | Peroxiredoxin (PRX) family, PRX5-like subfamily; Thioredoxin_like superfamily | BDRG | |
| Nga02160 | | cl01037; COG0697 | EamA-like transporter family; Permeases of the drug/metabolite transporter (DMT) superfamily (RhaT) | BDRG | |
| Nga02379 | | cd07211; cl11396 | Patatin-like phospholipase domain containing protein 8; Patatins and Phospholipases | BDRG | |
| Nga02651.01 | | cd00554 | MECDP_synthase (2-C-methyl-D-erythritol-2,4-cyclodiphosphate synthase) (IspF) | BDRG | |
| Nga02662 | | cl08419 | Sigma-70 region 2 | BDRG | |
| Nga02686 | SQD1 | cl09931; PLN02572 | Rossmann-fold NAD(P)(+)-binding proteins; UDP-sulfoquinovose synthase | BDRG | |

FIGURE 11 M

| N. gaditana Gene ID | Gene Name[a] | Conserved Domain ID[b] | Conserved Domain Description[c] | Algal group[d] | Found in GreenCut2[e] |
|---|---|---|---|---|---|
| Nga02690 | | cd00170; COG0456; cd04301 | Sec14p-like lipid-binding domain; Acetyltransferases (RimI); N-Acyltransferase superfamily: Various enzymes that characteristically catalyze the transfer of an acyl group to a substrate | BDRG | |
| Nga02746 | | cd00498 | Heat shock protein 33-like chaperonin | BDRG | |
| Nga02754 | | TIGR02997 | RNA polymerase sigma factor 70-like | BDRG | |
| Nga02798 | | cl01467 | Uncharacterized conserved protein | BDRG | |
| Nga02900 | | pfam06325 | Ribosomal protein L11 methyltransferase (PrmA) | BDRG | |
| Nga02957 | PSY1 (CrtB) | cd00683; cl00210 | Trans-Isoprenyl Diphosphate Synthases, head-to-head; Isoprenoid Biosynthesis enzymes, Class 1 | BDRG | |
| Nga03147 | | cd05399 | Nucleotidyltransferase (NT) domain of RelA- and SpoT-like ppGpp synthetases and hydrolases.; | BDRG | |
| Nga03217 | | cl00951; cl00386 | Fe-S metabolism associated domain, SufE-related proteins; BolA-like protein | BDRG | |
| Nga03341 | | cd02440 | S-adenosylmethionine-dependent methyltransferases (SAM or AdoMet-MTase), class I | BDRG | |
| Nga03442 | | cd01517; cl00289 | PAP-phosphatase_like domain; FIG, FBPase/IMPase/glpX-like domain | BDRG | |
| Nga03565 | | PRK00517 | ribosomal protein L11 methyltransferase | BDRG | |
| Nga03664 | | cl02879 | Chlorophyll A-B binding protein | BDRG | |
| Nga03732 | | TIGR02227 | signal peptidase I, bacterial typ | BDRG | |
| Nga03876 | | cl09931 | Rossmann-fold NAD(P)(+)-binding proteins | BDRG | |
| Nga03950 | | cd07233 | Glyoxalase I | BDRG | |
| Nga04047.1 | | cl09117; TIGR00841 | Membrane transport protein; Bile Acid:Na+ Symporter (BASS) Family | BDRG | |
| Nga04073 | | cl09925 | Protein Kinases, catalytic domain | BDRG | |
| Nga04218 | | cl08419 | Sigma-70 region 2 | BDRG | |
| Nga04326.01 | | cl10468 | Integral membrane protein TerC family | BDRG | |

FIGURE 11 N

| N. gaditana Gene ID | Gene Name[a] | Conserved Domain ID[b] | Conserved Domain Description[c] | Algal group[d] | Found in GreenCut2[e] |
|---|---|---|---|---|---|
| Nga04512 | | cd00831 | Chalcone and stilbene synthases like | BDRG | |
| Nga04526 | | cl09925 | Protein Kinases, catalytic domain-like superfamily | BDRG | |
| Nga04584.1 | | COG1947 | 4-diphosphocytidyl-2C-methyl-D-erythritol 2-phosphate synthase (IspE) | BDRG | |
| Nga04742 | | COG1506; cl12031; cl00020 | Dipeptidyl aminopeptidases/acylaminoacyl-peptidases (DAP2); Esterase lipase superfamily; Type 1 glutamine amidotransferase (GATase1)-like domain | BDRG | |
| Nga04777.1 | | cd00948; cl09108 | Fructose-1,6-bisphosphate aldolase; TIM phosphate binding superfamily | BDRG | |
| Nga04801 | | cl01037 | EamA-like transporter family | BDRG | |
| Nga04846 | | cl12050 | TraB superfamily | BDRG | |
| Nga04895 | GGR (ChlP) | PLN00093; cl09931 | geranylgeranyl diphosphate reductase; Rossmann-fold NAD(P)(+)-binding proteins | BDRG | |
| Nga05141 | | COG1842 | Phage shock protein A (IM30) | BDRG | |
| Nga05308 | HDR (IspH) | PLN02821 | 1-hydroxy-2-methyl-2-(E)-butenyl 4-diphosphate reductase (HDR) | BDRG | |
| Nga05494.01 | | PRK04184 | DNA topoisomerase VI subunit B | BDRG | |
| Nga05568 | | cd03017; cl00388 | Peroxiredoxin (PRX) family, Bacterioferritin comigratory protein (BCP) subfamily; Thioredoxin_like superfamily | BDRG | |
| Nga05781 | | cl01379 | Tryptophan-rich sensory protein (TspO)/MBR family | BDRG | |
| Nga05803 | | cl09611 | Domain of unknown function (DUF1995) | BDRG | |
| Nga05850 | | PLN00033; cl10130 | photosystem II stability/assembly factor; Ycf48-like protein | BDRG | |
| Nga05921 | | cl14656 | Phosphoenolpyruvate carboxylase | BDRG | |
| Nga06059.1 | | cl00489 | 60Kd inner membrane protein | BDRG | |
| Nga06149 | | cl01379 | Tryptophan-rich sensory protein (TspO)/MBR family | BDRG | |
| Nga06200 | | cl03940 | TLC ATP/ADP transporter | BDRG | |
| Nga06242 | ChlH2 | PLN03241 | magnesium chelatase subunit H | BDRG | |
| Nga06284 | | cl01697 | NnrU protein (exact function unclear) | BDRG | |
| Nga06431 | | cd04451 | Translation Initiation Factor IF1, S1-like RNA-binding domain | BDRG | |

FIGURE 11 O

| N. gaditana Gene ID | Gene Name[a] | Conserved Domain ID[b] | Conserved Domain Description[c] | Algal group[d] | Found in GreenCut2[e] |
|---|---|---|---|---|---|
| Nga06432 | | PRK12902 | preprotein translocase subunit (SecA) | BDRG | |
| Nga06516 | | TIGR00691 | (p)ppGpp synthetase, RelA/SpoT family | BDRG | |
| Nga06559 | | cd02440 | S-adenosylmethionine-dependent methyltransferases (SAM or AdoMet-MTase), class I superfamily | BDRG | |
| Nga06584 | | cl03037 | HCO3- transporter family | BDRG | |
| Nga07147 | | cd07211 | Patatin-like phospholipase domain containing protein 8 | BDRG | |
| Nga20052 | | PLN03241; cl13412 | magnesium chelatase subunit H; Domain of unknown function (DUF3479) | BDRG | |
| Nga20056 | | pfam09258 | Glycosyl transferase family 64 domain | BDRG | |
| Nga20192 | | pfam02536 | mitochondrial transcription termination factor (mTERF) | BDRG | |
| Nga20325 | | PRK00131 | shikimate kinase (aroK) | BDRG | |
| Nga20417 | | cl08224 | Photosystem I psaA/psaB protein | BDRG | |
| Nga20459 | | cl08224 | Photosystem I psaA/psaB protein | BDRG | |
| Nga20492 | | cl08232 | Ribulose bisphosphate carboxylase large chain superfamily | BDRG | |
| Nga20546.1 | | cl12011 | S-adenosylmethionine-dependent methyltransferases (SAM or AdoMet-MTase), class I superfamily | BDRG | |
| Nga20664 | | cl08224 | Photosystem I psaA/psaB protein superfamily | BDRG | |
| Nga20720 | | cl08232 | Ribulose bisphosphate carboxylase large chain superfamily | BDRG | |
| Nga20725 | | cl08224 | Photosystem I psaA/psaB protein superfamily | BDRG | |
| Nga20738 | | cl08224 | Photosystem I psaA/psaB protein superfamily | BDRG | |
| Nga20923 | | cl08223 | Photosystem II protein | BDRG | |
| Nga20940 | | pfam09258 | Glycosyl transferase family 64 domain | BDRG | |
| Nga21049 | | cl08224 | Photosystem I psaA/psaB protein | BDRG | |
| Nga21063 | | cl08224 | Photosystem I psaA/psaB protein | BDRG | |
| Nga21066 | | cl08224 | Photosystem I psaA/psaB protein | BDRG | |
| Nga21084 | | cl08224 | Photosystem I psaA/psaB protein | BDRG | |

FIGURE 11 P

| N. gaditana Gene ID | Gene Name[a] | Conserved Domain ID[b] | Conserved Domain Description[c] | Algal group[d] | Found in GreenCut2[e] |
|---|---|---|---|---|---|
| Nga21158 | | cl08224 | Photosystem I psaA/psaB protein | BDRG | |
| Nga21178 | | cl08232 | Ribulose bisphosphate carboxylase large chain superfamily | BDRG | |
| Nga21247 | | cl08224 | Photosystem I psaA/psaB protein | BDRG | |
| Nga21271 | | cd09289 | D1 subunit of photosystem II | BDRG | |
| Nga30090 | | smart00487; cd00079; COG1197 | DEAD-like helicases superfamily (DEXDc); Helicase superfamily c-terminal domain (HELICc); Transcription-repair coupling factor (Mfd) | BDRG | |
| Nga30125 | | cd00412 | Inorganic pyrophosphatase | BDRG | |
| Nga30126 | | cl03940 | TLC ATP/ADP transporter | BDRG | |
| Nga30194 | | cl09931; PRK07208 | Rossmann-fold NAD(P)(+)-binding proteins; hypothetical protein | BDRG | |
| Nga30232 | | cl02879 | Chlorophyll A-B binding protein | BDRG | |
| Nga30264 | | cl09925 | Protein Kinases, catalytic domain | BDRG | |
| Nga30614 | | cd00170 | Sec14p-like lipid-binding domain superfamily | BDRG | |
| Nga30622 | | TIGR02997; cl08419 | RNA polymerase sigma factor, cyanobacterial RpoD-like family; Sigma-70 region 2 | BDRG | |
| Nga30671 | | PRK07379; cl06150 | coproporphyrinogen III oxidase; HemN C-terminal region | BDRG | |
| Nga30751 | | PRK11132 | Serine acetyltransferase (SAT) | BDRG | |
| Nga30761 | | COG2262; cd01878 | GTPases; HflX subfamily | BDRG | |
| Nga30766 | | cl12138; TIGR03060 | Thylakoid formation protein (THF1); photosystem II biogenesis protein Psp29 | BDRG | |
| Nga30790 | CAS | cd02892 | Squalene cyclase (SQCY) domain subgroup 1 | BDRG | |
| Nga30806 | HDS (IspG) | PLN02925 | 4-hydroxy-3-methylbut-2-en-1-yl diphosphate synthase (IspG) | BDRG | |
| Nga30840 | | TIGR02997; cl08419 | RNA polymerase sigma factor, cyanobacterial RpoD-like family; Sigma-70 region 2 | BDRG | |
| Nga30855 | | cd03013; cl00388 | Peroxiredoxin (PRX) family, PRX5-like subfamily; Thioredoxin_like superfamily | BDRG | |
| Nga30862 | | cl00938 | Rieske [2Fe-2S] cluster binding domain | BDRG | |

FIGURE 11 Q

| N. gaditana Gene ID | Gene Name[a] | Conserved Domain ID[b] | Conserved Domain Description[c] | Algal group[d] | Found in GreenCut2[e] |
|---|---|---|---|---|---|
| Nga30939 | | cd02440 | S-adenosylmethionine-dependent methyltransferases (SAM or AdoMet-MTase), class I superfamily | BDRG | |
| Nga30995 | ChlH1 | PRK12493; cl13412 | magnesium chelatase subunit H; Domain of unknown function (DUF3479) | BDRG | |
| Nga31026 | | PLN02536 | Diaminopimelate epimerase | BDRG | |
| Nga40002 | psbB | cl08223 | Photosystem II protein | BDRG | |
| Nga40005 | psbH | cl02951 | Photosystem II 10 kDa phosphoprotein | BDRG | |
| Nga40009 | petB | cd00284 | Cytochrome b (N-terminus)/b6/petB | BDRG | |
| Nga40010 | petD | cd00290 | Cytochrome b(C-terminus)/b6/petD | BDRG | |
| Nga40017 | rps14 | cl00355 | Ribosomal protein S14p/S29e | BDRG | |
| Nga40018 | psaB | cl08224 | Photosystem I psaA/psaB protein | BDRG | |
| Nga40019 | psaA | cl08224 | Photosystem I psaA/psaB protein | BDRG | |
| Nga40020 | petJ | cl11414 | Cytochrome c | BDRG | |
| Nga40024 | rpl19 | cl00406 | Ribosomal protein L19 | BDRG | |
| Nga40046 | psbA | cd09289; cl08220 | D1 subunit of photosystem II (PS II); D1, D2 subunits of photosystem II (PSII) | BDRG | |
| Nga40048 | rbcL | cd08212 | Ribulose bisphosphate carboxylase large chain, Form I superfamily | BDRG | |
| Nga40050 | petA | cl03168 | Apocytochrome F, C-terminal | BDRG | |
| Nga40051 | tatC | cl00521 | Sec-independent protein translocase protein (TatC) | BDRG | |
| Nga40054 | ycf3 | CHL00033 | photosystem I assembly protein (Ycf3) | BDRG | |
| Nga40056 | rpl33 | cl00383 | Ribosomal protein L33 | BDRG | |
| Nga40060 | rpoC2 | TIGR02388 | DNA-directed RNA polymerase, beta' subunit (rpoC2 cyan) | BDRG | |
| Nga40061 | rps2 | cd01425 | Ribosomal protein S2 (RPS2) | BDRG | |
| Nga40062 | atpI | cl00413 | ATP synthase A chain | BDRG | |
| Nga40073 | ccsA | cl00504 | Cytochrome C assembly protein | BDRG | |
| Nga40078 | secA | CHL00122 | preprotein translocase subunit SecA | BDRG | |
| Nga40084 | psaC | CHL00065 | photosystem I subunit VII (psaC) | BDRG | |
| Nga40093 | psbC | cl08223; TIGR01153 | Photosystem II protein; psbC | BDRG | |
| Nga40094 | psbD | cd09288; cl08220 | D2 subunit of photosystem II (PS II); D1, D2 subunits of photosystem II (PSII) | BDRG | |

FIGURE 11 R

| N. gaditana Gene ID | Gene Name[a] | Conserved Domain ID[b] | Conserved Domain Description[c] | Algal group[d] | Found in GreenCut2[e] |
|---|---|---|---|---|---|
| Nga40113 | secY | CHL00161 | preprotein translocase subunit SecY | BDRG | |
| Nag50013 | | | | BDRG | |

[a] Name given to *N. gaditana* gene model by manual curation.

[b] Conserved protein domain(s) ID assigned from NCBI-curated domains, Pfam, SMART, COG, PRK, or TIGRFAM databases.

[c] Description(s) of conserved protein domain given.

[d] Algal lineages with homologs to *N. gaditana* gene model. B – Brown, D – diatom, R – red, G – green.

[e] Indicates if *N. gaditana* gene model has homology to a GreenCut2 gene[37].

FIGURE 11 S

| Enzyme | Description | EC number | N. gaditana model[a] | Transcript support[b] |
|---|---|---|---|---|
| Fatty acid biosynthesis | | | | |
| ACS | acetyl-CoA synthetase | 6.2.1.1 | Nga30020 | Y |
| ACS | acetyl-CoA synthetase | 6.2.1.1 | Nga02166 | Y |
| ACC | acetyl-CoA carboxylase | 6.4.1.2 | Nga30028 | Y |
| ACC | acetyl-CoA carboxylase | 6.4.1.2 | Nga30783 | Y |
| MAT | malonyl-CoA:ACP-trans-acylase | 2.3.1.39 | Nga00899 | Y |
| KASIII | 3-oxoacyl-ACP synthase III | 2.3.1.180 | Nga30106 | Y |
| KASII | 3-oxoacyl-ACP synthase II | 2.3.1.179 | Nga02138 | Y |
| KASII | 3-oxoacyl-ACP synthase II | 2.3.1.179 | Nga30755 | Y |
| KASII | 3-oxoacyl-ACP synthase II | 2.3.1.179 | Nga04201.01 | Y |
| KASI/II | fatty acid synthase | 2.3.1.- | Nga05827 | Y |
| KAR | 3-oxoacyl-ACP reductase | 1.1.1.100 | Nga20022 | Y |
| KAR | 3-oxoacyl-ACP reductase | 1.1.1.100 | Nga01542 | Y |
| HD | 3-hydroxy acyl-CoA dehydratase | 4.2.1.- | Nga05985.01 | Y |
| ENR | enoyl-ACP reductase I | 1.3.1.9 | Nga05091 | Y |
| ENR | enoyl-ACP reductase I | 1.3.1.9 | Nga10004 | Y |
| KAR | 3-oxoacyl-ACP reductase | 1.1.1.100 | Nga00602 | Y |
| KAR | 3-oxoacyl-ACP reductase | 1.1.1.100 | Nga05627 | Y |
| FAT | oleyl-ACP hydrolase | 3.1.2.14 | Nga01045.01 | Y |
| ELOVL | elongation of very long chain fatty acids | 2.3.1.- | Nga03084 | Y |
| ELOVL | elongation of very long chain fatty acids | 2.3.1.- | Nga00451 | Y |
| DESA | acyl-ACP desaturase | 1.14.19.2 | Nga01458.01 | Y |
| DESC | stearoyl-CoA desaturase | 1.14.19.1 | Nga00524 | Y |
| DES | omega-6 fatty acid desaturase delta-12 | 1.14.19.- | Nga02019 | Y |
| DES | omega-6 fatty acid desaturase delta-12 | 1.14.19.- | Nga00817 | Y |
| DEGS | sphingolipid delta-4 desaturase | 1.14.-.- | Nga06739.1 | Y |
| FAD7 | glycerolipid omega-3 fatty acid desaturase | 1.14.19.- | Nga30138 | Y |
| TAG assembly | | | | |
| G3PDH | glycerol-3-phosphate dehydrogenase | 1.1.1.8 | Nga06665.1 | Y |
| G3PDH | glycerol-3-phosphate dehydrogenase | 1.1.1.8 | Nga01869 | Y |
| G3PDH | glycerol-3-phosphate dehydrogenase | 1.1.1.8 | Nga04914 | Y |
| G3PDH | glycerol-3-phosphate dehydrogenase | 1.1.1.8 | Nga05226 | Y |
| G3PDH | glycerol-3-phosphate dehydrogenase | 1.1.1.8 | Nga30015 | Y |
| GPAT | glycerol-3-phosphate acyltransferase | 2.3.1.15 | Nga04759 | Y |
| GPAT | glycerol-3-phosphate acyltransferase | 2.3.1.15 | Nga10005 | Y |
| GPAT | glycerol-3-phosphate acyltransferase | 2.3.1.15 | Nga04850 | Y |

FIGURE 15 A

| Enzyme | Description | EC number | N. gaditana model[a] | Transcript support[b] |
|---|---|---|---|---|
| LPAAT | 1-acylglycerol-3-phosphate O-acyltransferase | 2.3.1.51 | Nga00059 | Y |
| LPAAT | 1-acylglycerol-3-phosphate O-acyltransferase | 2.3.1.51 | Nga30581 | Y |
| LPAAT | 1-acylglycerol-3-phosphate O-acyltransferase | 2.3.1.51 | Nga30809 | Y |
| LPAAT | 1-acylglycerol-3-phosphate O-acyltransferase | 2.3.1.51 | Nga02265 | Y |
| LPAAT | 1-acylglycerol-3-phosphate O-acyltransferase | 2.3.1.51 | Nga21122.1 | Y |
| PAP | phosphatidic acid phosphatase | 3.1.3.4 | Nga21116 | Y |
| DAGK | diacylglycerol kinase | 2.7.1.107 | Nga02796 | Y |
| DAGK | diacylglycerol kinase | 2.7.1.107 | Nga05586.1 | Y |
| PDAT | phospholipid:diacylglycerol acyltransferase | 2.3.1.158 | Nga02737 | Y |
| DGAT | diacylglycerol acyltransferase | 2.3.1.20 | Nga10003 | Y |
| DGAT | diacylglycerol acyltransferase | 2.3.1.20 | Nga30544 | Y |
| LPAT | lysophosphatidylglycerol acyltransferase | 2.3.1.-KO | Nga05465 | Y |
| PKS5 | polyketide synthase 5 | K12433 | Nga00335 | Y |
| MGD | monogalactosyldiacylglycerol synthase | 2.4.1.46 | Nga00818 | Y |
| SQD2 | sulfoquinovosyltransferase | 2.4.1.- | Nga00561 | Y |
| SQD1 | UDP-sulfoquinovose synthase | 3.13.1.1 | Nga02686 | Y |
| Lipid activation | | | | |
| TAGL | TAG-lipase | 3.1.1.3 | Nga30958 | Y |
| TAGL | TAG-lipase | 3.1.1.3 | Nga30749 | Y |
| AASDH | acyl-CoA synthetase | 6.2.1.- | Nga03422 | Y |
| AASDH | acyl-CoA synthase | 6.2.1.- | Nga05597 | Y |
| ACSL | long-chain acyl-CoA synthetase | 6.2.1.3 | Nga30170 | Y |
| ACSL | long-chain acyl-CoA synthetase | 6.2.1.3 | Nga03113 | Y |
| ACSL | long-chain acyl-CoA synthetase | 6.2.1.3 | Nga00675 | Y |
| ACSL | long-chain acyl-CoA synthetase | 6.2.1.3 | Nga30631 | Y |
| ACSL | long-chain acyl-CoA ligase | 6.2.1.3 | Nga00919 | Y |
| ACSL | long-chain acyl-CoA ligase | 6.2.1.3 | Nga02299 | Y |
| FADD9 | long-chain acyl-CoA ligase | 6.2.1.- | Nga00006 | Y |
| ACSL | long-chain acyl-CoA ligase | 6.2.1.3 | Nga30568 | Y |
| HADH | 3-hydroxyacyl-CoA dehydrogenase | 1.1.1.35 | Nga00482.01 | Y |
| HADH | 3-hydroxyacyl-CoA dehydrogenase | 1.1.1.35 | Nga02679 | Y |
| HADH | 3-hydroxyacyl-CoA dehydrogenase | 1.1.1.35 | Nga06144.1 | Y |
| LCD | long-chain hydroxyacyl-CoA dehydrogenase | 1.1.1.211 | Nga03480 | Y |
| ACADS | short-chain acyl-CoA dehydrogenase | 1.3.8.1 | Nga31130 | Y |
| ACADSB | short-branched-chain acyl-CoA dehydrogenase | 1.3.99.12 | Nga05705 | Y |
| ACDH | Acyl-CoA dehydrogenase | 1.3.99.3 | Nga04204.01 | Y |

FIGURE 15 B

| Enzyme | Description | EC number | *N. gaditana* model[a] | Transcript support[b] |
|---|---|---|---|---|
| ACOX | acyl-CoA oxidase | 1.3.3.6 | Nga03053 | Y |
| PTER | peroxisomal trans-2-enoyl-CoA reductase | 1.3.1.38 | Nga06128 | Y |
| AOX | alternative oxidase | 1.-.-.- | Nga03545 | Y |
| AOX | alternative oxidase | 1.-.-.- | Nga30837 | Y |
| AOX | alternative oxidase | 1.-.-.- | Nga03289 | Y |
| ACOX | acyl-CoA oxidase | 1.3.3.6 | Nga04370.1 | Y |
| ACOX | acyl-CoA oxidase | 1.3.3.6 | Nga30819 | Y |
| ECH | enyol-CoA hydratase | 4.2.1.17 | Nga01761.01 | Y |
| ECH | enyol-CoA hydratase | 4.2.1.17 | Nga00171 | Y |
| ECH | enyol-CoA hydratase | 4.2.1.17 | Nga20152 | Y |
| ECH | enyol-CoA hydratase | 4.2.1.17 | Nga06135 | Y |
| KCT1 | beta-ketoacyl-CoA thiolase | 2.3.1.16 | Nga01710 | Y |
| KCT2 | beta-ketoacyl-CoA thiolase | 2.3.1.16 | Nga04504.01 | Y |
| KCT3 | beta-ketoacyl-CoA thiolase | 2.3.1.16 | Nga30830 | Y |
| ACAT | acetyl-CoA acetyltransferase | 2.3.1.9 | Nga20998 | Y |
| KCT3 | beta-ketoacyl-CoA thiolase | 2.3.1.16 | Nga30830 | Y |
| FATP2 | solute carrier family (fatty acid transporter) | 6.2.1.- | Nga06551 | Y |
| DECR2 | peroxisomal 2,4-dienoyl-CoA reductase | 1.3.1.34 | Nga05502.01 | Y |
| PNPLA | patatin-like phospholipase | 3.1.1.- | Nga03028.01 | Y |

[a] Candidate *N. gaditana* gene model encoding corresponding enzyme.

[b] Indicates if given gene model has transcript support from RNAseq of a pool of conditions including: +/- nitrate, logarithmic phase, stationary phase, heat shocked culture (2h at 37°C), cold treated culture (2h at 4°C), culture after 12h dark, +/- $CO_2$..

FIGURE 15 C

|  | N. gaditana | E. siliculosus | P. tricornutum | C. merolae | C. reinhardtii |
|---|---|---|---|---|---|
| Total # of genes[b] | 9,052 | 16,256 | 10,402 | 5,331 | 15,143 |
| Fatty acid biosynthesis[c] | | | | | |
| ACC | 2 | 5 | 1 | 1 | 1 |
| MAT | 1 | 1 | 1 | 1 | 2 |
| KASIII | 1 | 1 | 1 | 0 | 1 |
| KASI/II | 4 | 6 | 4 | 2 | 3 |
| KAR | 4 | 5 | 2 | 4 | 4 |
| HD | 1 | 1 | 1 | 1 | 1 |
| ENR | 2 | 2 | 2 | 1 | 1 |
| Total[d] | 15 | 21 | 12 | 10 | 13 |
| TAG assembly[c] | | | | | |
| G3PDH | 5 | 1 | 2 | 3 | 6 |
| GPAT | 3 | 2 | 1 | 0 | 0 |
| LPAAT | 5 | 5 | 4 | 6 | 1 |
| PAP | 1 | 1 | 1 | 0 | 2 |
| DAGK | 2 | 2 | 1 | 1 | 2 |
| PDAT | 1 | 0 | 1 | 0 | 1 |
| DGAT | 2 | 2 | 2 | 1 | 1 |
| Total[d] | 19 | 13 | 12 | 11 | 13 |
| Lipid degradation[c] | | | | | |
| TAGL | 2 | 1 | 2 | 1 | 1 |
| AASDH | 2 | 0 | 0 | 0 | 1 |
| ACSL | 7 | 6 | 5 | 4 | 4 |
| FADD9 | 1 | 0 | 0 | 0 | 0 |
| HADH | 3 | 2 | 3 | 2 | 2 |
| LCD | 1 | 1 | 1 | 0 | 0 |
| ACADS | 1 | 1 | 5 | 1 | 3 |
| ACADSB | 1 | 0 | 0 | 0 | 0 |
| ACDH | 1 | 1 | 1 | 0 | 0 |
| ACOX | 3 | 0 | 1 | 1 | 3 |
| AOX | 3 | 2 | 2 | 3 | 5 |
| ECH | 4 | 8 | 8 | 3 | 3 |
| KCT1 | 1 | 1 | 1 | 0 | 1 |
| KCT2 | 1 | 1 | 1 | 0 | 0 |
| KCT3 | 2 | 1 | 1 | 0 | 0 |
| ACAT | 1 | 0 | 1 | 2 | 1 |
| Total[d] | 34 | 25 | 32 | 17 | 24 |
| Total in all categories[e] | 68 | 59 | 56 | 38 | 50 |

FIGURE 17

| GO term[b] | Over- or Under-represented[c] | p-value[d] P. tricornutum | p-value[d] C. reinhardtii |
|---|---|---|---|
| auxin biosynthetic process | over | 2.20E-53 | 1.26E-55 |
| acyl-carrier-protein biosynthetic process | over | 2.22E-25 | 1.35E-30 |
| pyruvate metabolic process | over | 1.96E-06 | 1.45E-09 |
| carbon utilization | over | 2.44E-07 | 2.54E-04 |
| response to stress | over | 8.46E-07 | 1.87E-12 |
| response to chemical stimulus | over | 6.11E-08 | 1.97E-16 |
| posttranscriptional regulation of gene expression | over | 2.76E-04 | 2.38E-04 |
| halogenated hydrocarbon metabolic process | over | 3.15E-05 | 3.51E-06 |
| chlorinated hydrocarbon metabolic process | over | 3.15E-05 | 3.51E-06 |
| cellular ketone metabolic process | over | 3.88E-14 | 2.63E-21 |
| carboxylic acid metabolic process | over | 5.51E-13 | 7.07E-20 |
| organic acid metabolic process | over | 1.55E-12 | 8.11E-20 |
| response to temperature stimulus | over | - | 5.55E-06 |
| response to salt stress | over | - | 1.95E-04 |
| acetyl-CoA catabolic process | over | - | 2.46E-03 |
| C-acyltransferase activity | over | - | 3.58E-03 |
| regulation of growth rate | under | 6.37E-13 | 1.15E-09 |
| regulation of growth | under | 2.89E-09 | 1.92E-08 |
| transcription factor activity | under | 1.33E-10 | 6.07E-04 |
| reproduction | under | 1.64E-18 | 2.00E-19 |
| meiotic cell cycle | under | 1.27E-03 | 3.04E-03 |
| multicellular organismal development | under | 1.17E-27 | 1.18E-37 |
| cell wall | under | 6.24E-07 | 3.30E-12 |
| vitamin binding | under | 2.52E-13 | 2.24E-07 |
| transmembrane transport | under | 1.96E-32 | 3.09E-25 |
| phagocytosis | under | 6.78E-06 | 2.14E-05 |
| cytokinesis | under | 1.82E-03 | 5.65E-04 |
| response to water deprivation | under | - | 8.40E-04 |

[a] Expansions and reduction of GO-terms. Green indicates over-representation in comparison with both P. tricornutum and C. reinhardtii, while red indicates under-representation. Lighter green and red indicates over-representation and under-representation in comparison with C. reinhardtii alone.

[b] Gene ontology term description.

[c] Signifies whether the GO-term is over- or under-represented in comparison with P. tricornutum and C. reinhardtii.

[d] Probability for over/under-representation in comparison with C. reinhardtii and P. tricornutum calculated by Fisher exact test..

FIGURE 18

| GO term[b] | Over- or Under-represented[c] | p-value[d] P. tricornutum | p-value[d] C. reinhardtii |
|---|---|---|---|
| serine family amino acid metabolic process | over | 3.39E-23 | 3.37E-28 |
| isoleucine metabolic process | over | 2.81E-12 | 3.10E-16 |
| cellular amino acid metabolic process | over | 2.10E-11 | 8.37E-22 |
| valine metabolic process | over | 6.23E-10 | 3.86E-15 |
| cellular amino acid and derivative metabolic process | over | 3.47E-09 | 2.03E-17 |
| tyrosine metabolic process | over | 7.89E-09 | 4.25E-10 |
| leucine metabolic process | over | 5.65E-08 | 5.39E-12 |
| isoleucine catabolic process | over | 8.54E-08 | 1.19E-10 |
| aspartate family amino acid metabolic process | over | 4.62E-07 | 1.57E-10 |
| valine catabolic process | over | 5.92E-07 | 1.74E-09 |
| valine biosynthetic process | over | 7.25E-07 | 3.62E-08 |
| leucine catabolic process | over | 2.86E-06 | 1.33E-08 |
| tryptophan metabolic process | over | 2.86E-06 | 1.63E-08 |
| tyrosine biosynthetic process | over | 7.36E-06 | 2.42E-06 |
| isoleucine biosynthetic process | over | 7.36E-06 | 4.06E-07 |
| lysine catabolic process | over | 1.23E-05 | 1.12E-06 |
| aromatic amino acid family metabolic process | over | 2.90E-05 | 3.46E-07 |
| lysine metabolic process | over | 7.78E-05 | 1.99E-05 |
| L-phenylalanine metabolic process | over | 1.36E-04 | 1.43E-06 |
| cellular amino acid derivative metabolic process | over | 3.08E-04 | 1.43E-03 |
| aspartate metabolic process | over | 4.60E-04 | 5.07E-05 |
| branched chain family amino acid metabolic process | over | 5.22E-04 | 2.01E-08 |
| tryptophan biosynthetic process | over | 5.43E-04 | 7.31E-04 |
| leucine biosynthetic process | over | 5.43E-04 | 3.41E-05 |
| branched chain family amino acid catabolic process | over | 6.73E-04 | 2.98E-07 |
| L-serine metabolic process | over | 6.95E-04 | 8.19E-05 |
| threonine metabolic process | over | 8.29E-04 | 7.83E-07 |
| glycine metabolic process | over | 9.27E-04 | 5.07E-05 |
| aspartate family amino acid catabolic process | over | 2.13E-03 | 3.51E-06 |
| alanine metabolic process | over | 2.13E-03 | 1.86E-05 |
| aromatic amino acid family biosynthetic process, prephenate pathway | over | 1.73E-05 | 8.66E-07 |
| L-phenylalanine biosynthetic process | over | 7.36E-06 | 4.06E-07 |
| pyruvate family amino acid metabolic process | over | 2.13E-03 | 1.86E-05 |
| amino acid binding | under | 2.65E-03 | 1.14E-03 |
| cysteine-type endopeptidase activity | under | 1.27E-03 | 3.59E-05 |
| serine-type peptidase activity | under | 1.79E-04 | 1.32E-03 |
| serine hydrolase activity | under | 1.79E-04 | 1.32E-03 |
| serine-type endopeptidase activity | under | 8.53E-04 | 5.59E-04 |

FIGURE 19

| N. gaditana model[a] | Fold regulation[b] | Description[c] | Conserved Domain ID[d] | Conserved Domain definition[e] |
|---|---|---|---|---|
| Nga06526 | 7.25 | copper amine oxidase | cl08309; PRK11504 | Copper amine oxidase, enzyme domain; tyramine oxidase |
| Nga04678 | 4.33 | no hit | no hit | no hit |
| Nga02936 | 4.23 | midasin-like protein | cl09099; COG5271 | P-loop containing Nucleoside Triphosphate Hydrolases; AAA ATPase containing von Willebrand factor type A (vWA) domain |
| Nga31211 | 3.79 | no hit | no hit | no hit |
| Nga01342.01 | 3.79 | urease accessory protein ureD | cl00530 | UreD urease accessory protein |
| Nga20676.1 | 3.61 | no hit | no hit | no hit |
| Nga20915 | 3.47 | no hit | no hit | no hit |
| Nga20972 | 3.45 | ammonium transporter | cl03012 | Ammonium Transporter Family |
| Nga04280 | 3.25 | no hit | no hit | no hit |
| Nga20680 | 3.25 | no hit | no hit | no hit |
| Nga06280.01 | 3.25 | no hit | no hit | no hit |
| Nga04146 | 3.16 | atp-dependent rna | no hit | no hit |
| Nga20823 | 3.11 | midasin-like protein | COG5271 | AAA ATPase containing von Willebrand factor type A (vWA) domain |
| Nga01883.01 | 3.05 | no hit | no hit | no hit |
| Nga30731 | 3.03 | ribonuclease hii | cl14782 | Ribonuclease H (RNase H) |
| Nga03789 | 2.98 | no hit | no hit | no hit |
| Nga20714 | 2.98 | polyketide synthase | cl14614 | Medium chain reductase/dehydrogenase (MDR)/zinc-dependent alcohol dehydrogenase-like family |
| Nga03637 | 2.97 | monovalent cation:proton antiporter-1 family | TIGR00831 | Na+/H+ antiporter |
| Nga03295 | 2.95 | no hit | no hit | no hit |
| Nga07000 | 2.92 | formin like protein | cl11068 | C2 domain of PTEN tumour-suppressor protein |

FIGURE 20 A

| N. gaditana model[a] | Fold regulation[b] | Description[c] | Conserved Domain ID[d] | Conserved Domain definition[e] |
|---|---|---|---|---|
| Nga02041 | 2.83 | hypothetical protein FB2170_06015 [Maribacter sp. HTCC2170] | no hit | no hit |
| Nga07101 | 2.8 | no hit | no hit | no hit |
| Nga21265 | 2.74 | rme1-like gtpase atpase without a c-terminal eh domain | no hit | no hit |
| Nga06490 | 2.71 | no hit | no hit | no hit |
| Nga00341 | 2.71 | no hit | no hit | no hit |
| Nga20547 | 2.65 | 3-5 exoribonuclease rna-binding protein | cl03114 | 3' exoribonuclease family, domain 1 |
| Nga07033 | 2.6 | no hit | no hit | no hit |
| Nga00173 | 2.6 | no hit | no hit | no hit |
| Nga03960 | 2.6 | protein | cd09857; cl14815 | PIN domain of Exonuclease-1; H3TH domains of structure-specific 5' nucleases |
| Nga20524.1 | 2.57 | dna-directed rna polymerase iii largest | cl04880 | RNA polymerase Rpb1, domain 1 |
| Nga00028.01 | 2.57 | no hit | no hit | no hit |
| Nga01948 | 2.57 | no hit | no hit | no hit |
| Nga20592 | 2.5 | alpha-galactosidase | cl11402 | Glycosyl hydrolase family 31 (GH31) |
| Nga04495 | 2.49 | fatty acid elongase | cl03120 | GNS1/SUR4 family |
| Nga30495 | 2.49 | no hit | no hit | no hit |
| Nga03619 | 2.48 | no hit | no hit | no hit |
| Nga00231.01 | 2.46 | phd zinc finger-containing protein | cl15348 | RING-finger |
| Nga02632 | 2.44 | no hit | no hit | no hit |
| Nga04597 | 2.44 | no hit | no hit | no hit |
| Nga06236 | 2.41 | no hit | no hit | no hit |
| Nga01424 | 2.41 | no hit | no hit | no hit |
| Nga00280 | 2.37 | no hit | no hit | no hit |
| Nga30460 | 2.36 | no hit | no hit | no hit |
| Nga31210 | 2.35 | no hit | no hit | no hit |
| Nga20586 | 2.34 | no hit | no hit | no hit |

FIGURE 20 B

| N. gaditana model[a] | Fold regulation[b] | Description[c] | Conserved Domain ID[d] | Conserved Domain definition[e] |
|---|---|---|---|---|
| Nga05509 | 2.29 | predicted protein [Thalassiosira pseudonana CCMP1335] | cl00117 | PDZ domain |
| Nga20741 | 2.29 | fbox protein | no hit | no hit |
| Nga04500 | 2.29 | no hit | no hit | no hit |
| Nga30473 | 2.28 | no hit | no hit | no hit |
| Nga20390 | 2.27 | rna polymerase ii elongator | cl02567 | WD40 domain |
| Nga06889 | 2.26 | no hit | no hit | no hit |
| Nga07058 | 2.25 | no hit | no hit | no hit |
| Nga20704 | 2.24 | no hit | no hit | no hit |
| Nga05678 | 2.23 | glutamine synthetase | cl08245 | Glutamine synthetase |
| Nga30260 | 2.22 | nuclear condensin complex subunit smc4 | cl05797 | SMC proteins Flexible Hinge Domain |
| Nga01032 | 2.21 | notch-regulated ankyrin repeat-containing protein b | cd00204 | Ankyrin repeats |
| Nga20904 | 2.21 | tetratricopeptide repeat family protein | no hit | no hit |
| Nga06186 | 2.2 | protein | cl00456 | Urea/Na+ high-affinity symporter |
| Nga04596 | 2.2 | no hit | no hit | no hit |
| Nga31101 | 2.17 | tetratricopeptide repeat | no hit | no hit |
| Nga21159 | 2.17 | ribosome biogenesis atpase rix7 | cl09099; cl03209; cd00009 | P-loop containing Nucleoside Triphosphate Hydrolases; Peptidase family M41; The AAA+ (ATPases Associated with a wide variety of cellular Activities) superfamily |
| Nga02039 | 2.13 | no hit | no hit | no hit |
| Nga21141 | 2.13 | protein | cl10757 | Guanylyl cyclase |
| Nga21257 | 2.08 | no hit | no hit | no hit |
| Nga21076 | 2.08 | vacuolar protein sorting-associated protein vps13 | cl01386 | 2-hydroxycarboxylate transporter family |
| Nga02799 | 2.06 | protein | no hit | no hit |

FIGURE 20 C

| N. gaditana model[a] | Fold regulation[b] | Description[c] | Conserved Domain ID[d] | Conserved Domain definition[e] |
|---|---|---|---|---|
| Nga40094 | 2.06 | photosystem ii d2 protein | cd09288 | D2 subunit of photosystem II (PS II) |
| Nga04295 | 2.05 | hypothetical protein Tcur_2694 [Thermomonospora curvata DSM 43183] | no hit | no hit |
| Nga00509 | 2.05 | no hit | no hit | no hit |
| Nga30431 | 2.04 | calcineurin-like phosphoesterase | cl09501 | EF-hand, calcium binding motif |
| Nga07039 | 2.04 | no hit | no hit | no hit |
| Nga20583.1 | 2.03 | protein | TIGR01241 | ATP-dependent metalloprotease FtsH |
| Nga07207 | 2.02 | no hit | no hit | no hit |
| Nga20327 | 2.02 | zinc finger fyve domain-containing protein | cd00065 | FYVE domain |
| Nga04524 | 2.01 | no hit | no hit | no hit |
| Nga05615.1 | 2.01 | phosphoribosylformylglycinamidine synthase | cd01740; cl10019; cd02204 | Type 1 glutamine amidotransferase (GATase1)-like domain; AIR (aminoimidazole ribonucleotide) synthase related protein; PurL subunit of the formylglycinamide ribonucleotide amidotransferase (FGAR-AT), second repeat |
| Nga40046 | 0.5 | photosystem ii 32 kda protein | cd09289 | D1 subunit of photosystem II (PS II) |
| Nga04641 | 0.5 | light-harvesting protein | cl02879 | Chlorophyll A-B binding protein |
| Nga01578.01 | 0.5 | auxin efflux carrier-like protein | cl09117 | Membrane transport protein |
| Nga20668.1 | 0.5 | protein kinase domain containing protein | no hit | no hit |
| Nga20029.1 | 0.49 | abc subfamily abcg | cl11417 | ABC-2 type transporter |
| Nga20678 | 0.49 | no hit | no hit | no hit |
| Nga20579 | 0.49 | no hit | no hit | no hit |
| Nga03015 | 0.49 | protein kinase wee1 | cl09925 | Protein Kinases, catalytic domain |

FIGURE 20 D

| N. gaditana model[a] | Fold regulation[b] | Description[c] | Conserved Domain ID[d] | Conserved Domain definition[e] |
|---|---|---|---|---|
| Nga04225 | 0.48 | low molecular mass early light-inducible protein hv60 | no hit | no hit |
| Nga40088 | 0.48 | ycf66 family protein | cd06468 | Ycf66 protein N-terminus |
| Nga05473 | 0.48 | no hit | no hit | no hit |
| Nga06871 | 0.47 | bnr asp-box repeat-containing protein | COG4447 | Uncharacterized protein related to plant photosystem II stability/assembly factor |
| Nga20458 | 0.47 | chaperone protein | cd06257 | DnaJ domain or J-domain |
| Nga30457 | 0.46 | stip-like protein | cl02611 | G-patch domain |
| Nga20417 | 0.46 | photosystem i p700 chlorophyll a apoprotein a1 | cl08224 | Photosystem I psaA/psaB protein |
| Nga00448.01 | 0.46 | light harvesting complex protein | cl02879 | Chlorophyll A-B binding protein |
| Nga03116 | 0.45 | light-harvesting protein | cl02879 | Chlorophyll A-B binding protein |
| Nga20981 | 0.45 | myb-like dna-binding domain containing protein | cl00132 | 'SWI3, ADA2, N-CoR and TFIIIB' DNA-binding domains |
| Nga01043 | 0.45 | no hit | no hit | no hit |
| Nga40023 | 0.45 | hypothetical protein [uncultured delta proteobacterium HF0130_19C20] | no hit | no hit |
| Nga30860 | 0.45 | no hit | no hit | no hit |
| Nga06456 | 0.45 | no hit | no hit | no hit |
| Nga03667 | 0.44 | glutathione s-transferase | cl02776; cl00388 | C-terminal, alpha helical domain of the Glutathione S-transferase family; Protein Disulfide Oxidoreductases and Other Proteins with a Thioredoxin fold |
| Nga40124 | 0.43 | 30s ribosomal protein s10 | cl00314 | Ribosomal protein S20e |
| Nga00253.1 | 0.43 | no hit | no hit | no hit |
| Nga02520.01 | 0.43 | phytochelatin synthase | pfam05023 | Phytochelatin synthase |
| Nga40090 | 0.43 | no hit | no hit | no hit |

FIGURE 20 E

| N. gaditana model[a] | Fold regulation[b] | Description[c] | Conserved Domain ID[d] | Conserved Domain definition[e] |
|---|---|---|---|---|
| Nga02790 | 0.42 | light-harvesting protein | cl02879 | Chlorophyll A-B binding protein |
| Nga03527 | 0.42 | no hit | no hit | no hit |
| Nga30169 | 0.41 | no hit | no hit | no hit |
| Nga00347 | 0.41 | cap family transcription factor | cd00038; cl00446 | Effector domain of the CAP family of transcription factors; Metallo-beta-lactamase superfamily |
| Nga01885.01 | 0.39 | no hit | no hit | no hit |
| Nga04558 | 0.39 | no hit | no hit | no hit |
| Nga00243.01 | 0.39 | no hit | no hit | no hit |
| Nga30680 | 0.39 | zinc finger protein 598 | COG5236 | Uncharacterized conserved protein, contains RING Zn-finger |
| Nga20514 | 0.39 | peptide chain release factor 2 | cl02875 | RF-1 domain |
| Nga01194 | 0.39 | no hit | no hit | no hit |
| Nga01460.01 | 0.38 | riken cdna 6720467c03 isoform cra_a | no hit | no hit |
| Nga07186 | 0.38 | no hit | no hit | no hit |
| Nga05697 | 0.37 | light-harvesting protein | cl02879 | Chlorophyll A-B binding protein |
| Nga06201 | 0.37 | no hit | no hit | no hit |
| Nga04536.01 | 0.37 | light-harvesting protein | cl02879 | Chlorophyll A-B binding protein |
| Nga30207 | 0.37 | ammonium transporter | cl03012 | Ammonium Transporter Family |
| Nga06069 | 0.37 | protein | cl01841 | Protein of unknown function (DUF1499) |
| Nga50010 | 0.36 | nadh dehydrogenase subunit 9 | cl00539 | Respiratory-chain NADH dehydrogenase |
| Nga06056 | 0.36 | predicted protein [Thalassiosira pseudonana CCMP1335] | no hit | no hit |
| Nga05289 | 0.36 | protein fucoxanthin chlorophyll a c protein | cl02879 | Chlorophyll A-B binding protein |

FIGURE 20 F

| N. gaditana model[a] | Fold regulation[b] | Description[c] | Conserved Domain ID[d] | Conserved Domain definition[e] |
|---|---|---|---|---|
| Nga20601 | 0.35 | wd40 repeat-containing protein | cl02567 | WD40 domain |
| Nga05030 | 0.34 | no hit | no hit | no hit |
| Nga06911.1 | 0.34 | ankyrin repeat and kh domain-containing protein 1 | cd00204 | Ankyrin repeats |
| Nga30730 | 0.33 | no hit | no hit | no hit |
| Nga01282 | 0.32 | no hit | no hit | no hit |
| Nga00736 | 0.32 | no hit | no hit | no hit |
| Nga21288.1 | 0.31 | udp-sulfoquinovose synthase | cl09931 | Rossmann-fold NAD(P)(+)-binding proteins |
| Nga40020 | 0.31 | cytochrome c553 | cl11414 | Cytochrome c |
| Nga02267 | 0.3 | ferredoxin-nitrite reductase | PRK09568 | Ferredoxin-nitrite reductase |
| Nga02416 | 0.3 | no hit | no hit | no hit |
| Nga07010 | 0.3 | protein fucoxanthin chlorophyll a c protein | cl02879 | Chlorophyll A-B binding protein |
| Nga02785 | 0.28 | light-harvesting protein | cl02879 | Chlorophyll A-B binding protein |
| Nga02325.01 | 0.24 | rna binding protein | cd00105 | K homology RNA-binding domain, type I |
| Nga01100.1 | 0.24 | poly -binding protein 3 isoform 2 | cd00105 | K homology RNA-binding domain, type I |
| Nga40044 | 0.22 | light-independent protochlorophyllide iron-sulfur atp-binding protein | cl10444; CHL00072 | Ras-like GTPase superfamily; photochlorophyllide reductase subunit L |
| Nga03568 | 0.21 | no hit | no hit | no hit |
| Nga40018 | 0.19 | photosystem i p700 chlorophyll a apoprotein a2 | cl09224 | Photosystem I psaA/psaB protein |
| Nga20911.1 | 0.18 | myo-inositol-1-phosphate synthase | cl00554 | Myo-inositol-1-phosphate synthase |
| Nga50007 | 0.18 | 30s ribosomal protein s3 | cl00098; cl02819 | K homology RNA-binding domain, type I; Ribosomal protein S3, C-terminal domain |
| Nga06064 | 0.11 | protein | cl02429 | Tetratricopeptide repeat domain |

FIGURE 20 G

| N. gaditana model[a] | Fold regulation[b] | Description[c] | Conserved Domain ID[d] | Conserved Domain definition[e] |
|---|---|---|---|---|
| Nga20756 | 0.11 | photosystem I p700 chlorophyll a apoprotein a1 | cl08224 | Photosystem I psaA/psaB protein |
| Nga00124 | 0.1 | no hit | no hit | no hit |
| Nga05257 | 0.1 | no hit | no hit | no hit |
| Nga30862 | 0.1 | rieske (2fe-2s) region protein | cl00938 | Rieske domain |
| Nga04958 | 0.09 | no hit | no hit | no hit |

[a] *N. gaditana* gene models differentially regulated during nitrogen deprivation.

[b] Fold regulation of gene, >1 signifies up-regulation, <1 signifies down-regulation.

[c] *N. gaditana* gene model description. A green label indicates a function in photosynthesis; a blue label indicates a function in nitrogen utilization or protein degradation/recycling.

[d] Conserved protein domain ID assigned from NCBI-curated domains, Pfam, SMART, COG, PRK, or TIGRFAM databases.

[e] Description of conserved protein domain given.

FIGURE 20 H

|  | pep# | Nga model | Description |
|---|---|---|---|
| Chlorophyll, carotenoid and sterol biosynthesis genes | | | |
| SEQ ID NO: 8722 | 59 | Nga02834 | glutamyl-tRNA synthetase |
| SEQ ID NO: 8713 | 50 | Nga02604 | glutamyl-tRNA reductase |
| SEQ ID NO: 8804 | 141 | Nga30045 | glutamate-1-semialdehyde aminotransferase / glutamate-1-semialdehyde 21-aminomutase |
| SEQ ID NO: 8678 | 15 | Nga00585 | 5-aminolevulinic acid dehydratase / porphobilinogen synthase |
| SEQ ID NO: 8730 | 67 | Nga03248 | porphobilinogen deaminase / hydroxymethylbilane synthase |
| SEQ ID NO: 8686 | 23 | Nga00807 | uroporphyrinogen III synthase |
| SEQ ID NO: 8745 | 82 | Nga04120 | uroporphyrinogen III decarboxylase |
| SEQ ID NO: 8774 | 111 | Nga05706 | uroporphyrinogen III decarboxylase |
| SEQ ID NO: 8763 | 100 | Nga05151 | coproporphyrinogen III oxidase |
| SEQ ID NO: 8749 | 86 | Nga04278 | coproporphyrinogen III oxidase |
| SEQ ID NO: 8744 | 81 | Nga03873 | protoporphyrinogen IX oxidase |
| SEQ ID NO: 8818 | 155 | Nga30773 | protoporphyrin IX Mg-chelatase subunit D |
| SEQ ID NO: 8838 | 175 | Nga40092 | protoporphyrin IX MG-chelatase subuint I |
| SEQ ID NO: 8831 | 168 | Nga30995 | protoporphyrin IX Mg-chelatase subunit H |
| SEQ ID NO: 8785 | 122 | Nga06242 | protoporphyrin IX Mg-chelatase subunit H |
| SEQ ID NO: 8837 | 174 | Nga40091 | Mg-protoporphyrin IX monomethyl ester (oxidative) cyclase |
| SEQ ID NO: 8777 | 114 | Nga05945 | divinyl protochlorophyllide a 8-vinyl-reductase |
| SEQ ID NO: 8759 | 96 | Nga04959 | light-dependent NADPH:protochlorophyllide oxidoreductase |
| SEQ ID NO: 8683 | 20 | Nga00683 | light-dependent NADPH:protochlorophyllide oxidoreductase |
| SEQ ID NO: 8836 | 173 | Nga40089 | light-independent:protochlorophyllide oxidoreductase subunit B |
| SEQ ID NO: 8834 | 171 | Nga40044 | light-independent:protochlorophyllide oxidoreductase subunit L |
| SEQ ID NO: 8835 | 172 | Nga40045 | light-independent:protochlorophyllide oxidoreductase subunit N |
| SEQ ID NO: 8832 | 169 | Nga31097 | chlorophyll synthase |
| SEQ ID NO: 8757 | 94 | Nga04895 | geranylgeranyl reductase |
| SEQ ID NO: 8764 | 101 | Nga05160 | uroporphyrinogen III C-methyltransferase |
| SEQ ID NO: 8671 | 8 | Nga00339 | sirohydrochlorin ferrochelatase |
| SEQ ID NO: 8684 | 21 | Nga00748 | ferrochelatase |
| SEQ ID NO: 8817 | 154 | Nga30771 | 1-deoxy-D-xylulose-5-phosphate reductoisomerase |
| SEQ ID NO: 8784 | 121 | Nga06198 | 2-C-methyl-D-erythritol 4-phosphate cytidyltransferase |
| SEQ ID NO: 8821 | 158 | Nga30806 | 4-hydroxy-3-methylbut-2-enyl diphosphate synthase |
| SEQ ID NO: 8767 | 104 | Nga05308 | 4-hydroxy-3-methylbut-2-enyl diphosphate reductase |
| SEQ ID NO: 8742 | 79 | Nga03838 | isopentenyl diphosphate:dimethylallyl diphosphate isomerase type I |
| SEQ ID NO: 8714 | 51 | Nga02636 | geranylgeranyl pyrophosphate synthase |
| SEQ ID NO: 8725 | 62 | Nga02957 | phytoene synthase |
| SEQ ID NO: 8761 | 98 | Nga05064 | phytoene desaturase |
| SEQ ID NO: 8792 | 129 | Nga07310 | zeta-carotene desaturase |
| SEQ ID NO: 8680 | 17 | Nga00640 | lycopene β-cyclase |
| SEQ ID NO: 8805 | 142 | Nga30077 | cytochrome P450 enzyme related to CYP97A carotene β-hydroxylase |
| SEQ ID NO: 8666 | 3 | Nga00100 | cytochrome P450 enzyme related to CYP97A carotene β-hydroxylase |
| SEQ ID NO: 8797 | 134 | Nga20998 | acetyl-CoA C-acetyltransferase |
| SEQ ID NO: 8824 | 161 | Nga30830 | acetyl-CoA C-acetyltransferase |
| SEQ ID NO: 8786 | 123 | Nga06246 | hydroxymethylglutaryl-CoA synthase |
| SEQ ID NO: 8723 | 60 | Nga02865 | geranyl-disphosphate synthase / dimethylallyltranstransferase |
| SEQ ID NO: 8724 | 61 | Nga02874 | farnesyl-diphosphate synthase |
| SEQ ID NO: 8742 | 79 | Nga03838 | isopentenyl diphosphate:dimethylallyl diphosphate isomerase type I |
| SEQ ID NO: 8698 | 35 | Nga01590 | squalene monooxygenase / squalene epoxidase |
| SEQ ID NO: 8820 | 157 | Nga30790 | cycloartenol synthase |
| SEQ ID NO: 8740 | 77 | Nga03733.1 | C14-demethylase (sterol 14-demethylase) |
| SEQ ID NO: 8685 | 22 | Nga00758 | D14-sterol reductase |
| SEQ ID NO: 8779 | 116 | Nga06114 | C4-decarboxylase (sterol-4-alpha-carboxylate 3-dehydrogenase) |
| SEQ ID NO: 8776 | 113 | Nga05943 | sterol-C24-methyl transferase (sterol 24-C-methyltransferase) |
| SEQ ID NO: 8712 | 49 | Nga02534 | sterol-C24-methyl transferase (sterol 24-C-methyltransferase) |
| SEQ ID NO: 8720 | 57 | Nga02795 | C5-desaturase (lathosterol oxidase) |
| SEQ ID NO: 8731 | 68 | Nga03254 | D7-sterol reductase (7-dehydrocholesterol reductase) |
| SEQ ID NO: 8766 | 103 | Nga05293 | D24-sterol reductase (24-dehydrocholesterol reductase) |
| SEQ ID NO: 8809 | 146 | Nga30196 | cyclopropyl sterol isomerase (cycloeucalenol cycloisomerase) |
| SEQ ID NO: 8681 | 18 | Nga00656 | D5-sterol reductase |
| Lipid metabolic pathway genes | | | |
| SEQ ID NO: 8802 | 139 | Nga30020 | acetyl-CoA synthetase |
| SEQ ID NO: 8706 | 43 | Nga02166 | acetyl-CoA synthetase |
| SEQ ID NO: 8803 | 140 | Nga30028 | acetyl-CoA carboxylase |
| SEQ ID NO: 8819 | 156 | Nga30783 | acetyl-CoA carboxylase |
| SEQ ID NO: 8690 | 27 | Nga00899 | malonyl-CoA:ACP-trans-acylase |
| SEQ ID NO: 8806 | 143 | Nga30106 | 3-oxoacyl-ACP synthase III |
| SEQ ID NO: 8705 | 42 | Nga02138 | 3-oxoacyl-ACP synthase II |
| SEQ ID NO: 8816 | 153 | Nga30755 | 3-oxoacyl-ACP synthase II |
| SEQ ID NO: 8747 | 84 | Nga04201.01 | 3-oxoacyl-ACP synthase II |

FIGURE 23A

| | pep# | Nga model | Description |
|---|---|---|---|
| SEQ ID NO: 8775 | 112 | Nga05827 | fatty acid synthase |
| SEQ ID NO: 8793 | 130 | Nga20022 | 3-oxoacyl-ACP reductase |
| SEQ ID NO: 8697 | 34 | Nga01542 | 3-oxoacyl-ACP reductase |
| SEQ ID NO: 8778 | 115 | Nga05985.01 | 3-hydroxy acyl-CoA dehydratase |
| SEQ ID NO: 8762 | 99 | Nga05091 | enoyl-ACP reductase I |
| SEQ ID NO: 8679 | 16 | Nga00602 | 3-oxoacyl-ACP reductase |
| SEQ ID NO: 8772 | 109 | Nga05627 | 3-oxoacyl-ACP reductase |
| SEQ ID NO: 8692 | 29 | Nga01045.01 | oleyl-ACP hydrolase |
| SEQ ID NO: 8728 | 65 | Nga03084 | elongation of very long chain fatty acids |
| SEQ ID NO: 8673 | 10 | Nga00451 | elongation of very long chain fatty acids |
| SEQ ID NO: 8695 | 32 | Nga01458.01 | acyl-ACP desaturase |
| SEQ ID NO: 8675 | 12 | Nga00524 | stearoyl-CoA desaturase |
| SEQ ID NO: 8704 | 41 | Nga02019 | omega-6 fatty acid desaturase delta-12 |
| SEQ ID NO: 8687 | 24 | Nga00817 | omega-6 fatty acid desaturase delta-12 |
| SEQ ID NO: 8791 | 128 | Nga06739.1 | sphingolipid delta-4 desaturase |
| SEQ ID NO: 8807 | 144 | Nga30138 | glycerolipid omega-3 fatty acid desaturase |
| SEQ ID NO: 8789 | 126 | Nga06665.1 | glycerol-3-phosphate dehydrogenase |
| SEQ ID NO: 8702 | 39 | Nga01869 | glycerol-3-phosphate dehydrogenase |
| SEQ ID NO: 8758 | 95 | Nga04914 | glycerol-3-phosphate dehydrogenase |
| SEQ ID NO: 8765 | 102 | Nga05226 | glycerol-3-phosphate dehydrogenase |
| SEQ ID NO: 8801 | 138 | Nga30015 | glycerol-3-phosphate dehydrogenase |
| SEQ ID NO: 8754 | 91 | Nga04759 | glycerol-3-phosphate acyltransferase |
| SEQ ID NO: 8756 | 93 | Nga04850 | glycerol-3-phosphate acyltransferase |
| SEQ ID NO: 8665 | 2 | Nga00059 | 1-acylglycerol-3-phosphate O-acyltransferase |
| SEQ ID NO: 8813 | 150 | Nga30581 | 1-acylglycerol-3-phosphate O-acyltransferase |
| SEQ ID NO: 8822 | 159 | Nga30809 | 1-acylglycerol-3-phosphate O-acyltransferase |
| SEQ ID NO: 8708 | 45 | Nga02265 | 1-acylglycerol-3-phosphate O-acyltransferase |
| SEQ ID NO: 8799 | 136 | Nga21116 | phosphatidic acid phosphatase |
| SEQ ID NO: 8721 | 58 | Nga02796 | diacylglycerol kinase |
| SEQ ID NO: 8770 | 107 | Nga05586.1 | diacylglycerol kinase |
| SEQ ID NO: 8719 | 56 | Nga02737 | phospholipid:diacylglycerol acyltransferase |
| SEQ ID NO: 8811 | 148 | Nga30544 | diacylglycerol acyltransferase |
| SEQ ID NO: 8768 | 105 | Nga05465 | lysophosphatidylglycerol acyltransferase |
| SEQ ID NO: 8670 | 7 | Nga00335 | polyketide synthase 5 |
| SEQ ID NO: 8688 | 25 | Nga00818 | monogalactosyldiacylglycerol synthase |
| SEQ ID NO: 8677 | 14 | Nga00561 | sulfoquinovosyltransferase |
| SEQ ID NO: 8717 | 54 | Nga02686 | UDP-sulfoquinovose synthase |
| SEQ ID NO: 8830 | 167 | Nga30958 | TAG-lipase |
| SEQ ID NO: 8815 | 152 | Nga30749 | TAG-lipase |
| SEQ ID NO: 8734 | 71 | Nga03422 | acyl-CoA synthetase |
| SEQ ID NO: 8771 | 108 | Nga05597 | acyl-CoA synthase |
| SEQ ID NO: 8808 | 145 | Nga30170 | long-chain acyl-CoA synthetase |
| SEQ ID NO: 8729 | 66 | Nga03113 | long-chain acyl-CoA synthetase |
| SEQ ID NO: 8682 | 19 | Nga00675 | long-chain acyl-CoA synthetase |
| SEQ ID NO: 8814 | 151 | Nga30631 | long-chain acyl-CoA synthetase |
| SEQ ID NO: 8691 | 28 | Nga00919 | long-chain acyl-CoA ligase |
| SEQ ID NO: 8711 | 48 | Nga02299 | long-chain acyl-CoA ligase |
| SEQ ID NO: 8664 | 1 | Nga00006 | long-chain acyl-CoA ligase |
| SEQ ID NO: 8812 | 149 | Nga30568 | long-chain acyl-CoA ligase |
| SEQ ID NO: 8674 | 11 | Nga00482.01 | 3-hydroxyacyl-CoA dehydrogenase |
| SEQ ID NO: 8716 | 53 | Nga02679 | 3-hydroxyacyl-CoA dehydrogenase |
| SEQ ID NO: 8782 | 119 | Nga06144.1 | 3-hydroxyacyl-CoA dehydrogenase |
| SEQ ID NO: 8735 | 72 | Nga03480 | long-chain hydroxyacyl-CoA dehydrogenase |
| SEQ ID NO: 8833 | 170 | Nga31130 | short-chain acyl-CoA dehydrogenase |
| SEQ ID NO: 8773 | 110 | Nga05705 | short-branched-chain acyl-CoA dehydrogenase |
| SEQ ID NO: 8748 | 85 | Nga04204.01 | Acyl-CoA dehydrogenase |
| SEQ ID NO: 8727 | 64 | Nga03053 | acyl-CoA oxidase |
| SEQ ID NO: 8780 | 117 | Nga06128 | peroxisomal trans-2-enoyl-CoA reductase |
| SEQ ID NO: 8736 | 73 | Nga03545 | alternative oxidase |
| SEQ ID NO: 8827 | 164 | Nga30837 | alternative oxidase |
| SEQ ID NO: 8732 | 69 | Nga03289 | alternative oxidase |
| SEQ ID NO: 8750 | 87 | Nga04370.1 | acyl-CoA oxidase |
| SEQ ID NO: 8823 | 160 | Nga30819 | acyl-CoA oxidase |
| SEQ ID NO: 8701 | 38 | Nga01761.01 | enyol-CoA hydratase |
| SEQ ID NO: 8668 | 5 | Nga00171 | enyol-CoA hydratase |
| SEQ ID NO: 8794 | 131 | Nga20152 | enyol-CoA hydratase |
| SEQ ID NO: 8781 | 118 | Nga06135 | enyol-CoA hydratase |
| SEQ ID NO: 8699 | 36 | Nga01710 | beta-ketoacyl-CoA thiolase |

FIGURE 23 B

|  | pep# | Nga model | Description |
|---|---|---|---|
| SEQ ID NO: 8752 | 89 | Nga04504.01 | beta-ketoacyl-CoA thiolase |
| SEQ ID NO: 8824 | 161 | Nga30830 | beta-ketoacyl-CoA thiolase |
| SEQ ID NO: 8797 | 134 | Nga20998 | acetyl-CoA acetyltransferase |
| SEQ ID NO: 8824 | 161 | Nga30830 | beta-ketoacyl-CoA thiolase |
| SEQ ID NO: 8787 | 124 | Nga06551 | solute carrier family (fatty acid transporter) |
| SEQ ID NO: 8769 | 106 | Nga05502.01 | peroxisomal 2,4-dienoyl-CoA reductase |
| SEQ ID NO: 8726 | 63 | Nga03028.01 | patatin-like phospholipase |
| Carbon assimilation genes | | | |
| SEQ ID NO: 8693 | 30 | Nga01240 | Carbonic anhydrase |
| SEQ ID NO: 8700 | 37 | Nga01717 | Carbonic anhydrase |
| SEQ ID NO: 8739 | 76 | Nga03728 | Carbonic anhydrase |
| SEQ ID NO: 8828 | 165 | Nga30848 | Carbonic anhydrase |
| SEQ ID NO: 8800 | 137 | Nga21222 | Carbonic anhydrase |
| SEQ ID NO: 8667 | 4 | Nga00165.01 | Bicarbonate transporter |
| SEQ ID NO: 8788 | 125 | Nga06584 | Bicarbonate transporter |
| Nitrate assimilation genes | | | |
| SEQ ID NO: 8710 | 47 | Nga02268 | NAD(P)H nitrate reductase |
| SEQ ID NO: 8709 | 46 | Nga02267 | Ferredoxin nitrite reductase |
| SEQ ID NO: 8738 | 75 | Nga03713 | Urease |
| SEQ ID NO: 8669 | 6 | Nga00207.01 | Urease accessory protein ureG |
| SEQ ID NO: 8694 | 31 | Nga01342.01 | Urease accessory protein ureD |
| SEQ ID NO: 8829 | 166 | Nga30904 | Nitrate high affinity transporter |
| SEQ ID NO: 8746 | 83 | Nga04130 | Putative nitrate / peptide transporter |
| SEQ ID NO: 8689 | 26 | Nga00897 | Nitrite transporter |
| SEQ ID NO: 8790 | 127 | Nga06677 | Nitrite transporter |
| SEQ ID NO: 8796 | 133 | Nga20972 | Ammonium transporter |
| SEQ ID NO: 8810 | 147 | Nga30207 | Ammonium transporter |
| SEQ ID NO: 8783 | 120 | Nga06186 | Urea/Na+ high affinity symporter |
| SEQ ID NO: 8672 | 9 | Nga00381 | carbamoyl-phosphate synthetase I large subunit |
| SEQ ID NO: 8733 | 70 | Nga03303 | carbamoyl-phosphate synthetase I small subunit |
| SEQ ID NO: 8795 | 132 | Nga20220 | ornithine carbamoyltransferase |
| SEQ ID NO: 8751 | 88 | Nga04487 | argininosuccinate synthetase |
| SEQ ID NO: 8737 | 74 | Nga03647 | argininosuccinate lyase |
| SEQ ID NO: 8676 | 13 | Nga00526 | arginase |

FIGURE 23 C

| # | Nga model | +N rpkb | -N rpkb | GO |
|---|---|---|---|---|
| SEQ ID NO: 1 | Nga00398 | 207.6225 | 207.99664 | beta adaptin |
| SEQ ID NO: 2 | Nga00392 | 784.4507 | 773.59444 | glutamine-trna ligase |
| SEQ ID NO: 3 | Nga00399 | 457.2264 | 413.26353 | glutathione synthetase |
| SEQ ID NO: 4 | Nga00401 | 202.9731 | 154.21684 | protein |
| SEQ ID NO: 5 | Nga00403 | 951.5608 | 963.13373 | ---NA--- |
| SEQ ID NO: 6 | Nga00407 | 97.71078 | 92.235162 | epidermal growth factor receptor pathway substrate 15 |
| SEQ ID NO: 7 | Nga00428 | 561.6046 | 534.89202 | uridine diphosphate-n-acetylglucosamine transporter hut1 |
| SEQ ID NO: 8 | Nga00426.2 | 1419.718 | 1439.0992 | chromatin modification-related protein eaf3 |
| SEQ ID NO: 9 | Nga00396 | 393.3464 | 576.59419 | protein |
| SEQ ID NO: 10 | Nga00394 | 739.9037 | 811.52243 | puromycin-sensitive aminopeptidase |
| SEQ ID NO: 11 | Nga00393 | 6558.025 | 6146.3496 | pumpkin fruit trypsin inhibitor |
| SEQ ID NO: 12 | Nga00405 | 418.0791 | 381.47787 | s-adenosylmethionine-dependent methyltransferase domain-containing protein |
| SEQ ID NO: 13 | Nga20048.1 | 923.9281 | 819.54214 | nudix hydrolase |
| SEQ ID NO: 14 | Nga00391 | 586.6781 | 621.63382 | protein |
| SEQ ID NO: 15 | Nga00404 | 353.5354 | 361.76184 | domain-containing histone demethylation protein 3c |
| SEQ ID NO: 16 | Nga00400.1 | 317.6551 | 342.24876 | cell division control protein 45 |
| SEQ ID NO: 17 | Nga00395 | 472.3931 | 462.21181 | protein |
| SEQ ID NO: 18 | Nga00408 | 1374.384 | 1291.3429 | ---NA--- |
| SEQ ID NO: 19 | Nga00397.01 | 144.845 | 165.12295 | fidgetin-like protein |
| SEQ ID NO: 20 | Nga20104 | 607.9952 | 643.08936 | protein |
| SEQ ID NO: 21 | Nga00406 | 266.4756 | 325.90133 | ---NA--- |
| SEQ ID NO: 22 | Nga20131.1 | 392.5466 | 476.35381 | hypothetical protein AURANDRAFT_63258 [Aureococcus anophagefferens] |
| SEQ ID NO: 23 | Nga03946.2 | 7492.188 | 6006.6103 | ---NA--- |
| SEQ ID NO: 24 | Nga03460 | 47.35376 | 56.525299 | phosphatidylinositol kinase (pik-I4) |
| SEQ ID NO: 25 | Nga03458.01 | 2169.955 | 2504.3321 | ---NA--- |
| SEQ ID NO: 26 | Nga03461 | 364.3791 | 396.47778 | ---NA--- |
| SEQ ID NO: 27 | Nga03453.01 | 210.8067 | 224.78066 | structural maintenance of chromosomes protein 3 |
| SEQ ID NO: 28 | Nga03459 | 428.2946 | 300.19855 | membrane protein |
| SEQ ID NO: 29 | Nga03456 | 397.3903 | 370.07281 | transcription elongation factor |
| SEQ ID NO: 30 | Nga03455 | 1262.334 | 1416.0045 | ankyrin partial |
| SEQ ID NO: 31 | Nga03454.01 | 651.7944 | 688.18451 | protein |
| SEQ ID NO: 32 | Nga03457.1 | 132.216 | 183.56478 | protein |
| SEQ ID NO: 33 | Nga21127 | 205.5514 | 237.28755 | solute carrier family member 27 |
| SEQ ID NO: 34 | Nga05422 | 108.4813 | 110.03264 | ---NA--- |
| SEQ ID NO: 35 | Nga03210.02 | 259.3477 | 279.21066 | protein |
| SEQ ID NO: 36 | Nga03209.02 | 131.5789 | 98.187872 | ---NA--- |
| SEQ ID NO: 37 | Nga05414.01 | 2174.783 | 2062.8542 | peptide methionine sulfoxide reductase |
| SEQ ID NO: 38 | Nga05415.01 | 1324.324 | 1401.0941 | protein |
| SEQ ID NO: 39 | Nga05420.01 | 13110.33 | 13438.712 | ribosomal protein l27 |
| SEQ ID NO: 40 | Nga05418 | 808.2192 | 788.93066 | ---NA--- |
| SEQ ID NO: 41 | Nga05416 | 386.2816 | 297.20498 | protein |
| SEQ ID NO: 42 | Nga05417 | 755.0471 | 727.98764 | tryptophan synthetase |
| SEQ ID NO: 43 | Nga05421 | 1873.007 | 2142.0519 | protein |
| SEQ ID NO: 44 | Nga05424 | 1797.619 | 1782.1777 | nmda receptor glutamate-binding chain |
| SEQ ID NO: 45 | Nga05426 | 298.0501 | 256.476 | ---NA--- |
| SEQ ID NO: 46 | Nga04327.02 | 178.0576 | 211.06177 | protein |
| SEQ ID NO: 47 | Nga05764 | 1305.814 | 1340.1871 | membrane-associated protein in eicosanoid and glutathione metabolism |
| SEQ ID NO: 48 | Nga05771 | 137.3737 | 146.61954 | lysophosphatidic acid |
| SEQ ID NO: 49 | Nga20723 | 93.75 | 74.472333 | serine threonine protein kinase |
| SEQ ID NO: 50 | Nga20343 | 194.6565 | 202.58955 | traf2 and nck-interacting protein kinase-like |
| SEQ ID NO: 51 | Nga04326.02 | 428.1109 | 438.60149 | protein |
| SEQ ID NO: 52 | Nga05768.1 | 229.0076 | 219.40311 | probable serca-type calcium atpase |
| SEQ ID NO: 53 | Nga20086.1 | 274.6067 | 437.6752 | serine threonine protein |
| SEQ ID NO: 54 | Nga05767 | 562.2776 | 488.29051 | protein |
| SEQ ID NO: 55 | Nga02263.02 | 11320.72 | 10950.608 | fructose-bisphosphate aldolase |
| SEQ ID NO: 56 | Nga05770 | 1349.741 | 1449.9245 | nucleosome chromatin assembly complex protein |
| SEQ ID NO: 57 | Nga02264.02 | 153.2385 | 168.5601 | cyclopropane-fatty-acyl-phospholipid synthase |
| SEQ ID NO: 58 | Nga04304.02 | 390.411 | 650.43499 | protein |
| SEQ ID NO: 59 | Nga04302.02 | 284.5426 | 377.93588 | pak1ip1 protein |
| SEQ ID NO: 60 | Nga05096.1 | 346.4912 | 404.62905 | retinoblastoma binding protein 4 |
| SEQ ID NO: 61 | Nga04303.02 | 490.0872 | 462.58642 | n-ethylmaleimide-sensitive fusion protein |

FIGURE 24 A

| # | Nga model | +N rpkb | -N rpkb | GO |
|---|---|---|---|---|
| SEQ ID NO: 62 | Nga05101 | 683.6066 | 701.43837 | ---NA--- |
| SEQ ID NO: 63 | Nga04401.02 | 420.6799 | 494.05287 | ---NA--- |
| SEQ ID NO: 64 | Nga21200.1 | 802.2388 | 1023.9525 | c19orf60 homolog |
| SEQ ID NO: 65 | Nga04400.2 | 159.6107 | 175.00422 | minichromosome maintenance protein 2 |
| SEQ ID NO: 66 | Nga05100.1 | 272.9104 | 285.80795 | dna replication licensing factor mcm2 |
| SEQ ID NO: 67 | Nga20255.1 | 331.1966 | 290.48261 | probable palmitoyltransferase zdhhc11-like |
| SEQ ID NO: 68 | Nga01865.2 | 128.6667 | 163.9294 | protein |
| SEQ ID NO: 69 | Nga04340.2 | 661.3295 | 756.31909 | mitochondrion protein |
| SEQ ID NO: 70 | Nga05117 | 666.6667 | 797.81039 | protein |
| SEQ ID NO: 71 | Nga05131.1 | 333.6481 | 322.89032 | calcium-transporting atpase type 2c member 1-like |
| SEQ ID NO: 72 | Nga05125 | 19.23077 | 93.741399 | ---NA--- |
| SEQ ID NO: 73 | Nga01335.02 | 703.7594 | 567.67974 | protein |
| SEQ ID NO: 74 | Nga20059.1 | 1173.2 | 1059.2993 | protein |
| SEQ ID NO: 75 | Nga01334.02 | 6031.915 | 6632.5672 | 40s ribosomal protein s2 |
| SEQ ID NO: 76 | Nga01088.02 | 700.4539 | 686.64905 | protein |
| SEQ ID NO: 77 | Nga20927.1 | 5178.976 | 5806.8178 | protein |
| SEQ ID NO: 78 | Nga05116 | 1110.123 | 993.58188 | cdc37 protein |
| SEQ ID NO: 79 | Nga05122.1 | 256.9061 | 266.31995 | ---NA--- |
| SEQ ID NO: 80 | Nga05123 | 7665.007 | 5768.8004 | ---NA--- |
| SEQ ID NO: 81 | Nga01087.2 | 793.6937 | 779.73326 | ---NA--- |
| SEQ ID NO: 82 | Nga05124 | 596 | 682.43738 | sister chromatid cohesion protein dcc1 |
| SEQ ID NO: 83 | Nga05136 | 623.6324 | 711.8846 | cytochrome b5 domain-containing |
| SEQ ID NO: 84 | Nga02421.02 | 1065.574 | 1197.3921 | phosphoglycerate kinase |
| SEQ ID NO: 85 | Nga20253.1 | 907.1895 | 718.61598 | lrr and pyd domains-containing protein 3-like |
| SEQ ID NO: 86 | Nga04768.02 | 315.6342 | 389.8364 | ---NA--- |
| SEQ ID NO: 87 | Nga05137 | 2510.606 | 2473.3842 | predicted protein [Phaeodactylum tricornutum CCAP 1055/1] |
| SEQ ID NO: 88 | Nga20778 | 292.1028 | 226.74735 | transducin wd-40 repeat |
| SEQ ID NO: 89 | Nga05132 | 505.1238 | 572.60616 | ca2 :cation antiporter family |
| SEQ ID NO: 90 | Nga02203.02 | 2106.762 | 1790.8269 | protein |
| SEQ ID NO: 91 | Nga20097.1 | 190.1932 | 218.09539 | type i inositol polyphosphate 5- |
| SEQ ID NO: 92 | Nga06060 | 463.5193 | 538.51759 | protease |
| SEQ ID NO: 93 | Nga06063 | 1310.484 | 1311.8196 | 50s ribosomal protein l3 |
| SEQ ID NO: 94 | Nga06056 | 3280.692 | 1172.6975 | predicted protein [Thalassiosira pseudonana CCMP1335] |
| SEQ ID NO: 95 | Nga06058 | 923.2915 | 826.40023 | ---NA--- |
| SEQ ID NO: 96 | Nga06059.1 | 1347.354 | 1430.8389 | protein |
| SEQ ID NO: 97 | Nga06061 | 1233.25 | 1223.7322 | cell adhesion domain-containing protein |
| SEQ ID NO: 98 | Nga06062 | 1048.626 | 1144.6859 | rieske (2fe-2s) domain protein |
| SEQ ID NO: 99 | Nga06057 | 1101.551 | 1477.9243 | phenylalanine hydroxylase |
| SEQ ID NO: 100 | Nga04012.02 | 785.3695 | 857.9792 | t-complex protein 1 subunit alpha |
| SEQ ID NO: 101 | Nga20296 | 342.8928 | 329.56245 | conserved unknown protein [Ectocarpus siliculosus] |
| SEQ ID NO: 102 | Nga06468 | 353.4994 | 345.65828 | apicomplexan specific region near n-terminus |
| SEQ ID NO: 103 | Nga06469 | 948.6166 | 1161.8589 | mate efflux family protein |
| SEQ ID NO: 104 | Nga06581 | 533.7079 | 416.8625 | syntaxin 6 |
| SEQ ID NO: 105 | Nga00063.2 | 543.497 | 530.88726 | lao ao transport system atpase |
| SEQ ID NO: 106 | Nga06584 | 856.3218 | 540.0606 | anion exchanger family |
| SEQ ID NO: 107 | Nga00070.02 | 910.2384 | 770.26593 | ---NA--- |
| SEQ ID NO: 108 | Nga00057.02 | 412.6568 | 515.55491 | conserved hypothetical protein [Phytophthora infestans T30-4] |
| SEQ ID NO: 109 | Nga00061.02 | 734.1954 | 684.80307 | ---NA--- |
| SEQ ID NO: 110 | Nga00052.02 | 725.0415 | 763.11406 | isoleucyl-trna synthetase |
| SEQ ID NO: 111 | Nga00054.02 | 1480.13 | 1451.604 | gamma tubulin |
| SEQ ID NO: 112 | Nga00053.02 | 6413.408 | 6296.6755 | expressed unknown protein [Ectocarpus siliculosus] |
| SEQ ID NO: 113 | Nga00062.2 | 197.3856 | 174.16703 | folate biopterin transporter |
| SEQ ID NO: 114 | Nga20370.1 | 283.0189 | 324.45922 | autophagy ubiquitin-activating enzyme |
| SEQ ID NO: 115 | Nga01899.2 | 238.9046 | 301.23928 | autophagy-related protein 7 |
| SEQ ID NO: 116 | Nga06246 | 3098.947 | 4042.4285 | hydroxymethylglutaryl- synthase |
| SEQ ID NO: 117 | Nga01898.02 | 25470.99 | 15573.132 | light-harvesting protein |
| SEQ ID NO: 118 | Nga01900.02 | 3330.409 | 3329.9414 | protein |
| SEQ ID NO: 119 | Nga06249 | 696.7509 | 875.97257 | acyl- wax alcohol acyltransferase 2 |
| SEQ ID NO: 120 | Nga04989.02 | 994.8893 | 888.85465 | protein |
| SEQ ID NO: 121 | Nga06270 | 122.3097 | 151.25471 | pathogenesis-related transcriptional factor and erf |
| SEQ ID NO: 122 | Nga06272.1 | 183.6115 | 300.39606 | ---NA--- |
| SEQ ID NO: 123 | Nga20972 | 5904.439 | 20343.027 | ammonium transporter |
| SEQ ID NO: 124 | Nga06269.01 | 1489.596 | 1356.3627 | ---NA--- |
| SEQ ID NO: 125 | Nga06267 | 469.2982 | 542.97441 | like protein n-terminal domain of phosphotransacetylase-like protein |

FIGURE 24 B

| # | Nga model | +N rpkb | -N rpkb | GO |
|---|---|---|---|---|
| SEQ ID NO: 126 | Nga06271.01 | 2306.054 | 2335.2678 | thiol-disulfide oxidoreductase dcc |
| SEQ ID NO: 127 | Nga06273.01 | 77.77778 | 96.287461 | ---NA--- |
| SEQ ID NO: 128 | Nga06266.01 | 780.5841 | 1109.7377 | gdsl lipase acylhydrolase family protein |
| SEQ ID NO: 129 | Nga06280.01 | 13.10044 | 42.572513 | ---NA--- |
| SEQ ID NO: 130 | Nga06268 | 5536.43 | 7500.7538 | ---NA--- |
| SEQ ID NO: 131 | Nga06431 | 1476.19 | 1080.3682 | translation initiation factor if-1 |
| SEQ ID NO: 132 | Nga20399 | 130.2521 | 220.74305 | stelar k+ outward rectifying channel |
| SEQ ID NO: 133 | Nga06437 | 272.7273 | 247.01016 | protein |
| SEQ ID NO: 134 | Nga20161 | 289.2263 | 449.58516 | shaker-like potassium channel |
| SEQ ID NO: 135 | Nga21210.1 | 396.8254 | 554.18196 | 6-phosphofructo-2-kinase fructose- -biphosphatase-1-like protein |
| SEQ ID NO: 136 | Nga06438 | 4389.199 | 3892.1786 | cyclophilin |
| SEQ ID NO: 137 | Nga06436 | 173.4612 | 189.63088 | rna family |
| SEQ ID NO: 138 | Nga06434 | 867.7897 | 856.52342 | phosphatase ptc7 family protein |
| SEQ ID NO: 139 | Nga06435 | 4999.031 | 6118.3824 | l-ascorbate peroxidase |
| SEQ ID NO: 140 | Nga06433 | 8604.491 | 8276.7305 | 60s ribosomal protein l44 |
| SEQ ID NO: 141 | Nga06432 | 1185.586 | 1034.83 | preprotein translocase subunit |
| SEQ ID NO: 142 | Nga20950.1 | 1581.604 | 1600.1298 | conserved unknown protein [Ectocarpus siliculosus] |
| SEQ ID NO: 143 | Nga01308.1 | 383.8764 | 369.2226 | methionyl-trna synthetase |
| SEQ ID NO: 144 | Nga01304 | 1096.552 | 1065.0911 | protein |
| SEQ ID NO: 145 | Nga01309.01 | 1077.348 | 825.89107 | protein |
| SEQ ID NO: 146 | Nga01314.01 | 517.0604 | 329.80351 | conserved unknown protein [Ectocarpus siliculosus] |
| SEQ ID NO: 147 | Nga01305.1 | 2472.452 | 2697.7859 | carrier protein |
| SEQ ID NO: 148 | Nga01306 | 103.6036 | 88.643018 | phosphoserine aminotransferase |
| SEQ ID NO: 149 | Nga01307 | 1448.664 | 1523.9187 | nadh:ubiquinone oxidoreductase complex i intermediate-associated protein 30 |
| SEQ ID NO: 150 | Nga00790 | 4971.613 | 4377.6628 | ---NA--- |
| SEQ ID NO: 151 | Nga00792.01 | 188.2394 | 194.48459 | nmda receptor regulated 1-like |
| SEQ ID NO: 152 | Nga20855.1 | 288.7597 | 417.75883 | ---NA--- |
| SEQ ID NO: 153 | Nga00796 | 1002.509 | 1043.8189 | copper ion binding protein |
| SEQ ID NO: 154 | Nga00791 | 117.0483 | 119.21086 | tryptophan tyrosine permease family protein |
| SEQ ID NO: 155 | Nga00797 | 216.33 | 253.48404 | cyclin l1 |
| SEQ ID NO: 156 | Nga00795 | 426.2102 | 470.63765 | probable alpha-ketoglutarate-dependent dioxygenase abh6-like |
| SEQ ID NO: 157 | Nga00794 | 1639.733 | 1699.1275 | fatty acid desaturase domain protein |
| SEQ ID NO: 158 | Nga00793 | 9758.47 | 9081.4072 | 50s ribosomal protein l28 |
| SEQ ID NO: 159 | Nga01153 | 233.9565 | 256.16649 | amino acid transport protein |
| SEQ ID NO: 160 | Nga01154.01 | 513.587 | 528.8615 | class 3 |
| SEQ ID NO: 161 | Nga01152.01 | 187.3016 | 257.91284 | ---NA--- |
| SEQ ID NO: 162 | Nga01150.1 | 730.5062 | 797.23647 | ll-diaminopimelate aminotransferase |
| SEQ ID NO: 163 | Nga01155.01 | 3923.423 | 4163.9854 | s-adenosylmethionine mitochondrial carrier protein |
| SEQ ID NO: 164 | Nga01156.01 | 309.6192 | 286.54685 | ---NA--- |
| SEQ ID NO: 165 | Nga01151.01 | 2026.278 | 2082.6096 | ribosome biogenesis protein nsa2 homolog |
| SEQ ID NO: 166 | Nga01149.01 | 371.1584 | 514.72818 | short chain dehydrogenase |
| SEQ ID NO: 167 | Nga01515 | 643.8095 | 701.52293 | sodium bile acid symporter family protein |
| SEQ ID NO: 168 | Nga01524 | 377.3585 | 245.26051 | ---NA--- |
| SEQ ID NO: 169 | Nga01525.01 | 170.5202 | 169.05963 | ---NA--- |
| SEQ ID NO: 170 | Nga20615.1 | 117.4935 | 141.41435 | c-myc promoter-binding protein irlb |
| SEQ ID NO: 171 | Nga01520 | 963.1206 | 1084.7704 | glutaredoxin 2 |
| SEQ ID NO: 172 | Nga20595.1 | 14.81481 | 56.167686 | ---NA--- |
| SEQ ID NO: 173 | Nga06576.2 | 178.2274 | 170.10321 | brefeldin a-inhibited guanine nucleotide-exchange |
| SEQ ID NO: 174 | Nga01532 | 144.4665 | 141.41623 | oligopeptidase b |
| SEQ ID NO: 175 | Nga01522.1 | 173.0959 | 192.32492 | brefeldin a-inhibited guanine nucleotide-exchange |
| SEQ ID NO: 176 | Nga01518 | 1066.289 | 981.65339 | ---NA--- |
| SEQ ID NO: 177 | Nga01516 | 427.4892 | 480.65575 | nitroreductase-like protein |
| SEQ ID NO: 178 | Nga01521 | 278.9474 | 225.19864 | inosine-uridine preferring nucleoside hydrolase |
| SEQ ID NO: 179 | Nga01517 | 1802.653 | 1682.336 | fructose- -bisphosphate 2-phosphatase |
| SEQ ID NO: 180 | Nga01523 | 150 | 165.8702 | ---NA--- |
| SEQ ID NO: 181 | Nga20384 | 220.5607 | 198.42416 | predicted protein [Thalassiosira pseudonana CCMP1335] |
| SEQ ID NO: 182 | Nga20236 | 221.458 | 184.76067 | conserved unknown protein [Ectocarpus siliculosus] |
| SEQ ID NO: 183 | Nga01519 | 862.4879 | 1397.4665 | ---NA--- |
| SEQ ID NO: 184 | Nga01193 | 695.1081 | 488.00983 | ---NA--- |
| SEQ ID NO: 185 | Nga01194 | 120.6897 | 46.691118 | ---NA--- |
| SEQ ID NO: 186 | Nga01192 | 565.0558 | 512.22066 | v-myb myeloblastosis viral oncogene homologue |
| SEQ ID NO: 187 | Nga01191 | 3554.609 | 3521.5591 | nadh-cytochrome b5 reductase 2-like isoform 2 |
| SEQ ID NO: 188 | Nga01130.1 | 2190.024 | 2291.2585 | luminal binding protein |

FIGURE 24 C

| # | Nga model | +N rpkb | -N rpkb | GO |
|---|---|---|---|---|
| SEQ ID NO: 189 | Nga01137 | 302.682 | 278.07155 | 3-mercaptopyruvate sulfurtransferase |
| SEQ ID NO: 190 | Nga01138 | 323.4323 | 303.87751 | 3-mercaptopyruvate sulfurtransferase |
| SEQ ID NO: 191 | Nga01131 | 1779.286 | 2313.264 | protein |
| SEQ ID NO: 192 | Nga20010 | 690.5738 | 654.8238 | dienoyl- reductase |
| SEQ ID NO: 193 | Nga20721 | 317.3653 | 350.26726 | ---NA--- |
| SEQ ID NO: 194 | Nga20697 | 222.7273 | 256.03711 | protein |
| SEQ ID NO: 195 | Nga20437 | 303.6364 | 289.51889 | serine threonine protein kinase |
| SEQ ID NO: 196 | Nga01265 | 1622.817 | 1581.345 | ---NA--- |
| SEQ ID NO: 197 | Nga01264 | 366.9372 | 438.66116 | thioredoxin reductase |
| SEQ ID NO: 198 | Nga01262 | 157.8947 | 175.94122 | sphingosine-1-phosphate lyase |
| SEQ ID NO: 199 | Nga01263 | 218.3236 | 224.8819 | phosphoadenosine phosphosulfate reductase family protein |
| SEQ ID NO: 200 | Nga01266.01 | 264.8115 | 275.18421 | dhhc zinc finger domain-containing protein |
| SEQ ID NO: 201 | Nga00751 | 104.9223 | 116.46168 | retrograde transporter |
| SEQ ID NO: 202 | Nga00747.01 | 1671.614 | 1771.8947 | sugar transporter |
| SEQ ID NO: 203 | Nga00566.02 | 651.7572 | 609.10279 | protein bud31 homolog |
| SEQ ID NO: 204 | Nga00750 | 1565.502 | 1291.3662 | 1-like protein |
| SEQ ID NO: 205 | Nga00748 | 662.9297 | 707.58331 | ferrochelatase |
| SEQ ID NO: 206 | Nga00745 | 9752.981 | 9653.1461 | ---NA--- |
| SEQ ID NO: 207 | Nga00746.1 | 106.9114 | 139.20609 | pre-rrna-processing protein tsr1 |
| SEQ ID NO: 208 | Nga20529 | 439.7163 | 455.36333 | clathrin-adaptor gamma chain |
| SEQ ID NO: 209 | Nga20705 | 312.2066 | 300.05072 | ap-1 complex subunit gamma-1 |
| SEQ ID NO: 210 | Nga00833 | 595.6938 | 507.40958 | glucose-6-phosphate 1-dehydrogenase |
| SEQ ID NO: 211 | Nga00835 | 64.58797 | 77.201528 | ---NA--- |
| SEQ ID NO: 212 | Nga00834 | 176.7422 | 162.34866 | y8236_dicdi ame: full=tpr-containing protein ddb_g0280363 |
| SEQ ID NO: 213 | Nga01489 | 204.4502 | 268.62525 | conserved unknown protein [Ectocarpus siliculosus] |
| SEQ ID NO: 214 | Nga01487 | 130.137 | 103.87175 | zinc transporter |
| SEQ ID NO: 215 | Nga01488 | 553.3553 | 546.97951 | protein |
| SEQ ID NO: 216 | Nga01486 | 569.6546 | 693.57237 | bifunctional aspartokinase i homeserine dehydrogenase i |
| SEQ ID NO: 217 | Nga20977.1 | 692.3783 | 601.79663 | protein |
| SEQ ID NO: 218 | Nga00861.2 | 321.6031 | 379.07894 | ferrochelatase [Actinomyces viscosus C505] |
| SEQ ID NO: 219 | Nga01106.01 | 1262.956 | 1069.7195 | chalcone isomerase-like protein |
| SEQ ID NO: 220 | Nga20761.1 | 418.5293 | 517.04204 | serine threonine-protein kinase smg1 |
| SEQ ID NO: 221 | Nga01107.01 | 535.2381 | 451.8633 | isoamyl acetate-hydrolyzing esterase 1 homolog ( cerevisiae) |
| SEQ ID NO: 222 | Nga01108.01 | 2068.654 | 1876.8227 | predicted protein [Thalassiosira pseudonana CCMP1335] |
| SEQ ID NO: 223 | Nga21000 | 326.6453 | 317.31973 | ania-6a type cyclin |
| SEQ ID NO: 224 | Nga01041 | 528.6329 | 500.56093 | alpha-glucosidase ii |
| SEQ ID NO: 225 | Nga01044 | 983.6852 | 1031.2553 | protein |
| SEQ ID NO: 226 | Nga01040 | 419.0317 | 484.65225 | ubiquitin-conjugating enzyme |
| SEQ ID NO: 227 | Nga01042.01 | 765.3333 | 615.27688 | rae1-like protein |
| SEQ ID NO: 228 | Nga01045.01 | 3785.006 | 3574.5526 | microcystin synthetase-associated thioesterase |
| SEQ ID NO: 229 | Nga01043 | 52.28758 | 23.599868 | ---NA--- |
| SEQ ID NO: 230 | Nga21140.1 | 134.7068 | 151.06908 | d-2-hydroxyglutarate mitochondrial precursor |
| SEQ ID NO: 231 | Nga20552.1 | 125.3264 | 178.18208 | ---NA--- |
| SEQ ID NO: 232 | Nga20751.1 | 250.6427 | 261.75833 | protein |
| SEQ ID NO: 233 | Nga01510 | 556.2588 | 622.36437 | sjogren syndrome antigen b |
| SEQ ID NO: 234 | Nga01509 | 637.621 | 555.85033 | aspartyl aminopeptidase |
| SEQ ID NO: 235 | Nga21163.1 | 233.0827 | 154.74771 | myb-like dna-binding |
| SEQ ID NO: 236 | Nga01480 | 1645.643 | 1647.7741 | protein |
| SEQ ID NO: 237 | Nga20898.1 | 116.3265 | 132.64089 | ---NA--- |
| SEQ ID NO: 238 | Nga01479.01 | 3896.409 | 4264.1115 | translationally controlled tumor protein |
| SEQ ID NO: 239 | Nga04160.01 | 2642.633 | 2382.096 | brain protein 44-like protein |
| SEQ ID NO: 240 | Nga04163 | 60.10929 | 47.354489 | ---NA--- |
| SEQ ID NO: 241 | Nga04157 | 1099.129 | 997.09442 | ---NA--- |
| SEQ ID NO: 242 | Nga04159 | 1494.46 | 1292.5291 | 26s proteasome subunit rpn6a |
| SEQ ID NO: 243 | Nga04161 | 348.0315 | 411.97007 | metal ion transporter family |
| SEQ ID NO: 244 | Nga20961 | 443.3333 | 528.07655 | magnesium and cobalt transport protein |
| SEQ ID NO: 245 | Nga04158 | 419.5046 | 360.51904 | glyoxalase bleomycin resistance protein dioxygenase |
| SEQ ID NO: 246 | Nga04162.1 | 351.8519 | 272.24133 | ---NA--- |
| SEQ ID NO: 247 | Nga20375.1 | 288.8147 | 339.97993 | protein |
| SEQ ID NO: 248 | Nga03952.01 | 4710.142 | 4386.2837 | protein |
| SEQ ID NO: 249 | Nga03956.01 | 679.941 | 627.89224 | pyridoxamine 5 -phosphate oxidase |
| SEQ ID NO: 250 | Nga03954 | 4982.488 | 5552.9077 | choline-phosphate cytidylyltransferase b |
| SEQ ID NO: 251 | Nga03955 | 16857.14 | 18321.732 | alcohol dehydrogenase |
| SEQ ID NO: 252 | Nga03953 | 809.2567 | 1112.8596 | ---NA--- |

FIGURE 24 D

| # | Nga model | +N rpkb | -N rpkb | GO |
|---|---|---|---|---|
| SEQ ID NO: 253 | Nga03501 | 777.7778 | 845.07612 | protein |
| SEQ ID NO: 254 | Nga03503 | 199.0741 | 260.77854 | ---NA--- |
| SEQ ID NO: 255 | Nga03500 | 611.1888 | 645.39533 | 5 deoxy cytosolic type c protein domain containing protein |
| SEQ ID NO: 256 | Nga03502 | 371.3592 | 283.95453 | dt1p1a10l protein |
| SEQ ID NO: 257 | Nga02234.02 | 420.6049 | 304.08363 | ---NA--- |
| SEQ ID NO: 258 | Nga03537 | 131.2336 | 85.294011 | ---NA--- |
| SEQ ID NO: 259 | Nga03536 | 1911.173 | 1979.2887 | serine threonine-protein phosphatase pp1-gamma catalytic subunit |
| SEQ ID NO: 260 | Nga03534 | 2398.051 | 2516.6155 | ring zinc finger-containing protein |
| SEQ ID NO: 261 | Nga03535 | 746.0908 | 904.17368 | dual specificity phosphatase 10 |
| SEQ ID NO: 262 | Nga21251.1 | 32.52033 | 52.84068 | ---NA--- |
| SEQ ID NO: 263 | Nga04223.01 | 669.0939 | 1243.6157 | trna (guanine-n -)-methyltransferase-like |
| SEQ ID NO: 264 | Nga04222.01 | 558.6457 | 647.05873 | protein |
| SEQ ID NO: 265 | Nga20765 | 608.209 | 633.5706 | traf and tnf receptor associated protein |
| SEQ ID NO: 266 | Nga04221 | 907.8014 | 882.20826 | protein |
| SEQ ID NO: 267 | Nga03914 | 1839.734 | 1903.2596 | oxidoreductase domain protein |
| SEQ ID NO: 268 | Nga03913 | 757.7808 | 749.02915 | replication factor c subunit 2 |
| SEQ ID NO: 269 | Nga03629 | 1434.009 | 2048.7684 | protein phosphatase pp2a regulatory subunit b |
| SEQ ID NO: 270 | Nga03630 | 125.9542 | 89.924955 | protein |
| SEQ ID NO: 271 | Nga21180.1 | 252.2523 | 243.97161 | gtp-binding protein parf-like |
| SEQ ID NO: 272 | Nga20137.1 | 310.0522 | 349.29345 | ras superfamily gtpase |
| SEQ ID NO: 273 | Nga03043.02 | 2702.461 | 2792.9018 | mgc84239 protein |
| SEQ ID NO: 274 | Nga03020.02 | 2188.825 | 1948.3601 | golgi snap receptor complex member 1 |
| SEQ ID NO: 275 | Nga20668.1 | 585.3659 | 290.62374 | protein kinase domain containing protein |
| SEQ ID NO: 276 | Nga21011.1 | 964.775 | 1131.9901 | copia ltr rider |
| SEQ ID NO: 277 | Nga21010.1 | 1209.77 | 1048.9938 | gag-pol polyprotein |
| SEQ ID NO: 278 | Nga20110 | 353.9463 | 274.11371 | nad-dependent epimerase dehydratase |
| SEQ ID NO: 279 | Nga04230 | 1039.88 | 786.2356 | protein |
| SEQ ID NO: 280 | Nga03893 | 1742.857 | 1535.4411 | fkbp-type peptidyl-prolyl cis-trans isomerase |
| SEQ ID NO: 281 | Nga03895 | 876.7507 | 901.17782 | protein |
| SEQ ID NO: 282 | Nga03896 | 1639.269 | 1283.558 | protein |
| SEQ ID NO: 283 | Nga03894 | 3576.208 | 2613.4529 | ---NA--- |
| SEQ ID NO: 284 | Nga03892 | 1051.075 | 1026.4515 | ist1-like protein |
| SEQ ID NO: 285 | Nga01896.02 | 626.2712 | 569.15682 | arrestin domain protein |
| SEQ ID NO: 286 | Nga20588 | 572.327 | 551.83616 | conserved unknown protein [Ectocarpus siliculosus] |
| SEQ ID NO: 287 | Nga03971 | 402.2843 | 427.51999 | loc100145185 related |
| SEQ ID NO: 288 | Nga03970 | 5975.518 | 6111.8058 | expressed unknown protein [Ectocarpus siliculosus] |
| SEQ ID NO: 289 | Nga03725 | 657.1072 | 885.1363 | ef hand domain protein |
| SEQ ID NO: 290 | Nga21162.1 | 119.4539 | 129.39655 | lysine ornithine decarboxylase |
| SEQ ID NO: 291 | Nga03729 | 201.909 | 203.60344 | folic acid synthesis protein |
| SEQ ID NO: 292 | Nga03724 | 3311.798 | 3436.8335 | actin depolymerizing factor 8 |
| SEQ ID NO: 293 | Nga04192 | 382.7751 | 266.40299 | ---NA--- |
| SEQ ID NO: 294 | Nga04190 | 1060.047 | 1166.9848 | mitochondrial phosphate carrier protein |
| SEQ ID NO: 295 | Nga02088.02 | 2302.264 | 2571.7791 | protein |
| SEQ ID NO: 296 | Nga20976.1 | 455.051 | 416.62844 | conserved hypothetical protein [Phytophthora infestans T30-4] |
| SEQ ID NO: 297 | Nga03785 | 886.3496 | 1010.3047 | ring finger protein 13 |
| SEQ ID NO: 298 | Nga20229 | 155.5324 | 131.16403 | trna (uracil-5-)-methyltransferase |
| SEQ ID NO: 299 | Nga20749 | 272.1713 | 228.5723 | trna (uracil-5-)-methyltransferase |
| SEQ ID NO: 300 | Nga03783 | 576.6962 | 430.5775 | tpr repeat-containing protein |
| SEQ ID NO: 301 | Nga21044 | 847.1338 | 812.42546 | polymerase (dna directed) epsilon 3 (p17 subunit) |
| SEQ ID NO: 302 | Nga20783 | 772.9779 | 852.25023 | short-chain dehydrogenase reductase sdr |
| SEQ ID NO: 303 | Nga05796.2 | 149.2637 | 234.19315 | n -dimethylguanosine trna methyltransferase |
| SEQ ID NO: 304 | Nga03852.01 | 338.7755 | 446.55767 | ---NA--- |
| SEQ ID NO: 305 | Nga03853 | 89.20188 | 76.28408 | ---NA--- |
| SEQ ID NO: 306 | Nga03851 | 261.9522 | 277.28199 | ---NA--- |
| SEQ ID NO: 307 | Nga03850 | 226.4631 | 222.34318 | deoxyhypusine synthase |
| SEQ ID NO: 308 | Nga03750.1 | 133.9995 | 198.71778 | dna binding |
| SEQ ID NO: 309 | Nga21172 | 295.203 | 299.78799 | protein |
| SEQ ID NO: 310 | Nga20575 | 325.9005 | 343.73633 | sulfotransferase member 1-like |
| SEQ ID NO: 311 | Nga20608 | 355.2124 | 334.58963 | kin17 protein |
| SEQ ID NO: 312 | Nga20272 | 275.5299 | 296.37615 | ---NA--- |
| SEQ ID NO: 313 | Nga20934 | 1618.502 | 1985.1007 | ---NA--- |
| SEQ ID NO: 314 | Nga20367 | 215.8648 | 195.79911 | transcription factor e2 dimerization partner protein |
| SEQ ID NO: 315 | Nga03491.02 | 1636.641 | 1347.8407 | ---NA--- |
| SEQ ID NO: 316 | Nga04018.1 | 2458.194 | 2300.5136 | type iii effector protein |

FIGURE 24 E

| # | Nga model | +N rpkb | -N rpkb | GO |
|---|---|---|---|---|
| SEQ ID NO: 317 | Nga01851 | 1371.485 | 1378.1402 | protein kinase |
| SEQ ID NO: 318 | Nga01850 | 1510.73 | 1237.5832 | ---NA--- |
| SEQ ID NO: 319 | Nga01849.1 | 165.4275 | 245.64041 | ---NA--- |
| SEQ ID NO: 320 | Nga01773 | 41.99354 | 73.981829 | pentatricopeptide repeat-containing protein |
| SEQ ID NO: 321 | Nga01771.01 | 653.7196 | 566.93284 | protein |
| SEQ ID NO: 322 | Nga04098.2 | 440.7895 | 793.71829 | phosphoribosylformylglycinamidine cyclo-ligase |
| SEQ ID NO: 323 | Nga01754 | 369.0037 | 279.80212 | protein |
| SEQ ID NO: 324 | Nga01757.01 | 527.2109 | 633.7287 | 2-oxoisovalerate dehydrogenase alpha mitochondrial expressed |
| SEQ ID NO: 325 | Nga01755.01 | 547.7583 | 711.59812 | ---NA--- |
| SEQ ID NO: 326 | Nga01756 | 631.8632 | 583.05481 | protein |
| SEQ ID NO: 327 | Nga01855 | 656.8978 | 579.17011 | loc495188 protein |
| SEQ ID NO: 328 | Nga01999 | 96.2406 | 117.28247 | fan partial |
| SEQ ID NO: 329 | Nga01597.02 | 519.4468 | 640.39068 | nucleoside diphosphate-linked moiety x motif 6 |
| SEQ ID NO: 330 | Nga07239.2 | 581.0306 | 773.39182 | splicing factor 3b |
| SEQ ID NO: 331 | Nga02160 | 401.99 | 575.56908 | protein |
| SEQ ID NO: 332 | Nga02159 | 2863.456 | 3006.0456 | natural killer enhancing factor |
| SEQ ID NO: 333 | Nga02176 | 406.0797 | 460.77184 | intron-binding protein aquarius |
| SEQ ID NO: 334 | Nga02174 | 2205.747 | 2269.8109 | expressed unknown protein [Ectocarpus siliculosus] |
| SEQ ID NO: 335 | Nga20457 | 254.818 | 211.07985 | ---NA--- |
| SEQ ID NO: 336 | Nga21075 | 102.0408 | 99.480668 | protein |
| SEQ ID NO: 337 | Nga20717 | 125.9843 | 85.294011 | ---NA--- |
| SEQ ID NO: 338 | Nga02193.01 | 1625.663 | 1479.539 | upf0414 transmembrane protein c20orf30-like protein |
| SEQ ID NO: 339 | Nga02194 | 148.4552 | 132.24107 | nucleic acid binding |
| SEQ ID NO: 340 | Nga02195.01 | 3082.659 | 3114.4192 | pyruvate kinase |
| SEQ ID NO: 341 | Nga01669 | 409.3908 | 538.88472 | kh domain protein |
| SEQ ID NO: 342 | Nga01736 | 673.1107 | 834.47723 | ubiquitin family |
| SEQ ID NO: 343 | Nga20243 | 351.4894 | 396.41753 | ---NA--- |
| SEQ ID NO: 344 | Nga20374 | 313.6247 | 364.79086 | grip and coiled-coil domain-containing protein 1 |
| SEQ ID NO: 345 | Nga02051.01 | 393.8547 | 450.84318 | ---NA--- |
| SEQ ID NO: 346 | Nga21186 | 431.2977 | 351.43086 | nucleotidyl transferase domain-containing protein |
| SEQ ID NO: 347 | Nga02050 | 206.0988 | 232.36564 | protein |
| SEQ ID NO: 348 | Nga03605.2 | 115.0342 | 112.2714 | mitochondrial carrier protein |
| SEQ ID NO: 349 | Nga01673 | 83.83234 | 110.26932 | ---NA--- |
| SEQ ID NO: 350 | Nga01672 | 523.5911 | 638.86668 | cell division cycle protein 123 homolog |
| SEQ ID NO: 351 | Nga02287 | 1085.133 | 937.33458 | ---NA--- |
| SEQ ID NO: 352 | Nga02288 | 364.726 | 443.30978 | zinc finger protein |
| SEQ ID NO: 353 | Nga20830.1 | 373.5294 | 270.80849 | retrovirus-related pol polyprotein from transposon tnt 1-94 |
| SEQ ID NO: 354 | Nga06718.2 | 2232.103 | 2335.0459 | elongation factor 3 |
| SEQ ID NO: 355 | Nga01709.1 | 390.2676 | 366.34919 | protein |
| SEQ ID NO: 356 | Nga01712 | 116.6415 | 114.36859 | ---NA--- |
| SEQ ID NO: 357 | Nga02133 | 596.577 | 458.18942 | predicted protein [Thalassiosira pseudonana CCMP1335] |
| SEQ ID NO: 358 | Nga02131 | 380.7711 | 504.23741 | asparagine synthetase |
| SEQ ID NO: 359 | Nga02132.1 | 327.3273 | 357.82503 | dynamin like protein |
| SEQ ID NO: 360 | Nga00253.2 | 3745.673 | 1601.4958 | ---NA--- |
| SEQ ID NO: 361 | Nga02325.01 | 763.4409 | 183.45091 | rna binding protein |
| SEQ ID NO: 362 | Nga02324 | 353.8296 | 369.25774 | ---NA--- |
| SEQ ID NO: 363 | Nga01800.02 | 3475.895 | 4617.9188 | gcn5-related n-acetyltransferase |
| SEQ ID NO: 364 | Nga01825.1 | 561.6883 | 637.74812 | conserved hypothetical protein [Phytophthora infestans T30-4] |
| SEQ ID NO: 365 | Nga01829 | 93.02326 | 94.468076 | ---NA--- |
| SEQ ID NO: 366 | Nga02333.2 | 316.0652 | 324.08745 | dna polymerase delta subunit 1 |
| SEQ ID NO: 367 | Nga01704 | 482.4825 | 413.12526 | short-chain dehydrogenase reductase sdr |
| SEQ ID NO: 368 | Nga01707 | 1393.6 | 1562.0233 | ---NA--- |
| SEQ ID NO: 369 | Nga01705 | 835.6998 | 689.92993 | protein |
| SEQ ID NO: 370 | Nga02125 | 1000.459 | 832.95067 | hypothetical protein PPL_04681 [Polysphondylium pallidum PN500] |
| SEQ ID NO: 371 | Nga02123 | 773.2191 | 542.59374 | nadh:ubiquinone oxidoreductase complex i intermediate-associated protein 30 |
| SEQ ID NO: 372 | Nga02124 | 336.7232 | 305.99829 | protein |
| SEQ ID NO: 373 | Nga02042 | 663.75 | 686.49951 | protein |
| SEQ ID NO: 374 | Nga02038 | 432.5203 | 361.07798 | ---NA--- |
| SEQ ID NO: 375 | Nga03606.2 | 1402.083 | 1990.4424 | agc ndr protein kinase |
| SEQ ID NO: 376 | Nga02411 | 8.333333 | 6.0179663 | ---NA--- |
| SEQ ID NO: 377 | Nga05034 | 410.5431 | 474.13115 | ---NA--- |
| SEQ ID NO: 378 | Nga04270.01 | 132.8125 | 93.090417 | ---NA--- |
| SEQ ID NO: 379 | Nga04915 | 852.9584 | 771.65347 | ---NA--- |

FIGURE 24 F

| # | Nga model | +N rpkb | -N rpkb | GO |
|---|---|---|---|---|
| SEQ ID NO: 380 | Nga20305 | 527.0555 | 450.64968 | glycosyl group 2 family protein |
| SEQ ID NO: 381 | Nga04536.02 | 8371.486 | 3099.6152 | light-harvesting protein |
| SEQ ID NO: 382 | Nga04607.01 | 198.1567 | 219.64191 | ---NA--- |
| SEQ ID NO: 383 | Nga04606.1 | 91.6129 | 101.33479 | intraflagellar transport protein 52 |
| SEQ ID NO: 384 | Nga04635 | 601.1905 | 725.84043 | protein |
| SEQ ID NO: 385 | Nga04634 | 6594.635 | 5790.7007 | protein |
| SEQ ID NO: 386 | Nga04633 | 3442.519 | 3280.3653 | aspartic protease |
| SEQ ID NO: 387 | Nga21002.1 | 133.5227 | 184.64215 | phytochelatin synthase |
| SEQ ID NO: 388 | Nga04697 | 66.66667 | 48.143731 | ---NA--- |
| SEQ ID NO: 389 | Nga04696.1 | 255.4865 | 258.36139 | pheromone-regulated membrane protein |
| SEQ ID NO: 390 | Nga04523 | 1712.789 | 1689.3433 | glyoxalase domain-containing protein 4-like |
| SEQ ID NO: 391 | Nga04524 | 55.55556 | 111.76223 | ---NA--- |
| SEQ ID NO: 392 | Nga04525 | 290.4452 | 321.08889 | conserved unknown protein [Ectocarpus siliculosus] |
| SEQ ID NO: 393 | Nga20151 | 480.8511 | 450.1951 | protein phosphatase 2c-related protein |
| SEQ ID NO: 394 | Nga20221.1 | 202.5478 | 164.20999 | protein |
| SEQ ID NO: 395 | Nga20745.1 | 496.5035 | 545.4045 | ---NA--- |
| SEQ ID NO: 396 | Nga21300.1 | 473.4694 | 530.56356 | udp-n-acetylglucosamine pyrophosphorylase |
| SEQ ID NO: 397 | Nga04998 | 241.2141 | 301.09058 | udp-n-acetylglucosamine pyrophosphorylase |
| SEQ ID NO: 398 | Nga04997 | 1405.213 | 1450.3014 | protein |
| SEQ ID NO: 399 | Nga03706.02 | 591.2863 | 553.97752 | protein |
| SEQ ID NO: 400 | Nga04405 | 587.8565 | 658.70988 | conserved unknown protein [Ectocarpus siliculosus] |
| SEQ ID NO: 401 | Nga04407 | 214.0221 | 239.83039 | ---NA--- |
| SEQ ID NO: 402 | Nga20779 | 450.1816 | 502.26753 | perq amino acid-rich with gyf domain-containing protein 1 |
| SEQ ID NO: 403 | Nga20093.1 | 189.7856 | 187.1413 | exportin 4 |
| SEQ ID NO: 404 | Nga21159 | 34.59119 | 74.940713 | ribosome biogenesis atpase rix7 |
| SEQ ID NO: 405 | Nga20583.1 | 42.32804 | 85.970948 | protein |
| SEQ ID NO: 406 | Nga20400.1 | 81.76101 | 74.940713 | ---NA--- |
| SEQ ID NO: 407 | Nga20359.1 | 1231.905 | 1166.4365 | ---NA--- |
| SEQ ID NO: 408 | Nga04678 | 26.08696 | 113.03311 | ---NA--- |
| SEQ ID NO: 409 | Nga04590 | 7654.321 | 8003.2874 | ---NA--- |
| SEQ ID NO: 410 | Nga04591 | 2558.065 | 2291.098 | ef-1 guanine nucleotide exchange domain-containing |
| SEQ ID NO: 411 | Nga04761 | 347.2222 | 280.83843 | ---NA--- |
| SEQ ID NO: 412 | Nga04446 | 162.1622 | 93.685098 | ---NA--- |
| SEQ ID NO: 413 | Nga04441 | 1111.922 | 1059.5135 | ---NA--- |
| SEQ ID NO: 414 | Nga04440 | 1710.95 | 1671.948 | ---NA--- |
| SEQ ID NO: 415 | Nga04443 | 315.7895 | 459.89932 | ---NA--- |
| SEQ ID NO: 416 | Nga04902 | 450.8475 | 376.37789 | ---NA--- |
| SEQ ID NO: 417 | Nga04903 | 320.8396 | 302.07123 | tetracycline resistance protein |
| SEQ ID NO: 418 | Nga04904.1 | 134.0206 | 174.95531 | cysteine protease family |
| SEQ ID NO: 419 | Nga01250.02 | 11149.22 | 11737.134 | ---NA--- |
| SEQ ID NO: 420 | Nga04581 | 63.88889 | 93.278478 | selenoprotein t |
| SEQ ID NO: 421 | Nga04705 | 135.2381 | 165.06422 | ---NA--- |
| SEQ ID NO: 422 | Nga01343.02 | 695.6522 | 897.88395 | ---NA--- |
| SEQ ID NO: 423 | Nga04491 | 198.032 | 178.5404 | ---NA--- |
| SEQ ID NO: 424 | Nga20981 | 114.3617 | 51.856944 | myb-like dna-binding domain containing protein |
| SEQ ID NO: 425 | Nga04831 | 4350.14 | 3858.3761 | conserved unknown protein [Ectocarpus siliculosus] |
| SEQ ID NO: 426 | Nga20929 | 7248.269 | 6437.4189 | pap2_haloperoxidase domain-containing protein |
| SEQ ID NO: 427 | Nga04622.1 | 578.1742 | 558.09849 | ---NA--- |
| SEQ ID NO: 428 | Nga20871.1 | 1056.358 | 926.69724 | pterin-4-alpha-carbinolamine dehydratase |
| SEQ ID NO: 429 | Nga04554 | 2118.163 | 3447.5681 | ---NA--- |
| SEQ ID NO: 430 | Nga20772.1 | 554.8246 | 701.9641 | protein |
| SEQ ID NO: 431 | Nga20330 | 822.9842 | 936.66104 | uncharacterized udp-glucosyltransferase |
| SEQ ID NO: 432 | Nga04735.1 | 258.0466 | 349.25578 | aldehyde dehydrogenase family |
| SEQ ID NO: 433 | Nga04361 | 8.364312 | 6.5436995 | protein |
| SEQ ID NO: 434 | Nga02230.02 | 1230.58 | 956.34464 | ---NA--- |
| SEQ ID NO: 435 | Nga04973.1 | 902.7778 | 1079.762 | px domain containing protein |
| SEQ ID NO: 436 | Nga03201.02 | 325.5172 | 340.6584 | trigger factor |
| SEQ ID NO: 437 | Nga04972.1 | 198.7578 | 224.27204 | conserved unknown protein [Ectocarpus siliculosus] |
| SEQ ID NO: 438 | Nga03844.02 | 2072.273 | 1940.1417 | 10 kda heat shock mitochondrial |
| SEQ ID NO: 439 | Nga04391.1 | 223.2754 | 293.1976 | dead box rna helicase |
| SEQ ID NO: 440 | Nga04760.1 | 284.9462 | 241.68929 | uncharacterized protein |
| SEQ ID NO: 441 | Nga07054.1 | 473.025 | 488.39449 | ---NA--- |
| SEQ ID NO: 442 | Nga03620.02 | 513.8554 | 614.05008 | endonuclease exonuclease phosphatase |
| SEQ ID NO: 443 | Nga20555.1 | 1400.729 | 1298.3022 | retrotransposon ty1-copia subclass |

FIGURE 24 G

| # | Nga model | +N rpkb | -N rpkb | GO |
|---|---|---|---|---|
| SEQ ID NO: 444 | Nga05790.2 | 953.0201 | 993.34998 | major facilitator superfamily mfs_1 |
| SEQ ID NO: 445 | Nga06926 | 147.8873 | 228.85224 | ---NA--- |
| SEQ ID NO: 446 | Nga07217 | 196.5602 | 150.37523 | egf-like protein |
| SEQ ID NO: 447 | Nga07216 | 281.8229 | 296.20121 | ---NA--- |
| SEQ ID NO: 448 | Nga07183 | 935.7683 | 854.03583 | conserved unknown protein [Ectocarpus siliculosus] |
| SEQ ID NO: 449 | Nga07184 | 3520 | 3149.711 | ---NA--- |
| SEQ ID NO: 450 | Nga06894 | 184.9148 | 187.128 | ---NA--- |
| SEQ ID NO: 451 | Nga20032.1 | 659.7222 | 541.61697 | glutathione s-transferase |
| SEQ ID NO: 452 | Nga00239.02 | 309.4001 | 285.51939 | integral membrane protein gpr155-like |
| SEQ ID NO: 453 | Nga07164 | 7902.349 | 7868.9549 | ---NA--- |
| SEQ ID NO: 454 | Nga21013.1 | 801.3857 | 1023.1933 | hypothetical protein VITISV_004538 [Vitis vinifera] |
| SEQ ID NO: 455 | Nga07115 | 60.9319 | 58.238384 | ---NA--- |
| SEQ ID NO: 456 | Nga06941 | 608.1871 | 574.34626 | ---NA--- |
| SEQ ID NO: 457 | Nga21017.1 | 312.1827 | 316.17234 | nad-dependent epimerase dehydratase |
| SEQ ID NO: 458 | Nga07291 | 108.2251 | 79.718515 | ---NA--- |
| SEQ ID NO: 459 | Nga07292 | 410.6383 | 493.21716 | ribosome biogenesis protein rlp24 |
| SEQ ID NO: 460 | Nga07181.1 | 133.9901 | 140.87377 | glycosyl hydrolase |
| SEQ ID NO: 461 | Nga20581 | 502.2288 | 350.8841 | duf563 domain protein |
| SEQ ID NO: 462 | Nga07139 | 483.3333 | 531.30046 | ---NA--- |
| SEQ ID NO: 463 | Nga07214 | 607.8125 | 626.24462 | ---NA--- |
| SEQ ID NO: 464 | Nga07213 | 3279.232 | 2599.3834 | ---NA--- |
| SEQ ID NO: 465 | Nga07028 | 292.654 | 252.84015 | conserved unknown protein [Ectocarpus siliculosus] |
| SEQ ID NO: 466 | Nga07065 | 3104.61 | 2738.8149 | purple acid phosphatase |
| SEQ ID NO: 467 | Nga07066 | 1356.725 | 1265.8845 | ---NA--- |
| SEQ ID NO: 468 | Nga07156.1 | 329.2568 | 355.64313 | protein |
| SEQ ID NO: 469 | Nga07178 | 919.2913 | 710.07264 | prefoldin subunit 5 |
| SEQ ID NO: 470 | Nga07155 | 233.8028 | 288.86238 | protein |
| SEQ ID NO: 471 | Nga03591.02 | 688.0223 | 748.30646 | possible sulfotransferase |
| SEQ ID NO: 472 | Nga05479.02 | 231.5789 | 228.04925 | ---NA--- |
| SEQ ID NO: 473 | Nga20629 | 49.0566 | 53.139778 | ---NA--- |
| SEQ ID NO: 474 | Nga07277 | 401.9461 | 771.07446 | protein |
| SEQ ID NO: 475 | Nga06901 | 234.5191 | 279.7284 | protein |
| SEQ ID NO: 476 | Nga06953 | 558.8526 | 413.57893 | ---NA--- |
| SEQ ID NO: 477 | Nga07091 | 529.2259 | 612.63468 | ---NA--- |
| SEQ ID NO: 478 | Nga07172 | 204.955 | 224.45388 | ---NA--- |
| SEQ ID NO: 479 | Nga06912 | 141.4655 | 198.20291 | wd repeat |
| SEQ ID NO: 480 | Nga06944 | 228.8288 | 208.8397 | uncharacterized protein |
| SEQ ID NO: 481 | Nga06920 | 62.99213 | 85.294011 | ---NA--- |
| SEQ ID NO: 482 | Nga06793 | 1735.88 | 1399.9269 | proteasome ( macropain) beta 6 |
| SEQ ID NO: 483 | Nga07042 | 265.0794 | 238.99923 | ---NA--- |
| SEQ ID NO: 484 | Nga07050 | 447.9638 | 511.39099 | ---NA--- |
| SEQ ID NO: 485 | Nga07290 | 523.1388 | 699.63399 | ---NA--- |
| SEQ ID NO: 486 | Nga20667.1 | 79.81221 | 81.369686 | ---NA--- |
| SEQ ID NO: 487 | Nga20924 | 78.43137 | 74.339584 | ---NA--- |
| SEQ ID NO: 488 | Nga07279 | 202.1505 | 172.38562 | ---NA--- |
| SEQ ID NO: 489 | Nga06811 | 73.23944 | 125.10589 | ---NA--- |
| SEQ ID NO: 490 | Nga06900 | 645.9948 | 579.4042 | ---NA--- |
| SEQ ID NO: 491 | Nga07302 | 829.2135 | 925.61732 | atp-binding cassette superfamily |
| SEQ ID NO: 492 | Nga07000 | 64.86486 | 189.32197 | formin like protein |
| SEQ ID NO: 493 | Nga06977 | 17.85714 | 12.895642 | myb domain-containing protein |
| SEQ ID NO: 494 | Nga06897 | 181.9923 | 184.68931 | adenylate kinase |
| SEQ ID NO: 495 | Nga06832 | 453.5256 | 430.51605 | aldehyde reductase i |
| SEQ ID NO: 496 | Nga00443.1 | 195.2645 | 257.81767 | serine threonine protein |
| SEQ ID NO: 497 | Nga00437 | 1226.667 | 1155.4495 | high mobility group protein b3 |
| SEQ ID NO: 498 | Nga00434 | 1569.892 | 1562.5806 | hypothetical protein Osl_22634 [Oryza sativa Indica Group] |
| SEQ ID NO: 499 | Nga00442.1 | 326.9136 | 360.00812 | sh2 domain containing protein |
| SEQ ID NO: 500 | Nga00432 | 23043.6 | 20055.906 | cytochrome b6-f complex iron-sulfur subunit |
| SEQ ID NO: 501 | Nga00438 | 1556.914 | 1784.3299 | lipoic acid synthetase |
| SEQ ID NO: 502 | Nga00471 | 11.36364 | 49.237906 | ribosomal large subunit pseudouridine synthase d |
| SEQ ID NO: 503 | Nga00445 | 318.9087 | 348.50989 | ---NA--- |
| SEQ ID NO: 504 | Nga20019 | 573.2722 | 501.07724 | protein |
| SEQ ID NO: 505 | Nga00436 | 1288.955 | 1058.6635 | ddb1- and cul4-associated factor 7 |
| SEQ ID NO: 506 | Nga00441 | 382.716 | 596.78166 | 3 -5 exonuclease domain-containing protein |
| SEQ ID NO: 507 | Nga20469 | 534.1098 | 409.1416 | conserved unknown protein [Ectocarpus siliculosus] |

FIGURE 24 H

| # | Nga model | +N rpkb | -N rpkb | GO |
|---|---|---|---|---|
| SEQ ID NO: 508 | Nga00430 | 1072.738 | 1048.0016 | methionine aminopeptidase 2b |
| SEQ ID NO: 509 | Nga00470 | 445.9907 | 484.54799 | cys met metabolism pyridoxal-phosphate-dependent enzyme |
| SEQ ID NO: 510 | Nga00431 | 469.8391 | 425.27097 | atp-binding cassette superfamily |
| SEQ ID NO: 511 | Nga00435 | 838.1692 | 750.33982 | n-myristoyltransferase 2 |
| SEQ ID NO: 512 | Nga00440 | 196.0784 | 217.30032 | dual specificity phosphatase 15 |
| SEQ ID NO: 513 | Nga00439 | 292.9624 | 284.54836 | arp1 actin-related protein 1 homolog centractin beta |
| SEQ ID NO: 514 | Nga00433 | 2908.56 | 2649.076 | u6 snrna-associated sm-like protein lsm6 |
| SEQ ID NO: 515 | Nga00429.01 | 7422.336 | 5958.4819 | thioredoxin f |
| SEQ ID NO: 516 | Nga00444 | 879.4051 | 886.40967 | ---NA--- |
| SEQ ID NO: 517 | Nga20025 | 194.6903 | 249.23967 | ---NA--- |
| SEQ ID NO: 518 | Nga21267 | 149.5327 | 101.23682 | ---NA--- |
| SEQ ID NO: 519 | Nga21266 | 73.3945 | 139.13096 | trna modification gtpase |
| SEQ ID NO: 520 | Nga00269 | 717.8423 | 750.62269 | protein |
| SEQ ID NO: 521 | Nga00275 | 3345.168 | 3719.7442 | conserved unknown protein [Ectocarpus siliculosus] |
| SEQ ID NO: 522 | Nga00277 | 222.0249 | 219.98179 | c transferase |
| SEQ ID NO: 523 | Nga00276 | 7134.314 | 7549.7158 | beta-lactamase |
| SEQ ID NO: 524 | Nga21179 | 171.1712 | 300.08508 | pentatricopeptide repeat-containing |
| SEQ ID NO: 525 | Nga20706 | 295.0495 | 375.3781 | salt-inducible protein |
| SEQ ID NO: 526 | Nga00274 | 127.5862 | 159.37235 | fidgetin-like 1 |
| SEQ ID NO: 527 | Nga00265 | 1312.013 | 1549.5427 | t-complex protein 1 subunit delta |
| SEQ ID NO: 528 | Nga00280 | 275.8621 | 655.1123 | ---NA--- |
| SEQ ID NO: 529 | Nga00270 | 481.5972 | 740.58598 | protein |
| SEQ ID NO: 530 | Nga00273 | 278.5388 | 247.31369 | ---NA--- |
| SEQ ID NO: 531 | Nga00278 | 504.1597 | 493.55335 | novel protein vertebrate deah (asp-glu-ala-asp his) box polypeptide 57 |
| SEQ ID NO: 532 | Nga00282 | 166.7969 | 134.9811 | conserved hypothetical protein [Capsaspora owczarzaki ATCC 30864] |
| SEQ ID NO: 533 | Nga00260 | 18877.38 | 11804.309 | luminal binding protein |
| SEQ ID NO: 534 | Nga00259 | 493.7676 | 533.55914 | nuclear pore complex protein |
| SEQ ID NO: 535 | Nga00268 | 723.055 | 516.48842 | protein |
| SEQ ID NO: 536 | Nga21168 | 77.44108 | 43.767028 | ---NA--- |
| SEQ ID NO: 537 | Nga00283 | 256.351 | 281.85764 | ---NA--- |
| SEQ ID NO: 538 | Nga00262 | 1462.753 | 1667.9341 | 30s ribosomal protein s1 |
| SEQ ID NO: 539 | Nga20639 | 57.85124 | 71.618773 | ---NA--- |
| SEQ ID NO: 540 | Nga00271 | 795.6587 | 652.6971 | protein |
| SEQ ID NO: 541 | Nga00272 | 484.5447 | 460.62329 | hypothetical protein LNTAR_19477 [Lentisphaera araneosa HTCC2155] |
| SEQ ID NO: 542 | Nga00263 | 2198.137 | 2177.4745 | phosphoglycerate mutase |
| SEQ ID NO: 543 | Nga00264.01 | 515.7685 | 588.96792 | ccr4-not transcription complex subunit 10 |
| SEQ ID NO: 544 | Nga00266 | 1552.022 | 1528.06 | 5-methyltetrahydropteroyltriglutamate--homocysteine s-methyltransferase |
| SEQ ID NO: 545 | Nga00284 | 194.3128 | 112.94382 | ---NA--- |
| SEQ ID NO: 546 | Nga20165 | 330.1304 | 249.80549 | protein |
| SEQ ID NO: 547 | Nga00281 | 11729.49 | 12331.093 | protein |
| SEQ ID NO: 548 | Nga00279 | 462.1212 | 589.68255 | protein |
| SEQ ID NO: 549 | Nga00267.01 | 818.779 | 835.86483 | px domain containing protein |
| SEQ ID NO: 550 | Nga20441 | 245.1253 | 211.21553 | mannosyloligosaccharid alpha-mannosidase |
| SEQ ID NO: 551 | Nga00261 | 362.6506 | 316.48702 | translation initiation factor eif-2b subunit delta isoform 1 |
| SEQ ID NO: 552 | Nga00485 | 654.0084 | 626.17321 | ---NA--- |
| SEQ ID NO: 553 | Nga00486 | 632 | 623.94275 | ---NA--- |
| SEQ ID NO: 554 | Nga00507 | 972.2719 | 968.90335 | peptidyl-prolyl cis-trans isomerase 10 |
| SEQ ID NO: 555 | Nga00480 | 7953.103 | 8292.3426 | ribosomal protein s18 |
| SEQ ID NO: 556 | Nga00473 | 314.6517 | 235.90043 | dihydrodipicolinate synthase |
| SEQ ID NO: 557 | Nga00510 | 165.4224 | 223.4569 | small rna degrading nuclease 5 |
| SEQ ID NO: 558 | Nga00475 | 710.1193 | 787.41486 | transmembrane protein |
| SEQ ID NO: 559 | Nga20859 | 2137.755 | 2024.1553 | conserved unknown protein [Ectocarpus siliculosus] |
| SEQ ID NO: 560 | Nga00515 | 209.0164 | 213.0952 | ---NA--- |
| SEQ ID NO: 561 | Nga00481 | 719.7279 | 791.42398 | fat-free protein |
| SEQ ID NO: 562 | Nga00476.01 | 472.374 | 546.54973 | 4-hydroxyphenylpyruvate dioxygenase |
| SEQ ID NO: 563 | Nga00511 | 240.7407 | 259.44122 | ---NA--- |
| SEQ ID NO: 564 | Nga00498 | 639.7849 | 681.38909 | ---NA--- |
| SEQ ID NO: 565 | Nga00482.01 | 3534.884 | 2768.9643 | beta-hydroxyacyl-acp dehydratase precursor |
| SEQ ID NO: 566 | Nga20160 | 142.7796 | 182.89129 | rrna biogenesis protein rrp5 |
| SEQ ID NO: 567 | Nga00499.01 | 3887.179 | 3369.1353 | ---NA--- |
| SEQ ID NO: 568 | Nga00487 | 4163.636 | 3749.2428 | phosphatidylinositol n-acetylglucosaminyltransferase subunit h-like |
| SEQ ID NO: 569 | Nga00513 | 998.1651 | 991.80502 | ---NA--- |
| SEQ ID NO: 570 | Nga00503 | 1485.666 | 1622.7198 | p-type atpase |

FIGURE 24 I

| # | Nga model | +N rpkb | -N rpkb | GO |
|---|---|---|---|---|
| SEQ ID NO: 571 | Nga00501 | 8380.399 | 7881.3366 | protein |
| SEQ ID NO: 572 | Nga00472 | 5885.945 | 3934.2108 | permease |
| SEQ ID NO: 573 | Nga00534 | 389.7436 | 388.85321 | ---NA--- |
| SEQ ID NO: 574 | Nga20028 | 78.94737 | 57.012313 | atp-dependent dead h dna helicase recq |
| SEQ ID NO: 575 | Nga00477.01 | 134.8601 | 100.80258 | conserved hypothetical protein [Phytophthora infestans T30-4] |
| SEQ ID NO: 576 | Nga00478 | 459.695 | 441.31753 | rrna biogenesis protein rrp5 |
| SEQ ID NO: 577 | Nga20628 | 207.2829 | 221.50162 | atp-dependent dna family expressed |
| SEQ ID NO: 578 | Nga00512.01 | 74.11424 | 81.849564 | ---NA--- |
| SEQ ID NO: 579 | Nga00474 | 549.5164 | 512.92699 | ---NA--- |
| SEQ ID NO: 580 | Nga00514 | 700.8514 | 838.83557 | family |
| SEQ ID NO: 581 | Nga20483 | 190.9722 | 206.86759 | prematurely terminated mrna decay factor-like |
| SEQ ID NO: 582 | Nga00506 | 890.5752 | 951.10254 | splicing factor 3b subunit 1 |
| SEQ ID NO: 583 | Nga00509 | 78.55626 | 160.99018 | ---NA--- |
| SEQ ID NO: 584 | Nga00533 | 214.2305 | 196.87546 | protein |
| SEQ ID NO: 585 | Nga00488 | 1245.968 | 1131.2806 | predicted protein [Phaeodactylum tricornutum CCAP 1055/1] |
| SEQ ID NO: 586 | Nga00483 | 235.651 | 299.74696 | ubiquitin-protein ligase |
| SEQ ID NO: 587 | Nga00484 | 1071.582 | 1189.4638 | eukaryotic translation initiation factor 3 subunit |
| SEQ ID NO: 588 | Nga00500.01 | 4996.238 | 4992.331 | glutaryl- mitochondrial precursor |
| SEQ ID NO: 589 | Nga00508.01 | 6980.9 | 6051.6275 | glutathione peroxidase |
| SEQ ID NO: 590 | Nga00504 | 258.1903 | 306.71913 | low-density lipoprotein |
| SEQ ID NO: 591 | Nga00479 | 491.0973 | 451.23534 | atp-binding cassette sub-family b member 9 |
| SEQ ID NO: 592 | Nga00505 | 1501.88 | 1518.2477 | amino acid-polyamine-organocation family |
| SEQ ID NO: 593 | Nga00502 | 3516.592 | 5094.725 | c14c577g12199 |
| SEQ ID NO: 594 | Nga00663 | 2639.663 | 2428.0167 | chaperonin |
| SEQ ID NO: 595 | Nga20429.1 | 246.0137 | 199.86777 | elongator complex protein 4 |
| SEQ ID NO: 596 | Nga00671 | 227.4939 | 202.94164 | ---NA--- |
| SEQ ID NO: 597 | Nga00688.1 | 444.6123 | 587.43351 | atp-dependent rna helicase |
| SEQ ID NO: 598 | Nga20297 | 315.4762 | 214.92737 | mitochondrial protein |
| SEQ ID NO: 599 | Nga00664 | 109.2896 | 136.14416 | phd finger protein 8 |
| SEQ ID NO: 600 | Nga00673 | 981.88 | 1018.2154 | ---NA--- |
| SEQ ID NO: 601 | Nga20068 | 320.2576 | 393.21138 | pentatricopeptide repeat10 |
| SEQ ID NO: 602 | Nga00668 | 1057.707 | 1043.3426 | s-adenosylmethionine-dependent methyltransferase domain-containing protein |
| SEQ ID NO: 603 | Nga00669.01 | 324.263 | 434.2761 | sumo ligase |
| SEQ ID NO: 604 | Nga00656 | 2106.164 | 2248.0814 | 3-oxo-5-alpha-steroid 4-dehydrogenase |
| SEQ ID NO: 605 | Nga00662 | 2118.433 | 2170.9606 | nadp-dependent malic enzyme |
| SEQ ID NO: 606 | Nga00657 | 2076.51 | 1616.8539 | zinc finger hit domain-containing protein 1 |
| SEQ ID NO: 607 | Nga00658 | 4937.87 | 4748.4959 | mpv17-like protein |
| SEQ ID NO: 608 | Nga00670 | 266.1064 | 379.28359 | ---NA--- |
| SEQ ID NO: 609 | Nga00659 | 825.2662 | 824.74685 | cobalamin synthesis protein p47k |
| SEQ ID NO: 610 | Nga00654 | 820.3971 | 785.05131 | ---NA--- |
| SEQ ID NO: 611 | Nga21199 | 1297.583 | 1148.6861 | upf0587 protein c1orf123 homolog |
| SEQ ID NO: 612 | Nga00661 | 607.4534 | 527.48783 | protein |
| SEQ ID NO: 613 | Nga00667.1 | 895.9508 | 1007.724 | lipoate-protein ligase b |
| SEQ ID NO: 614 | Nga00672 | 62.89308 | 84.024436 | flagellar outer dynein arm-docking complex |
| SEQ ID NO: 615 | Nga00665 | 183.3539 | 208.88071 | uncharacterized protein c9orf114-like |
| SEQ ID NO: 616 | Nga00660 | 9375 | 9082.3422 | ribosomal protein l12 |
| SEQ ID NO: 617 | Nga00681.2 | 1095.077 | 1240.4002 | ---NA--- |
| SEQ ID NO: 618 | Nga20187 | 228.1803 | 304.0223 | protein |
| SEQ ID NO: 619 | Nga20024 | 326.5027 | 279.68745 | conserved hypothetical protein [Albugo laibachii Nc14] |
| SEQ ID NO: 620 | Nga00666 | 994.763 | 919.28809 | protein |
| SEQ ID NO: 621 | Nga00011 | 449.3464 | 430.10759 | tf1-like protein |
| SEQ ID NO: 622 | Nga00018 | 88.88889 | 100.29944 | dynein light chain |
| SEQ ID NO: 623 | Nga00015.01 | 3272.989 | 2182.0316 | ferredoxin |
| SEQ ID NO: 624 | Nga00004 | 1060.413 | 715.55438 | methyltransferase family |
| SEQ ID NO: 625 | Nga00009 | 435.1088 | 468.07408 | protein |
| SEQ ID NO: 626 | Nga00001 | 5567.879 | 5567.0727 | 40s ribosomal protein s4 |
| SEQ ID NO: 627 | Nga00010 | 7007.191 | 7870.276 | ---NA--- |
| SEQ ID NO: 628 | Nga00005 | 765 | 895.02204 | homoserine kinase |
| SEQ ID NO: 629 | Nga00012 | 123.8913 | 115.91688 | phosphoethanolamine n- |
| SEQ ID NO: 630 | Nga00038 | 250.4105 | 287.26155 | protein |
| SEQ ID NO: 631 | Nga00014 | 65.30214 | 104.52257 | histone deacetylase |
| SEQ ID NO: 632 | Nga00008 | 437.8472 | 545.00208 | repeat-containing protein a_04 |
| SEQ ID NO: 633 | Nga00006 | 297.7194 | 266.64633 | fatty-acid- ligase fadd9 |

FIGURE 24 J

| # | Nga model | +N rpkb | -N rpkb | GO |
|---|---|---|---|---|
| SEQ ID NO: 634 | Nga20828 | 266.9231 | 198.31514 | alg2 protein |
| SEQ ID NO: 635 | Nga00016 | 2230.867 | 1908.0945 | 2fe-2s iron-sulfur cluster binding domain protein |
| SEQ ID NO: 636 | Nga00017 | 80.71473 | 67.410122 | rna recognition motif-containing protein |
| SEQ ID NO: 637 | Nga00007 | 563.786 | 483.66618 | methyltransferase family |
| SEQ ID NO: 638 | Nga00013 | 294.7368 | 341.19676 | protein |
| SEQ ID NO: 639 | Nga00003.01 | 13762.2 | 16785.777 | ethylmalonic encephalopathy 1 |
| SEQ ID NO: 640 | Nga00002 | 344.1842 | 437.33581 | protein |
| SEQ ID NO: 641 | Nga20792 | 260.2378 | 320.53422 | ---NA--- |
| SEQ ID NO: 642 | Nga02883 | 168.3168 | 220.46015 | conserved hypothetical protein [Albugo laibachii Nc14] |
| SEQ ID NO: 643 | Nga02882 | 224.4898 | 231.1167 | fha domain containing protein |
| SEQ ID NO: 644 | Nga20557 | 409.7065 | 448.69848 | dhhc zinc finger domain containing protein |
| SEQ ID NO: 645 | Nga02880.2 | 960.1407 | 1295.3091 | ras-related protein rab-2-a |
| SEQ ID NO: 646 | Nga02872 | 4786.309 | 3947.1401 | histone 2 |
| SEQ ID NO: 647 | Nga02881 | 1240.246 | 1118.8227 | conserved unknown protein [Ectocarpus siliculosus] |
| SEQ ID NO: 648 | Nga20407 | 1363.897 | 1145.3104 | protein |
| SEQ ID NO: 649 | Nga20428 | 237.1542 | 181.25258 | alanyl-trna synthetase |
| SEQ ID NO: 650 | Nga20209 | 1189.607 | 1134.9614 | protein |
| SEQ ID NO: 651 | Nga02874 | 1032.068 | 922.34856 | farnesyl diphosphate synthase |
| SEQ ID NO: 652 | Nga02871 | 1024.259 | 873.01064 | ubiquitin-conjugating enzyme e2 i |
| SEQ ID NO: 653 | Nga02876 | 304.8303 | 231.91954 | calcium-dependent protein |
| SEQ ID NO: 654 | Nga02873 | 1300.479 | 1416.8789 | protein |
| SEQ ID NO: 655 | Nga02878 | 1588.435 | 1447.9964 | protein |
| SEQ ID NO: 656 | Nga02879 | 1459.848 | 2282.177 | hypothetical protein Esi_0209_0049 [Ectocarpus siliculosus] |
| SEQ ID NO: 657 | Nga02870 | 1575.112 | 1360.7216 | protein |
| SEQ ID NO: 658 | Nga02884 | 650.237 | 769.04476 | ---NA--- |
| SEQ ID NO: 659 | Nga02877 | 3319.838 | 3433.8954 | hypersensitive-induced response protein |
| SEQ ID NO: 660 | Nga02189.2 | 538.6473 | 556.26941 | violaxanthin de-epoxidase-related protein |
| SEQ ID NO: 661 | Nga00161.01 | 760.492 | 1253.322 | had-superfamily subfamily iia hydrolase |
| SEQ ID NO: 662 | Nga00150 | 234.2342 | 231.77303 | gamma complex associated protein 2 |
| SEQ ID NO: 663 | Nga00165.01 | 1802.676 | 1561.4509 | anion exchanger family |
| SEQ ID NO: 664 | Nga21119 | 2242.798 | 1887.8583 | retinol retinaldehyde reductase |
| SEQ ID NO: 665 | Nga00166 | 231.1396 | 270.66359 | ---NA--- |
| SEQ ID NO: 666 | Nga00143.01 | 842.3308 | 907.80017 | conserved uncharacterized protein |
| SEQ ID NO: 667 | Nga20066.1 | 799.1845 | 721.05175 | receptor-interacting serine-threonine kinase 4 |
| SEQ ID NO: 668 | Nga00194 | 103.7037 | 157.80445 | ---NA--- |
| SEQ ID NO: 669 | Nga00149.01 | 1285.985 | 1033.996 | ---NA--- |
| SEQ ID NO: 670 | Nga00163 | 1542.049 | 1652.793 | nuclear receptor coactivator 7 |
| SEQ ID NO: 671 | Nga00167 | 2613.397 | 2935.4726 | l-aspartate oxidase |
| SEQ ID NO: 672 | Nga00170 | 1444.444 | 1633.0572 | peroxiredoxin-like protein |
| SEQ ID NO: 673 | Nga00168 | 4507.298 | 4185.0861 | molecular chaperone |
| SEQ ID NO: 674 | Nga00172 | 4215.859 | 4080.0221 | conserved unknown protein [Ectocarpus siliculosus] |
| SEQ ID NO: 675 | Nga00193 | 1161.348 | 1054.4245 | zinc finger protein |
| SEQ ID NO: 676 | Nga20242 | 463.0503 | 446.23788 | rna polymerase ii ctd phosphatase |
| SEQ ID NO: 677 | Nga00171 | 1501.247 | 1407.3937 | enoyl- hydratase isomerase |
| SEQ ID NO: 678 | Nga20286 | 491.8605 | 530.2808 | rna polymerase ii ctd phosphatase |
| SEQ ID NO: 679 | Nga00169 | 185.7143 | 219.46038 | tumor suppressor candidate 4 |
| SEQ ID NO: 680 | Nga20422 | 139.8176 | 186.0265 | conserved unknown protein [Ectocarpus siliculosus] |
| SEQ ID NO: 681 | Nga00144 | 799.2767 | 605.279 | caltractin |
| SEQ ID NO: 682 | Nga20351 | 152.5886 | 152.49887 | pentatricopeptide repeat-containing protein |
| SEQ ID NO: 683 | Nga21250 | 137.4408 | 97.542393 | protein |
| SEQ ID NO: 684 | Nga20271 | 157.6037 | 188.69236 | ---NA--- |
| SEQ ID NO: 685 | Nga00147 | 1786.268 | 1309.9573 | abc subfamily abcg |
| SEQ ID NO: 686 | Nga00151 | 185.0534 | 185.0364 | copine family protein |
| SEQ ID NO: 687 | Nga00164 | 19765.55 | 15222.287 | heat shock protein hsp20 |
| SEQ ID NO: 688 | Nga00145 | 177.2535 | 226.73862 | u3 small nucleolar rna-interacting protein 2 |
| SEQ ID NO: 689 | Nga00162 | 979.8658 | 984.17983 | serine threonine-protein kinase ctr1 |
| SEQ ID NO: 690 | Nga00146 | 621.4689 | 479.10589 | protein |
| SEQ ID NO: 691 | Nga00173 | 38.75969 | 100.76595 | ---NA--- |
| SEQ ID NO: 692 | Nga00174 | 78.125 | 118.47871 | ---NA--- |
| SEQ ID NO: 693 | Nga20762 | 713.5632 | 946.27333 | fha domain protein |
| SEQ ID NO: 694 | Nga03257 | 622.0096 | 645.79401 | rna binding motif protein 17 |
| SEQ ID NO: 695 | Nga03264 | 84.50704 | 45.770448 | metal ion transporter family |
| SEQ ID NO: 696 | Nga03260 | 559.6591 | 518.02381 | protein |
| SEQ ID NO: 697 | Nga03262 | 345.3608 | 352.88858 | protein |

FIGURE 24 K

| # | Nga model | +N rpkb | -N rpkb | GO |
|---|---|---|---|---|
| SEQ ID NO: 698 | Nga03267 | 413.9768 | 408.37682 | ---NA--- |
| SEQ ID NO: 699 | Nga20709.1 | 107.6923 | 168.50306 | protein |
| SEQ ID NO: 700 | Nga20491.1 | 112.5731 | 158.36754 | atp-dependent clp protease adaptor protein containing protein |
| SEQ ID NO: 701 | Nga21277 | 577.111 | 627.41394 | pentatricopeptide repeat-containing |
| SEQ ID NO: 702 | Nga03254 | 577.2931 | 533.62647 | 7-dehydrocholesterol reductase |
| SEQ ID NO: 703 | Nga03261 | 491.9499 | 434.0687 | rna recognition motif-containing protein |
| SEQ ID NO: 704 | Nga03263 | 194.7484 | 165.92205 | ---NA--- |
| SEQ ID NO: 705 | Nga03256 | 977.5281 | 964.33099 | trehalase-like isoform 1 |
| SEQ ID NO: 706 | Nga03266 | 95.63994 | 62.464967 | ---NA--- |
| SEQ ID NO: 707 | Nga20643 | 318.9369 | 212.32825 | ---NA--- |
| SEQ ID NO: 708 | Nga03258 | 643.2584 | 651.15748 | ---NA--- |
| SEQ ID NO: 709 | Nga03265 | 447.6651 | 415.15246 | protein |
| SEQ ID NO: 710 | Nga03259 | 718.6761 | 624.84416 | immature colon carcinoma transcript 1 |
| SEQ ID NO: 711 | Nga03255 | 163.9833 | 196.36441 | fad nad -binding oxidoreductase family protein |
| SEQ ID NO: 712 | Nga20184 | 191.5104 | 221.35185 | conserved unknown protein [Ectocarpus siliculosus] |
| SEQ ID NO: 713 | Nga00198 | 315.2318 | 359.40411 | single-stranded nucleic acid binding r3h protein |
| SEQ ID NO: 714 | Nga00196.01 | 469.4271 | 500.67626 | ---NA--- |
| SEQ ID NO: 715 | Nga00202 | 149.4642 | 165.57044 | pentafunctional arom polypeptide |
| SEQ ID NO: 716 | Nga00197.01 | 501.9973 | 375.74227 | proly 4-hydroxylase |
| SEQ ID NO: 717 | Nga00205 | 753.7609 | 807.06503 | transcription factor iie |
| SEQ ID NO: 718 | Nga00207.01 | 2368.566 | 2338.2092 | urease accessory protein ureg |
| SEQ ID NO: 719 | Nga00206 | 359.589 | 395.7019 | nad -binding rossmann-fold-containing protein |
| SEQ ID NO: 720 | Nga00212 | 764.0879 | 839.0666 | ---NA--- |
| SEQ ID NO: 721 | Nga00209 | 805.5556 | 926.33696 | protein |
| SEQ ID NO: 722 | Nga00200.01 | 608.4316 | 561.54786 | dna gyrase subunit a |
| SEQ ID NO: 723 | Nga00211.01 | 160.0424 | 132.60574 | nlr card domain containing 3 |
| SEQ ID NO: 724 | Nga00208 | 1932.836 | 1980.5397 | protein disulfide-isomerase |
| SEQ ID NO: 725 | Nga00203.01 | 242.0765 | 225.52575 | beta-adaptin-like protein a |
| SEQ ID NO: 726 | Nga20546.1 | 1033.708 | 983.05587 | n6-adenine-specific methylase |
| SEQ ID NO: 727 | Nga00195.01 | 617.7215 | 606.06253 | conserved hypothetical protein [Phytophthora infestans T30-4] |
| SEQ ID NO: 728 | Nga00201.01 | 99.67846 | 118.42429 | dmc1 |
| SEQ ID NO: 729 | Nga00204.01 | 1006.969 | 929.74435 | atp-binding cassette transporter |
| SEQ ID NO: 730 | Nga20535.1 | 648.855 | 613.74069 | pseudouridine synthase |
| SEQ ID NO: 731 | Nga20949.1 | 223.9289 | 183.02012 | protein |
| SEQ ID NO: 732 | Nga20254.1 | 389.5112 | 359.05565 | protein |
| SEQ ID NO: 733 | Nga20878.1 | 554.0037 | 444.79159 | aspartate carbamoyltransferase |
| SEQ ID NO: 734 | Nga00199.01 | 1643.221 | 1667.3632 | dna-directed rna polymerase ii 19 kda polypeptide |
| SEQ ID NO: 735 | Nga00210.01 | 206.4632 | 259.30196 | uncharacterized protein c16orf7 homolog |
| SEQ ID NO: 736 | Nga02630 | 138.9728 | 130.9044 | hypothetical protein Esi_0116_0070 [Ectocarpus siliculosus] |
| SEQ ID NO: 737 | Nga01767.02 | 2941.606 | 3178.5405 | h aca ribonucleoprotein complex subunit 2-like protein |
| SEQ ID NO: 738 | Nga02628 | 884.0852 | 809.71058 | phd zn finger-containing protein |
| SEQ ID NO: 739 | Nga01765.02 | 492.6185 | 522.67931 | cystathionine gamma-lyase |
| SEQ ID NO: 740 | Nga02645 | 125.9259 | 88.263506 | ---NA--- |
| SEQ ID NO: 741 | Nga02622 | 847.8261 | 902.36789 | serine threonine phosphatase 2c ptc2 |
| SEQ ID NO: 742 | Nga01764.02 | 4929.6 | 5797.4681 | protein |
| SEQ ID NO: 743 | Nga02624 | 4731.634 | 4153.7501 | endonuclease exonuclease phosphatase family protein |
| SEQ ID NO: 744 | Nga02621 | 596.2644 | 566.00011 | atp-dependent dna helicase pif1 |
| SEQ ID NO: 745 | Nga02631 | 136.4594 | 138.11518 | amino acid permease-associated region |
| SEQ ID NO: 746 | Nga02620 | 4806.452 | 4279.6017 | ubiquinol-cytochrome c reductase subunit 7 |
| SEQ ID NO: 747 | Nga02623.1 | 3232.196 | 3711.7164 | molybdenum cofactor synthesis 1 |
| SEQ ID NO: 748 | Nga02632 | 23.25581 | 56.680846 | ---NA--- |
| SEQ ID NO: 749 | Nga02625 | 1965.352 | 2248.0016 | sulfate permease family |
| SEQ ID NO: 750 | Nga02627 | 142.4522 | 171.96627 | mrna decapping protein 2 |
| SEQ ID NO: 751 | Nga02626 | 379.37 | 430.44395 | lysine-specific demethylase 5c |
| SEQ ID NO: 752 | Nga05087 | 1530.34 | 1172.4792 | predicted protein [Naegleria gruberi] |
| SEQ ID NO: 753 | Nga05088 | 122.3022 | 83.125866 | serine threonine-protein |
| SEQ ID NO: 754 | Nga05084 | 159.5205 | 170.80037 | protein |
| SEQ ID NO: 755 | Nga05083 | 3769.884 | 3502.317 | succinyl- ligase subunit mitochondrial precursor |
| SEQ ID NO: 756 | Nga20444 | 224.2424 | 439.85863 | cytochrome p450 |
| SEQ ID NO: 757 | Nga20671 | 295.082 | 399.5535 | cholesterol 24-hydroxylase-like |
| SEQ ID NO: 758 | Nga05086 | 1375.543 | 1434.1075 | succinic semialdehyde dehydrogenase |
| SEQ ID NO: 759 | Nga20512 | 539.6825 | 406.92915 | protein |
| SEQ ID NO: 760 | Nga05085 | 345.9583 | 330.6975 | isoleucyl-trna synthetase |
| SEQ ID NO: 761 | Nga20051 | 644.2335 | 742.32228 | oxidation resistance 1 |

FIGURE 24 L

| # | Nga model | +N rpkb | -N rpkb | GO |
|---|---|---|---|---|
| SEQ ID NO: 762 | Nga20290 | 445.1754 | 450.15972 | zn-dependent protease with chaperone function |
| SEQ ID NO: 763 | Nga02969 | 1224.479 | 1329.2183 | dnaj-like sec63 |
| SEQ ID NO: 764 | Nga02979 | 272.7273 | 262.60217 | ---NA--- |
| SEQ ID NO: 765 | Nga20152 | 911.1303 | 894.43907 | enoyl- hydratase isomerase |
| SEQ ID NO: 766 | Nga02975 | 922.9885 | 973.0429 | stomatal cytokinesis defective scd1 protein |
| SEQ ID NO: 767 | Nga02968 | 587.3606 | 464.43487 | protein |
| SEQ ID NO: 768 | Nga02967 | 498.5755 | 556.82722 | conserved hypothetical protein [Albugo laibachii Nc14] |
| SEQ ID NO: 769 | Nga02977 | 702.6556 | 881.86655 | ---NA--- |
| SEQ ID NO: 770 | Nga02966 | 1955.729 | 1932.3314 | glutaredoxin |
| SEQ ID NO: 771 | Nga02976 | 204.4025 | 173.7262 | 2-octaprenyl-3-methyl-6-methoxy- -benzoquinol hydroxylase |
| SEQ ID NO: 772 | Nga02971 | 1662.572 | 1669.653 | protein |
| SEQ ID NO: 773 | Nga02974 | 2705.443 | 2519.3645 | gamma-glutamyl phosphate reductase |
| SEQ ID NO: 774 | Nga02980 | 806.4516 | 896.03914 | ---NA--- |
| SEQ ID NO: 775 | Nga02972 | 826.2911 | 1042.5491 | ---NA--- |
| SEQ ID NO: 776 | Nga02993 | 98.76543 | 120.35933 | s-adenosylmethionine:trna ribosyltransferase-isomerase |
| SEQ ID NO: 777 | Nga02995 | 62.5 | 203.10636 | ---NA--- |
| SEQ ID NO: 778 | Nga20080 | 740.9639 | 703.12324 | hypothetical protein Esi_0058_0057 [Ectocarpus siliculosus] |
| SEQ ID NO: 779 | Nga02978 | 116.6667 | 117.35034 | ---NA--- |
| SEQ ID NO: 780 | Nga02970 | 4316.161 | 4561.4488 | leucine rich repeat protein |
| SEQ ID NO: 781 | Nga02973 | 1285.761 | 1224.7103 | ccr4-not transcription complex subunit 3 |
| SEQ ID NO: 782 | Nga03007 | 1712.928 | 1896.6891 | ---NA--- |
| SEQ ID NO: 783 | Nga01574.02 | 1614.892 | 1529.24 | kazal-type serine protease inhibitor domain |
| SEQ ID NO: 784 | Nga03001 | 1710.496 | 1762.9101 | protein binding protein |
| SEQ ID NO: 785 | Nga03003 | 312.2711 | 293.62385 | ---NA--- |
| SEQ ID NO: 786 | Nga21166.1 | 195.7295 | 231.2955 | aec family transporter: auxin efflux |
| SEQ ID NO: 787 | Nga01578.02 | 240.8027 | 119.55425 | auxin efflux carrier-like protein |
| SEQ ID NO: 788 | Nga03008 | 593.9902 | 585.90012 | ---NA--- |
| SEQ ID NO: 789 | Nga03006 | 298.6279 | 334.84956 | ---NA--- |
| SEQ ID NO: 790 | Nga03002 | 956.1875 | 1042.852 | ---NA--- |
| SEQ ID NO: 791 | Nga03000 | 3461.353 | 2902.5785 | ---NA--- |
| SEQ ID NO: 792 | Nga02998 | 376.3838 | 331.76538 | protein |
| SEQ ID NO: 793 | Nga01575.02 | 767.9924 | 915.00443 | tumor protein p53 inducible protein 3 |
| SEQ ID NO: 794 | Nga02997 | 1074.631 | 929.28665 | coatomer subunit beta |
| SEQ ID NO: 795 | Nga01577.02 | 349.4624 | 423.68424 | ---NA--- |
| SEQ ID NO: 796 | Nga03377 | 318.4524 | 361.07798 | hypothetical protein AURANDRAFT_63220 [Aureococcus anophagefferens] |
| SEQ ID NO: 797 | Nga00844.02 | 102.0408 | 51.582569 | ---NA--- |
| SEQ ID NO: 798 | Nga03354 | 2333.971 | 2325.9497 | homoaconitate hydratase family protein |
| SEQ ID NO: 799 | Nga03353.1 | 115.1762 | 79.627969 | insulin-degrading enzyme |
| SEQ ID NO: 800 | Nga03355 | 537.2168 | 788.76258 | vitamin k epoxide reductase family |
| SEQ ID NO: 801 | Nga03357 | 16.85393 | 10.14264 | sperm associated antigen 1 |
| SEQ ID NO: 802 | Nga03352 | 147.6744 | 167.52339 | major facilitator superfamily |
| SEQ ID NO: 803 | Nga00841.02 | 1149.094 | 1359.2105 | inorganic pyrophosphatase |
| SEQ ID NO: 804 | Nga03125.01 | 120.2186 | 139.10381 | ---NA--- |
| SEQ ID NO: 805 | Nga20189.1 | 117.338 | 185.91406 | conserved unknown protein [Ectocarpus siliculosus] |
| SEQ ID NO: 806 | Nga03119 | 3781.176 | 3466.3486 | expressed unknown protein [Ectocarpus siliculosus] |
| SEQ ID NO: 807 | Nga03120 | 437.4461 | 426.1904 | syntaxin-like protein |
| SEQ ID NO: 808 | Nga03122 | 1355.675 | 1270.0652 | dcp1-like decapping family protein |
| SEQ ID NO: 809 | Nga03124 | 7230.667 | 6512.4025 | thioredoxin |
| SEQ ID NO: 810 | Nga03117 | 3725.264 | 3056.1557 | protein |
| SEQ ID NO: 811 | Nga03118 | 2968.661 | 1677.0066 | peptidase membrane alanine aminopeptidase |
| SEQ ID NO: 812 | Nga03116 | 15449.28 | 7019.2164 | light-harvesting protein |
| SEQ ID NO: 813 | Nga20975 | 2033.856 | 2185.2523 | metallo-beta-lactamase family protein |
| SEQ ID NO: 814 | Nga21152 | 1194.376 | 1150.4321 | short-chain dehydrogenase reductase family protein |
| SEQ ID NO: 815 | Nga20056 | 164.859 | 160.56613 | n-acetylglucosaminyltransferase-like protein |
| SEQ ID NO: 816 | Nga03127 | 7677.5 | 7539.3082 | ---NA--- |
| SEQ ID NO: 817 | Nga20113.1 | 756.9767 | 779.67652 | transcription initiation factor tfiid subunit |
| SEQ ID NO: 818 | Nga03121 | 367.1875 | 271.74879 | dhhc zinc finger domain containing protein |
| SEQ ID NO: 819 | Nga03128 | 66.66667 | 61.899082 | ---NA--- |
| SEQ ID NO: 820 | Nga20750 | 237.7688 | 247.73512 | short-chain dehydrogenase reductase sdr |
| SEQ ID NO: 821 | Nga03126.01 | 9669.355 | 7501.5198 | protein |
| SEQ ID NO: 822 | Nga20990 | 432.8358 | 436.52711 | aerobic respiration control sensor protein |
| SEQ ID NO: 823 | Nga20941 | 342.437 | 416.45338 | aminoadipate-semialdehyde dehydrogenase-phosphopantetheinyl transferase |

FIGURE 24 M

| # | Nga model | +N rpkb | -N rpkb | GO |
|---|---|---|---|---|
| SEQ ID NO: 824 | Nga02551 | 761.924 | 813.95792 | ---NA--- |
| SEQ ID NO: 825 | Nga21222 | 239.3443 | 251.45234 | mitochondrial protein 18 kda |
| SEQ ID NO: 826 | Nga02564.2 | 844.6111 | 826.95277 | protein |
| SEQ ID NO: 827 | Nga02552 | 1049.405 | 1182.3404 | fam49 family protein |
| SEQ ID NO: 828 | Nga02546 | 553.2915 | 516.14909 | ohcu decarboxylase |
| SEQ ID NO: 829 | Nga20070 | 406.4039 | 344.71386 | conserved oligomeric golgi complex subunit 2 |
| SEQ ID NO: 830 | Nga06481.2 | 915.6985 | 913.82738 | protein |
| SEQ ID NO: 831 | Nga20681 | 609.0014 | 536.2846 | component of oligomeric golgi complex 2 |
| SEQ ID NO: 832 | Nga02550 | 902.4 | 724.46686 | ---NA--- |
| SEQ ID NO: 833 | Nga02554 | 1555.27 | 1484.2254 | tetratricopeptide repeat family |
| SEQ ID NO: 834 | Nga02547.01 | 1214.516 | 1151.3729 | 26s proteasome non-atpase regulatory subunit 2 |
| SEQ ID NO: 835 | Nga02549 | 7600 | 6319.0374 | voltage-dependent anion-selective channel protein 2 |
| SEQ ID NO: 836 | Nga02548.01 | 817.3913 | 679.86089 | peroxisomal membrane 22 kda (mpv17 pmp22) family protein |
| SEQ ID NO: 837 | Nga20978.1 | 205.2023 | 219.15138 | mate efflux multi antimicrobial extrusion family |
| SEQ ID NO: 838 | Nga21293.1 | 263.9692 | 265.06881 | ---NA--- |
| SEQ ID NO: 839 | Nga20832.1 | 327.6451 | 223.67117 | multidrug oligosaccharidyl-lipid polysaccharide flippase superfamily |
| SEQ ID NO: 840 | Nga02553 | 3816.801 | 3283.5831 | integral membrane protein |
| SEQ ID NO: 841 | Nga02695 | 303.6702 | 386.13015 | protein |
| SEQ ID NO: 842 | Nga02696.01 | 1319.672 | 1235.2862 | hypothetical protein Dole_0419 [Desulfococcus oleovorans Hxd3] |
| SEQ ID NO: 843 | Nga02698 | 1454.075 | 1396.4329 | protein |
| SEQ ID NO: 844 | Nga02700.01 | 1149.425 | 1155.1728 | violaxanthin de-epoxidase |
| SEQ ID NO: 845 | Nga02702 | 368.9205 | 291.04684 | ---NA--- |
| SEQ ID NO: 846 | Nga02701 | 434.4942 | 388.9223 | myo inositol monophosphatase |
| SEQ ID NO: 847 | Nga20690 | 776.9857 | 1081.0278 | set domain protein |
| SEQ ID NO: 848 | Nga20033 | 1092.025 | 1265.3236 | set domain-containing protein 3 |
| SEQ ID NO: 849 | Nga02703 | 833.0658 | 814.30909 | solute carrier family member b2 |
| SEQ ID NO: 850 | Nga02699 | 393.5018 | 348.04267 | expressed unknown protein [Ectocarpus siliculosus] |
| SEQ ID NO: 851 | Nga21139.1 | 113.253 | 107.01829 | pot1 protection of telomeres 1 homolog |
| SEQ ID NO: 852 | Nga02320.02 | 509.7907 | 517.11438 | duf1688 domain-containing protein |
| SEQ ID NO: 853 | Nga02705 | 185.654 | 207.20087 | transcription factor |
| SEQ ID NO: 854 | Nga20944.1 | 3347.214 | 3327.7288 | dna-directed rna polymerase iii subunit rpc10 |
| SEQ ID NO: 855 | Nga20568 | 514.8438 | 527.23027 | oxidoreductase domain protein |
| SEQ ID NO: 856 | Nga02697 | 489.9598 | 514.20985 | eukaryotic translation initiation factor 4e member 2 |
| SEQ ID NO: 857 | Nga02704 | 324.9476 | 304.30471 | ---NA--- |
| SEQ ID NO: 858 | Nga03236.02 | 290.8257 | 319.00743 | ---NA--- |
| SEQ ID NO: 859 | Nga20853 | 1055.085 | 1767.1401 | breast cancer 2 like |
| SEQ ID NO: 860 | Nga03233.2 | 466.9269 | 514.95311 | blue cheese |
| SEQ ID NO: 861 | Nga03223.2 | 2371.736 | 2031.6876 | ---NA--- |
| SEQ ID NO: 862 | Nga05325.1 | 974.0562 | 1018.3058 | plastid atp adp translocase |
| SEQ ID NO: 863 | Nga20719.1 | 255.137 | 341.29289 | coiled-coil domain containing 76 |
| SEQ ID NO: 864 | Nga03228.02 | 227.8594 | 231.39844 | calcium-dependent protein |
| SEQ ID NO: 865 | Nga05323.1 | 876.5432 | 1084.5713 | protein |
| SEQ ID NO: 866 | Nga03225.02 | 843.5606 | 1355.2734 | nadph--cytochrome p450 reductase |
| SEQ ID NO: 867 | Nga05327 | 4.504505 | 34.156025 | ---NA--- |
| SEQ ID NO: 868 | Nga21130 | 230.6397 | 187.83349 | protein |
| SEQ ID NO: 869 | Nga05337 | 271.0623 | 190.45871 | ---NA--- |
| SEQ ID NO: 870 | Nga04345.02 | 633.4215 | 637.85789 | amine oxidase |
| SEQ ID NO: 871 | Nga05348 | 63.61323 | 115.76546 | ---NA--- |
| SEQ ID NO: 872 | Nga05339 | 3347.973 | 2995.7274 | beta-lactamase |
| SEQ ID NO: 873 | Nga20320 | 420.2335 | 356.16058 | nuclease domain containing protein |
| SEQ ID NO: 874 | Nga05341 | 451.6765 | 519.18313 | ---NA--- |
| SEQ ID NO: 875 | Nga03059 | 437.8109 | 420.71872 | protein |
| SEQ ID NO: 876 | Nga03047 | 62.7763 | 72.790256 | protein |
| SEQ ID NO: 877 | Nga03051.01 | 599.3512 | 581.59032 | sentrin-specific protease 8 |
| SEQ ID NO: 878 | Nga03052 | 202.8302 | 163.50701 | uncharacterized protein |
| SEQ ID NO: 879 | Nga03061 | 60.27397 | 84.086653 | ---NA--- |
| SEQ ID NO: 880 | Nga03057 | 1445.333 | 1458.755 | iron-sulfur cluster assembly 2 mitochondrial-like |
| SEQ ID NO: 881 | Nga03062 | 60.60606 | 82.063177 | ---NA--- |
| SEQ ID NO: 882 | Nga03050 | 1356.15 | 1422.1066 | aldo keto reductase family protein |
| SEQ ID NO: 883 | Nga03053 | 323.5816 | 277.53068 | peroxisomal acyl-coenzyme a oxidase 1 |
| SEQ ID NO: 884 | Nga03046 | 587.5262 | 637.27993 | protein |
| SEQ ID NO: 885 | Nga03045.01 | 422.5352 | 411.93403 | proteasome subunit alpha |
| SEQ ID NO: 886 | Nga03058.01 | 293.4473 | 271.58002 | transmembrane protein 144 |
| SEQ ID NO: 887 | Nga03049.1 | 1050.495 | 1231.2402 | iron-sulfur cluster scaffold protein nfu-like protein |

FIGURE 24 N

| # | Nga model | +N rpkb | -N rpkb | GO |
|---|---|---|---|---|
| SEQ ID NO: 888 | Nga03055 | 650.6922 | 685.24064 | tim21-like mitochondrial precursor |
| SEQ ID NO: 889 | Nga03056 | 354.8387 | 336.61786 | tbc1 domain member 20 |
| SEQ ID NO: 890 | Nga03044 | 506.2657 | 559.26364 | chaperone protein dnaj |
| SEQ ID NO: 891 | Nga03060 | 282.2086 | 299.05231 | atp-binding cassette superfamily |
| SEQ ID NO: 892 | Nga03048 | 278.8314 | 283.16213 | protein |
| SEQ ID NO: 893 | Nga03054 | 255.7078 | 206.09474 | soluble nsf attachment protein receptor |
| SEQ ID NO: 894 | Nga00357.01 | 1129.63 | 1157.8567 | dihydrolipoyllysine-residue acetyltransferase component of pyruvate dehydrogenase mitochondrial |
| SEQ ID NO: 895 | Nga00372 | 34.52855 | 40.279615 | ---NA--- |
| SEQ ID NO: 896 | Nga00371 | 112.2807 | 193.84186 | conserved hypothetical protein [Phytophthora infestans T30-4] |
| SEQ ID NO: 897 | Nga00351.01 | 7803.557 | 7858.4813 | atp synthase gamma |
| SEQ ID NO: 898 | Nga00389.01 | 155.303 | 164.12635 | eukaryotic translation initiation factor 2-alpha kinase 1 |
| SEQ ID NO: 899 | Nga00368.01 | 282.2528 | 304.32702 | eukaryotic translation initiation factor 2-alpha kinase 1 |
| SEQ ID NO: 900 | Nga00367 | 675.6453 | 686.89919 | malate dehydrogenase |
| SEQ ID NO: 901 | Nga00353 | 758.1428 | 842.26506 | phosphatidate cytidylyltransferase |
| SEQ ID NO: 902 | Nga00390.01 | 251.7986 | 311.722 | ---NA--- |
| SEQ ID NO: 903 | Nga00362 | 903.0934 | 1018.6092 | atp-dependent clp protease atp-binding subunit |
| SEQ ID NO: 904 | Nga20758 | 163.0435 | 164.83995 | ---NA--- |
| SEQ ID NO: 905 | Nga00358 | 491.8191 | 516.42144 | pheromone processing carboxypeptidase |
| SEQ ID NO: 906 | Nga00352 | 735.6882 | 684.77273 | protein |
| SEQ ID NO: 907 | Nga00365 | 347.032 | 401.88474 | serine protease family s09x |
| SEQ ID NO: 908 | Nga00359 | 854.8535 | 919.55848 | protein |
| SEQ ID NO: 909 | Nga00369 | 993.5691 | 1033.31 | carbon-nitrogen family protein |
| SEQ ID NO: 910 | Nga00363 | 230.198 | 214.50177 | ---NA--- |
| SEQ ID NO: 911 | Nga00355 | 531.8163 | 561.47398 | a chain crystal structure of the protein bh0493 from bacillus halodurans c-125 complexed with zn |
| SEQ ID NO: 912 | Nga00356 | 827.5862 | 816.42755 | peptidyl-prolyl cis-trans isomerase |
| SEQ ID NO: 913 | Nga00364 | 470.8141 | 441.77974 | protein |
| SEQ ID NO: 914 | Nga20736 | 465.1163 | 577.30491 | 50s ribosomal protein l27 |
| SEQ ID NO: 915 | Nga00366 | 597.2716 | 621.92791 | tha domain |
| SEQ ID NO: 916 | Nga00370 | 166.1631 | 199.62922 | ---NA--- |
| SEQ ID NO: 917 | Nga00354 | 281.4313 | 423.76028 | set and zf-mynd domain-containing protein |
| SEQ ID NO: 918 | Nga00361 | 555.4342 | 541.91277 | glycosyl group 1 |
| SEQ ID NO: 919 | Nga00360 | 847.4702 | 886.5754 | eukaryotic translation initiation factor 5 |
| SEQ ID NO: 920 | Nga02480 | 1609.689 | 2169.4384 | ---NA--- |
| SEQ ID NO: 921 | Nga02482.01 | 461.488 | 468.30074 | pre-mrna-splicing factor syf1 |
| SEQ ID NO: 922 | Nga02486.1 | 775.3004 | 706.73992 | atp-binding sub-family c (cftr mrp) member 3 |
| SEQ ID NO: 923 | Nga02485.1 | 1718.162 | 1876.166 | protein |
| SEQ ID NO: 924 | Nga02328.02 | 304.9645 | 320.61676 | signal recognition particle 72kda |
| SEQ ID NO: 925 | Nga02483.01 | 1542.857 | 1293.6908 | peptide methionine sulfoxide reductase |
| SEQ ID NO: 926 | Nga02484.1 | 8670.943 | 10558.3 | Aardvark [Ectocarpus siliculosus] |
| SEQ ID NO: 927 | Nga02593 | 690.8345 | 637.19644 | trafficking protein particle complex subunit 3 |
| SEQ ID NO: 928 | Nga02604 | 2590.909 | 2356.6614 | glutamyl-trna reductase |
| SEQ ID NO: 929 | Nga02600 | 419.7012 | 519.36567 | tkl family protein kinase |
| SEQ ID NO: 930 | Nga02605 | 3395.317 | 3428.7488 | isoform c |
| SEQ ID NO: 931 | Nga02603 | 6181.495 | 5675.7347 | ---NA--- |
| SEQ ID NO: 932 | Nga02599 | 423.3668 | 449.53301 | two-pore calcium channel |
| SEQ ID NO: 933 | Nga02596 | 285.7143 | 257.91284 | dnaj homolog subfamily b member 12 |
| SEQ ID NO: 934 | Nga02597.1 | 555.1331 | 626.05156 | u2 small nuclear ribonucleoprotein auxiliary factor u2af |
| SEQ ID NO: 935 | Nga02595 | 49.46237 | 62.315071 | dna polymerase epsilon catalytic subunit a |
| SEQ ID NO: 936 | Nga02607 | 374.2489 | 356.11897 | ---NA--- |
| SEQ ID NO: 937 | Nga02592.01 | 324.4253 | 366.05837 | thiamine monophosphate synthase |
| SEQ ID NO: 938 | Nga02598 | 2450.573 | 2299.5796 | si: (novel protein vertebrate udp-galactose transporters) |
| SEQ ID NO: 939 | Nga02601.01 | 1569.873 | 1348.6361 | protein |
| SEQ ID NO: 940 | Nga06487.2 | 139.5349 | 178.1398 | transportin 1 |
| SEQ ID NO: 941 | Nga21191 | 254.9575 | 300.72784 | mitochondrial inner membrane protein oxa1l-like |
| SEQ ID NO: 942 | Nga02606 | 87.11303 | 87.344997 | protein |
| SEQ ID NO: 943 | Nga02602 | 282.1782 | 422.30036 | dead box atp-dependent rna helicase |
| SEQ ID NO: 944 | Nga00539 | 997.8669 | 988.03505 | digalactosyldiacylglycerol synthase 1 |
| SEQ ID NO: 945 | Nga00564 | 1872.2 | 1631.2732 | hsp90-like protein |
| SEQ ID NO: 946 | Nga00556 | 1823.432 | 1410.3491 | nuclear transport |
| SEQ ID NO: 947 | Nga20874 | 423.9195 | 445.7357 | casein kinase 2 subunit beta |
| SEQ ID NO: 948 | Nga20782 | 1705.882 | 1532.685 | 50s ribosomal protein l9 |
| SEQ ID NO: 949 | Nga00537 | 510.4432 | 554.76882 | protein |

FIGURE 24 O

| # | Nga model | +N rpkb | -N rpkb | GO |
|---|---|---|---|---|
| SEQ ID NO: 950 | Nga00563 | 2255.952 | 1841.9276 | peptide methionine sulfoxide reductase b5 |
| SEQ ID NO: 951 | Nga20573 | 404.8193 | 339.32629 | uncharacterized protein |
| SEQ ID NO: 952 | Nga20405 | 311.2339 | 383.02195 | uncharacterized protein |
| SEQ ID NO: 953 | Nga00568 | 316.8142 | 285.667 | cdc2-like protein kinase |
| SEQ ID NO: 954 | Nga21265 | 154.5455 | 423.446 | rme1-like gtpase atpase without a c-terminal eh domain |
| SEQ ID NO: 955 | Nga00569 | 355.0725 | 382.01004 | rme1-like gtpase atpase without a c-terminal eh domain |
| SEQ ID NO: 956 | Nga00586.2 | 3477.536 | 3371.7408 | nucleoredoxin |
| SEQ ID NO: 957 | Nga00565 | 246.6509 | 222.7928 | transcriptional sir2 family |
| SEQ ID NO: 958 | Nga00557 | 847.185 | 1039.6723 | glycyl-trna synthetase |
| SEQ ID NO: 959 | Nga20199 | 1761.337 | 1789.0164 | mrna (2 -o-methyladenosine-n -)- |
| SEQ ID NO: 960 | Nga00594 | 572.6817 | 635.28006 | wd repeat domain 18 |
| SEQ ID NO: 961 | Nga00572 | 612.6533 | 561.54736 | protein |
| SEQ ID NO: 962 | Nga00535 | 827.0295 | 750.96892 | histone-lysine n-methyltransferase |
| SEQ ID NO: 963 | Nga00560 | 531.4201 | 569.7564 | tetratricopeptide repeat protein 30a |
| SEQ ID NO: 964 | Nga00538 | 1563.501 | 1539.8801 | small nuclear ribonucleoprotein associated protein b |
| SEQ ID NO: 965 | Nga20185 | 464.5197 | 584.18948 | hnrnp arginine n-methyltransferase |
| SEQ ID NO: 966 | Nga00558 | 12029.89 | 12677.572 | ribosomal protein s16 |
| SEQ ID NO: 967 | Nga00570 | 142.7713 | 143.91025 | retrograde transporter |
| SEQ ID NO: 968 | Nga00596 | 165.0485 | 192.80863 | rna helicase rnase |
| SEQ ID NO: 969 | Nga20986 | 255.3191 | 237.06032 | wd40 repeat domain-containing protein |
| SEQ ID NO: 970 | Nga00541 | 169.8718 | 190.9547 | neural precursor cell developmentally down-regulated 1 |
| SEQ ID NO: 971 | Nga00595 | 289.1414 | 298.16288 | dicer-like protein 2 |
| SEQ ID NO: 972 | Nga00562 | 691.5094 | 805.27202 | 5 -3 exoribonuclease 2 |
| SEQ ID NO: 973 | Nga00573 | 1462.664 | 1313.3899 | taurine catabolism dioxygenase |
| SEQ ID NO: 974 | Nga00559 | 764.2105 | 1000.376 | ---NA--- |
| SEQ ID NO: 975 | Nga20178 | 475.1773 | 433.10151 | dicer-1 |
| SEQ ID NO: 976 | Nga00536 | 923.2323 | 1088.7048 | ---NA--- |
| SEQ ID NO: 977 | Nga00561 | 3143.882 | 2544.8223 | glycosyl group 1 family protein |
| SEQ ID NO: 978 | Nga00542 | 369.5324 | 356.17647 | ---NA--- |
| SEQ ID NO: 979 | Nga00571 | 156.4356 | 218.79181 | ---NA--- |
| SEQ ID NO: 980 | Nga03381 | 450.0805 | 394.2204 | trna-dihydrouridine synthase 1-like |
| SEQ ID NO: 981 | Nga03384 | 729.8637 | 710.07528 | cytosolic iron-sulfur protein assembly 1 homolog ( cerevisiae) |
| SEQ ID NO: 982 | Nga03382 | 906.0119 | 868.60503 | ---NA--- |
| SEQ ID NO: 983 | Nga20887 | 197.8346 | 215.36738 | helicase mov-10 |
| SEQ ID NO: 984 | Nga03383 | 1518.848 | 1790.1717 | rna helicase |
| SEQ ID NO: 985 | Nga03385 | 4139.18 | 3538.8396 | conserved unknown protein [Ectocarpus siliculosus] |
| SEQ ID NO: 986 | Nga03380 | 1726.364 | 1951.2648 | protein |
| SEQ ID NO: 987 | Nga03388 | 388.6463 | 373.69206 | ---NA--- |
| SEQ ID NO: 988 | Nga03379.01 | 1003.876 | 948.87934 | conserved hypothetical protein [Phytophthora infestans T30-4] |
| SEQ ID NO: 989 | Nga03386 | 523.0927 | 627.40851 | protein |
| SEQ ID NO: 990 | Nga03387 | 4681.694 | 4936.7055 | ---NA--- |
| SEQ ID NO: 991 | Nga20108 | 248.2447 | 344.41841 | eukaryotic translation initiation factor 4b |
| SEQ ID NO: 992 | Nga03389 | 60.34483 | 102.72046 | ---NA--- |
| SEQ ID NO: 993 | Nga01429.02 | 3957.888 | 4347.0705 | xylulose kinase |
| SEQ ID NO: 994 | Nga02900 | 487.8517 | 518.06091 | ribosomal protein l11 methyltransferase |
| SEQ ID NO: 995 | Nga02908.1 | 1334.945 | 1391.3009 | protein |
| SEQ ID NO: 996 | Nga01433.02 | 155.3154 | 150.8197 | ---NA--- |
| SEQ ID NO: 997 | Nga01432.02 | 137.793 | 204.38376 | amidophosphoribosyltransferase |
| SEQ ID NO: 998 | Nga02906 | 459.6062 | 421.38021 | arabinose 5-phosphate isomerase |
| SEQ ID NO: 999 | Nga01427.02 | 422.5513 | 474.99438 | mitochondrial inner membrane protease atp23 homolog |
| SEQ ID NO: 1000 | Nga01426.02 | 551.8035 | 429.80196 | udp-glucose 4-epimerase |
| SEQ ID NO: 1001 | Nga01425.02 | 1500.775 | 1598.8197 | protein |
| SEQ ID NO: 1002 | Nga01431.02 | 8.438819 | 7.3129718 | protein |
| SEQ ID NO: 1003 | Nga02903 | 6260.047 | 7722.63 | cytochrome c1 |
| SEQ ID NO: 1004 | Nga01428.02 | 796.5368 | 725.67295 | snf7 family protein |
| SEQ ID NO: 1005 | Nga02904 | 1660.081 | 1686.311 | calcium-dependent protein kinase |
| SEQ ID NO: 1006 | Nga04498.02 | 165.4135 | 222.61951 | conserved hypothetical protein [Phytophthora infestans T30-4] |
| SEQ ID NO: 1007 | Nga06724 | 513.5135 | 576.33065 | lipase class 3 |
| SEQ ID NO: 1008 | Nga06728 | 719.0476 | 964.59403 | serine threonine protein kinase |
| SEQ ID NO: 1009 | Nga06729 | 1141.35 | 1285.1024 | conserved unknown protein [Ectocarpus siliculosus] |
| SEQ ID NO: 1010 | Nga06726 | 2934.808 | 2558.6515 | malate synthase |
| SEQ ID NO: 1011 | Nga06725 | 1471.335 | 1440.2214 | atp-dependent rna helicase |
| SEQ ID NO: 1012 | Nga20336 | 552.4862 | 560.56858 | conserved plasmodium protein |
| SEQ ID NO: 1013 | Nga20947 | 539.5778 | 477.30889 | mitochondrial protein |

FIGURE 24 P

| # | Nga model | +N rpkb | -N rpkb | GO |
|---|---|---|---|---|
| SEQ ID NO: 1014 | Nga20205 | 500.4292 | 577.41483 | protein memo1 |
| SEQ ID NO: 1015 | Nga20380 | 277.4451 | 337.2944 | ---NA--- |
| SEQ ID NO: 1016 | Nga21193 | 459.4595 | 653.84391 | ---NA--- |
| SEQ ID NO: 1017 | Nga20064 | 2607.602 | 2232.0582 | conserved unknown protein [Ectocarpus siliculosus] |
| SEQ ID NO: 1018 | Nga20046 | 560.0248 | 658.25231 | imidazoleglycerol-phosphate dehydratase |
| SEQ ID NO: 1019 | Nga21189 | 122.1591 | 187.71952 | ---NA--- |
| SEQ ID NO: 1020 | Nga21068.1 | 156.0976 | 195.51052 | glutamate carboxypeptidase 2 |
| SEQ ID NO: 1021 | Nga20401.1 | 232.8767 | 204.03379 | glutamate carboxypeptidase |
| SEQ ID NO: 1022 | Nga20577.1 | 202.7027 | 146.38296 | ---NA--- |
| SEQ ID NO: 1023 | Nga06109 | 1195.153 | 1418.9812 | ---NA--- |
| SEQ ID NO: 1024 | Nga06113 | 556.7568 | 543.24345 | hypothetical protein RHA1_ro04171 [Rhodococcus jostii RHA1] |
| SEQ ID NO: 1025 | Nga06116 | 577.6892 | 565.35317 | ---NA--- |
| SEQ ID NO: 1026 | Nga06114 | 196.7871 | 181.26405 | nad dependent steroid dehydrogenase-like |
| SEQ ID NO: 1027 | Nga06115 | 250.1005 | 246.96166 | c2h2-type zinc finger-containing protein |
| SEQ ID NO: 1028 | Nga06111 | 6255.613 | 6012.3537 | protein |
| SEQ ID NO: 1029 | Nga06110 | 746.8847 | 710.345 | histidyl-trna synthetase |
| SEQ ID NO: 1030 | Nga03152.1 | 319.5793 | 293.59496 | metallo-beta-lactamase domain-containing protein |
| SEQ ID NO: 1031 | Nga03154 | 88 | 87.019793 | protein |
| SEQ ID NO: 1032 | Nga03144 | 966.4778 | 1127.2179 | ---NA--- |
| SEQ ID NO: 1033 | Nga03147 | 353.6836 | 370.08638 | ppgpp synthetase |
| SEQ ID NO: 1034 | Nga03145 | 358.9744 | 342.56116 | vacuolar amino acid |
| SEQ ID NO: 1035 | Nga03157 | 360.4336 | 299.43052 | ---NA--- |
| SEQ ID NO: 1036 | Nga03153 | 237.6812 | 345.37894 | trna (guanine-n -)-methyltransferase |
| SEQ ID NO: 1037 | Nga21223 | 313.2184 | 289.48493 | thioesterase family protein |
| SEQ ID NO: 1038 | Nga03155 | 289.5377 | 271.46739 | protein |
| SEQ ID NO: 1039 | Nga21154 | 581.1733 | 610.33509 | mediator of rna polymerase ii transcription subunit 31 |
| SEQ ID NO: 1040 | Nga03148 | 42.64871 | 52.277283 | kinesin-like protein |
| SEQ ID NO: 1041 | Nga03150 | 131.6726 | 187.60635 | toxin biosynthesis |
| SEQ ID NO: 1042 | Nga03151 | 691.2669 | 767.45726 | dna-3-methyladenine glycosylase |
| SEQ ID NO: 1043 | Nga03156 | 332.3782 | 364.1818 | lysine decarboxylase |
| SEQ ID NO: 1044 | Nga03149 | 46.2204 | 67.82544 | protein |
| SEQ ID NO: 1045 | Nga20073 | 668.5117 | 702.83629 | abl-philin partial |
| SEQ ID NO: 1046 | Nga01458.02 | 7968.763 | 9166.4674 | delta-9 acyl-desaturase |
| SEQ ID NO: 1047 | Nga01459.02 | 828.3642 | 775.11018 | methionine aminopeptidase |
| SEQ ID NO: 1048 | Nga21224.1 | 93.61702 | 69.142592 | conserved unknown protein [Ectocarpus siliculosus] |
| SEQ ID NO: 1049 | Nga01460.02 | 97.11286 | 36.960738 | riken cdna 6720467c03 isoform cra_a |
| SEQ ID NO: 1050 | Nga05263 | 160.3053 | 140.57234 | ---NA--- |
| SEQ ID NO: 1051 | Nga05276 | 195.1477 | 164.54186 | protein |
| SEQ ID NO: 1052 | Nga20764.1 | 329.5924 | 273.84768 | tubulin tyrosine ligase |
| SEQ ID NO: 1053 | Nga05260 | 675.3103 | 650.83683 | nicotinamide nucleotide transhydrogenase |
| SEQ ID NO: 1054 | Nga05261 | 915.1751 | 842.56212 | protein |
| SEQ ID NO: 1055 | Nga04994.02 | 756.4935 | 695.19235 | stromal cell-derived factor 2 |
| SEQ ID NO: 1056 | Nga05636 | 2555.225 | 2617.1447 | ppgpp synthetase |
| SEQ ID NO: 1057 | Nga05641 | 235.5123 | 349.5275 | mucolipin-like protein |
| SEQ ID NO: 1058 | Nga04806.02 | 6873.897 | 6980.2338 | 60s ribosomal protein l39 |
| SEQ ID NO: 1059 | Nga05635 | 1593.084 | 2002.2593 | pkd domain-containing protein |
| SEQ ID NO: 1060 | Nga20957.1 | 523.0461 | 366.86681 | cytochrome c oxidase assembly protein cox19 |
| SEQ ID NO: 1061 | Nga20109.1 | 316.7128 | 290.06264 | folate-binding protein |
| SEQ ID NO: 1062 | Nga05640 | 124.5902 | 149.16664 | ---NA--- |
| SEQ ID NO: 1063 | Nga04995.02 | 2294.228 | 2284.0334 | nad-dependent epimerase dehydratase |
| SEQ ID NO: 1064 | Nga04996.02 | 1387.654 | 1414.8908 | ntp pyrophosphohydrolase |
| SEQ ID NO: 1065 | Nga02527 | 941.8239 | 1137.7363 | predicted protein [Thalassiosira pseudonana CCMP1335] |
| SEQ ID NO: 1066 | Nga02522 | 1190.734 | 1207.7211 | membrane protein |
| SEQ ID NO: 1067 | Nga02528 | 2026.354 | 1517.7963 | expressed unknown protein [Ectocarpus siliculosus] |
| SEQ ID NO: 1068 | Nga02523 | 407.0568 | 542.54919 | intraflagellar transport protein 72 74 |
| SEQ ID NO: 1069 | Nga02524.01 | 18205.19 | 18242.249 | predicted protein [Phaeodactylum tricornutum CCAP 1055/1] |
| SEQ ID NO: 1070 | Nga02545 | 224.1379 | 219.96705 | ---NA--- |
| SEQ ID NO: 1071 | Nga02526 | 204.1467 | 211.63662 | ---NA--- |
| SEQ ID NO: 1072 | Nga02529 | 74.91857 | 85.858933 | ---NA--- |
| SEQ ID NO: 1073 | Nga02531 | 131.9444 | 180.53899 | ---NA--- |
| SEQ ID NO: 1074 | Nga02530 | 150.6173 | 230.02005 | ubiquitin-specific protease, putative [Phytophthora infestans T30-4] |
| SEQ ID NO: 1075 | Nga02525 | 281.0373 | 343.40447 | dead-box atp-dependent rna helicase 13 |
| SEQ ID NO: 1076 | Nga20966 | 406.8182 | 502.22665 | ubiquitin carboxyl-terminal hydrolase 24 |
| SEQ ID NO: 1077 | Nga05070 | 508.7719 | 459.45217 | 50s ribosomal protein l15 |

FIGURE 24 Q

| # | Nga model | +N rpkb | -N rpkb | GO |
|---|---|---|---|---|
| SEQ ID NO: 1078 | Nga05071 | 661.9965 | 508.41803 | acetylornithine deacetylase |
| SEQ ID NO: 1079 | Nga05072 | 1534.29 | 1215.3988 | anion-transporting atpase |
| SEQ ID NO: 1080 | Nga04814.2 | 297.8036 | 270.10872 | ---NA--- |
| SEQ ID NO: 1081 | Nga05081 | 129.2517 | 162.11664 | subtilisin-like serine peptidase |
| SEQ ID NO: 1082 | Nga05074 | 131.4741 | 93.865889 | n-ethylmaleimide-sensitive factor attachment gamma |
| SEQ ID NO: 1083 | Nga05073 | 318.232 | 293.25118 | ---NA--- |
| SEQ ID NO: 1084 | Nga05056 | 266.6667 | 238.31147 | neuro-oncological ventral antigen 2 |
| SEQ ID NO: 1085 | Nga05053.01 | 3648.168 | 3444.6372 | vacuolar h+ atpase b subunit |
| SEQ ID NO: 1086 | Nga05055 | 502.1699 | 558.74187 | sedoheptulose- -bisphosphatase |
| SEQ ID NO: 1087 | Nga04458.02 | 20072.77 | 23208.969 | inorganic phosphate |
| SEQ ID NO: 1088 | Nga05052 | 2484.892 | 2467.2796 | ---NA--- |
| SEQ ID NO: 1089 | Nga05057 | 24.74527 | 21.286256 | inorganic phosphate |
| SEQ ID NO: 1090 | Nga05620.01 | 2161.398 | 1892.5052 | polyubiquitin-like protein |
| SEQ ID NO: 1091 | Nga05622 | 462.7615 | 599.17794 | trna pseudouridine synthase a |
| SEQ ID NO: 1092 | Nga05623 | 304 | 358.18936 | tata-box binding protein |
| SEQ ID NO: 1093 | Nga05621 | 688.7822 | 747.05789 | crystal protein |
| SEQ ID NO: 1094 | Nga05624 | 6611.679 | 6088.2492 | ribosomal protein s15a |
| SEQ ID NO: 1095 | Nga04451.2 | 984.6697 | 1532.1933 | deah (asp-glu-ala-his) box polypeptide 36 |
| SEQ ID NO: 1096 | Nga06094 | 1360.065 | 1292.4346 | mitotic spindle-associated mmxd complex subunit mip18 |
| SEQ ID NO: 1097 | Nga06098 | 140.4682 | 178.72756 | methyltransferase type 11 |
| SEQ ID NO: 1098 | Nga06096 | 134.3202 | 150.2512 | ctp synthase |
| SEQ ID NO: 1099 | Nga06095 | 1733.026 | 2393.5881 | 6-phosphofructo-2-kinase fructose- -bisphosphatase short form |
| SEQ ID NO: 1100 | Nga06097 | 560.7537 | 611.65061 | protein |
| SEQ ID NO: 1101 | Nga06203 | 161.079 | 189.09633 | protein |
| SEQ ID NO: 1102 | Nga06199 | 358.484 | 406.7777 | pre-mrna-processing protein 40a |
| SEQ ID NO: 1103 | Nga06198 | 343.4685 | 242.75175 | protein |
| SEQ ID NO: 1104 | Nga06204 | 1927.728 | 2155.1764 | ---NA--- |
| SEQ ID NO: 1105 | Nga06200 | 781.1121 | 753.86581 | carrier protein |
| SEQ ID NO: 1106 | Nga06197 | 1064.14 | 1029.9971 | seryl-trna synthetase |
| SEQ ID NO: 1107 | Nga06202 | 1434.806 | 1354.763 | protein |
| SEQ ID NO: 1108 | Nga06201 | 1527.867 | 566.57895 | ---NA--- |
| SEQ ID NO: 1109 | Nga06196 | 272.6406 | 335.60632 | ---NA--- |
| SEQ ID NO: 1110 | Nga04202.02 | 741.7783 | 699.28622 | udp-glucuronate decarboxylase 1 |
| SEQ ID NO: 1111 | Nga04201.02 | 917.2619 | 756.97419 | 3-oxoacyl-(acyl-carrier-protein) synthase 2 |
| SEQ ID NO: 1112 | Nga06687 | 483.7641 | 551.30793 | ---NA--- |
| SEQ ID NO: 1113 | Nga04206.02 | 698.4127 | 747.94724 | ---NA--- |
| SEQ ID NO: 1114 | Nga04203.02 | 23497.08 | 20695.47 | ---NA--- |
| SEQ ID NO: 1115 | Nga06689 | 240.1919 | 265.38161 | exosome component 10 |
| SEQ ID NO: 1116 | Nga06686 | 323.9247 | 324.67899 | protein high chlorophyll fluorescent 107 |
| SEQ ID NO: 1117 | Nga02345.02 | 1162.684 | 1729.2092 | glutamate dehydrogenase |
| SEQ ID NO: 1118 | Nga06372 | 21606.13 | 22502.413 | ---NA--- |
| SEQ ID NO: 1119 | Nga06375.1 | 985.9296 | 1047.8519 | protein |
| SEQ ID NO: 1120 | Nga06376 | 3891.015 | 4130.8012 | tpa_inf: von willebrand factor |
| SEQ ID NO: 1121 | Nga06371 | 2529.624 | 1893.3113 | gdp-mannose -epimerase |
| SEQ ID NO: 1122 | Nga06377 | 148.855 | 184.67347 | ---NA--- |
| SEQ ID NO: 1123 | Nga20771 | 314.4154 | 297.55121 | suppression of tumorigenicity 5 |
| SEQ ID NO: 1124 | Nga06374 | 705.2519 | 565.41749 | ---NA--- |
| SEQ ID NO: 1125 | Nga05670 | 744.1077 | 694.80157 | ---NA--- |
| SEQ ID NO: 1126 | Nga05667 | 560.462 | 484.95324 | protein |
| SEQ ID NO: 1127 | Nga05675 | 90.46625 | 66.335829 | ---NA--- |
| SEQ ID NO: 1128 | Nga05674.01 | 1694.783 | 1273.9773 | light harvesting complex protein |
| SEQ ID NO: 1129 | Nga05669 | 969.5274 | 1081.8866 | cysteine subfamily |
| SEQ ID NO: 1130 | Nga05672 | 479.1224 | 354.94502 | endoplasmic reticulum protein |
| SEQ ID NO: 1131 | Nga01541.2 | 738.3513 | 652.2699 | ---NA--- |
| SEQ ID NO: 1132 | Nga05666.1 | 1267.76 | 1299.2888 | protein |
| SEQ ID NO: 1133 | Nga05687 | 105.0375 | 125.39042 | hypothetical protein (Partial) [Ectocarpus siliculosus] |
| SEQ ID NO: 1134 | Nga01539.2 | 338.326 | 507.73609 | hypothetical protein GLRG_11977 [Glomerella graminicola M1.001] |
| SEQ ID NO: 1135 | Nga05673 | 628.5714 | 394.60665 | nudix (nucleoside diphosphate linked moiety x)-type motif isoform cra_a |
| SEQ ID NO: 1136 | Nga02810 | 981.32 | 914.61097 | protein |
| SEQ ID NO: 1137 | Nga21290.1 | 2242.386 | 1954.7699 | transmembrane protein 222 |
| SEQ ID NO: 1138 | Nga02806 | 504.5045 | 472.86134 | udp-n-acetylglucosamine transporter |
| SEQ ID NO: 1139 | Nga02807 | 400.8547 | 492.5474 | zinc finger mynd domain-containing protein 10 |
| SEQ ID NO: 1140 | Nga02803.01 | 1532.258 | 2007.8153 | x-pro dipeptidyl-peptidase domain-containing protein |

FIGURE 24 R

| # | Nga model | +N rpkb | -N rpkb | GO |
|---|---|---|---|---|
| SEQ ID NO: 1141 | Nga02804 | 1168.84 | 1122.6378 | protein |
| SEQ ID NO: 1142 | Nga02808.01 | 152.0681 | 125.19127 | cysteine synthase |
| SEQ ID NO: 1143 | Nga02809 | 448.9572 | 575.50519 | vesicle-associated membrane protein 4 |
| SEQ ID NO: 1144 | Nga20044.1 | 243.6364 | 319.97064 | protein |
| SEQ ID NO: 1145 | Nga20890 | 399.4823 | 462.6409 | iws1 c-terminus family protein |
| SEQ ID NO: 1146 | Nga20954 | 138.5224 | 175.77543 | atp-dependent rna |
| SEQ ID NO: 1147 | Nga20617 | 859.4164 | 959.68206 | u5 small nuclear ribonucleoprotein 40 kda protein |
| SEQ ID NO: 1148 | Nga21041 | 557.6756 | 405.86042 | bzip transcription factor |
| SEQ ID NO: 1149 | Nga20204 | 170.0913 | 210.21663 | deah (asp-glu-ala-his) box polypeptide 16 |
| SEQ ID NO: 1150 | Nga20197 | 218.1373 | 198.23889 | pre-mrna-splicing factor atp-dependent rna helicase dhx16 |
| SEQ ID NO: 1151 | Nga20933 | 2507.644 | 2549.7885 | pas pac sensor hybrid histidine kinase |
| SEQ ID NO: 1152 | Nga21085 | 16120.79 | 16179.915 | f-type h-atpase beta subunit |
| SEQ ID NO: 1153 | Nga21038 | 685.5576 | 695.09161 | beclin-1-like protein |
| SEQ ID NO: 1154 | Nga20049 | 1594.843 | 2070.0444 | transmembrane and coiled-coil domains 4 |
| SEQ ID NO: 1155 | Nga20078 | 848.8111 | 704.66093 | violaxanthin de-epoxidase |
| SEQ ID NO: 1156 | Nga20799.1 | 224.7765 | 242.10209 | competence-like protein |
| SEQ ID NO: 1157 | Nga21114 | 410.8619 | 358.09386 | protein |
| SEQ ID NO: 1158 | Nga20812 | 553.9247 | 622.15096 | phd zinc finger-containing protein |
| SEQ ID NO: 1159 | Nga20906 | 327.7512 | 308.38478 | ---NA--- |
| SEQ ID NO: 1160 | Nga05829.1 | 946.2366 | 938.39761 | myb-like dna-binding domain containing protein |
| SEQ ID NO: 1161 | Nga05825 | 425.2598 | 386.62187 | ---NA--- |
| SEQ ID NO: 1162 | Nga05826.1 | 245.4268 | 257.04789 | signal recognition particle receptor |
| SEQ ID NO: 1163 | Nga05827 | 935.4866 | 1116.1801 | beta-ketoacyl synthase |
| SEQ ID NO: 1164 | Nga04858.2 | 142.8571 | 152.42417 | endoribonuclease |
| SEQ ID NO: 1165 | Nga04857.02 | 2722.667 | 2415.8524 | signal peptidase complex catalytic subunit sec11a |
| SEQ ID NO: 1166 | Nga05839 | 803.9807 | 1238.7283 | atp-binding cassette |
| SEQ ID NO: 1167 | Nga20872.1 | 585.3081 | 720.01687 | ubiquitin carboxyl-terminal hydrolase 10 |
| SEQ ID NO: 1168 | Nga06401 | 1986.053 | 1589.3474 | pre-mrna-processing factor 17 |
| SEQ ID NO: 1169 | Nga06400 | 283.3333 | 252.75459 | predicted protein [Phaeodactylum tricornutum CCAP 1055/1] |
| SEQ ID NO: 1170 | Nga01885.02 | 3082.192 | 1211.3874 | ---NA--- |
| SEQ ID NO: 1171 | Nga06404 | 977.8963 | 1145.9822 | tryptophanyl-trna synthetase |
| SEQ ID NO: 1172 | Nga06406.1 | 4746.489 | 4117.57 | fatty-acyl |
| SEQ ID NO: 1173 | Nga01884.2 | 524.6727 | 603.25113 | s-adenosyl-l-methionine-dependent methyltransferase domain-containing protein |
| SEQ ID NO: 1174 | Nga06405 | 163.242 | 187.34012 | non-ribosomal peptide synthase |
| SEQ ID NO: 1175 | Nga03329 | 200 | 248.3512 | peroxin 3 |
| SEQ ID NO: 1176 | Nga03326 | 1255.692 | 1327.3252 | seryl-trna synthetase |
| SEQ ID NO: 1177 | Nga03321 | 4297.498 | 4343.5557 | ---NA--- |
| SEQ ID NO: 1178 | Nga03320 | 964.2276 | 1012.7797 | conserved unknown protein [Ectocarpus siliculosus] |
| SEQ ID NO: 1179 | Nga03318 | 475.5678 | 547.95385 | protein |
| SEQ ID NO: 1180 | Nga03330 | 610.2362 | 588.52868 | ---NA--- |
| SEQ ID NO: 1181 | Nga03325 | 591.8367 | 502.5616 | thioredoxin domain containing 9 |
| SEQ ID NO: 1182 | Nga03322.01 | 2959.641 | 2797.9496 | ubiquitin-conjugating enzyme |
| SEQ ID NO: 1183 | Nga03328 | 141.3502 | 107.40927 | dna binding protein |
| SEQ ID NO: 1184 | Nga03317.1 | 646.7331 | 730.55312 | splicing factor subunit 49kda |
| SEQ ID NO: 1185 | Nga03319 | 493.7076 | 494.95297 | protein |
| SEQ ID NO: 1186 | Nga03327 | 50.05688 | 65.314447 | uncharacterized protein |
| SEQ ID NO: 1187 | Nga03324 | 371.7949 | 441.62615 | s-adenosylmethionine mitochondrial carrier protein |
| SEQ ID NO: 1188 | Nga03323 | 1321.357 | 1457.2848 | radical sam cfr family |
| SEQ ID NO: 1189 | Nga05176 | 1786.078 | 1919.108 | atp-dependent clp protease proteolytic subunit |
| SEQ ID NO: 1190 | Nga05177 | 327.8167 | 435.30946 | serine hydroxymethyltransferase |
| SEQ ID NO: 1191 | Nga21108 | 173.3615 | 160.30946 | protein arginine n- |
| SEQ ID NO: 1192 | Nga20154 | 198.3095 | 174.66971 | protein arginine n-methyltransferase 5 |
| SEQ ID NO: 1193 | Nga05179 | 359.7734 | 452.11464 | methionyl-trna formyltransferase |
| SEQ ID NO: 1194 | Nga05181 | 362.5378 | 356.7145 | anaphase-promoting complex subunit 11 |
| SEQ ID NO: 1195 | Nga05175 | 582.3666 | 676.07872 | conserved unknown protein [Ectocarpus siliculosus] |
| SEQ ID NO: 1196 | Nga05178 | 230.9368 | 231.61585 | voltage-gated ion channel superfamily |
| SEQ ID NO: 1197 | Nga05180 | 322.4044 | 366.99729 | ---NA--- |
| SEQ ID NO: 1198 | Nga00607 | 1118.23 | 1343.6321 | ferredoxin-dependent glutamate synthase |
| SEQ ID NO: 1199 | Nga00603 | 1680.412 | 1756.998 | mitochondrial import inner membrane translocase subunit tim23 |
| SEQ ID NO: 1200 | Nga00608 | 747.0862 | 761.29378 | subfamily member 9 |
| SEQ ID NO: 1201 | Nga00617.01 | 240.0794 | 208.47955 | hexose-6-phosphate dehydrogenase (glucose 1-dehydrogenase) |
| SEQ ID NO: 1202 | Nga21227.1 | 293.5636 | 255.07864 | hexose-6-phosphate dehydrogenase (glucose 1-dehydrogenase) |
| SEQ ID NO: 1203 | Nga00609 | 563.7025 | 540.77201 | folate biopterin transporter |

FIGURE 24 S

| # | Nga model | +N rpkb | -N rpkb | GO |
|---|---|---|---|---|
| SEQ ID NO: 1204 | Nga00601.01 | 1153.053 | 973.70791 | protein |
| SEQ ID NO: 1205 | Nga00619 | 434.903 | 414.08943 | hypothetical protein AURANDRAFT_66563 [Aureococcus anophagefferens] |
| SEQ ID NO: 1206 | Nga00627 | 1028.249 | 1389.2322 | ---NA--- |
| SEQ ID NO: 1207 | Nga00602 | 2057.908 | 1588.8055 | short-chain dehydrogenase reductase acting with nad or nadp as acceptor |
| SEQ ID NO: 1208 | Nga20886 | 612.3596 | 702.88494 | n-acetylglucosaminylphosphatidylinositol de-n-acetylase family protein |
| SEQ ID NO: 1209 | Nga00612 | 2266.667 | 2563.6537 | atp-dependent clp protease proteolytic subunit |
| SEQ ID NO: 1210 | Nga20353 | 1054.28 | 893.27225 | n-acetylglucosaminylphosphatidylinositol de-n-acetylase family protein |
| SEQ ID NO: 1211 | Nga20647 | 79.09605 | 73.439589 | hypothetical protein AURANDRAFT_66563 [Aureococcus anophagefferens] |
| SEQ ID NO: 1212 | Nga21169 | 119.469 | 119.82676 | hypothetical protein AURANDRAFT_69090 [Aureococcus anophagefferens] |
| SEQ ID NO: 1213 | Nga20614 | 283.7838 | 204.93615 | hypothetical protein AURANDRAFT_66563 [Aureococcus anophagefferens] |
| SEQ ID NO: 1214 | Nga00653 | 1924.554 | 1907.9182 | proteasome component domain protein |
| SEQ ID NO: 1215 | Nga00604 | 957.2471 | 696.92945 | glutathione peroxidase |
| SEQ ID NO: 1216 | Nga00615 | 258.2799 | 247.37314 | phosphatidylinositol kinase |
| SEQ ID NO: 1217 | Nga00611 | 6168.681 | 6815.1069 | exo-beta- -glucanase |
| SEQ ID NO: 1218 | Nga00620 | 2981.685 | 3436.1926 | hypothetical protein DFA_07107 [Dictyostelium fasciculatum] |
| SEQ ID NO: 1219 | Nga00616 | 2996.366 | 2567.17 | ---NA--- |
| SEQ ID NO: 1220 | Nga00600 | 2286.137 | 1933.5212 | fructose- -bisphosphatase |
| SEQ ID NO: 1221 | Nga00625 | 457.0528 | 463.51145 | protein kinase |
| SEQ ID NO: 1222 | Nga00598 | 825.7669 | 688.48489 | 30s ribosomal protein s6 |
| SEQ ID NO: 1223 | Nga00599 | 1840.718 | 1780.6835 | dna binding protein |
| SEQ ID NO: 1224 | Nga00623 | 1570.136 | 1499.8624 | ---NA--- |
| SEQ ID NO: 1225 | Nga00618.1 | 305.6332 | 288.66042 | conserved unknown protein putative [Albugo laibachii Nc14] |
| SEQ ID NO: 1226 | Nga00606 | 375.3056 | 354.89816 | ---NA--- |
| SEQ ID NO: 1227 | Nga00613 | 230.1943 | 255.83104 | protein |
| SEQ ID NO: 1228 | Nga00610 | 2349.867 | 2328.8085 | protein |
| SEQ ID NO: 1229 | Nga00622 | 286.2903 | 323.22303 | atp-binding cassette superfamily |
| SEQ ID NO: 1230 | Nga00624 | 1312.399 | 1465.244 | fumarylacetoacetase |
| SEQ ID NO: 1231 | Nga00614 | 438.2494 | 563.04786 | atp-binding cassette superfamily |
| SEQ ID NO: 1232 | Nga00621 | 1619.741 | 1482.8736 | fumarylacetoacetate hydrolase |
| SEQ ID NO: 1233 | Nga00626 | 938.6503 | 881.65053 | ---NA--- |
| SEQ ID NO: 1234 | Nga20007.1 | 373.1988 | 415.18765 | butyrylcholinesterase precursor |
| SEQ ID NO: 1235 | Nga05927 | 1015.251 | 931.01479 | aldose 1- |
| SEQ ID NO: 1236 | Nga05926 | 308.046 | 328.70547 | u1 small nuclear |
| SEQ ID NO: 1237 | Nga20285 | 213.6752 | 198.12997 | e3 ubiquitin-protein ligase ubr2 |
| SEQ ID NO: 1238 | Nga21181 | 100.9174 | 69.565482 | ---NA--- |
| SEQ ID NO: 1239 | Nga21105 | 338.1309 | 410.05701 | protein |
| SEQ ID NO: 1240 | Nga20023 | 67.96117 | 73.617841 | cell cycle switch protein |
| SEQ ID NO: 1241 | Nga21053 | 47.24409 | 85.294011 | protein |
| SEQ ID NO: 1242 | Nga05925 | 1973.97 | 1978.488 | ---NA--- |
| SEQ ID NO: 1243 | Nga20754 | 269.9115 | 196.51589 | golgi transport complex subunit cog6 |
| SEQ ID NO: 1244 | Nga20347 | 134.6154 | 156.23566 | component of oligomeric golgi complex 6 |
| SEQ ID NO: 1245 | Nga20223 | 221.8845 | 238.70657 | component of oligomeric golgi complex 6 |
| SEQ ID NO: 1246 | Nga21133 | 305.2109 | 263.41669 | conserved unknown protein [Ectocarpus siliculosus] |
| SEQ ID NO: 1247 | Nga05930 | 325.5287 | 347.71482 | protein |
| SEQ ID NO: 1248 | Nga05924 | 2836.425 | 3850.6866 | phosphoinositol transporter |
| SEQ ID NO: 1249 | Nga05928 | 1358.41 | 1484.0636 | chaperonin containing tcp1 theta subunit |
| SEQ ID NO: 1250 | Nga05929 | 472.4221 | 488.36446 | pre-mrna-splicing factor cwc25-like protein |
| SEQ ID NO: 1251 | Nga05229.2 | 755.8411 | 843.21832 | glycosyl hydrolase family 81 protein |
| SEQ ID NO: 1252 | Nga20860.1 | 1766.687 | 2124.0141 | isovaleryl- dehydrogenase |
| SEQ ID NO: 1253 | Nga05995.1 | 1085.29 | 843.36289 | peptidyl-prolyl cis-trans isomerase |
| SEQ ID NO: 1254 | Nga20235.1 | 36 | 38.996422 | protein |
| SEQ ID NO: 1255 | Nga06005 | 343.5115 | 223.26196 | mekhla domain protein |
| SEQ ID NO: 1256 | Nga20456.1 | 69.29134 | 51.176407 | ribokinase |
| SEQ ID NO: 1257 | Nga05996.1 | 576.412 | 509.22792 | cytosolic phosphoglucose isomerase |
| SEQ ID NO: 1258 | Nga05999 | 807.0761 | 793.98589 | protein |
| SEQ ID NO: 1259 | Nga06000 | 155.6225 | 174.01348 | protein |
| SEQ ID NO: 1260 | Nga05998 | 10922.08 | 12835.351 | nadp-dependent glyceraldehyde-3-phosphate dehydrogenase |

FIGURE 24 T

| # | Nga model | +N rpkb | -N rpkb | GO |
|---|---|---|---|---|
| SEQ ID NO: 1261 | Nga20596.1 | 62.0155 | 100.76595 | vacuolar protein sorting-associated |
| SEQ ID NO: 1262 | Nga05973 | 1112.971 | 951.79551 | adenylate kinase |
| SEQ ID NO: 1263 | Nga20598 | 1377.953 | 1264.0572 | adenylate kinase 3 |
| SEQ ID NO: 1264 | Nga20884 | 531.3653 | 636.54983 | hsp70-binding protein 1-like |
| SEQ ID NO: 1265 | Nga20777 | 426.1662 | 524.42515 | vacuolar protein sorting-associated |
| SEQ ID NO: 1266 | Nga05970 | 704.0404 | 827.19683 | conserved unknown protein [Ectocarpus siliculosus] |
| SEQ ID NO: 1267 | Nga05967 | 1652.556 | 1988.2361 | sorting nexin-29-like |
| SEQ ID NO: 1268 | Nga05972 | 250 | 145.07597 | ---NA--- |
| SEQ ID NO: 1269 | Nga20553 | 443.4524 | 399.76491 | cathepsin a |
| SEQ ID NO: 1270 | Nga05971 | 500.8013 | 481.72663 | protein |
| SEQ ID NO: 1271 | Nga02181.2 | 494.4148 | 529.25369 | vesicle transport through interaction with t-snares homolog 1a |
| SEQ ID NO: 1272 | Nga05969 | 200.3968 | 200.59888 | deoxyribodipyrimidine photo-lyase |
| SEQ ID NO: 1273 | Nga05855 | 67.96117 | 71.865035 | pdx1 c-terminal inhibiting factor 1 |
| SEQ ID NO: 1274 | Nga20675 | 37.73585 | 51.095941 | ---NA--- |
| SEQ ID NO: 1275 | Nga05841 | 17633.25 | 17364.735 | iron-sulfur cluster scaffold homolog ( coli) |
| SEQ ID NO: 1276 | Nga21174 | 46.43963 | 73.78064 | ---NA--- |
| SEQ ID NO: 1277 | Nga05840 | 2179.762 | 1240.5608 | selenoprotein h |
| SEQ ID NO: 1278 | Nga05842 | 1313.021 | 1450.7987 | transferring glycosyl |
| SEQ ID NO: 1279 | Nga20115 | 108.7786 | 109.56374 | phd zinc finger-containing protein |
| SEQ ID NO: 1280 | Nga05843 | 163.8955 | 137.65562 | activating signal cointegrator 1 complex subunit 3 |
| SEQ ID NO: 1281 | Nga05847 | 210.6383 | 186.685 | set domain-containing protein |
| SEQ ID NO: 1282 | Nga05846 | 3655.148 | 4091.9572 | ---NA--- |
| SEQ ID NO: 1283 | Nga20450 | 166.6667 | 124.12056 | glycoside hydrolase family 31 protein |
| SEQ ID NO: 1284 | Nga05844 | 221.7544 | 229.56958 | glycoside hydrolase family 31 protein |
| SEQ ID NO: 1285 | Nga05845 | 739.6789 | 702.48715 | nop16_tetng ame: full=nucleolar protein 16 |
| SEQ ID NO: 1286 | Nga05219 | 2880.379 | 2944.8675 | ---NA--- |
| SEQ ID NO: 1287 | Nga05215 | 414.8148 | 470.07004 | protein |
| SEQ ID NO: 1288 | Nga05216 | 459.7701 | 343.64663 | ---NA--- |
| SEQ ID NO: 1289 | Nga05221 | 211.0672 | 228.63515 | serine threonine protein kinase |
| SEQ ID NO: 1290 | Nga05209 | 1098.325 | 912.03091 | ---NA--- |
| SEQ ID NO: 1291 | Nga05220 | 1600.614 | 1757.6899 | myb dna binding protein transcription factor-like protein |
| SEQ ID NO: 1292 | Nga05213 | 651.9174 | 724.81878 | conserved unknown protein [Ectocarpus siliculosus] |
| SEQ ID NO: 1293 | Nga05211 | 982.151 | 1063.4036 | cad protein |
| SEQ ID NO: 1294 | Nga05214 | 13241.8 | 12013.542 | linoleoyl- desaturase |
| SEQ ID NO: 1295 | Nga20988 | 542.7215 | 812.42546 | ---NA--- |
| SEQ ID NO: 1296 | Nga05217 | 203.4588 | 211.57774 | ---NA--- |
| SEQ ID NO: 1297 | Nga05212 | 1979.616 | 1979.4347 | ---NA--- |
| SEQ ID NO: 1298 | Nga05218 | 150.8333 | 187.76055 | potential inositol polyphosphate-5-phosphatase inp51p |
| SEQ ID NO: 1299 | Nga05210 | 1682.886 | 1932.6154 | glutathione reductase |
| SEQ ID NO: 1300 | Nga20980 | 2636.542 | 2921.965 | conserved unknown protein [Ectocarpus siliculosus] |
| SEQ ID NO: 1301 | Nga02763 | 15.65558 | 18.371874 | kinesin family-like protein |
| SEQ ID NO: 1302 | Nga02753 | 706.2147 | 625.7665 | holliday junction resolvase |
| SEQ ID NO: 1303 | Nga02749 | 810.3976 | 759.92008 | peptidase d |
| SEQ ID NO: 1304 | Nga02764 | 38.41932 | 49.54418 | ---NA--- |
| SEQ ID NO: 1305 | Nga02750 | 776.1194 | 732.93441 | bola-like protein |
| SEQ ID NO: 1306 | Nga02752 | 719.4139 | 897.53669 | rimp_proma ame: full=ribosome maturation factor rimp |
| SEQ ID NO: 1307 | Nga02754 | 912.7726 | 740.15362 | rna polymerase sigma factor |
| SEQ ID NO: 1308 | Nga02748 | 747.8788 | 628.93219 | suppressor enhancer of lin-12 protein 9 |
| SEQ ID NO: 1309 | Nga02751 | 151.9644 | 184.68777 | dna mismatch repair protein |
| SEQ ID NO: 1310 | Nga02745 | 10661.19 | 9104.0154 | ---NA--- |
| SEQ ID NO: 1311 | Nga20177 | 462.6866 | 396.64686 | peptidyl-prolyl cis-trans isomerase cyclophilin type |
| SEQ ID NO: 1312 | Nga02755 | 635.0168 | 441.31753 | protein |
| SEQ ID NO: 1313 | Nga02746 | 639.379 | 613.85805 | chaperonin |
| SEQ ID NO: 1314 | Nga02747 | 2917.146 | 2970.4793 | histone family protein dna-binding protein |
| SEQ ID NO: 1315 | Nga01017 | 268.5851 | 361.94387 | ribosome maturation protein sbds |
| SEQ ID NO: 1316 | Nga01016 | 82.91457 | 81.6508 | queuine trna-ribosyltransferase |
| SEQ ID NO: 1317 | Nga01014 | 6748.933 | 6773.2185 | lipocalin protein |
| SEQ ID NO: 1318 | Nga01019 | 443.4524 | 498.09418 | ---NA--- |
| SEQ ID NO: 1319 | Nga01018 | 596.5217 | 570.81719 | conserved hypothetical protein [Phytophthora infestans T30-4] |
| SEQ ID NO: 1320 | Nga01021 | 52.17391 | 65.935979 | ---NA--- |
| SEQ ID NO: 1321 | Nga01020 | 449.012 | 465.2272 | ubiquitin protein ligase e3a |
| SEQ ID NO: 1322 | Nga01015 | 10992.84 | 9131.288 | glycerophosphoryl diester phosphodiesterase |
| SEQ ID NO: 1323 | Nga06237 | 77.97271 | 105.57836 | atpbinding cassette superfamily |
| SEQ ID NO: 1324 | Nga04419.02 | 1411.924 | 1395.5811 | trigger factor |

FIGURE 24 U

| # | Nga model | +N rpkb | -N rpkb | GO |
|---|---|---|---|---|
| SEQ ID NO: 1325 | Nga06233 | 465.5397 | 615.56987 | adp-ribose pyrophosphatase |
| SEQ ID NO: 1326 | Nga06234 | 400.6734 | 322.78183 | potential dna binding component of sbf |
| SEQ ID NO: 1327 | Nga06236 | 22.55639 | 54.297441 | ---NA--- |
| SEQ ID NO: 1328 | Nga06235.01 | 963.3508 | 921.59956 | signal peptidase |
| SEQ ID NO: 1329 | Nga20648 | 105.5046 | 149.06889 | hypothetical protein PTSG_00045 [Salpingoeca sp. ATCC 50818] |
| SEQ ID NO: 1330 | Nga20905 | 239.1304 | 259.0342 | ring finger-like protein |
| SEQ ID NO: 1331 | Nga06622 | 6324.859 | 6432.084 | rpel repeat protein |
| SEQ ID NO: 1332 | Nga06623 | 350.3528 | 252.25996 | amine oxidase |
| SEQ ID NO: 1333 | Nga06617 | 157.5 | 183.24708 | protein |
| SEQ ID NO: 1334 | Nga06619 | 63.88889 | 48.143731 | c2h2 finger domain-containing protein |
| SEQ ID NO: 1335 | Nga01978.02 | 1568.285 | 1993.2907 | geranyl diphosphate synthase |
| SEQ ID NO: 1336 | Nga06620 | 74.25541 | 87.065315 | sulphonylurea receptor 2b |
| SEQ ID NO: 1337 | Nga20618.1 | 318.75 | 230.18721 | ---NA--- |
| SEQ ID NO: 1338 | Nga01980.02 | 748.1172 | 702.51574 | alpha beta fold family protein |
| SEQ ID NO: 1339 | Nga01981.02 | 2059.333 | 2352.2456 | ---NA--- |
| SEQ ID NO: 1340 | Nga05980.01 | 464.0523 | 445.02608 | gcn5-like n-acetyltransferase |
| SEQ ID NO: 1341 | Nga21036.1 | 568.5686 | 455.41367 | egl nine homolog 1 ( elegans) |
| SEQ ID NO: 1342 | Nga05979.01 | 323.0303 | 344.9936 | peptidase m1 membrane alanine aminopeptidase |
| SEQ ID NO: 1343 | Nga01175 | 200 | 244.90506 | ---NA--- |
| SEQ ID NO: 1344 | Nga01173 | 12800.93 | 14910.545 | ---NA--- |
| SEQ ID NO: 1345 | Nga20181 | 392.6302 | 352.36072 | mkiaa0609 protein |
| SEQ ID NO: 1346 | Nga01174 | 424.8826 | 419.56244 | protein |
| SEQ ID NO: 1347 | Nga01172 | 289.9408 | 391.82581 | protein phosphatase |
| SEQ ID NO: 1348 | Nga02657 | 524.1433 | 650.44655 | methyltransfer with n-terminal ankyrin repeats |
| SEQ ID NO: 1349 | Nga20176 | 379.3478 | 346.16389 | sel-1 suppressor of lin-12-like 2 ( elegans) |
| SEQ ID NO: 1350 | Nga02652 | 563.5684 | 562.44839 | carboxylesterase type b |
| SEQ ID NO: 1351 | Nga02659 | 870.4581 | 867.61391 | ---NA--- |
| SEQ ID NO: 1352 | Nga02649 | 279.2128 | 283.7993 | s-adenosylmethionine-dependent methyltransferase methyltransferase thiopurine s-methyltransferase |
| SEQ ID NO: 1353 | Nga02658 | 4052.305 | 3925.7627 | uncharacterized oxidoreductase ycsn |
| SEQ ID NO: 1354 | Nga02647 | 2148.564 | 2136.04 | fibronectin type iii domain protein |
| SEQ ID NO: 1355 | Nga20787 | 2104.753 | 2365.419 | -related protein kinase 2 |
| SEQ ID NO: 1356 | Nga02656 | 186.4407 | 147.49118 | protein |
| SEQ ID NO: 1357 | Nga02654 | 853.264 | 808.5143 | protein |
| SEQ ID NO: 1358 | Nga02651.01 | 1413.223 | 1125.0116 | 2c-methyl-d-erythritol -cyclodiphosphate synthase |
| SEQ ID NO: 1359 | Nga02655 | 701.4925 | 579.88046 | beta- -glucan-binding |
| SEQ ID NO: 1360 | Nga02653 | 806.6784 | 670.12012 | heterogeneous nuclear |
| SEQ ID NO: 1361 | Nga02646 | 3516.278 | 3519.7088 | ---NA--- |
| SEQ ID NO: 1362 | Nga02648 | 1573.273 | 1899.4608 | sphinganine c4-hydroxylase |
| SEQ ID NO: 1363 | Nga02650 | 1679.654 | 1795.4251 | protein |
| SEQ ID NO: 1364 | Nga05581 | 2001.678 | 3129.7464 | ---NA--- |
| SEQ ID NO: 1365 | Nga05579 | 5212.963 | 5971.1599 | kid repeat family protein |
| SEQ ID NO: 1366 | Nga05577 | 1721.336 | 1446.1119 | conserved protein |
| SEQ ID NO: 1367 | Nga02025.02 | 940.1709 | 742.98738 | signal peptidase complex subunit 1 |
| SEQ ID NO: 1368 | Nga02024.2 | 257.9473 | 334.51366 | histone acetyltransferase |
| SEQ ID NO: 1369 | Nga05578 | 1580.867 | 1853.8644 | peptidyl-prolyl cis-trans |
| SEQ ID NO: 1370 | Nga21120.1 | 134.6154 | 160.24171 | bromodomain phd finger transcription factor |
| SEQ ID NO: 1371 | Nga05373 | 624.8042 | 604.9706 | rna polymerase ii second largest subunit |
| SEQ ID NO: 1372 | Nga05374 | 452.2989 | 611.96492 | guanine nucleotide binding 2 |
| SEQ ID NO: 1373 | Nga05375 | 631.5789 | 614.46604 | protein |
| SEQ ID NO: 1374 | Nga05372 | 14386.19 | 12269.282 | expressed unknown protein [Ectocarpus siliculosus] |
| SEQ ID NO: 1375 | Nga01064 | 580.0866 | 517.38879 | actin related protein |
| SEQ ID NO: 1376 | Nga01063 | 400.1883 | 403.91774 | cop9 signalosome complex subunit 6a |
| SEQ ID NO: 1377 | Nga01066.01 | 143.6782 | 143.1861 | ---NA--- |
| SEQ ID NO: 1378 | Nga01065.01 | 307.4627 | 219.88032 | ---NA--- |
| SEQ ID NO: 1379 | Nga01062 | 6518.284 | 5480.92 | 30s ribosomal protein s15 |
| SEQ ID NO: 1380 | Nga00951 | 141.7323 | 132.20572 | ---NA--- |
| SEQ ID NO: 1381 | Nga00950 | 8120.546 | 7621.2365 | ribosomal protein l15 |
| SEQ ID NO: 1382 | Nga21306 | 9.52381 | 10.316514 | dynein heavy chain |
| SEQ ID NO: 1383 | Nga00952 | 1712.367 | 1980.7217 | like protein |
| SEQ ID NO: 1384 | Nga00953 | 726.1905 | 797.38054 | ---NA--- |
| SEQ ID NO: 1385 | Nga06154 | 125.3071 | 113.55769 | cyclin delta-3 |
| SEQ ID NO: 1386 | Nga06151 | 6808.732 | 6481.3873 | histone h2a isoform 2 |
| SEQ ID NO: 1387 | Nga20642 | 214.8438 | 186.18083 | regulator of ribonuclease activity a |

FIGURE 24 V

| # | Nga model | +N rpkb | -N rpkb | GO |
|---|---|---|---|---|
| SEQ ID NO: 1388 | Nga20731 | 341.7722 | 370.21919 | regulator of ribonuclease activity a |
| SEQ ID NO: 1389 | Nga02495.02 | 994.5227 | 955.24621 | heme steroid binding domain-containing |
| SEQ ID NO: 1390 | Nga02497.02 | 1070.802 | 1097.487 | protein |
| SEQ ID NO: 1391 | Nga20138 | 594.3971 | 719.07734 | n-acetyltransferase subunit |
| SEQ ID NO: 1392 | Nga02499.02 | 9351.421 | 9217.2852 | ribosomal protein l35a |
| SEQ ID NO: 1393 | Nga06149 | 1127.001 | 1101.1294 | mbr-related protein |
| SEQ ID NO: 1394 | Nga20436.1 | 76.31579 | 51.311081 | ---NA--- |
| SEQ ID NO: 1395 | Nga20650.1 | 41.18993 | 49.575924 | retinal pigment epithelial membrane protein |
| SEQ ID NO: 1396 | Nga02505.2 | 127.5322 | 75.806427 | nucleolar mif4g domain-containing protein 1 |
| SEQ ID NO: 1397 | Nga06559 | 1746.078 | 1799.0179 | methyltransferase type 11 |
| SEQ ID NO: 1398 | Nga06564 | 1260.7 | 1171.7472 | 26s proteasome non-atpase regulatory |
| SEQ ID NO: 1399 | Nga06565 | 920.6939 | 1289.9477 | purine nucleoside phosphorylase |
| SEQ ID NO: 1400 | Nga06567.01 | 13.7931 | 7.4705789 | ---NA--- |
| SEQ ID NO: 1401 | Nga06562 | 291.2874 | 296.93851 | polyadenylate-binding protein 1-like |
| SEQ ID NO: 1402 | Nga01530.02 | 735.0427 | 701.58172 | tpr repeat-containing protein |
| SEQ ID NO: 1403 | Nga07224.2 | 147.4954 | 165.80111 | protein |
| SEQ ID NO: 1404 | Nga06563 | 174.4548 | 115.85991 | transmembrane protein 184c |
| SEQ ID NO: 1405 | Nga06561 | 1135.762 | 903.89057 | glutamine cyclotransferase |
| SEQ ID NO: 1406 | Nga03762.02 | 964.1898 | 915.4636 | subunit of proteaseome activator |
| SEQ ID NO: 1407 | Nga20282.1 | 245.4545 | 256.03711 | cgi-01 protein isoform 1 |
| SEQ ID NO: 1408 | Nga20207.1 | 175.3813 | 175.81902 | methyltransferase-like protein 13 |
| SEQ ID NO: 1409 | Nga05604 | 312.7854 | 351.18543 | predicted protein [Thalassiosira pseudonana CCMP1335] |
| SEQ ID NO: 1410 | Nga05605 | 404.9409 | 335.09278 | soluble nsf attachment protein receptor |
| SEQ ID NO: 1411 | Nga05607 | 240.73 | 167.56863 | kinesin family member 11 |
| SEQ ID NO: 1412 | Nga05606 | 5832.871 | 7229.1029 | aconitate mitochondrial |
| SEQ ID NO: 1413 | Nga05610 | 190.9465 | 187.22562 | cyclin h |
| SEQ ID NO: 1414 | Nga20964.1 | 406.8323 | 363.3207 | hsbp1-like protein |
| SEQ ID NO: 1415 | Nga20264 | 586.6983 | 611.51686 | fumarate hydratase |
| SEQ ID NO: 1416 | Nga20993 | 755.597 | 679.04217 | 26s protease regulatory subunit 6a |
| SEQ ID NO: 1417 | Nga20186 | 792.8496 | 741.51976 | 26s protease regulatory subunit 6a |
| SEQ ID NO: 1418 | Nga04755.02 | 367.3966 | 342.62874 | short-chain dehydrogenase reductase sdr |
| SEQ ID NO: 1419 | Nga05609 | 333.1671 | 327.40138 | wd40 domain-containing protein |
| SEQ ID NO: 1420 | Nga20331 | 168.26 | 130.48516 | ---NA--- |
| SEQ ID NO: 1421 | Nga20740 | 100 | 93.880275 | ---NA--- |
| SEQ ID NO: 1422 | Nga05403 | 292.6182 | 326.75352 | zinc cchc domain containing 17 |
| SEQ ID NO: 1423 | Nga05396 | 1669.568 | 1421.4024 | glu leu phe val dehydrogenase |
| SEQ ID NO: 1424 | Nga05399 | 1183.333 | 1113.3238 | d-glycerate 3-kinase |
| SEQ ID NO: 1425 | Nga05393 | 936.8351 | 1018.4128 | rna pseudouridylate synthase domain-containing protein 1 |
| SEQ ID NO: 1426 | Nga05395 | 641.9647 | 651.52718 | phosphatidylinositol-4-phosphate 5-kinase |
| SEQ ID NO: 1427 | Nga05397 | 1760.386 | 1628.514 | electron transfer alpha subunit |
| SEQ ID NO: 1428 | Nga05398 | 3380.265 | 3922.8945 | glucokinase |
| SEQ ID NO: 1429 | Nga05400.1 | 1037.525 | 1019.0529 | proliferation-associated protein 2g4 |
| SEQ ID NO: 1430 | Nga05401 | 384.535 | 381.45229 | ---NA--- |
| SEQ ID NO: 1431 | Nga04774.02 | 8119.114 | 8316.7961 | mosc domain protein |
| SEQ ID NO: 1432 | Nga20854 | 222.5352 | 186.13316 | hypothetical protein CHLNCDRAFT_136762 [Chlorella variabilis] |
| SEQ ID NO: 1433 | Nga05402 | 195.7511 | 266.28816 | hypothetical protein VOLCADRAFT_105929 [Volvox carteri f. nagariensis] |
| SEQ ID NO: 1434 | Nga05438 | 589.2099 | 832.44274 | protein |
| SEQ ID NO: 1435 | Nga05442 | 384.7981 | 398.81535 | udp-n-acetylglucosamine transferase subunit alg13 homolog isoform 6 |
| SEQ ID NO: 1436 | Nga02620 | 138.6139 | 107.25089 | ---NA--- |
| SEQ ID NO: 1437 | Nga05446 | 517.0732 | 449.14578 | ---NA--- |
| SEQ ID NO: 1438 | Nga05444 | 850.385 | 931.29519 | protein |
| SEQ ID NO: 1439 | Nga05440 | 10219.82 | 8949.7022 | adp-ribosylation factor |
| SEQ ID NO: 1440 | Nga05443 | 258.4615 | 373.29908 | ---NA--- |
| SEQ ID NO: 1441 | Nga05439 | 2086.19 | 2344.8544 | ---NA--- |
| SEQ ID NO: 1442 | Nga05445 | 56 | 8.6658715 | ---NA--- |
| SEQ ID NO: 1443 | Nga05441 | 3148.618 | 3215.5908 | peptidase caspase catalytic subunit p20 |
| SEQ ID NO: 1444 | Nga06036.1 | 598.4556 | 518.61393 | protein |
| SEQ ID NO: 1445 | Nga06034 | 2208.706 | 2585.6801 | carboxyl transferase |
| SEQ ID NO: 1446 | Nga06033.01 | 1056.995 | 1318.0282 | gtp-binding protein |
| SEQ ID NO: 1447 | Nga06037 | 1366.412 | 1174.1925 | 26s protease regulatory subunit s10b |
| SEQ ID NO: 1448 | Nga06038 | 150.5532 | 178.19433 | rho gtpase activating protein 2 |
| SEQ ID NO: 1449 | Nga06035 | 174.6287 | 157.85384 | nad synthetase |
| SEQ ID NO: 1450 | Nga01543 | 257.8445 | 255.66094 | alcohol dehydrogenase |
| SEQ ID NO: 1451 | Nga01546.1 | 686.0405 | 739.20739 | solute carrier family 29 (nucleoside transporters) member 2 |

FIGURE 24 W

| # | Nga model | +N rpkb | -N rpkb | GO |
|---|---|---|---|---|
| SEQ ID NO: 1452 | Nga20142 | 367.2727 | 392.59024 | phosphatidylinositol kinase |
| SEQ ID NO: 1453 | Nga01551 | 353.7778 | 435.21933 | phosphatidylinositol kinase (pik-5) |
| SEQ ID NO: 1454 | Nga01544 | 4987.429 | 4585.484 | peptidylprolyl isomerase f (cyclophilin f) |
| SEQ ID NO: 1455 | Nga01542 | 3103.521 | 2785.8946 | 3-oxoacyl-(acyl-carrier-protein) reductase |
| SEQ ID NO: 1456 | Nga01378 | 564.5798 | 829.07414 | folate-biopterin transporter family |
| SEQ ID NO: 1457 | Nga04873.2 | 4269.746 | 3098.8901 | ---NA--- |
| SEQ ID NO: 1458 | Nga01376.01 | 265.6514 | 284.09689 | flap endonuclease-1 |
| SEQ ID NO: 1459 | Nga01377.01 | 421.0526 | 445.23901 | flap endonuclease-1 |
| SEQ ID NO: 1460 | Nga01375.01 | 437.799 | 290.2445 | flap endonuclease 1 |
| SEQ ID NO: 1461 | Nga20676.1 | 24.19355 | 87.357576 | ---NA--- |
| SEQ ID NO: 1462 | Nga00777 | 140.4255 | 176.69774 | transcription factor |
| SEQ ID NO: 1463 | Nga00776 | 2372.871 | 2142.9331 | undecaprenyl diphosphate synthase |
| SEQ ID NO: 1464 | Nga00775 | 838.9313 | 785.55133 | anthranilate phosphoribosyltransferase |
| SEQ ID NO: 1465 | Nga00778 | 154.3568 | 176.19407 | ankyrin repeat-containing protein |
| SEQ ID NO: 1466 | Nga00774.01 | 7425.419 | 5973.5619 | light-harvesting protein |
| SEQ ID NO: 1467 | Nga00784 | 254.2735 | 296.26911 | short-chain dehydrogenase reductase sdr |
| SEQ ID NO: 1468 | Nga20471.1 | 391.0806 | 343.73633 | wd repeat and hmg-box dna-binding protein 1 |
| SEQ ID NO: 1469 | Nga20781.1 | 866.3559 | 771.8147 | protein |
| SEQ ID NO: 1470 | Nga05503.2 | 1697.917 | 1685.0306 | glycoprotease m22 family protein |
| SEQ ID NO: 1471 | Nga05893 | 5327.88 | 4818.8035 | beta alanine--pyruvate transaminase |
| SEQ ID NO: 1472 | Nga05506.02 | 360.9467 | 301.25441 | ---NA--- |
| SEQ ID NO: 1473 | Nga05892 | 759.6458 | 670.76915 | 3-phosphoinositide-dependent protein |
| SEQ ID NO: 1474 | Nga20875.1 | 1243.391 | 985.47627 | protein |
| SEQ ID NO: 1475 | Nga05502.02 | 1425.926 | 1289.8508 | peroxisomal -dienoyl- reductase |
| SEQ ID NO: 1476 | Nga05890 | 201.7837 | 138.87615 | udp-sugar transporter ust74c (fringe connection protein) |
| SEQ ID NO: 1477 | Nga05895.1 | 422.2846 | 434.61212 | ---NA--- |
| SEQ ID NO: 1478 | Nga05889 | 2055.18 | 2218.9218 | ribosomal rna small subunit methyltransferase g |
| SEQ ID NO: 1479 | Nga21035 | 1109.005 | 944.62107 | protein |
| SEQ ID NO: 1480 | Nga05499.02 | 1387.165 | 1469.0119 | peptidase dimerization domain-containing protein |
| SEQ ID NO: 1481 | Nga05500.02 | 1186.111 | 978.92252 | rna (guanine-9-)-methyltransferase domain-containing |
| SEQ ID NO: 1482 | Nga05888 | 762.2413 | 842.27226 | protein |
| SEQ ID NO: 1483 | Nga21122.1 | 467.1875 | 504.3808 | lysocardiolipin acyltransferase 1 |
| SEQ ID NO: 1484 | Nga06829.2 | 48.85057 | 54.472971 | protein shq1 homolog isoform 2 |
| SEQ ID NO: 1485 | Nga01353 | 398.7241 | 323.06977 | ---NA--- |
| SEQ ID NO: 1486 | Nga01351.01 | 1830.59 | 2111.6756 | eukaryotic translation initiation factor 3 subunit g |
| SEQ ID NO: 1487 | Nga01354 | 631.8052 | 557.13608 | expressed unknown protein [Ectocarpus siliculosus] |
| SEQ ID NO: 1488 | Nga02827.1 | 233.5827 | 222.40963 | ubx domain-containing protein 7 |
| SEQ ID NO: 1489 | Nga02825 | 2231.366 | 2354.8564 | gtp-binding protein ypt1 |
| SEQ ID NO: 1490 | Nga20157 | 193.7322 | 175.90979 | phosphatidylinositol- -trisphosphate 5-phosphatase 1 |
| SEQ ID NO: 1491 | Nga20958 | 1066.978 | 1097.5758 | protein arginine serine-rich 45 |
| SEQ ID NO: 1492 | Nga02828 | 106.1752 | 117.40154 | protein |
| SEQ ID NO: 1493 | Nga02822 | 927.1565 | 840.28499 | protein |
| SEQ ID NO: 1494 | Nga02823 | 2258.128 | 2118.4427 | nucleoside diphosphate kinase |
| SEQ ID NO: 1495 | Nga02824 | 358.4229 | 408.96287 | 5-enolpyruvylshikimate-3-phosphate synthase |
| SEQ ID NO: 1496 | Nga03090 | 663.3565 | 496.97525 | F-box protein, putative [Phytophthora infestans T30-4] |
| SEQ ID NO: 1497 | Nga21086 | 781.9473 | 798.32657 | protein sel-1 homolog 1 |
| SEQ ID NO: 1498 | Nga03087 | 716.271 | 821.67716 | ---NA--- |
| SEQ ID NO: 1499 | Nga03096 | 606.7416 | 585.32253 | aspartyl-trna synthetase |
| SEQ ID NO: 1500 | Nga03097 | 471.3764 | 602.96944 | pre-mrna-splicing factor slu7 |
| SEQ ID NO: 1501 | Nga03085 | 809.1658 | 809.80754 | otu-like cysteine type protease |
| SEQ ID NO: 1502 | Nga03089 | 1624.242 | 1744.1161 | conserved unknown protein [Ectocarpus siliculosus] |
| SEQ ID NO: 1503 | Nga03092 | 1117.212 | 1255.6426 | ribosomal rna assembly protein mis3 |
| SEQ ID NO: 1504 | Nga03094 | 334.2199 | 299.13774 | cullin 3 |
| SEQ ID NO: 1505 | Nga03099 | 532.9768 | 714.43237 | hypothetical protein Esi_0081_0011 [Ectocarpus siliculosus] |
| SEQ ID NO: 1506 | Nga03100 | 844.375 | 751.49355 | exodeoxyribonuclease iii |
| SEQ ID NO: 1507 | Nga07097.2 | 706.486 | 893.8014 | gtp-binding protein |
| SEQ ID NO: 1508 | Nga03098 | 654.8148 | 680.43139 | ---NA--- |
| SEQ ID NO: 1509 | Nga03084 | 669.507 | 630.29315 | gns1 sur4 family protein |
| SEQ ID NO: 1510 | Nga03095 | 1002.151 | 983.06392 | nad-dependent epimerase dehydratase |
| SEQ ID NO: 1511 | Nga03091 | 301.8242 | 418.56303 | serine threonine protein kinase |
| SEQ ID NO: 1512 | Nga03086 | 1336.815 | 975.75903 | ferredoxin (2fe-2s) |
| SEQ ID NO: 1513 | Nga03088 | 538.6289 | 486.80698 | cytochrome b-561 domain containing 2 |
| SEQ ID NO: 1514 | Nga05303 | 359.944 | 300.39261 | conserved unknown protein [Ectocarpus siliculosus] |
| SEQ ID NO: 1515 | Nga05301 | 1665.58 | 1779.094 | propionyl- alpha subunit |

FIGURE 24 X

| # | Nga model | +N rpkb | -N rpkb | GO |
|---|---|---|---|---|
| SEQ ID NO: 1516 | Nga05304 | 266.6667 | 212.74324 | atp-binding cassette sub-family b member mitochondrial |
| SEQ ID NO: 1517 | Nga20922 | 169.9346 | 304.4383 | abc transporter |
| SEQ ID NO: 1518 | Nga05297 | 2164.684 | 2012.6406 | mannitol dehydrogenase |
| SEQ ID NO: 1519 | Nga05302 | 236.4066 | 326.50668 | nudix hydrolase |
| SEQ ID NO: 1520 | Nga05298 | 5700.475 | 5767.4491 | white |
| SEQ ID NO: 1521 | Nga05299 | 3574.202 | 2930.6912 | endosomal p24a protein |
| SEQ ID NO: 1522 | Nga05300 | 10436.2 | 10902.839 | cazy family gt2 |
| SEQ ID NO: 1523 | Nga05305 | 53.23591 | 64.451289 | e3 ubiquitin-protein ligase shprh |
| SEQ ID NO: 1524 | Nga01228 | 1208.453 | 1194.575 | ---NA--- |
| SEQ ID NO: 1525 | Nga01227 | 187.5792 | 194.95465 | hypothetical protein PTSG_03392 [Salpingoeca sp. ATCC 50818] |
| SEQ ID NO: 1526 | Nga01225 | 8943.038 | 9082.9394 | vacuolar transporter chaperone |
| SEQ ID NO: 1527 | Nga01229 | 3633.406 | 3039.3994 | conserved unknown protein [Ectocarpus siliculosus] |
| SEQ ID NO: 1528 | Nga01226 | 1012.112 | 1167.7304 | hypothetical membrane spanning protein |
| SEQ ID NO: 1529 | Nga20334 | 196.2482 | 189.13608 | myb-like dna-binding domain-containing protein |
| SEQ ID NO: 1530 | Nga20421.1 | 323.8866 | 350.845 | ---NA--- |
| SEQ ID NO: 1531 | Nga01418.01 | 692.9023 | 666.07849 | protein |
| SEQ ID NO: 1532 | Nga01419.1 | 357.5143 | 406.42397 | cullin-associated and neddylation-dissociated 1 |
| SEQ ID NO: 1533 | Nga01416 | 413.7495 | 415.74985 | trna (5-methylaminomethyl-2-thiouridylate)-methyltransferase |
| SEQ ID NO: 1534 | Nga01417 | 1390.653 | 2177.9307 | lysine decarboxylase domain-containing protein |
| SEQ ID NO: 1535 | Nga01420 | 453.252 | 770.59325 | ---NA--- |
| SEQ ID NO: 1536 | Nga05988.1 | 2033.517 | 2206.4515 | protein |
| SEQ ID NO: 1537 | Nga05990 | 139.7038 | 131.65878 | kinesin-related protein klpa-like protein |
| SEQ ID NO: 1538 | Nga05989 | 1090.932 | 1097.1524 | aminopeptidase n |
| SEQ ID NO: 1539 | Nga05861 | 644.4159 | 522.84462 | ---NA--- |
| SEQ ID NO: 1540 | Nga05859 | 876.4143 | 903.16633 | s-adenosyl-methyltransferase |
| SEQ ID NO: 1541 | Nga05857 | 1561.716 | 1448.8418 | protein |
| SEQ ID NO: 1542 | Nga05863 | 150.3831 | 118.28417 | ---NA--- |
| SEQ ID NO: 1543 | Nga05862 | 8278.788 | 9992.0125 | ---NA--- |
| SEQ ID NO: 1544 | Nga05856 | 336.1763 | 322.58353 | udp-galactopyranose mutase |
| SEQ ID NO: 1545 | Nga20654 | 486.6221 | 336.92561 | protein |
| SEQ ID NO: 1546 | Nga05858 | 802.4901 | 826.98505 | transmembrane protein |
| SEQ ID NO: 1547 | Nga05860 | 857.9235 | 786.08452 | eukaryotic translation initiation factor 3 subunit 12 |
| SEQ ID NO: 1548 | Nga01028 | 72.07207 | 41.475173 | ---NA--- |
| SEQ ID NO: 1549 | Nga20866.1 | 1586.207 | 1755.586 | ---NA--- |
| SEQ ID NO: 1550 | Nga01029.1 | 376.3713 | 480.82789 | ---NA--- |
| SEQ ID NO: 1551 | Nga20896.1 | 343.0532 | 468.22462 | ---NA--- |
| SEQ ID NO: 1552 | Nga02089.02 | 2521.918 | 2368.0285 | rhamnose biosynthetic enzyme expressed |
| SEQ ID NO: 1553 | Nga02093.02 | 595.3109 | 560.94072 | short-chain dehydrogenase |
| SEQ ID NO: 1554 | Nga06174 | 582.5893 | 464.24312 | sys1_dicdi ame: full=protein sys1 homolog |
| SEQ ID NO: 1555 | Nga02090.2 | 59.20206 | 83.647409 | nudix hydrolase |
| SEQ ID NO: 1556 | Nga02091.02 | 212.4183 | 166.37907 | ---NA--- |
| SEQ ID NO: 1557 | Nga06178 | 358.871 | 339.23859 | abc transporter family protein |
| SEQ ID NO: 1558 | Nga20908 | 94.73684 | 148.23201 | ---NA--- |
| SEQ ID NO: 1559 | Nga20662 | 157.3034 | 97.369343 | ---NA--- |
| SEQ ID NO: 1560 | Nga06180 | 473.2824 | 446.52391 | ---NA--- |
| SEQ ID NO: 1561 | Nga20521 | 383.0645 | 464.45111 | protein |
| SEQ ID NO: 1562 | Nga21171 | 681.8811 | 621.77329 | conserved hypothetical protein [Phytophthora infestans T30-4] |
| SEQ ID NO: 1563 | Nga06529 | 233.8889 | 330.98815 | ribosome biogenesis protein nob1 |
| SEQ ID NO: 1564 | Nga06527 | 1435.414 | 1696.9093 | eukaryotic translation initiation factor 3 |
| SEQ ID NO: 1565 | Nga06538 | 373.581 | 394.61463 | pyridoxamine 5 -phosphate oxidase- fmn-binding |
| SEQ ID NO: 1566 | Nga06526 | 171.1045 | 1240.2708 | copper amine oxidase |
| SEQ ID NO: 1567 | Nga06532 | 600.795 | 589.90423 | ---NA--- |
| SEQ ID NO: 1568 | Nga06531 | 398.8285 | 407.22213 | inorganic phosphate |
| SEQ ID NO: 1569 | Nga20089 | 1202.669 | 1285.6063 | protein |
| SEQ ID NO: 1570 | Nga06530 | 341.1033 | 352.9418 | alanyl-trna synthetase |
| SEQ ID NO: 1571 | Nga06528 | 1225.36 | 1408.3241 | potential zinc ring finger protein |
| SEQ ID NO: 1572 | Nga06533 | 807.6923 | 795.06594 | protein |
| SEQ ID NO: 1573 | Nga06359 | 473.4625 | 453.55288 | conserved unknown protein [Ectocarpus siliculosus] |
| SEQ ID NO: 1574 | Nga20953 | 285.4223 | 259.00212 | multidrug resistance protein 2 (atp-binding cassette protein c) |
| SEQ ID NO: 1575 | Nga21115 | 216.4846 | 235.57918 | atp-dependent bile acid permease |
| SEQ ID NO: 1576 | Nga20835 | 418.3192 | 372.84114 | abc transporter c family protein |
| SEQ ID NO: 1577 | Nga20587 | 162.3489 | 159.02398 | impact homolog |
| SEQ ID NO: 1578 | Nga06363 | 190.4762 | 151.06324 | ---NA--- |
| SEQ ID NO: 1579 | Nga06361 | 1032.932 | 891.81911 | 26s proteasome regulatory subunit n7 |

FIGURE 24 Y

| # | Nga model | +N rpkb | -N rpkb | GO |
|---|---|---|---|---|
| SEQ ID NO: 1580 | Nga06362 | 3924.299 | 4638.671 | translation initiation factor eif-5a |
| SEQ ID NO: 1581 | Nga06360 | 3093.82 | 3670.8242 | enolase |
| SEQ ID NO: 1582 | Nga06632 | 93.06987 | 94.302153 | rsc complex subunit |
| SEQ ID NO: 1583 | Nga02313.02 | 777.4914 | 613.2742 | zinc fyve domain containing 21 |
| SEQ ID NO: 1584 | Nga02316.2 | 51.3308 | 32.950082 | transducin wd40 domain-containing protein |
| SEQ ID NO: 1585 | Nga06630 | 300.7136 | 356.66112 | brf1 subunit of rna polymerase iii transcription initiation factor iiib |
| SEQ ID NO: 1586 | Nga20132 | 196.0656 | 198.88885 | n-terminal asparagine amidohydrolase |
| SEQ ID NO: 1587 | Nga06631 | 256.656 | 237.64238 | translation initiation factor eif-2b alpha subunit |
| SEQ ID NO: 1588 | Nga20261 | 121.2654 | 104.70627 | gdsl-like protein |
| SEQ ID NO: 1589 | Nga00325 | 3018.395 | 2650.1192 | ---NA--- |
| SEQ ID NO: 1590 | Nga00322 | 516.6003 | 584.05442 | zinc finger (c3hc4-type ring finger) family protein |
| SEQ ID NO: 1591 | Nga00316 | 375.8287 | 340.82373 | conserved protein |
| SEQ ID NO: 1592 | Nga00347 | 6.245121 | 2.5368476 | cap family transcription factor |
| SEQ ID NO: 1593 | Nga00319 | 1177.994 | 1479.9523 | protein |
| SEQ ID NO: 1594 | Nga00312 | 1069.463 | 1105.9492 | nuclear lim factor interactor-interacting protein cleavage-specific form |
| SEQ ID NO: 1595 | Nga00324 | 293.7853 | 299.87832 | ectonucleoside triphosphate diphosphohydrolase 4 |
| SEQ ID NO: 1596 | Nga00309 | 768.6782 | 757.1743 | atp synthase mitochondrial f1 complex assembly factor 2 |
| SEQ ID NO: 1597 | Nga00310 | 7792.723 | 8849.7944 | serine hydroxymethyltransferase |
| SEQ ID NO: 1598 | Nga00314.1 | 772.2772 | 646.0589 | protein |
| SEQ ID NO: 1599 | Nga00318.01 | 315.1042 | 373.77213 | expressed unknown protein [Ectocarpus siliculosus] |
| SEQ ID NO: 1600 | Nga00313 | 469.3878 | 569.67562 | dead deah box helicase |
| SEQ ID NO: 1601 | Nga00326 | 582.9384 | 532.20499 | ---NA--- |
| SEQ ID NO: 1602 | Nga00317 | 3870.263 | 4661.3348 | aureochrome1-like protein |
| SEQ ID NO: 1603 | Nga00320 | 1751.299 | 1941.2968 | protein |
| SEQ ID NO: 1604 | Nga00321 | 1558.491 | 1453.8498 | early-responsive to dehydration stress-related protein |
| SEQ ID NO: 1605 | Nga00350 | 30.30303 | 49.237906 | ---NA--- |
| SEQ ID NO: 1606 | Nga00315 | 393.5428 | 397.94196 | serine racemase |
| SEQ ID NO: 1607 | Nga00346 | 38.65074 | 59.37614 | kinesin motor protein |
| SEQ ID NO: 1608 | Nga00323 | 2103.635 | 2368.37 | heat shock protein |
| SEQ ID NO: 1609 | Nga00311 | 800 | 715.59091 | fgfr1 oncogene partner |
| SEQ ID NO: 1610 | Nga04197.01 | 2880.819 | 2549.735 | protein |
| SEQ ID NO: 1611 | Nga20607.1 | 124.6291 | 208.93236 | e3 ubiquitin-protein ligase ubr4 |
| SEQ ID NO: 1612 | Nga20308.1 | 251.6171 | 386.0685 | protein |
| SEQ ID NO: 1613 | Nga20168.1 | 528.1921 | 655.2994 | protein |
| SEQ ID NO: 1614 | Nga02949 | 513.8889 | 500.78077 | anaphase promoting complex subunit 1 |
| SEQ ID NO: 1615 | Nga02948 | 13.75476 | 9.1933814 | arf-gap with coiled- ank repeat and ph domain-containing protein 1 |
| SEQ ID NO: 1616 | Nga02938 | 487.3684 | 454.95826 | protein |
| SEQ ID NO: 1617 | Nga02945 | 549.1924 | 432.65732 | der1-like domain member 1 |
| SEQ ID NO: 1618 | Nga02942 | 389.3037 | 419.07366 | phosphoribosylformylglycinamidine synthase |
| SEQ ID NO: 1619 | Nga02943 | 2212.867 | 1748.3416 | peptidase s8 s53 subtilisin kexin sedolisin |
| SEQ ID NO: 1620 | Nga02944 | 387.808 | 403.22716 | metal dependent phosphohydrolase |
| SEQ ID NO: 1621 | Nga02946.1 | 2234.012 | 1934.7062 | dna-formamidopyrimidine glycosylase |
| SEQ ID NO: 1622 | Nga02947 | 75.09881 | 68.504913 | ---NA--- |
| SEQ ID NO: 1623 | Nga02950 | 501.9225 | 579.90341 | protein |
| SEQ ID NO: 1624 | Nga02939 | 241.0304 | 277.03683 | rio kinase |
| SEQ ID NO: 1625 | Nga02941 | 234.5779 | 240.03479 | dna-directed rna polymerase i subunit rpa2 |
| SEQ ID NO: 1626 | Nga02951 | 145.0777 | 151.5405 | ---NA--- |
| SEQ ID NO: 1627 | Nga02940 | 230.8276 | 195.75526 | chaperone -domain containing protein |
| SEQ ID NO: 1628 | Nga06743.2 | 377.7006 | 458.86993 | ---NA--- |
| SEQ ID NO: 1629 | Nga06739.1 | 1392.58 | 1334.6489 | sphingolipid delta 4 desaturase c-4 hydroxylase protein des2 |
| SEQ ID NO: 1630 | Nga06744 | 377.7778 | 349.04205 | ---NA--- |
| SEQ ID NO: 1631 | Nga06740 | 625.7036 | 461.33978 | solute carrier family member b3 |
| SEQ ID NO: 1632 | Nga06741 | 1342.806 | 1481.51 | dihydrolipoyllysine-residue acetyltransferase component 1 of pyruvate dehydrogenase complex |
| SEQ ID NO: 1633 | Nga06743.1 | 377.7006 | 458.86993 | ---NA--- |
| SEQ ID NO: 1634 | Nga06738 | 4765.01 | 4385.913 | hypothetical protein GOALK_097_02160 [Gordonia alkanivorans NBRC 16433] |
| SEQ ID NO: 1635 | Nga02678 | 312.4448 | 348.01161 | replication factor c subunit 4 |
| SEQ ID NO: 1636 | Nga02677 | 1277.234 | 1483.1755 | rna helicase |
| SEQ ID NO: 1637 | Nga02671 | 559.0043 | 634.28228 | nucleoprotein tpr |
| SEQ ID NO: 1638 | Nga02679 | 944.385 | 824.87975 | protein |
| SEQ ID NO: 1639 | Nga02676 | 554.6489 | 593.71613 | protein |
| SEQ ID NO: 1640 | Nga02681 | 617.7778 | 526.37146 | conserved unknown protein [Ectocarpus siliculosus] |
| SEQ ID NO: 1641 | Nga02674 | 779.4038 | 835.46986 | conserved unknown protein [Ectocarpus siliculosus] |

FIGURE 24 Z

| # | Nga model | +N rpkb | -N rpkb | GO |
|---|---|---|---|---|
| SEQ ID NO: 1642 | Nga20519 | 4586.698 | 5084.8957 | ---NA--- |
| SEQ ID NO: 1643 | Nga02673 | 527.4295 | 662.16495 | protein |
| SEQ ID NO: 1644 | Nga02675 | 226.3993 | 239.8137 | phosphatidylserine receptor |
| SEQ ID NO: 1645 | Nga02680 | 522.646 | 457.69539 | protein |
| SEQ ID NO: 1646 | Nga02682 | 64.35644 | 94.738282 | conserved unknown protein [Ectocarpus siliculosus] |
| SEQ ID NO: 1647 | Nga02672 | 1097.561 | 1355.5667 | abc transporter atp-binding protein |
| SEQ ID NO: 1648 | Nga06348 | 1944.215 | 1797.1836 | proteasome maturation factor ump1 family protein |
| SEQ ID NO: 1649 | Nga03952.02 | 4710.142 | 4386.2837 | protein |
| SEQ ID NO: 1650 | Nga03956.02 | 679.941 | 627.89224 | pyridoxamine 5 -phosphate oxidase |
| SEQ ID NO: 1651 | Nga06347 | 1766.458 | 1845.5726 | protein |
| SEQ ID NO: 1652 | Nga06346 | 1403.037 | 1762.0306 | serine threonine-protein kinase dclk3-like |
| SEQ ID NO: 1653 | Nga06344 | 912.0952 | 1003.0474 | retinol retinaldehyde reductase |
| SEQ ID NO: 1654 | Nga01357.1 | 879.9571 | 986.86908 | ---NA--- |
| SEQ ID NO: 1655 | Nga01358.01 | 440.5405 | 482.57584 | dna gyrase subunit b |
| SEQ ID NO: 1656 | Nga21070.1 | 576.6284 | 442.00925 | trafficking protein particle complex subunit 4 |
| SEQ ID NO: 1657 | Nga01356 | 3829.361 | 3494.9845 | udp-glucose 6- |
| SEQ ID NO: 1658 | Nga01359 | 132.3764 | 153.76048 | atp-binding cassette superfamily |
| SEQ ID NO: 1659 | Nga20289 | 91.33489 | 86.25282 | atp-binding cassette sub-family g member 2 |
| SEQ ID NO: 1660 | Nga20029.1 | 184.7015 | 90.943148 | abc subfamily abcg |
| SEQ ID NO: 1661 | Nga02467.02 | 721.6981 | 742.59434 | 50s ribosomal protein l25 general stress protein ctc |
| SEQ ID NO: 1662 | Nga01056.02 | 26.21723 | 14.199696 | ---NA--- |
| SEQ ID NO: 1663 | Nga01053.02 | 266.0819 | 191.62472 | ---NA--- |
| SEQ ID NO: 1664 | Nga01050.02 | 211.8877 | 198.52334 | lipase domain-containing protein |
| SEQ ID NO: 1665 | Nga06297 | 75.72016 | 73.107147 | dna rna non-specific nuclease |
| SEQ ID NO: 1666 | Nga06306 | 83.10249 | 68.014689 | tata-binding protein-associated factor 172 |
| SEQ ID NO: 1667 | Nga06307 | 82.25108 | 82.063177 | tata-binding protein-associated factor 172 |
| SEQ ID NO: 1668 | Nga04152 | 379.1349 | 365.21246 | ---NA--- |
| SEQ ID NO: 1669 | Nga04156 | 83.94161 | 101.47082 | hnh endonuclease |
| SEQ ID NO: 1670 | Nga04151 | 1295.841 | 1376.2752 | serine carboxypeptidase |
| SEQ ID NO: 1671 | Nga04150 | 698.2025 | 691.75299 | acetylserotonin o-methyltransferase-like |
| SEQ ID NO: 1672 | Nga03826 | 262.1083 | 262.32161 | ---NA--- |
| SEQ ID NO: 1673 | Nga03820.1 | 594.7137 | 774.64747 | predicted protein [Thalassiosira pseudonana CCMP1335] |
| SEQ ID NO: 1674 | Nga06683.2 | 417.1843 | 427.23823 | ---NA--- |
| SEQ ID NO: 1675 | Nga03818.01 | 401.5317 | 394.65744 | cop9 complex subunit 7a |
| SEQ ID NO: 1676 | Nga03817.01 | 595.4495 | 658.23594 | soluble pyridine nucleotide transhydrogenase |
| SEQ ID NO: 1677 | Nga06678.2 | 3382.787 | 2908.7495 | protein |
| SEQ ID NO: 1678 | Nga03043.01 | 2702.461 | 2792.9018 | mgc84239 protein |
| SEQ ID NO: 1679 | Nga03021 | 774.9172 | 901.56617 | ---NA--- |
| SEQ ID NO: 1680 | Nga03020.01 | 2188.825 | 1948.3601 | golgi snap receptor complex member 1 |
| SEQ ID NO: 1681 | Nga20672 | 612.9032 | 377.09354 | protein kinase domain protein |
| SEQ ID NO: 1682 | Nga03023.01 | 1230.971 | 1157.1554 | protein |
| SEQ ID NO: 1683 | Nga03026 | 1096.096 | 1166.1843 | ---NA--- |
| SEQ ID NO: 1684 | Nga03022 | 2081.91 | 2078.2149 | abc subfamily abcg |
| SEQ ID NO: 1685 | Nga03027.01 | 1082.492 | 1021.2307 | protein |
| SEQ ID NO: 1686 | Nga03029 | 212.1212 | 164.12635 | ---NA--- |
| SEQ ID NO: 1687 | Nga20536 | 245.6814 | 261.97212 | dna ligase |
| SEQ ID NO: 1688 | Nga03024 | 328.2313 | 288.30971 | dna ligase i |
| SEQ ID NO: 1689 | Nga03025.01 | 1242.206 | 1453.4038 | protein |
| SEQ ID NO: 1690 | Nga20148.1 | 242.963 | 224.67074 | dna-apurinic or apyrimidinic site lyase 2 |
| SEQ ID NO: 1691 | Nga03028.01 | 324.1913 | 305.46892 | protein |
| SEQ ID NO: 1692 | Nga06127 | 441.906 | 531.71797 | ---NA--- |
| SEQ ID NO: 1693 | Nga06126 | 260.8696 | 260.22352 | nudix hydrolase |
| SEQ ID NO: 1694 | Nga06124 | 747.9167 | 674.76448 | mitochondrial phosphate carrier protein |
| SEQ ID NO: 1695 | Nga06123.01 | 752.5355 | 799.79139 | mitochondrial protein translocase family |
| SEQ ID NO: 1696 | Nga06125 | 182.3944 | 180.79327 | cyclic nucleotide-binding domain protein |
| SEQ ID NO: 1697 | Nga20217 | 258.6873 | 313.67778 | gamma complex associated protein 3 |
| SEQ ID NO: 1698 | Nga20091 | 158.8527 | 193.584 | abc subfamily abcg |
| SEQ ID NO: 1699 | Nga20499 | 199.7919 | 206.2766 | ---NA--- |
| SEQ ID NO: 1700 | Nga06600 | 4222.222 | 3849.702 | nadh dehydrogenase |
| SEQ ID NO: 1701 | Nga21177 | 125.7143 | 111.41835 | ser thr protein phosphatase family |
| SEQ ID NO: 1702 | Nga21231.1 | 518.8811 | 534.79941 | rna binding protein |
| SEQ ID NO: 1703 | Nga06598 | 226.1905 | 184.83754 | adp-ribosylation factor-like protein 2 |
| SEQ ID NO: 1704 | Nga06599.1 | 176.8293 | 249.95032 | chromosome region maintenance protein 5 exportin |
| SEQ ID NO: 1705 | Nga06597 | 505.9133 | 549.44586 | tho complex 7 |

FIGURE 24 AA

| # | Nga model | +N rpkb | -N rpkb | GO |
|---|---|---|---|---|
| SEQ ID NO: 1706 | Nga03239.1 | 1841.419 | 2086.3256 | casein kinase i |
| SEQ ID NO: 1707 | Nga20497 | 144.6384 | 167.48255 | atp-binding sub-family c (cftr mrp) member 2 |
| SEQ ID NO: 1708 | Nga03243 | 306.3584 | 270.98241 | multidrug-resistance like protein isoform e |
| SEQ ID NO: 1709 | Nga03245.01 | 476.3713 | 413.63996 | e3 ubiquitin-protein ligase rnf14 |
| SEQ ID NO: 1710 | Nga03242 | 697.0492 | 668.40862 | conserved unknown protein [Ectocarpus siliculosus] |
| SEQ ID NO: 1711 | Nga03238 | 702.9973 | 601.14072 | transmembrane protein 115 |
| SEQ ID NO: 1712 | Nga03241 | 5336.549 | 5478.8649 | vacuolar h+-atpase a subunit |
| SEQ ID NO: 1713 | Nga03244 | 722.2222 | 678.5257 | gtp-binding protein era |
| SEQ ID NO: 1714 | Nga03240 | 5466.374 | 5159.6143 | nadh dehydrogenase subunit 10 |
| SEQ ID NO: 1715 | Nga05902.2 | 2056.911 | 1804.9896 | ---NA--- |
| SEQ ID NO: 1716 | Nga05498.01 | 3419.098 | 2738.2545 | ---NA--- |
| SEQ ID NO: 1717 | Nga05489 | 12153.85 | 10402.554 | ---NA--- |
| SEQ ID NO: 1718 | Nga05497.01 | 1666.924 | 1441.5215 | dolichyl-diphosphooligosaccharide--protein glycosyltransferase subunit dad1 |
| SEQ ID NO: 1719 | Nga05493 | 248.227 | 223.27295 | unc45 family protein |
| SEQ ID NO: 1720 | Nga20081 | 1131.985 | 943.39449 | pseudouridine synthase homolog 1 ( coli) |
| SEQ ID NO: 1721 | Nga05492 | 1087.874 | 985.38659 | rna binding protein |
| SEQ ID NO: 1722 | Nga20055.1 | 2043.287 | 1900.2292 | conserved unknown protein [Ectocarpus siliculosus] |
| SEQ ID NO: 1723 | Nga05495 | 376.1468 | 549.07042 | mitochondrial carrier domain-containing protein |
| SEQ ID NO: 1724 | Nga20804.1 | 2625.498 | 2593.7195 | mitochondrial carrier domain-containing protein |
| SEQ ID NO: 1725 | Nga21076 | 62.82723 | 130.44178 | vacuolar protein sorting-associated protein vps13 |
| SEQ ID NO: 1726 | Nga05509 | 96.01449 | 219.7866 | predicted protein [Thalassiosira pseudonana CCMP1335] |
| SEQ ID NO: 1727 | Nga05897.2 | 895.2703 | 834.3829 | ---NA--- |
| SEQ ID NO: 1728 | Nga05508 | 146.7991 | 198.47333 | syt3 protein |
| SEQ ID NO: 1729 | Nga05494.01 | 967.684 | 874.49586 | topoisomerase 6 subunit b |
| SEQ ID NO: 1730 | Nga05496 | 270.6311 | 326.02187 | vacuolar protein sorting-associated protein 13 family protein |
| SEQ ID NO: 1731 | Nga04128.01 | 25708.25 | 33515.408 | fructose-bisphosphate aldolase |
| SEQ ID NO: 1732 | Nga04129.01 | 2357.423 | 2462.0057 | ---NA--- |
| SEQ ID NO: 1733 | Nga05546.2 | 360.4411 | 368.04572 | ---NA--- |
| SEQ ID NO: 1734 | Nga04133 | 467.5325 | 769.0492 | ---NA--- |
| SEQ ID NO: 1735 | Nga04132 | 410.6231 | 479.10143 | mono-or diacylglycerol acyltransferase type 2 |
| SEQ ID NO: 1736 | Nga04130 | 192.2807 | 231.08991 | nitrate transporter |
| SEQ ID NO: 1737 | Nga20404 | 323.913 | 207.22736 | dna topoisomerase |
| SEQ ID NO: 1738 | Nga20335 | 265.8824 | 145.28079 | dna topoisomerase |
| SEQ ID NO: 1739 | Nga03611 | 1292.655 | 1408.2041 | serine threonine protein kinase |
| SEQ ID NO: 1740 | Nga03610 | 1474.63 | 1592.0304 | atp-binding cassette sub-family g member 2 |
| SEQ ID NO: 1741 | Nga03608 | 248.1618 | 291.38462 | protein |
| SEQ ID NO: 1742 | Nga03609 | 411.6766 | 483.77963 | protein |
| SEQ ID NO: 1743 | Nga21043 | 540 | 363.73855 | ser thr kinase |
| SEQ ID NO: 1744 | Nga20895 | 500 | 362.34938 | ser thr kinase |
| SEQ ID NO: 1745 | Nga20101 | 588.3377 | 465.7246 | ser thr kinase |
| SEQ ID NO: 1746 | Nga02505.1 | 127.5322 | 75.806427 | nucleolar mif4g domain-containing protein 1 |
| SEQ ID NO: 1747 | Nga02501.02 | 4314.115 | 5050.0668 | dihydrolipoyl dehydrogenase |
| SEQ ID NO: 1748 | Nga02498 | 4942.308 | 4534.3062 | histone h4 |
| SEQ ID NO: 1749 | Nga02500 | 108.31 | 107.21083 | cyclin delta-3 |
| SEQ ID NO: 1750 | Nga02501.01 | 4314.115 | 5050.0668 | dihydrolipoyl dehydrogenase |
| SEQ ID NO: 1751 | Nga02495.01 | 994.5227 | 955.24621 | heme steroid binding domain-containing |
| SEQ ID NO: 1752 | Nga02507 | 128.3167 | 111.37729 | conserved unknown protein [Ectocarpus siliculosus] |
| SEQ ID NO: 1753 | Nga02504 | 916.7816 | 853.63815 | protein |
| SEQ ID NO: 1754 | Nga02497.01 | 1070.802 | 1097.487 | protein |
| SEQ ID NO: 1755 | Nga02499.01 | 9351.421 | 9217.2852 | ribosomal protein l35a |
| SEQ ID NO: 1756 | Nga02502 | 490.0344 | 544.96718 | isoform a |
| SEQ ID NO: 1757 | Nga02496 | 3411.514 | 2940.2064 | nadh dehydrogenase |
| SEQ ID NO: 1758 | Nga20863 | 991.404 | 1066.1629 | protein |
| SEQ ID NO: 1759 | Nga02506 | 389.071 | 410.80019 | protein |
| SEQ ID NO: 1760 | Nga01606 | 551.0888 | 449.98663 | u6 snrna-associated sm-like protein lsm8 |
| SEQ ID NO: 1761 | Nga01610 | 342.8962 | 388.45479 | aspartyl glutamyl-trna amidotransferase subunit a |
| SEQ ID NO: 1762 | Nga01616 | 127.0125 | 155.02454 | ---NA--- |
| SEQ ID NO: 1763 | Nga01609 | 1611.903 | 1526.8025 | protein |
| SEQ ID NO: 1764 | Nga20814 | 322.1258 | 287.84416 | probable methyltransferase bcdin3d-like |
| SEQ ID NO: 1765 | Nga01608 | 28330.88 | 23337.319 | expressed unknown protein [Ectocarpus siliculosus] |
| SEQ ID NO: 1766 | Nga01607 | 977.5227 | 1125.7137 | homoaconitase |
| SEQ ID NO: 1767 | Nga07299.2 | 2197.878 | 2503.6802 | solute carrier family 35 member b1 |
| SEQ ID NO: 1768 | Nga06703.1 | 927.3743 | 1104.6472 | uncharacterized protein |

FIGURE 24 AB

| # | Nga model | +N rpkb | -N rpkb | GO |
|---|---|---|---|---|
| SEQ ID NO: 1769 | Nga06699 | 1065.029 | 901.65137 | mitochondrial ribosomal protein l11 |
| SEQ ID NO: 1770 | Nga06697 | 3123.953 | 3304.1357 | ---NA--- |
| SEQ ID NO: 1771 | Nga06700 | 641.6465 | 773.73853 | endonuclease |
| SEQ ID NO: 1772 | Nga20171 | 225.2986 | 184.06744 | fibronectin-binding a domain-containing protein |
| SEQ ID NO: 1773 | Nga20686 | 250 | 273.12309 | fibronectin-binding a domain-containing protein |
| SEQ ID NO: 1774 | Nga06702 | 2292 | 1808.2785 | protein |
| SEQ ID NO: 1775 | Nga06701 | 342.5358 | 268.03948 | proteasome subunit beta type-6 |
| SEQ ID NO: 1776 | Nga20669 | 129.771 | 90.958575 | ---NA--- |
| SEQ ID NO: 1777 | Nga03837 | 306.7485 | 331.17275 | coq7 family protein |
| SEQ ID NO: 1778 | Nga03838 | 466.1469 | 464.94161 | squalene synthase |
| SEQ ID NO: 1779 | Nga20134 | 1234.158 | 1354.0424 | vacuolar sorting protein 9 domain-containing protein |
| SEQ ID NO: 1780 | Nga01200 | 633.1878 | 636.22255 | potential rn mrp complex component |
| SEQ ID NO: 1781 | Nga01198.01 | 154.661 | 172.12404 | ---NA--- |
| SEQ ID NO: 1782 | Nga01197.01 | 2927.435 | 2518.5728 | peptide deformylase |
| SEQ ID NO: 1783 | Nga01199 | 1094.29 | 1182.4944 | pas-domain protein |
| SEQ ID NO: 1784 | Nga21026 | 578.9474 | 527.36389 | rna methylase |
| SEQ ID NO: 1785 | Nga01501 | 281.909 | 351.05917 | cox11 cytochrome c oxidase assembly protein |
| SEQ ID NO: 1786 | Nga01500.01 | 378.1903 | 335.94494 | ---NA--- |
| SEQ ID NO: 1787 | Nga04084.2 | 1391.663 | 1262.367 | pyridoxal kinase |
| SEQ ID NO: 1788 | Nga05539.1 | 400.8715 | 348.09805 | cysteinyl-trna synthetase |
| SEQ ID NO: 1789 | Nga05544 | 466.6667 | 393.48241 | protein |
| SEQ ID NO: 1790 | Nga04136.02 | 176.7358 | 235.4007 | protein |
| SEQ ID NO: 1791 | Nga05542 | 5735.736 | 5819.5361 | transmembrane bax inhibitor motif-containing protein 4 |
| SEQ ID NO: 1792 | Nga04134.02 | 716.0563 | 560.23029 | activating transcription factor 1 |
| SEQ ID NO: 1793 | Nga05543 | 611.6006 | 644.21402 | protein |
| SEQ ID NO: 1794 | Nga20225 | 377.0701 | 329.79989 | rna guanylyltransferase and 5-phosphatase |
| SEQ ID NO: 1795 | Nga05545 | 158.2609 | 207.85532 | homolog of coli closely related to ydj1p |
| SEQ ID NO: 1796 | Nga05538 | 671.3911 | 690.88149 | conserved hypothetical protein [Phytophthora infestans T30-4] |
| SEQ ID NO: 1797 | Nga05541 | 414.9001 | 342.48826 | 6-phosphofructo-2- isoform a |
| SEQ ID NO: 1798 | Nga01218 | 1524.8 | 1274.4608 | abc transporter g family member 7 |
| SEQ ID NO: 1799 | Nga20368.1 | 1223.301 | 1139.3237 | transthyretin family protein |
| SEQ ID NO: 1800 | Nga01221.01 | 112.069 | 93.382236 | ---NA--- |
| SEQ ID NO: 1801 | Nga01220.01 | 140.8451 | 85.67289 | ---NA--- |
| SEQ ID NO: 1802 | Nga01219 | 190.5263 | 141.39054 | ---NA--- |
| SEQ ID NO: 1803 | Nga06134 | 987.2979 | 1053.839 | ---NA--- |
| SEQ ID NO: 1804 | Nga06133.1 | 325.7373 | 374.63051 | dna replication complex gins protein psf2 |
| SEQ ID NO: 1805 | Nga06137 | 1353.991 | 1166.6379 | mitochondrial carrier |
| SEQ ID NO: 1806 | Nga06135 | 1176.416 | 1078.8983 | 3-hydroxyacyl- dehydrogenase |
| SEQ ID NO: 1807 | Nga06142 | 502.8681 | 488.80155 | transporter belonging to the mfs superfamily |
| SEQ ID NO: 1808 | Nga21238 | 280.8989 | 216.03823 | ---NA--- |
| SEQ ID NO: 1809 | Nga06141 | 543.7352 | 513.02096 | major facilitator superfamily protein |
| SEQ ID NO: 1810 | Nga06136 | 3119.735 | 3234.3223 | fumarate hydratase |
| SEQ ID NO: 1811 | Nga21203.1 | 622.3092 | 735.58156 | protein |
| SEQ ID NO: 1812 | Nga06138 | 1791.444 | 1958.8963 | ---NA--- |
| SEQ ID NO: 1813 | Nga04845.02 | 295.9223 | 316.76705 | nadph dependent diflavin oxidoreductase 1 |
| SEQ ID NO: 1814 | Nga04844.02 | 224.1888 | 218.08471 | salicylate hydroxylase |
| SEQ ID NO: 1815 | Nga06783 | 100 | 117.35034 | ---NA--- |
| SEQ ID NO: 1816 | Nga06779 | 4436.236 | 4418.6799 | protein-l-isoaspartated-aspartate o-methyltransferase |
| SEQ ID NO: 1817 | Nga20295.1 | 569.7413 | 470.33555 | jmjc domain-containing protein 4-like |
| SEQ ID NO: 1818 | Nga06780 | 901.1765 | 1027.1607 | protein fucu homolog |
| SEQ ID NO: 1819 | Nga04328.02 | 440.3748 | 418.89967 | ---NA--- |
| SEQ ID NO: 1820 | Nga04329.02 | 180.8874 | 162.66994 | ---NA--- |
| SEQ ID NO: 1821 | Nga06781 | 6658.182 | 6686.5077 | ribosomal protein |
| SEQ ID NO: 1822 | Nga21161 | 245.4955 | 351.31912 | nad h dehydrogenase |
| SEQ ID NO: 1823 | Nga06789 | 463.9017 | 450.93149 | nad h dehydrogenase |
| SEQ ID NO: 1824 | Nga03624 | 87.03375 | 117.36638 | n-acetylglucosamine-1-phosphate transferase |
| SEQ ID NO: 1825 | Nga03625 | 300 | 241.57836 | ketose-bisphosphate aldolase class-ii-like protein |
| SEQ ID NO: 1826 | Nga01634.01 | 76.14213 | 67.816677 | ---NA--- |
| SEQ ID NO: 1827 | Nga20962 | 241.2935 | 266.76657 | tetratricopeptide repeat protein 26 |
| SEQ ID NO: 1828 | Nga00882 | 2295.918 | 2300.4092 | protein |
| SEQ ID NO: 1829 | Nga00884.1 | 36.52058 | 31.888029 | dna replication atp-dependent helicase dna2 |
| SEQ ID NO: 1830 | Nga00881.01 | 3447.703 | 3984.5643 | succinate fumarate mitochondrial transporter |
| SEQ ID NO: 1831 | Nga01403 | 10142.86 | 12660.655 | ---NA--- |
| SEQ ID NO: 1832 | Nga01404 | 372.093 | 268.70919 | ---NA--- |

FIGURE 24 AC

| # | Nga model | +N rpkb | -N rpkb | GO |
|---|---|---|---|---|
| SEQ ID NO: 1833 | Nga20494 | 371.308 | 292.51887 | short-chain dehydrogenase reductase sdr |
| SEQ ID NO: 1834 | Nga01400 | 1717.678 | 1625.3273 | transmembrane protein 56 |
| SEQ ID NO: 1835 | Nga01402 | 624.1747 | 670.62579 | hsp70 hsp90 organizing protein |
| SEQ ID NO: 1836 | Nga21131 | 163.7168 | 105.44755 | ---NA--- |
| SEQ ID NO: 1837 | Nga01401 | 328.152 | 437.78367 | ufm1-conjugating enzyme 1 |
| SEQ ID NO: 1838 | Nga01238 | 475.1082 | 618.99082 | phyhd1 protein |
| SEQ ID NO: 1839 | Nga01239 | 982.7246 | 1037.2526 | uncharacterized protein |
| SEQ ID NO: 1840 | Nga01237 | 716.8142 | 752.51207 | homeobox prox 1 |
| SEQ ID NO: 1841 | Nga03808 | 2240.779 | 2098.7058 | protein |
| SEQ ID NO: 1842 | Nga20061 | 618.888 | 598.97177 | dna primase |
| SEQ ID NO: 1843 | Nga06320 | 2054.688 | 1970.0108 | mannitol 1-phosphate dehydrogenase |
| SEQ ID NO: 1844 | Nga06319 | 282.2832 | 341.93161 | phosphatidylinositol 3-kinase |
| SEQ ID NO: 1845 | Nga06314 | 470.2277 | 476.16763 | translation initiation factor eif-2b subunit beta |
| SEQ ID NO: 1846 | Nga06316 | 255.2422 | 260.03881 | slc30a9 protein |
| SEQ ID NO: 1847 | Nga06317 | 1006.623 | 1046.5682 | ---NA--- |
| SEQ ID NO: 1848 | Nga06318.1 | 203.6082 | 234.51456 | protein |
| SEQ ID NO: 1849 | Nga06315 | 384.4508 | 431.90283 | bifunctional coenzyme a synthase |
| SEQ ID NO: 1850 | Nga01317 | 310.0437 | 264.89564 | didehydrogluconate reductase |
| SEQ ID NO: 1851 | Nga01316 | 2941.298 | 3026.6962 | protein |
| SEQ ID NO: 1852 | Nga01315 | 1364.583 | 1351.478 | methionine synthase |
| SEQ ID NO: 1853 | Nga21150.1 | 299.8776 | 234.67859 | protein |
| SEQ ID NO: 1854 | Nga06047 | 1942.127 | 1438.9662 | ---NA--- |
| SEQ ID NO: 1855 | Nga06048 | 615.4482 | 636.24893 | myb-like dna-binding |
| SEQ ID NO: 1856 | Nga06049 | 351.6721 | 255.90964 | ---NA--- |
| SEQ ID NO: 1857 | Nga20180 | 171.1957 | 192.80387 | rna polymerase ii associated protein 3 |
| SEQ ID NO: 1858 | Nga20208 | 101.0989 | 134.51147 | nad-specific glutamate dehydrogenase encoded in antisense gene pair with dnakj |
| SEQ ID NO: 1859 | Nga02731.01 | 1963.609 | 1938.1593 | hypothetical protein VOLCADRAFT_89537 [Volvox carteri f. nagariensis] |
| SEQ ID NO: 1860 | Nga20216 | 536.6492 | 561.46681 | ubiquitin carboxyl-terminal hydrolase and or f-box |
| SEQ ID NO: 1861 | Nga02735.01 | 456.2118 | 452.26672 | conserved unknown protein [Ectocarpus siliculosus] |
| SEQ ID NO: 1862 | Nga02729 | 257.3099 | 250.22071 | isoform a |
| SEQ ID NO: 1863 | Nga20748 | 758.567 | 757.02642 | ubiquitin carboxyl-terminal hydrolase and or f-box |
| SEQ ID NO: 1864 | Nga06813.2 | 1161.026 | 1004.3523 | protein |
| SEQ ID NO: 1865 | Nga02725.01 | 954.0785 | 1002.0732 | ---NA--- |
| SEQ ID NO: 1866 | Nga02723.01 | 176.7956 | 214.2529 | expressed unknown protein [Ectocarpus siliculosus] |
| SEQ ID NO: 1867 | Nga02728 | 3966.667 | 4339.0319 | h+-translocating pyrophosphatase family |
| SEQ ID NO: 1868 | Nga02726 | 447.5806 | 481.92263 | sugar fermentation stimulation protein |
| SEQ ID NO: 1869 | Nga02733 | 439.4753 | 397.89631 | leucyl aminopeptidase |
| SEQ ID NO: 1870 | Nga02734 | 408.7452 | 333.61958 | dihydrofolate reductase-thymidylate synthase |
| SEQ ID NO: 1871 | Nga02727 | 2606.964 | 2381.0574 | phosphoglucomutase |
| SEQ ID NO: 1872 | Nga02724 | 2800.532 | 2484.8119 | ---NA--- |
| SEQ ID NO: 1873 | Nga02730 | 1702.29 | 1590.3969 | protein |
| SEQ ID NO: 1874 | Nga01462 | 174.3827 | 185.55396 | tubulin-specific chaperone e |
| SEQ ID NO: 1875 | Nga01461 | 2782.575 | 2911.2975 | pyruvate dehydrogenase e1 component alpha subunit |
| SEQ ID NO: 1876 | Nga21022 | 212.766 | 220.59779 | ---NA--- |
| SEQ ID NO: 1877 | Nga01464 | 304.3478 | 290.82476 | nad-dependent deacetylase |
| SEQ ID NO: 1878 | Nga01465 | 1107.784 | 1312.9617 | conserved unknown protein [Ectocarpus siliculosus] |
| SEQ ID NO: 1879 | Nga01463 | 408.2251 | 426.72852 | cytochrome p450 |
| SEQ ID NO: 1880 | Nga01467 | 126.8293 | 133.86306 | u3 small nucleolar ribonucleoprotein protein mpp10 |
| SEQ ID NO: 1881 | Nga20838 | 141.0473 | 207.68083 | u3 small nucleolar ribonucleoprotein protein mpp10 |
| SEQ ID NO: 1882 | Nga04006 | 140.9432 | 164.28468 | breast cancer type 2 susceptibility protein homolog |
| SEQ ID NO: 1883 | Nga04004 | 894.9275 | 772.19666 | peptide chain release factor 1 |
| SEQ ID NO: 1884 | Nga04005.01 | 1076.887 | 1047.7602 | protease required for anti-sigma degradation |
| SEQ ID NO: 1885 | Nga04140.2 | 262.3336 | 318.9475 | uncharacterized membrane protein |
| SEQ ID NO: 1886 | Nga03645 | 301.9432 | 306.83532 | protein |
| SEQ ID NO: 1887 | Nga03643 | 1371.827 | 1151.9671 | protein |
| SEQ ID NO: 1888 | Nga20563 | 713.7405 | 756.60997 | protein |
| SEQ ID NO: 1889 | Nga03644 | 619.8663 | 707.67146 | protein |
| SEQ ID NO: 1890 | Nga00807 | 282.4742 | 304.86893 | uroporphyrinogen-iii synthase |
| SEQ ID NO: 1891 | Nga00805 | 3169.899 | 3540.469 | sulfite ferredoxin dependent |
| SEQ ID NO: 1892 | Nga00803 | 4287.931 | 4515.0311 | rnp-1 like rna-binding protein |
| SEQ ID NO: 1893 | Nga21102 | 2178.94 | 1937.537 | expressed unknown protein [Ectocarpus siliculosus] |
| SEQ ID NO: 1894 | Nga00804 | 1746.439 | 971.10431 | ---NA--- |
| SEQ ID NO: 1895 | Nga00806 | 73.21773 | 139.83945 | conserved hypothetical protein [Ricinus communis] |

FIGURE 24 AD

| # | Nga model | +N rpkb | -N rpkb | GO |
|---|---|---|---|---|
| SEQ ID NO: 1896 | Nga04125 | 459.1492 | 468.47491 | protein |
| SEQ ID NO: 1897 | Nga04124.1 | 341.5233 | 460.44096 | transcription antitermination protein nusg |
| SEQ ID NO: 1898 | Nga04123.01 | 522.1122 | 655.66041 | ---NA--- |
| SEQ ID NO: 1899 | Nga20969 | 549.8688 | 602.74435 | serine threonine-protein kinase eg2 |
| SEQ ID NO: 1900 | Nga20328 | 181.2689 | 206.17444 | component of oligomeric golgi complex 8 |
| SEQ ID NO: 1901 | Nga02573 | 555.3838 | 643.46663 | eukaryotic translation initiation factor 2a |
| SEQ ID NO: 1902 | Nga20425 | 203.3582 | 198.05397 | conserved oligomeric golgi complex subunit |
| SEQ ID NO: 1903 | Nga02108.2 | 580.3595 | 681.99438 | swi snf-related matrix-associated actin-dependent regulator of chromatin a1 isoform a isoform 19 |
| SEQ ID NO: 1904 | Nga20362 | 210.6227 | 200.37844 | serine threonine protein kinase |
| SEQ ID NO: 1905 | Nga20813 | 444.4024 | 427.72172 | protein kinase |
| SEQ ID NO: 1906 | Nga02109.02 | 1408.063 | 1229.1563 | gualynate kinase-1 |
| SEQ ID NO: 1907 | Nga20883 | 385.8447 | 576.24089 | mitochondrial ribosomal l36 protein |
| SEQ ID NO: 1908 | Nga02110.02 | 210.356 | 183.1682 | phosphoinositol transporter |
| SEQ ID NO: 1909 | Nga02578.1 | 520.9165 | 520.55346 | protein |
| SEQ ID NO: 1910 | Nga02580 | 285.4167 | 293.37586 | protein |
| SEQ ID NO: 1911 | Nga02574 | 429.4809 | 403.16249 | leukotriene a4 hydrolase |
| SEQ ID NO: 1912 | Nga02575 | 1068.664 | 1246.1924 | methyltransferase small |
| SEQ ID NO: 1913 | Nga02581 | 251.1166 | 293.52145 | conserved unknown protein [Ectocarpus siliculosus] |
| SEQ ID NO: 1914 | Nga03684 | 496.1182 | 600.11632 | histone acetylase complex subunit paf400 |
| SEQ ID NO: 1915 | Nga03402 | 508.6022 | 462.99515 | kelch repeat |
| SEQ ID NO: 1916 | Nga20038 | 2171.219 | 2215.5418 | c2h2-type zinc finger-containing protein |
| SEQ ID NO: 1917 | Nga03406 | 3095.548 | 2954.4882 | phosphoinositol transporter |
| SEQ ID NO: 1918 | Nga03401 | 400.8097 | 426.86142 | folylpolyglutamate synthase |
| SEQ ID NO: 1919 | Nga03405 | 283.906 | 321.2484 | abc1 protein |
| SEQ ID NO: 1920 | Nga03404 | 580.581 | 554.76406 | protein |
| SEQ ID NO: 1921 | Nga03408 | 4650.206 | 4488.9571 | ---NA--- |
| SEQ ID NO: 1922 | Nga03400 | 8735.661 | 7629.9109 | protein |
| SEQ ID NO: 1923 | Nga03399 | 6236.411 | 4757.7242 | cellulase 2 |
| SEQ ID NO: 1924 | Nga03407 | 1545.671 | 1497.943 | protein |
| SEQ ID NO: 1925 | Nga06481.1 | 915.6985 | 913.82738 | glutathione-regulated potassium-efflux system protein |
| SEQ ID NO: 1926 | Nga02547.02 | 1214.516 | 1151.3729 | 26s proteasome non-atpase regulatory subunit 2 |
| SEQ ID NO: 1927 | Nga02614.02 | 352.1657 | 411.0577 | choline ethanolaminephosphotransferase 1 |
| SEQ ID NO: 1928 | Nga02548.02 | 817.3913 | 679.86089 | peroxisomal membrane 22 kda (mpv17 pmp22) family protein |
| SEQ ID NO: 1929 | Nga02608.02 | 5491.917 | 5974.0477 | expressed unknown protein [Ectocarpus siliculosus] |
| SEQ ID NO: 1930 | Nga06477 | 198.5636 | 139.12257 | ribonucleoside-diphosphate reductase large subunit |
| SEQ ID NO: 1931 | Nga06475 | 716.8317 | 589.87987 | novel protein |
| SEQ ID NO: 1932 | Nga06655 | 115.2211 | 93.953964 | ---NA--- |
| SEQ ID NO: 1933 | Nga06660 | 1050.773 | 970.84543 | ---NA--- |
| SEQ ID NO: 1934 | Nga06656 | 1025.258 | 1004.2361 | actin binding protein |
| SEQ ID NO: 1935 | Nga06023.2 | 1939.289 | 2664.3985 | protein |
| SEQ ID NO: 1936 | Nga06657 | 375.4109 | 356.09268 | bud13 homolog |
| SEQ ID NO: 1937 | Nga06658 | 1810.726 | 1684.6509 | protein |
| SEQ ID NO: 1938 | Nga20150 | 334.2287 | 322.76714 | poly rna polymerase |
| SEQ ID NO: 1939 | Nga00046 | 1486.328 | 1419.0999 | conserved unknown protein [Ectocarpus siliculosus] |
| SEQ ID NO: 1940 | Nga00049 | 392.5128 | 471.87956 | drug metabolite transporter superfamily |
| SEQ ID NO: 1941 | Nga00042.01 | 832.1649 | 913.49007 | dna replication licensing factor mcm9 |
| SEQ ID NO: 1942 | Nga00045 | 2257.962 | 2228.5641 | nucleoside diphosphate kinase a |
| SEQ ID NO: 1943 | Nga20293 | 1037.52 | 1005.3712 | inositol 5-phosphatase |
| SEQ ID NO: 1944 | Nga00050 | 948.7399 | 845.85717 | ---NA--- |
| SEQ ID NO: 1945 | Nga00040 | 1443.492 | 1629.4945 | peptidase |
| SEQ ID NO: 1946 | Nga00041 | 536.1822 | 617.63932 | exocyst complex |
| SEQ ID NO: 1947 | Nga20074.1 | 1108.252 | 1092.1733 | hypothetical protein CHLNCDRAFT_136236 [Chlorella variabilis] |
| SEQ ID NO: 1948 | Nga00044 | 4000 | 3841.5249 | ubiquitin conjugating enzyme |
| SEQ ID NO: 1949 | Nga00048 | 571.9468 | 561.91942 | macrophage erythroblast attacher |
| SEQ ID NO: 1950 | Nga00043.01 | 365.3846 | 399.81712 | myosin light chain kinase |
| SEQ ID NO: 1951 | Nga21125 | 274.4043 | 295.57882 | tpr repeat nuclear phosphoprotein |
| SEQ ID NO: 1952 | Nga20797 | 299.4393 | 360.80802 | ctr9 protein |
| SEQ ID NO: 1953 | Nga20955 | 406.2827 | 389.0568 | protein |
| SEQ ID NO: 1954 | Nga01535 | 174.7212 | 240.27122 | afg1 family |
| SEQ ID NO: 1955 | Nga20562.1 | 152.0468 | 190.04104 | ---NA--- |
| SEQ ID NO: 1956 | Nga01534.1 | 3648.79 | 2991.1035 | zeaxanthin epoxidase |
| SEQ ID NO: 1957 | Nga06644 | 932.4222 | 962.32628 | fe-s oxidoreductase |
| SEQ ID NO: 1958 | Nga20916.1 | 595.9821 | 459.40725 | protein |

FIGURE 24 AE

| # | Nga model | +N rpkb | -N rpkb | GO |
|---|---|---|---|---|
| SEQ ID NO: 1959 | Nga06647 | 106.0851 | 98.581872 | tbc1 domain member 13 |
| SEQ ID NO: 1960 | Nga06645 | 549.2578 | 554.04273 | prolyl carboxypeptidase like protein |
| SEQ ID NO: 1961 | Nga06646 | 1916.94 | 1977.0499 | protein |
| SEQ ID NO: 1962 | Nga06643 | 138.322 | 178.49206 | chorismate mutase |
| SEQ ID NO: 1963 | Nga06642 | 1342.894 | 1380.9378 | atp-dependent metalloprotease |
| SEQ ID NO: 1964 | Nga20543 | 638.79 | 481.86563 | glutamyl-trna amidotransferase subunit c |
| SEQ ID NO: 1965 | Nga20599 | 195.4023 | 204.19582 | ---NA--- |
| SEQ ID NO: 1966 | Nga20194 | 267.0873 | 277.92753 | sterol 3-beta- |
| SEQ ID NO: 1967 | Nga00705 | 627.081 | 543.42036 | ---NA--- |
| SEQ ID NO: 1968 | Nga00692 | 526.8293 | 607.66782 | exosome component 8 |
| SEQ ID NO: 1969 | Nga00711 | 854.4153 | 708.36778 | ---NA--- |
| SEQ ID NO: 1970 | Nga00707 | 13.88889 | 15.044916 | low quality protein: 60 kda lysophospholipase-like |
| SEQ ID NO: 1971 | Nga00701 | 1813.62 | 970.63973 | ---NA--- |
| SEQ ID NO: 1972 | Nga00697 | 848.763 | 713.65492 | carbamoyltransferase |
| SEQ ID NO: 1973 | Nga00696 | 23297.15 | 23184.629 | enolase |
| SEQ ID NO: 1974 | Nga00703 | 319.7625 | 309.16728 | protein |
| SEQ ID NO: 1975 | Nga00706 | 275.2902 | 377.24565 | atp-dependent protease la |
| SEQ ID NO: 1976 | Nga00710.1 | 880 | 765.48532 | cytochrome c oxidase biogenesis protein cmc1-like protein |
| SEQ ID NO: 1977 | Nga00708 | 2069.307 | 2049.8325 | cyclin-dependent kinase 2 |
| SEQ ID NO: 1978 | Nga00699.01 | 156.6667 | 192.27402 | phosphatidylinositol kinase (pik-k) |
| SEQ ID NO: 1979 | Nga00693 | 557.0825 | 589.70981 | rab family gtpase |
| SEQ ID NO: 1980 | Nga00695 | 650.0921 | 703.20435 | protein |
| SEQ ID NO: 1981 | Nga00700 | 180.7732 | 232.04071 | phosphatidylinositol 4-kinase |
| SEQ ID NO: 1982 | Nga00698 | 438.3117 | 466.00161 | riboflavin kinase |
| SEQ ID NO: 1983 | Nga00702 | 321.499 | 293.42037 | serine threonine-protein kinase tousled-like 1 isoform 2 |
| SEQ ID NO: 1984 | Nga00694 | 441.1303 | 459.14154 | retinal pigment epithelial membrane protein |
| SEQ ID NO: 1985 | Nga00709 | 287.9652 | 245.42709 | atpase aaa domain containing 5 |
| SEQ ID NO: 1986 | Nga00704 | 1031.308 | 909.67712 | adp-ribosylation factor 3 |
| SEQ ID NO: 1987 | Nga05195.2 | 38.13559 | 32.12982 | elegans protein partially confirmed by transcript evidence |
| SEQ ID NO: 1988 | Nga00943.01 | 72.56236 | 58.951507 | dna repair and recombination protein rad54 |
| SEQ ID NO: 1989 | Nga00932 | 504.9248 | 617.70728 | protein |
| SEQ ID NO: 1990 | Nga00935.01 | 212.3552 | 201.45084 | mate efflux family protein |
| SEQ ID NO: 1991 | Nga05196.2 | 1679.558 | 1479.2228 | spermidine synthase |
| SEQ ID NO: 1992 | Nga00934 | 27757.31 | 24354.446 | heat shock protein 90 |
| SEQ ID NO: 1993 | Nga00933 | 1067.098 | 1094.618 | diacylglycerol acyltransferase family protein |
| SEQ ID NO: 1994 | Nga00938 | 537.2993 | 387.67296 | predicted protein [Phaeodactylum tricornutum CCAP 1055/1] |
| SEQ ID NO: 1995 | Nga21051 | 468.8399 | 508.90185 | ---NA--- |
| SEQ ID NO: 1996 | Nga20027 | 213.7405 | 136.43786 | protein |
| SEQ ID NO: 1997 | Nga03963 | 588.1122 | 599.20203 | cell surface |
| SEQ ID NO: 1998 | Nga03964 | 904.8132 | 906.58588 | exported nucleotide-binding protein |
| SEQ ID NO: 1999 | Nga03966 | 225.6569 | 220.99981 | prefoldin subunit 3 |
| SEQ ID NO: 2000 | Nga03965 | 106.1703 | 94.096847 | atp-binding cassette superfamily |
| SEQ ID NO: 2001 | Nga07110.2 | 99.28571 | 177.95986 | bromodomain containing protein |
| SEQ ID NO: 2002 | Nga01056.01 | 26.21726 | 14.199696 | ---NA--- |
| SEQ ID NO: 2003 | Nga01053.01 | 266.0819 | 191.62472 | ---NA--- |
| SEQ ID NO: 2004 | Nga01050.01 | 211.8877 | 198.52334 | lipase domain-containing protein |
| SEQ ID NO: 2005 | Nga01051 | 553.0303 | 746.77491 | ---NA--- |
| SEQ ID NO: 2006 | Nga01054 | 1369.528 | 1263.0545 | otu domain-containing protein 7b |
| SEQ ID NO: 2007 | Nga01052 | 1038.439 | 1053.7669 | eukaryotic translation initiation factor subunit e |
| SEQ ID NO: 2008 | Nga05705 | 1194.636 | 1318.1421 | isobutyryl- mitochondrial |
| SEQ ID NO: 2009 | Nga05703 | 1344.229 | 1006.6875 | phosphomannomutase |
| SEQ ID NO: 2010 | Nga05707 | 123.2068 | 91.412147 | methyltransferase type 11 |
| SEQ ID NO: 2011 | Nga05706 | 488.6481 | 375.61053 | probable dolichyl pyrophosphate glc1man9 c2 alpha- -glucosyltransferase |
| SEQ ID NO: 2012 | Nga05704 | 281.8018 | 275.19997 | guanylate-binding protein |
| SEQ ID NO: 2013 | Nga05702 | 335.119 | 358.49885 | ankyrin repeat family protein |
| SEQ ID NO: 2014 | Nga20864 | 1480.652 | 1381.0681 | uncharacterized protein |
| SEQ ID NO: 2015 | Nga05708 | 41.37931 | 14.941158 | ---NA--- |
| SEQ ID NO: 2016 | Nga02451.01 | 757.2407 | 824.83216 | zinc transporter |
| SEQ ID NO: 2017 | Nga02460 | 1658.027 | 2003.4759 | conserved unknown protein [Ectocarpus siliculosus] |
| SEQ ID NO: 2018 | Nga02461 | 322.1477 | 225.37082 | ---NA--- |
| SEQ ID NO: 2019 | Nga02462 | 314.6417 | 303.71045 | ---NA--- |
| SEQ ID NO: 2020 | Nga02459.01 | 69.37799 | 76.016417 | metallo-beta-lactamase superfamily protein |
| SEQ ID NO: 2021 | Nga20655 | 135.4167 | 157.97162 | glutathione s-transferase |

FIGURE 24 AF

| # | Nga model | +N rpkb | -N rpkb | GO |
|---|---|---|---|---|
| SEQ ID NO: 2022 | Nga02453.01 | 857.3643 | 952.90998 | protein |
| SEQ ID NO: 2023 | Nga04049.2 | 808.4186 | 789.84033 | 5 -3 exoribonuclease 1 |
| SEQ ID NO: 2024 | Nga02452 | 92.15956 | 95.360347 | n-acetyltransferase mak3-like protein |
| SEQ ID NO: 2025 | Nga02456 | 1085.77 | 1140.2463 | ---NA--- |
| SEQ ID NO: 2026 | Nga02448 | 5468.165 | 5239.6878 | uqcrx qcr9 like ubiquinol-cytochrome c reductase family protein |
| SEQ ID NO: 2027 | Nga02457 | 215.7012 | 254.57098 | ubiquitin carboxyl-terminal hydrolase 4 |
| SEQ ID NO: 2028 | Nga02463 | 161.6162 | 257.73916 | rna polymerase ii elongator |
| SEQ ID NO: 2029 | Nga20287 | 120.3931 | 170.33654 | elongator complex protein 2 |
| SEQ ID NO: 2030 | Nga02454 | 494.3705 | 487.84333 | potential 4 histone acetyltransferase complex component yng2 |
| SEQ ID NO: 2031 | Nga20390 | 166.362 | 378.24074 | rna polymerase ii elongator |
| SEQ ID NO: 2032 | Nga20077 | 225.0242 | 289.98309 | wd-40 repeat-containing protein |
| SEQ ID NO: 2033 | Nga20372 | 243.1694 | 236.77245 | 1-acyl-sn-glycerol-3-phosphate acyltransferase |
| SEQ ID NO: 2034 | Nga20245 | 227.4775 | 241.53189 | protein |
| SEQ ID NO: 2035 | Nga21001 | 334.2391 | 341.45418 | protein |
| SEQ ID NO: 2036 | Nga02477 | 153.1823 | 179.95472 | p-type atpase |
| SEQ ID NO: 2037 | Nga02449 | 6466.234 | 5714.0444 | citrate synthase |
| SEQ ID NO: 2038 | Nga02479 | 203.5928 | 259.45723 | e1-e2 atpase family protein |
| SEQ ID NO: 2039 | Nga02458 | 311.7326 | 308.86207 | ca-transporting atpase |
| SEQ ID NO: 2040 | Nga02455 | 1801.379 | 1933.8839 | protein |
| SEQ ID NO: 2041 | Nga01622 | 1013.298 | 1064.5078 | mitogen-activated protein kinase kinase 1-interacting protein 1 |
| SEQ ID NO: 2042 | Nga01629 | 148.6111 | 176.02552 | ---NA--- |
| SEQ ID NO: 2043 | Nga06228 | 254.0773 | 297.54065 | ---NA--- |
| SEQ ID NO: 2044 | Nga06227 | 227.9849 | 320.11289 | gtp-binding protein obg |
| SEQ ID NO: 2045 | Nga06229 | 350.8647 | 358.25505 | nadph:adrenodoxin mitochondrial |
| SEQ ID NO: 2046 | Nga00417.02 | 2296.524 | 2372.4817 | ubiquitin domain containing protein |
| SEQ ID NO: 2047 | Nga06226 | 356.0732 | 431.97183 | ---NA--- |
| SEQ ID NO: 2048 | Nga01119 | 777.1781 | 666.47701 | serine threonine-protein phosphatase 4 catalytic subunit |
| SEQ ID NO: 2049 | Nga01121 | 259.7938 | 415.4258 | diacylglycerol acyltransferase family protein |
| SEQ ID NO: 2050 | Nga01120 | 176.5499 | 242.34075 | ---NA--- |
| SEQ ID NO: 2051 | Nga03781 | 148.9002 | 185.1212 | 3 -5 exoribonuclease |
| SEQ ID NO: 2052 | Nga03772 | 1148.187 | 1012.515 | protein |
| SEQ ID NO: 2053 | Nga03774 | 3114.914 | 3644.3274 | ---NA--- |
| SEQ ID NO: 2054 | Nga03776 | 1542.533 | 1374.0075 | GrpE [Atopobium rimae ATCC 49626] |
| SEQ ID NO: 2055 | Nga03773 | 9570.216 | 11926.603 | pyruvate decarboxylase |
| SEQ ID NO: 2056 | Nga03775.01 | 595.6679 | 481.0028 | 3 (2 ) -bisphosphate nucleotidase |
| SEQ ID NO: 2057 | Nga01000 | 481.7098 | 549.40842 | nhl repeat containing 2 |
| SEQ ID NO: 2058 | Nga01001 | 338.5214 | 181.24148 | muscular protein 20 |
| SEQ ID NO: 2059 | Nga00999 | 1278.696 | 1366.1949 | folate biopterin transporter |
| SEQ ID NO: 2060 | Nga01094 | 2086.988 | 2019.1861 | peptidase m48 ste24p |
| SEQ ID NO: 2061 | Nga01097.1 | 511.3772 | 527.99547 | conserved unknown protein [Ectocarpus siliculosus] |
| SEQ ID NO: 2062 | Nga01095 | 595.3421 | 693.77429 | protein |
| SEQ ID NO: 2063 | Nga01096.1 | 560.4616 | 617.98143 | dna topoisomerase i |
| SEQ ID NO: 2064 | Nga01098 | 1.219512 | 2.0549153 | dynein heavy chain |
| SEQ ID NO: 2065 | Nga01099 | 6.666667 | 4.1266055 | dynein heavy chain |
| SEQ ID NO: 2066 | Nga04654.02 | 1314.465 | 1350.636 | protein |
| SEQ ID NO: 2067 | Nga04655.02 | 722.8464 | 900.66642 | ---NA--- |
| SEQ ID NO: 2068 | Nga05808 | 748.8636 | 745.13365 | abc1 family protein |
| SEQ ID NO: 2069 | Nga20416.1 | 301.1204 | 370.18079 | ---NA--- |
| SEQ ID NO: 2070 | Nga05810 | 4962.825 | 5506.3721 | protein |
| SEQ ID NO: 2071 | Nga05816 | 280.1498 | 301.84496 | ---NA--- |
| SEQ ID NO: 2072 | Nga20877 | 320.6349 | 333.56728 | conserved c2h2 zinc finger protein |
| SEQ ID NO: 2073 | Nga05814 | 651.0264 | 627.38623 | exocyst complex component 6 |
| SEQ ID NO: 2074 | Nga05809 | 1672.316 | 1615.671 | ---NA--- |
| SEQ ID NO: 2075 | Nga20638 | 671.6418 | 659.35979 | exocyst complex component 6b |
| SEQ ID NO: 2076 | Nga20852 | 99.45387 | 106.79771 | uncharacterized protein |
| SEQ ID NO: 2077 | Nga05813 | 27709.13 | 30559.299 | glyceraldehyde 3-phosphate |
| SEQ ID NO: 2078 | Nga21005 | 24312.97 | 18319.07 | glyceraldehyde-3-phosphate dehydrogenase |
| SEQ ID NO: 2079 | Nga05812 | 299.3601 | 333.1885 | myb dna binding protein transcription factor-like protein |
| SEQ ID NO: 2080 | Nga00912 | 118.5077 | 115.69287 | hypothetical conserved protein |
| SEQ ID NO: 2081 | Nga00910 | 509.8039 | 413.21223 | ---NA--- |
| SEQ ID NO: 2082 | Nga00909 | 715.0685 | 688.5213 | oral cancer overexpressed 1 |
| SEQ ID NO: 2083 | Nga00911 | 164.1975 | 168.50306 | nad-dependent epimerase dehydratase |
| SEQ ID NO: 2084 | Nga00918 | 449.2406 | 410.43396 | protein phosphatase |
| SEQ ID NO: 2085 | Nga01324.01 | 613.4507 | 665.19143 | upf0760 protein c2orf29-like |

FIGURE 24 AG

| # | Nga model | +N rpkb | -N rpkb | GO |
|---|---|---|---|---|
| SEQ ID NO: 2086 | Nga01327.01 | 342.3019 | 362.69716 | phosphopantothenoylcysteine decarboxylase |
| SEQ ID NO: 2087 | Nga01325.01 | 1065.072 | 1237.6855 | ---NA--- |
| SEQ ID NO: 2088 | Nga01328.01 | 1213.585 | 1115.473 | heat shock protein 101 |
| SEQ ID NO: 2089 | Nga01323 | 1176.222 | 1464.3597 | 26s proteasome non-atpase regulatory |
| SEQ ID NO: 2090 | Nga01326 | 241.1504 | 276.4004 | microtubule interacting and transport domain-containing protein |
| SEQ ID NO: 2091 | Nga01328.02 | 1213.585 | 1115.473 | heat shock protein 101 |
| SEQ ID NO: 2092 | Nga00824 | 65.1341 | 74.705789 | ---NA--- |
| SEQ ID NO: 2093 | Nga00819.01 | 590.0178 | 455.692 | uncharacterized protein conserved in bacteria with a cystatin-like fold |
| SEQ ID NO: 2094 | Nga00823 | 362.3037 | 334.61153 | pre-mrna-splicing regulator female-lethal d |
| SEQ ID NO: 2095 | Nga00822 | 168.4211 | 169.77 | ---NA--- |
| SEQ ID NO: 2096 | Nga00818 | 1076.087 | 1103.6427 | monogalactosyldiacylglycerol synthase |
| SEQ ID NO: 2097 | Nga00821 | 88.7574 | 64.096683 | ---NA--- |
| SEQ ID NO: 2098 | Nga00817 | 838.2599 | 651.26949 | fatty acid desaturase |
| SEQ ID NO: 2099 | Nga00820 | 327.619 | 292.98899 | ---NA--- |
| SEQ ID NO: 2100 | Nga05243 | 1140.489 | 944.28508 | ---NA--- |
| SEQ ID NO: 2101 | Nga03614.02 | 8410.891 | 7259.0974 | protein |
| SEQ ID NO: 2102 | Nga05238.02 | 227.2109 | 191.5924 | sorbitol dehydrogenase |
| SEQ ID NO: 2103 | Nga05240 | 1185.022 | 1338.5336 | histone deacetylase complex subunit |
| SEQ ID NO: 2104 | Nga03613.02 | 3916.282 | 4065.8798 | calcium-dependent protein |
| SEQ ID NO: 2105 | Nga05232 | 817.9104 | 786.28772 | multidrug oligosaccharidyl-lipid polysaccharide flippase |
| SEQ ID NO: 2106 | Nga05237 | 171.6418 | 176.49707 | ---NA--- |
| SEQ ID NO: 2107 | Nga05234 | 1064.363 | 899.02546 | stage iv sporulation protein fb |
| SEQ ID NO: 2108 | Nga05238.01 | 227.2109 | 191.5924 | sorbitol dehydrogenase |
| SEQ ID NO: 2109 | Nga05241 | 180.9524 | 263.0711 | ---NA--- |
| SEQ ID NO: 2110 | Nga05242 | 3325.301 | 3258.4025 | ---NA--- |
| SEQ ID NO: 2111 | Nga05236 | 463.6763 | 495.40392 | tpr repeat-containing protein |
| SEQ ID NO: 2112 | Nga06288 | 135.8025 | 203.94219 | protein |
| SEQ ID NO: 2113 | Nga06286 | 287.3016 | 244.15749 | autophagyrelated protein |
| SEQ ID NO: 2114 | Nga00970.02 | 3093.06 | 2547.4792 | glutaredoxin type i |
| SEQ ID NO: 2115 | Nga00971.2 | 204.5019 | 216.8543 | glutamine-fructose-6-phosphate transaminase |
| SEQ ID NO: 2116 | Nga06282.1 | 1803.519 | 2360.2429 | biotin and thiamin synthesis associated |
| SEQ ID NO: 2117 | Nga06287.1 | 265.5367 | 321.9102 | ---NA--- |
| SEQ ID NO: 2118 | Nga06289 | 913.6691 | 1109.7303 | small gtp-binding protein |
| SEQ ID NO: 2119 | Nga20974 | 1950.318 | 2292.0402 | small gtp-binding protein |
| SEQ ID NO: 2120 | Nga06284 | 6748.981 | 7340.161 | 15-cis-zeta-carotene isomerase |
| SEQ ID NO: 2121 | Nga06285 | 1322.974 | 1419.2279 | cbs domain-containing protein |
| SEQ ID NO: 2122 | Nga00979 | 1484.127 | 1628.2897 | predicted protein [Phaeodactylum tricornutum CCAP 1055/1] |
| SEQ ID NO: 2123 | Nga00977 | 401.8605 | 500.80676 | rrp15-like protein |
| SEQ ID NO: 2124 | Nga00976 | 361.2613 | 324.97018 | serine threonine-protein phosphatase 6 regulatory ankyrin repeat subunit c |
| SEQ ID NO: 2125 | Nga20210.1 | 152.6718 | 150.90855 | transcription factor iiic-gamma subunit |
| SEQ ID NO: 2126 | Nga00978 | 422.8758 | 569.93681 | topoisomerase 6 subunit b |
| SEQ ID NO: 2127 | Nga20277 | 250 | 189.16769 | cyclin-dependent kinase d1_2 |
| SEQ ID NO: 2128 | Nga00980 | 528.2392 | 640.58353 | ---NA--- |
| SEQ ID NO: 2129 | Nga20246.1 | 1860.104 | 2120.1638 | uncharacterized protein c9orf85 homolog |
| SEQ ID NO: 2130 | Nga01274 | 366.8342 | 371.51114 | protein |
| SEQ ID NO: 2131 | Nga01275 | 1015.57 | 910.74446 | l-gulonolactone oxidase-like |
| SEQ ID NO: 2132 | Nga01283 | 34.46502 | 50.149719 | cyclin e |
| SEQ ID NO: 2133 | Nga01273 | 2766.871 | 2698.1164 | h aca ribonucleoprotein complex subunit 3 |
| SEQ ID NO: 2134 | Nga20116 | 186.6109 | 183.10733 | genomes uncoupled 1 protein |
| SEQ ID NO: 2135 | Nga20122 | 274.3083 | 248.33031 | conserved unknown protein [Ectocarpus siliculosus] |
| SEQ ID NO: 2136 | Nga20084 | 442.6952 | 374.49335 | conserved unknown protein [Ectocarpus siliculosus] |
| SEQ ID NO: 2137 | Nga03708 | 263.3797 | 270.69436 | dna repair helicase rad25 |
| SEQ ID NO: 2138 | Nga03707 | 891.8239 | 805.27202 | 26s protease regulatory subunit 7 |
| SEQ ID NO: 2139 | Nga00893 | 3678.571 | 3271.2945 | ---NA--- |
| SEQ ID NO: 2140 | Nga20096 | 1484.926 | 1463.3038 | protein |
| SEQ ID NO: 2141 | Nga00890 | 780.9355 | 856.83869 | orotidine-5-phosphate decarboxylase orotate phosphoribosyltransferase |
| SEQ ID NO: 2142 | Nga20527 | 588.8224 | 548.1034 | dtw domain containing protein |
| SEQ ID NO: 2143 | Nga00891 | 339.2948 | 357.57237 | abc1 family protein |
| SEQ ID NO: 2144 | Nga00892 | 485.1158 | 490.85904 | ---NA--- |
| SEQ ID NO: 2145 | Nga02270 | 52.91005 | 63.045362 | ---NA--- |
| SEQ ID NO: 2146 | Nga02269 | 2376.374 | 2033.5436 | l-threonine-o-3-phosphate decarboxylase |

FIGURE 24 AH

| # | Nga model | +N rpkb | -N rpkb | GO |
|---|---|---|---|---|
| SEQ ID NO: 2147 | Nga01745 | 2281.679 | 1961.0119 | triosephosphate isomerase glyceraldehyde-3-phosphate dehydrogenase |
| SEQ ID NO: 2148 | Nga01746 | 271.7391 | 233.52326 | dihydrolipoamide s-acetyltransferase |
| SEQ ID NO: 2149 | Nga01744 | 757.1885 | 694.46947 | tricarboxylate transport mitochondrial precursor |
| SEQ ID NO: 2150 | Nga20985.1 | 152 | 181.9833 | uncharacterized protein |
| SEQ ID NO: 2151 | Nga05796.1 | 149.2637 | 234.19315 | n -dimethylguanosine trna methyltransferase |
| SEQ ID NO: 2152 | Nga05798 | 5359.477 | 5111.7314 | heat shock protein |
| SEQ ID NO: 2153 | Nga05802 | 2029.72 | 2149.424 | dihydrolipoamide s-succinyltransferase |
| SEQ ID NO: 2154 | Nga05795.02 | 3420.67 | 3770.0325 | dihydrolipoamide succinyltransferase |
| SEQ ID NO: 2155 | Nga05799 | 245.7483 | 244.09608 | cyclin-dependent kinase |
| SEQ ID NO: 2156 | Nga05800.1 | 1377.297 | 1509.5011 | electron transfer flavoprotein subunit |
| SEQ ID NO: 2157 | Nga05797 | 739.6825 | 777.86513 | cell division cycle 2 |
| SEQ ID NO: 2158 | Nga05795.01 | 3420.67 | 3770.0325 | dihydrolipoamide succinyltransferase |
| SEQ ID NO: 2159 | Nga05800.2 | 1377.297 | 1509.5011 | electron-transfer- beta polypeptide |
| SEQ ID NO: 2160 | Nga20040 | 3558.26 | 4267.4305 | ---NA--- |
| SEQ ID NO: 2161 | Nga00079 | 1211.514 | 1224.769 | dna-directed rna polymerase ii subunit rpb4 |
| SEQ ID NO: 2162 | Nga00088 | 1994.444 | 1567.6802 | ---NA--- |
| SEQ ID NO: 2163 | Nga00081.01 | 451.3981 | 552.43489 | cyclin dependent kinase |
| SEQ ID NO: 2164 | Nga00084 | 656.5008 | 635.21905 | malate synthase a |
| SEQ ID NO: 2165 | Nga00071 | 3824.536 | 3974.4332 | cdgsh iron sulfur domain 1 |
| SEQ ID NO: 2166 | Nga00072 | 3163.641 | 3547.3567 | glucose-6-phosphate isomerase |
| SEQ ID NO: 2167 | Nga00083 | 620.915 | 550.46692 | phosphatidylinositide phosphatase sac1 |
| SEQ ID NO: 2168 | Nga20882 | 1043.103 | 855.38128 | ap-4 complex subunit sigma- |
| SEQ ID NO: 2169 | Nga00086 | 4351.607 | 4235.67 | 60s ribosomal protein l13a |
| SEQ ID NO: 2170 | Nga00087 | 177.1379 | 189.99129 | regulator of chromosome condensation -like protein |
| SEQ ID NO: 2171 | Nga00078 | 14765.62 | 16839.859 | cell division protein |
| SEQ ID NO: 2172 | Nga00089 | 5387.294 | 4742.5398 | ---NA--- |
| SEQ ID NO: 2173 | Nga00074 | 1040.564 | 987.71067 | dnaj subfamily b member 5 |
| SEQ ID NO: 2174 | Nga00114 | 967.8715 | 1118.0366 | cystinosin |
| SEQ ID NO: 2175 | Nga00082 | 2055.556 | 1843.9425 | glycolate oxidase |
| SEQ ID NO: 2176 | Nga20784 | 971.2121 | 1250.6428 | ---NA--- |
| SEQ ID NO: 2177 | Nga00085 | 297.9684 | 311.15467 | protein |
| SEQ ID NO: 2178 | Nga00073 | 915.0579 | 844.83883 | prefoldin subunit 2 |
| SEQ ID NO: 2179 | Nga00076 | 2075.351 | 3336.1669 | imp dehydrogenase |
| SEQ ID NO: 2180 | Nga00075 | 1472.652 | 1115.6527 | translation elongation factor p |
| SEQ ID NO: 2181 | Nga00080 | 523.774 | 557.67461 | dna nad-dependent |
| SEQ ID NO: 2182 | Nga00090 | 292.1788 | 274.13686 | postreplication repair e3 ubiquitin-protein ligase rad18 |
| SEQ ID NO: 2183 | Nga00077 | 436.3002 | 469.30685 | protein |
| SEQ ID NO: 2184 | Nga02030 | 1970.76 | 2061.9453 | cystatin b |
| SEQ ID NO: 2185 | Nga02031 | 595.6989 | 479.88428 | aldehyde dehydrogenase |
| SEQ ID NO: 2186 | Nga02032 | 382.8265 | 299.39113 | protein |
| SEQ ID NO: 2187 | Nga01783.02 | 1437.126 | 1556.7434 | tim10-like protein |
| SEQ ID NO: 2188 | Nga01781.02 | 1005.471 | 838.98776 | endomembrane protein 70 containing expressed |
| SEQ ID NO: 2189 | Nga01782.2 | 159.7494 | 158.62549 | nad-dependent histone deacetylase sir2-like protein |
| SEQ ID NO: 2190 | Nga01677.1 | 1513.24 | 1322.8277 | molecular chaperone ( superfamily) |
| SEQ ID NO: 2191 | Nga01678.01 | 756.1299 | 824.80835 | mitochondrial-processing peptidase subunit beta |
| SEQ ID NO: 2192 | Nga01679.01 | 561.5797 | 630.07383 | pleiotropic regulator 1 |
| SEQ ID NO: 2193 | Nga01680 | 355.248 | 427.29643 | protein |
| SEQ ID NO: 2194 | Nga20780 | 336.8201 | 243.99202 | protein |
| SEQ ID NO: 2195 | Nga06766 | 253.5211 | 274.62269 | dna glycosylase |
| SEQ ID NO: 2196 | Nga06759 | 277.7778 | 281.75024 | ---NA--- |
| SEQ ID NO: 2197 | Nga06758 | 857.7388 | 887.55589 | phospholipase ddhd1 |
| SEQ ID NO: 2198 | Nga20206 | 237.1202 | 271.8817 | mitogen-activated protein kinase kinase 2 |
| SEQ ID NO: 2199 | Nga06760 | 1053.704 | 1089.2519 | flj10769 protein |
| SEQ ID NO: 2200 | Nga06757 | 760.7399 | 517.70309 | cellulase 2 |
| SEQ ID NO: 2201 | Nga01656 | 558.6488 | 618.41641 | myb domain-containing protein |
| SEQ ID NO: 2202 | Nga01658 | 87.96296 | 85.254523 | glutathione s-transferase c-terminal domain-containing |
| SEQ ID NO: 2203 | Nga06216 | 589.5789 | 541.23038 | transmembrane protein 110 |
| SEQ ID NO: 2204 | Nga06212 | 637.6147 | 579.38109 | uncharacterized protein c3orf26-like |
| SEQ ID NO: 2205 | Nga06213 | 312.2476 | 287.93904 | arylsulfatase j |
| SEQ ID NO: 2206 | Nga06217 | 373.7374 | 368.73721 | protein |
| SEQ ID NO: 2207 | Nga06218 | 317.757 | 354.32886 | ---NA--- |
| SEQ ID NO: 2208 | Nga06214 | 415.1515 | 541.61697 | conserved unknown protein [Ectocarpus siliculosus] |
| SEQ ID NO: 2209 | Nga06215.1 | 576.7386 | 467.583 | conserved unknown protein [Ectocarpus siliculosus] |

FIGURE 24 AI

| # | Nga model | +N rpkb | -N rpkb | GO |
|---|---|---|---|---|
| SEQ ID NO: 2210 | Nga20085 | 154.0195 | 159.51454 | subunit of golgi mannosyltransferase complex |
| SEQ ID NO: 2211 | Nga03572.2 | 794.279 | 844.68477 | protein |
| SEQ ID NO: 2212 | Nga20635 | 166.6667 | 116.06078 | ---NA--- |
| SEQ ID NO: 2213 | Nga20691 | 129.2929 | 144.43119 | kinesin family member 2b |
| SEQ ID NO: 2214 | Nga03572.1 | 794.279 | 844.68477 | protein |
| SEQ ID NO: 2215 | Nga03571.1 | 1037.758 | 960.85087 | protein |
| SEQ ID NO: 2216 | Nga03570.1 | 262.1118 | 255.67012 | integral membrane mpv17 pmp22 |
| SEQ ID NO: 2217 | Nga02313.01 | 777.4914 | 613.2742 | zinc fyve domain containing 21 |
| SEQ ID NO: 2218 | Nga02316.1 | 51.3308 | 32.950082 | transducin wd40 domain-containing protein |
| SEQ ID NO: 2219 | Nga02315 | 3352.59 | 2942.5698 | canine-like rab-type small g protein |
| SEQ ID NO: 2220 | Nga02314 | 8992.026 | 6693.9366 | ---NA--- |
| SEQ ID NO: 2221 | Nga02067 | 752.0176 | 748.64738 | ---NA--- |
| SEQ ID NO: 2222 | Nga20237 | 331.5364 | 291.9768 | protein kinase domain protein |
| SEQ ID NO: 2223 | Nga02068 | 76.74419 | 98.246799 | ---NA--- |
| SEQ ID NO: 2224 | Nga02066 | 320.4301 | 216.64679 | acetyl-coenzyme a transporter 1 |
| SEQ ID NO: 2225 | Nga00871 | 1874.825 | 1851.3453 | small gtp-binding protein |
| SEQ ID NO: 2226 | Nga00873 | 976.7442 | 1070.331 | phosphoribosylpyrophosphate synthetase |
| SEQ ID NO: 2227 | Nga00872 | 669.0717 | 749.77087 | ---NA--- |
| SEQ ID NO: 2228 | Nga00869 | 1194.201 | 1132.0022 | oligopeptidase b |
| SEQ ID NO: 2229 | Nga00870 | 538.0711 | 419.73024 | conserved unknown protein [Ectocarpus siliculosus] |
| SEQ ID NO: 2230 | Nga00876 | 352.8571 | 340.96078 | alpha- -mannosyltransferase |
| SEQ ID NO: 2231 | Nga00874 | 463.5368 | 469.57089 | protein |
| SEQ ID NO: 2232 | Nga00875 | 524.3399 | 635.4615 | conserved unknown protein [Ectocarpus siliculosus] |
| SEQ ID NO: 2233 | Nga01846 | 216.3934 | 200.66465 | aaa family atpase |
| SEQ ID NO: 2234 | Nga01845 | 131.4554 | 76.28408 | diphosphate fructose-6-phosphate 1-phosphotransferase |
| SEQ ID NO: 2235 | Nga01843 | 185.1157 | 156.82843 | pyrophosphate-dependent phosphofructokinase alpha subunit |
| SEQ ID NO: 2236 | Nga04265.2 | 125.0936 | 116.84321 | ---NA--- |
| SEQ ID NO: 2237 | Nga01844 | 446.7509 | 381.2827 | peroxisomal membrane protein pmp47b |
| SEQ ID NO: 2238 | Nga01842 | 594.5626 | 738.8014 | glutathione s-transferase mu 1-like |
| SEQ ID NO: 2239 | Nga02391 | 564.4871 | 757.02912 | ribose-phosphate pyrophosphokinase |
| SEQ ID NO: 2240 | Nga02390.1 | 608.7654 | 536.69581 | gtp cyclohydrolase ii |
| SEQ ID NO: 2241 | Nga02392.01 | 639.0328 | 692.22203 | cd4-specific ankyrin repeat protein |
| SEQ ID NO: 2242 | Nga01983.02 | 1527.665 | 1594.8829 | conserved unknown protein [Ectocarpus siliculosus] |
| SEQ ID NO: 2243 | Nga02022.1 | 988.9503 | 906.68476 | m-aaa protease afg3 yta10-like protein |
| SEQ ID NO: 2244 | Nga20730 | 132 | 90.991651 | epsilon 1 |
| SEQ ID NO: 2245 | Nga20701 | 95.2381 | 103.16514 | epsilon 1 |
| SEQ ID NO: 2246 | Nga02082 | 126.0163 | 134.3034 | epsilon tubulin |
| SEQ ID NO: 2247 | Nga02081 | 2184.369 | 2097.002 | protein atypical group |
| SEQ ID NO: 2248 | Nga20646.1 | 237.1968 | 195.62446 | ---NA--- |
| SEQ ID NO: 2249 | Nga01645.01 | 604.0992 | 504.80805 | lysophospholipase-like protein |
| SEQ ID NO: 2250 | Nga01647 | 75.63025 | 109.23367 | ---NA--- |
| SEQ ID NO: 2251 | Nga01646.1 | 1423.3 | 1713.4221 | iojap-like protein |
| SEQ ID NO: 2252 | Nga05879 | 203.5836 | 230.56787 | cell division cycle 5-like protein |
| SEQ ID NO: 2253 | Nga05878 | 349.537 | 317.19698 | ---NA--- |
| SEQ ID NO: 2254 | Nga05877 | 719.5915 | 572.29351 | hypothetical protein Pmar_PMAR026561 [Perkinsus marinus ATCC 50983] |
| SEQ ID NO: 2255 | Nga05880 | 297.9351 | 217.28586 | ---NA--- |
| SEQ ID NO: 2256 | Nga05876 | 377.5194 | 445.46946 | cell division cycle 5-like protein |
| SEQ ID NO: 2257 | Nga05872 | 9011.161 | 7577.8017 | glutathione peroxidase |
| SEQ ID NO: 2258 | Nga05875 | 1426.564 | 1155.1728 | nad-dependent epimerase dehydratase |
| SEQ ID NO: 2259 | Nga20683 | 54.34783 | 64.758551 | protein |
| SEQ ID NO: 2260 | Nga21034 | 166.1808 | 189.48699 | hypothetical protein CaO19.1645 [Candida albicans SC5314] |
| SEQ ID NO: 2261 | Nga05873 | 296.4286 | 352.05103 | myotubularin-related protein |
| SEQ ID NO: 2262 | Nga05874 | 610.1974 | 564.77822 | loc779510 protein |
| SEQ ID NO: 2263 | Nga05871 | 323.3743 | 432.78591 | lysyl-trna synthetase |
| SEQ ID NO: 2264 | Nga03925.01 | 1104.401 | 1177.4764 | ---NA--- |
| SEQ ID NO: 2265 | Nga03921.1 | 4067.703 | 4165.822 | ribosomal protein s7 |
| SEQ ID NO: 2266 | Nga03920.01 | 772.9636 | 741.5553 | cytochrome c oxidase assembly mitochondrial |
| SEQ ID NO: 2267 | Nga03924 | 616.5703 | 666.84633 | branched-chain-amino-acid transaminase |
| SEQ ID NO: 2268 | Nga03922 | 820.3209 | 660.36722 | protein |
| SEQ ID NO: 2269 | Nga03926 | 1188.748 | 1170.7184 | ---NA--- |
| SEQ ID NO: 2270 | Nga03923 | 2248.792 | 2217.4898 | periplasmic binding protein |
| SEQ ID NO: 2271 | Nga02252 | 639.3606 | 669.85196 | atp-binding cassette protein c4-like |
| SEQ ID NO: 2272 | Nga02253 | 212.1212 | 306.3692 | ---NA--- |
| SEQ ID NO: 2273 | Nga02248 | 255.914 | 186.36283 | ---NA--- |

FIGURE 24 AJ

| # | Nga model | +N rpkb | -N rpkb | GO |
|---|---|---|---|---|
| SEQ ID NO: 2274 | Nga02247.1 | 695.0445 | 664.80558 | histone deacetylase superfamily protein |
| SEQ ID NO: 2275 | Nga02249 | 66.0066 | 89.375738 | ---NA--- |
| SEQ ID NO: 2276 | Nga01202.02 | 701.7857 | 658.96731 | magnesium-dependent phosphatase 1 |
| SEQ ID NO: 2277 | Nga03425 | 845.9445 | 722.35252 | cdc25 protein |
| SEQ ID NO: 2278 | Nga03428 | 3385.317 | 3369.2379 | ---NA--- |
| SEQ ID NO: 2279 | Nga03430.1 | 1044.761 | 980.39865 | fha domain containing protein |
| SEQ ID NO: 2280 | Nga03438 | 469.8795 | 349.7671 | pseudouridine synthase and archaeosine transglycosylase domain-containing protein |
| SEQ ID NO: 2281 | Nga03432 | 897.1471 | 907.57438 | 4fe-4s iron-sulfur binding protein |
| SEQ ID NO: 2282 | Nga20095 | 2260.87 | 2214.2576 | aldo keto reductase |
| SEQ ID NO: 2283 | Nga03431 | 542.2427 | 554.9286 | methyltransferase type 11 |
| SEQ ID NO: 2284 | Nga03437 | 555.8158 | 716.23665 | tom1 protein |
| SEQ ID NO: 2285 | Nga03426 | 426.1874 | 490.86211 | ubiquitin-conjugating enzyme e2 t |
| SEQ ID NO: 2286 | Nga03436 | 390.7886 | 372.66876 | protein |
| SEQ ID NO: 2287 | Nga03434 | 400.995 | 437.60496 | conserved unknown protein [Ectocarpus siliculosus] |
| SEQ ID NO: 2288 | Nga03435 | 610.8298 | 737.01873 | dead deah box helicase |
| SEQ ID NO: 2289 | Nga20396 | 228.5966 | 237.10681 | cap-specific mrna (nucleoside-2 -o-)-methyltransferase 1 |
| SEQ ID NO: 2290 | Nga03452 | 3679.811 | 2759.9115 | protein |
| SEQ ID NO: 2291 | Nga03427 | 12704.65 | 15826.424 | ypl260w-like protein |
| SEQ ID NO: 2292 | Nga03429 | 1508.311 | 1284.8998 | hect e3 ubiquitin |
| SEQ ID NO: 2293 | Nga21287 | 101.5625 | 101.55318 | ---NA--- |
| SEQ ID NO: 2294 | Nga20716 | 38.46154 | 53.566514 | dna helicase |
| SEQ ID NO: 2295 | Nga02368 | 879.2627 | 936.47321 | hypothetical protein VOLCADRAFT_103907 [Volvox carteri f. nagariensis] |
| SEQ ID NO: 2296 | Nga21187 | 1103.261 | 1208.8263 | sucrose-phosphate phosphatase |
| SEQ ID NO: 2297 | Nga02367 | 387.5598 | 321.34213 | sulfate permease |
| SEQ ID NO: 2298 | Nga02366.1 | 334.6614 | 379.77923 | ---NA--- |
| SEQ ID NO: 2299 | Nga02244 | 6858.185 | 5816.4571 | ---NA--- |
| SEQ ID NO: 2300 | Nga02243 | 740.0722 | 732.58421 | homogentisate solanesyltransferase |
| SEQ ID NO: 2301 | Nga21059 | 619.9295 | 685.85712 | exosome complex exonuclease rrp41 |
| SEQ ID NO: 2302 | Nga02242.01 | 502.994 | 507.88753 | drug metabolite transporter superfamily |
| SEQ ID NO: 2303 | Nga04175 | 31271.32 | 18693.283 | light-harvesting protein |
| SEQ ID NO: 2304 | Nga04176 | 1022.435 | 1013.1865 | histone acetyltransferase |
| SEQ ID NO: 2305 | Nga04174 | 664.9162 | 702.65287 | beta-galactosidase |
| SEQ ID NO: 2306 | Nga04173 | 1576.88 | 1531.846 | ap-2 complex subunit mu |
| SEQ ID NO: 2307 | Nga00239.01 | 309.4001 | 285.51939 | integral membrane protein gpr155-like |
| SEQ ID NO: 2308 | Nga00243.01 | 5108.949 | 1993.6562 | ---NA--- |
| SEQ ID NO: 2309 | Nga00236 | 628.2051 | 396.78899 | ---NA--- |
| SEQ ID NO: 2310 | Nga00249.01 | 2197.105 | 1291.9193 | ---NA--- |
| SEQ ID NO: 2311 | Nga00237 | 931.9372 | 1201.3877 | ---NA--- |
| SEQ ID NO: 2312 | Nga00242.1 | 4126.603 | 2518.8661 | ---NA--- |
| SEQ ID NO: 2313 | Nga00238.01 | 4637.011 | 3068.5203 | ---NA--- |
| SEQ ID NO: 2314 | Nga00246 | 109.7561 | 165.12713 | ---NA--- |
| SEQ ID NO: 2315 | Nga00241 | 508.4623 | 540.56936 | propionyl- carboxylase |
| SEQ ID NO: 2316 | Nga00247 | 77.50473 | 61.431036 | ---NA--- |
| SEQ ID NO: 2317 | Nga00235 | 242.9178 | 299.96067 | conserved unknown protein [Ectocarpus siliculosus] |
| SEQ ID NO: 2318 | Nga00248 | 165.9919 | 149.10913 | ---NA--- |
| SEQ ID NO: 2319 | Nga00245 | 109.7561 | 165.12713 | ---NA--- |
| SEQ ID NO: 2320 | Nga00240 | 979.4195 | 975.76799 | hypothetical protein CY0110_14003 [Cyanothece sp. CCY0110] |
| SEQ ID NO: 2321 | Nga00244 | 1148.058 | 1196.2899 | carboxyl-terminal protease |
| SEQ ID NO: 2322 | Nga06410.2 | 353.6379 | 377.57393 | nicotinate-nucleotide pyrophosphorylase |
| SEQ ID NO: 2323 | Nga00968.01 | 54.57227 | 59.114537 | hypothetical protein PTSG_07517 [Salpingoeca sp. ATCC 50818] |
| SEQ ID NO: 2324 | Nga00966.1 | 738.2107 | 652.13643 | mitogen-activated protein kinase |
| SEQ ID NO: 2325 | Nga00965.01 | 26928.68 | 20938.844 | oxygen-evolving enhancer protein |
| SEQ ID NO: 2326 | Nga00964 | 2335.029 | 1760.2552 | nad-dependent epimerase dehydratase |
| SEQ ID NO: 2327 | Nga00967.01 | 484.4479 | 507.08152 | dna polymerase beta |
| SEQ ID NO: 2328 | Nga03051.02 | 599.3512 | 581.59032 | sentrin-specific protease 8 |
| SEQ ID NO: 2329 | Nga06386 | 252.1877 | 251.6343 | hypothetical protein SKA58_14132 [Sphingomonas sp. SKA58] |
| SEQ ID NO: 2330 | Nga21046 | 432.1951 | 425.89588 | tho complex subunit 5 homolog |
| SEQ ID NO: 2331 | Nga20043 | 436.5869 | 522.00729 | nucleoporin 98kd |
| SEQ ID NO: 2332 | Nga20534 | 252.3364 | 187.28811 | gtpase activator nb4s evi5 (contains tbc domain) calmodulin-binding protein pollux (contains ptb and tbc domains) |
| SEQ ID NO: 2333 | Nga05196.1 | 1679.558 | 1479.2228 | spermidine synthase |
| SEQ ID NO: 2334 | Nga05198 | 264.7263 | 262.73866 | ---NA--- |
| SEQ ID NO: 2335 | Nga05197 | 1009.174 | 1190.0666 | ---NA--- |

FIGURE 24 AK

| # | Nga model | +N rpkb | -N rpkb | GO |
|---|---|---|---|---|
| SEQ ID NO: 2336 | Nga05194 | 50.98039 | 36.107798 | phosphatidylinositol n-acetylglucosaminyltransferase subunit |
| SEQ ID NO: 2337 | Nga05199 | 317.6329 | 329.02577 | protein |
| SEQ ID NO: 2338 | Nga05193 | 731.4619 | 762.50948 | dna photolyase |
| SEQ ID NO: 2339 | Nga05190 | 1821.705 | 1648.6429 | protein |
| SEQ ID NO: 2340 | Nga05191 | 205.8636 | 202.28652 | probable phospholipid-transporting atpase ia isoform 1 |
| SEQ ID NO: 2341 | Nga05195.1 | 38.13559 | 32.12982 | dna repair and recombination protein rad26 |
| SEQ ID NO: 2342 | Nga00943.02 | 72.56236 | 58.951507 | dna repair and recombination protein rad54 |
| SEQ ID NO: 2343 | Nga00935.02 | 212.3552 | 201.45084 | mate efflux family protein |
| SEQ ID NO: 2344 | Nga20392 | 179.34 | 161.63032 | methyltransferase small |
| SEQ ID NO: 2345 | Nga04290 | 646.7149 | 749.69921 | protein |
| SEQ ID NO: 2346 | Nga02441 | 562.0781 | 601.86729 | atp-dependent rna helicase |
| SEQ ID NO: 2347 | Nga02442 | 277.2512 | 304.60607 | ---NA--- |
| SEQ ID NO: 2348 | Nga01803 | 97.11286 | 82.450877 | ---NA--- |
| SEQ ID NO: 2349 | Nga01804 | 6029.674 | 5975.4656 | 40s ribosomal protein s23 |
| SEQ ID NO: 2350 | Nga01805 | 489.8407 | 428.89164 | carrier protein |
| SEQ ID NO: 2351 | Nga01802 | 3402.211 | 3678.6535 | mitochondrial carrier protein |
| SEQ ID NO: 2352 | Nga04343.01 | 18888.24 | 14347.115 | ---NA--- |
| SEQ ID NO: 2353 | Nga04342.01 | 517.7936 | 528.12473 | dna-directed rna polymerases and iii kda polypeptide |
| SEQ ID NO: 2354 | Nga04344 | 770.7359 | 707.25823 | trypsin 5g1 |
| SEQ ID NO: 2355 | Nga04560 | 261.4379 | 343.77141 | retinol dehydrogenase 14 |
| SEQ ID NO: 2356 | Nga04618 | 162.2103 | 204.67522 | ---NA--- |
| SEQ ID NO: 2357 | Nga04617 | 10205.34 | 15520.908 | ---NA--- |
| SEQ ID NO: 2358 | Nga01794.01 | 1708.625 | 1941.741 | ---NA--- |
| SEQ ID NO: 2359 | Nga01792.01 | 1814.887 | 1902.2904 | expressed unknown protein [Ectocarpus siliculosus] |
| SEQ ID NO: 2360 | Nga01793.01 | 333.8789 | 304.93656 | protein |
| SEQ ID NO: 2361 | Nga01791.1 | 2943.874 | 3333.4838 | beta- aspartyl asparaginyl family |
| SEQ ID NO: 2362 | Nga04213 | 256.4103 | 273.7844 | sulfate permease family |
| SEQ ID NO: 2363 | Nga04212 | 641.0749 | 704.82976 | ---NA--- |
| SEQ ID NO: 2364 | Nga03741 | 703.5461 | 815.88259 | ---NA--- |
| SEQ ID NO: 2365 | Nga03740 | 1138.486 | 948.04774 | solute carrier family member b2 |
| SEQ ID NO: 2366 | Nga03742 | 885.5932 | 900.94639 | radical sam cfr family |
| SEQ ID NO: 2367 | Nga20943 | 3762.472 | 4644.2734 | protein |
| SEQ ID NO: 2368 | Nga20613 | 662.2807 | 676.22938 | protein |
| SEQ ID NO: 2369 | Nga03739.01 | 7230.616 | 8437.329 | malate synthase |
| SEQ ID NO: 2370 | Nga03865 | 148.1481 | 176.08124 | nucleolar complex protein 3 homolog |
| SEQ ID NO: 2371 | Nga03858 | 598.4556 | 588.04128 | cystathionine beta-lyase |
| SEQ ID NO: 2372 | Nga03859 | 128.2435 | 143.78255 | atp-dependent dna helicase |
| SEQ ID NO: 2373 | Nga03860 | 5805.501 | 5448.0921 | 60s ribosomal protein l43 |
| SEQ ID NO: 2374 | Nga03861 | 203.4739 | 232.05756 | es2 protein |
| SEQ ID NO: 2375 | Nga04688 | 730.6219 | 994.80017 | histidine kinase |
| SEQ ID NO: 2376 | Nga04511 | 149.4465 | 158.88764 | msk16-like protein rbm13 |
| SEQ ID NO: 2377 | Nga04510 | 215.8399 | 204.57943 | smad nuclear interacting protein 1 |
| SEQ ID NO: 2378 | Nga02200 | 1085.137 | 1277.0594 | mitochondrial import tom22 homolog |
| SEQ ID NO: 2379 | Nga02201.1 | 474.1533 | 494.30996 | gpn-loop gtpase 2-like |
| SEQ ID NO: 2380 | Nga02199 | 706.6136 | 822.52523 | pyruvate dehydrogenase |
| SEQ ID NO: 2381 | Nga02202 | 119.9791 | 189.8626 | rwp-rk domain-containing protein |
| SEQ ID NO: 2382 | Nga06333 | 496.1464 | 415.34404 | solute carrier family 25 member 45-like |
| SEQ ID NO: 2383 | Nga21292 | 68.62745 | 95.579465 | ---NA--- |
| SEQ ID NO: 2384 | Nga21291 | 104.8951 | 166.65138 | ---NA--- |
| SEQ ID NO: 2385 | Nga06337 | 169.0909 | 196.95163 | protein |
| SEQ ID NO: 2386 | Nga20480 | 584.3972 | 852.75863 | phosphoglucomutase phosphomannomutase alpha beta alpha domain i |
| SEQ ID NO: 2387 | Nga20323 | 143.1065 | 209.84113 | ---NA--- |
| SEQ ID NO: 2388 | Nga21235 | 658.0977 | 620.97987 | phosphoglucomutase phosphomannomutase |
| SEQ ID NO: 2389 | Nga21226 | 752.7594 | 1162.145 | phosphoglucomutase phosphomannomutase family protein |
| SEQ ID NO: 2390 | Nga06335 | 68.37607 | 114.18705 | snf2-related domain-containing protein |
| SEQ ID NO: 2391 | Nga20439 | 225.1656 | 172.16963 | oligomeric golgi complex component |
| SEQ ID NO: 2392 | Nga20337 | 157.3187 | 171.89485 | ---NA--- |
| SEQ ID NO: 2393 | Nga21006 | 396.2264 | 270.24075 | uncharacterized protein |
| SEQ ID NO: 2394 | Nga06331 | 7981.792 | 7293.8804 | fatty-acyl elongase |
| SEQ ID NO: 2395 | Nga06336 | 982.7338 | 932.04877 | fatty acid elongation protein 3 |
| SEQ ID NO: 2396 | Nga06332 | 782.6087 | 1093.2242 | rhodanese domain protein |
| SEQ ID NO: 2397 | Nga06334 | 508.3415 | 553.84189 | protein |
| SEQ ID NO: 2398 | Nga03803 | 50.77031 | 70.850175 | dynein heavy chain |

FIGURE 24 AL

| # | Nga model | +N rpkb | -N rpkb | GO |
|---|---|---|---|---|
| SEQ ID NO: 2399 | Nga03804 | 1038.889 | 1060.3657 | endoglucanase e |
| SEQ ID NO: 2400 | Nga05524 | 937.1383 | 1000.6096 | serine threonine protein phosphatase 5 |
| SEQ ID NO: 2401 | Nga05527 | 178.3476 | 137.64169 | alpha-( )-fucosyltransferase |
| SEQ ID NO: 2402 | Nga05520 | 471.7322 | 525.67412 | methylisocitrate lyase |
| SEQ ID NO: 2403 | Nga20584 | 105.1136 | 95.398444 | ---NA--- |
| SEQ ID NO: 2404 | Nga05526 | 1969.194 | 1374.5777 | atp-dependent clp protease adaptor protein |
| SEQ ID NO: 2405 | Nga05522 | 1169.638 | 1507.5152 | dihydroxy-acid dehydratase |
| SEQ ID NO: 2406 | Nga05525 | 607.9772 | 623.39959 | anthranilate synthase |
| SEQ ID NO: 2407 | Nga05521 | 289.7436 | 286.08486 | yeats domain-containing protein |
| SEQ ID NO: 2408 | Nga05523 | 4374.106 | 4691.6892 | 30s ribosomal protein s1 |
| SEQ ID NO: 2409 | Nga02227.01 | 599.177 | 542.06275 | gluconolactonase |
| SEQ ID NO: 2410 | Nga02226.1 | 439.0592 | 526.56133 | far upstream binding protein |
| SEQ ID NO: 2411 | Nga02075 | 564.8415 | 577.51665 | ---NA--- |
| SEQ ID NO: 2412 | Nga02076 | 2409.051 | 2402.1585 | calcium-dependent protein |
| SEQ ID NO: 2413 | Nga02074 | 74.38795 | 98.939447 | abc transporter atpase |
| SEQ ID NO: 2414 | Nga04611 | 211.6402 | 299.94308 | conserved unknown protein [Ectocarpus siliculosus] |
| SEQ ID NO: 2415 | Nga04613 | 117.6471 | 143.3692 | ---NA--- |
| SEQ ID NO: 2416 | Nga04612 | 111.6505 | 73.617841 | ---NA--- |
| SEQ ID NO: 2417 | Nga04610.1 | 184.9837 | 172.09157 | pectinacetylesterase family protein |
| SEQ ID NO: 2418 | Nga02849 | 525.8456 | 380.89464 | ap-4 complex subunit mu- |
| SEQ ID NO: 2419 | Nga02855 | 386.0148 | 438.4665 | protein |
| SEQ ID NO: 2420 | Nga02844 | 1185.029 | 1008.5282 | estradiol 17-beta-dehydrogenase 12-b |
| SEQ ID NO: 2421 | Nga02856 | 491.9852 | 494.20044 | 3-hydroxyisobutyrate dehydrogenase |
| SEQ ID NO: 2422 | Nga20358 | 528.8684 | 485.32883 | 3-hydroxyisobutyrate dehydrogenase |
| SEQ ID NO: 2423 | Nga02848 | 976.257 | 1037.0906 | conserved hypothetical protein [Phytophthora infestans T30-4] |
| SEQ ID NO: 2424 | Nga02851 | 1228.369 | 1046.3579 | ferredoxin [Ectocarpus siliculosus] |
| SEQ ID NO: 2425 | Nga02852 | 562.0023 | 433.78652 | protein |
| SEQ ID NO: 2426 | Nga02853 | 264.3756 | 217.45765 | protein |
| SEQ ID NO: 2427 | Nga02845 | 437.5 | 424.57263 | fusca protein fus6 |
| SEQ ID NO: 2428 | Nga02850 | 368.3908 | 377.88678 | sec1-like family protein |
| SEQ ID NO: 2429 | Nga02857 | 355.042 | 299.63404 | drug metabolite transporter superfamily |
| SEQ ID NO: 2430 | Nga02847 | 1017.954 | 946.86315 | aps kinase atp sulfurlyase pyrophosphatase fusion protein |
| SEQ ID NO: 2431 | Nga02854 | 292.6829 | 314.90189 | uncharacterized protein kiaa1530-like |
| SEQ ID NO: 2432 | Nga02846 | 611.9697 | 682.14173 | prp6 pre-mrna splicing factor 6 homolog |
| SEQ ID NO: 2433 | Nga04240 | 5503.173 | 5256.0907 | cen |
| SEQ ID NO: 2434 | Nga04241 | 849.6241 | 855.18469 | 5 ampactivated protein kinase subunit beta |
| SEQ ID NO: 2435 | Nga04242 | 1462.145 | 1146.4511 | bet1 homolog |
| SEQ ID NO: 2436 | Nga20559 | 322.3767 | 340.99273 | ---NA--- |
| SEQ ID NO: 2437 | Nga20774 | 265.1254 | 273.87223 | glycosyl hydrolase family 85 protein |
| SEQ ID NO: 2438 | Nga04073 | 550.8637 | 589.43728 | fructosamine kinase |
| SEQ ID NO: 2439 | Nga04074 | 640.264 | 661.38046 | coiled-coil domain-containing |
| SEQ ID NO: 2440 | Nga04075 | 1043.021 | 1006.5998 | carbonyl reductase |
| SEQ ID NO: 2441 | Nga04072 | 890.3038 | 1397.1201 | xanthine dehydrogenase |
| SEQ ID NO: 2442 | Nga04116 | 4064.74 | 4474.4449 | protein |
| SEQ ID NO: 2443 | Nga04117 | 105.7692 | 93.741399 | ---NA--- |
| SEQ ID NO: 2444 | Nga20307 | 196.1853 | 221.36933 | dna-directed rna polymerase iii subunit rpc8 |
| SEQ ID NO: 2445 | Nga04118 | 969.4656 | 998.89053 | conserved hypothetical protein [Phytophthora infestans T30-4] |
| SEQ ID NO: 2446 | Nga04115 | 762.8205 | 1027.6835 | ---NA--- |
| SEQ ID NO: 2447 | Nga04114 | 1065.911 | 992.64457 | cinnamyl alcohol dehydrogenase-like protein |
| SEQ ID NO: 2448 | Nga01942 | 965.3036 | 871.15096 | redoxin domain protein |
| SEQ ID NO: 2449 | Nga01941 | 6220.363 | 5204.6596 | peptidyl-prolyl cis-trans isomerase fkbp2-like |
| SEQ ID NO: 2450 | Nga02010 | 221.4765 | 175.69231 | membrane protein |
| SEQ ID NO: 2451 | Nga20356 | 199.3464 | 212.39881 | membrane protein |
| SEQ ID NO: 2452 | Nga02008 | 5251.773 | 5527.5661 | 60s ribosomal protein l9 |
| SEQ ID NO: 2453 | Nga20594 | 479.5918 | 331.60223 | ---NA--- |
| SEQ ID NO: 2454 | Nga20488 | 442.8044 | 375.73428 | thioredoxin-like protein |
| SEQ ID NO: 2455 | Nga02363.2 | 196.2296 | 182.85954 | alpha- -glucosyltransferase |
| SEQ ID NO: 2456 | Nga04938.1 | 648.4099 | 700.46576 | atp-dependent protease la |
| SEQ ID NO: 2457 | Nga20344 | 126.3345 | 132.99491 | ---NA--- |
| SEQ ID NO: 2458 | Nga06450 | 138.8889 | 202.03173 | ---NA--- |
| SEQ ID NO: 2459 | Nga06451 | 377.5811 | 316.34266 | ---NA--- |
| SEQ ID NO: 2460 | Nga06448 | 592.9204 | 410.07381 | channel hemolysin iii family |
| SEQ ID NO: 2461 | Nga06447 | 657.2827 | 596.64048 | plastid-lipid associated protein pap |
| SEQ ID NO: 2462 | Nga06449 | 2687.285 | 2981.6852 | protein |

FIGURE 24 AM

| # | Nga model | +N rpkb | -N rpkb | GO |
|---|---|---|---|---|
| SEQ ID NO: 2463 | Nga03733.2 | 793.9633 | 825.93034 | protein |
| SEQ ID NO: 2464 | Nga04282 | 403.5533 | 395.90276 | ---NA--- |
| SEQ ID NO: 2465 | Nga00945 | 1495.127 | 1528.7746 | protein |
| SEQ ID NO: 2466 | Nga00944 | 624.0474 | 717.26413 | brix domain containing 1 |
| SEQ ID NO: 2467 | Nga00946 | 770.1493 | 669.34157 | peptidyl prolyl isomerase h |
| SEQ ID NO: 2468 | Nga02239.01 | 275.2881 | 249.65699 | protein |
| SEQ ID NO: 2469 | Nga01635.01 | 777.3344 | 582.68131 | ---NA--- |
| SEQ ID NO: 2470 | Nga01636 | 167.2084 | 174.47538 | ---NA--- |
| SEQ ID NO: 2471 | Nga02043.01 | 344.3443 | 345.89752 | protein phosphatase 1a isoform 2 |
| SEQ ID NO: 2472 | Nga20538.1 | 195.0887 | 227.58257 | ---NA--- |
| SEQ ID NO: 2473 | Nga02045 | 59775.8 | 59616.416 | ubiquitin ribosomal protein cep52 fusion |
| SEQ ID NO: 2474 | Nga21008.1 | 5611.111 | 5267.7265 | hypothetical protein SNOG_05870 [Phaeosphaeria nodorum SN15] |
| SEQ ID NO: 2475 | Nga02046 | 185.1852 | 154.30683 | predicted protein [Micromonas pusilla CCMP1545] |
| SEQ ID NO: 2476 | Nga20951 | 707.5306 | 638.68434 | phytanoyl- dioxygenase superfamily protein |
| SEQ ID NO: 2477 | Nga02044 | 525.6831 | 522.08324 | ubiquinone biosynthesis protein coq4 mitochondrial-like |
| SEQ ID NO: 2478 | Nga02048 | 13.0719 | 10.029944 | dna topoisomerase |
| SEQ ID NO: 2479 | Nga01874 | 396.7093 | 455.47314 | ---NA--- |
| SEQ ID NO: 2480 | Nga01873 | 700 | 596.58705 | ---NA--- |
| SEQ ID NO: 2481 | Nga02062 | 540.3987 | 477.39586 | gluconolactonase |
| SEQ ID NO: 2482 | Nga21242 | 252.8302 | 188.03306 | ---NA--- |
| SEQ ID NO: 2483 | Nga05388.2 | 1009.963 | 1033.3215 | isoform b |
| SEQ ID NO: 2484 | Nga05388.1 | 1009.963 | 1033.3215 | peptidyl-trna hydrolase mitochondrial-like |
| SEQ ID NO: 2485 | Nga05386 | 130.4771 | 101.25653 | proline glycine betaine transporter |
| SEQ ID NO: 2486 | Nga05387 | 289.2157 | 297.35834 | protein |
| SEQ ID NO: 2487 | Nga00862 | 447.1387 | 534.08722 | bifunctional aspartokinase i homoserine dehydrogenase i |
| SEQ ID NO: 2488 | Nga00861.1 | 321.6031 | 379.07894 | ---NA--- |
| SEQ ID NO: 2489 | Nga21032 | 198.6301 | 220.10918 | protein |
| SEQ ID NO: 2490 | Nga01910 | 255.9809 | 238.41513 | expressed unknown protein [Ectocarpus siliculosus] |
| SEQ ID NO: 2491 | Nga01909 | 1225.446 | 1155.7719 | cell division protein |
| SEQ ID NO: 2492 | Nga03666 | 75.39683 | 73.075306 | protein |
| SEQ ID NO: 2493 | Nga03662 | 941.6058 | 684.50445 | rab acceptor 1 |
| SEQ ID NO: 2494 | Nga03664 | 24138.41 | 12092.462 | light-harvesting protein |
| SEQ ID NO: 2495 | Nga03663 | 266.7838 | 306.69418 | dna-directed rna polymerase i subunit |
| SEQ ID NO: 2496 | Nga03665 | 1622.416 | 1460.4209 | rna binding protein |
| SEQ ID NO: 2497 | Nga03661 | 389.1129 | 736.71556 | wd40 subgroup |
| SEQ ID NO: 2498 | Nga02403.02 | 9336.989 | 8769.5509 | atp synthase subunit 5 |
| SEQ ID NO: 2499 | Nga03545 | 8422.045 | 9003.6457 | immutans protein |
| SEQ ID NO: 2500 | Nga03548 | 171.5758 | 208.1915 | mitochondrial carrier protein |
| SEQ ID NO: 2501 | Nga20627 | 179.6407 | 184.86328 | ---NA--- |
| SEQ ID NO: 2502 | Nga03543 | 3441.392 | 3536.3819 | integral inner membrane protein |
| SEQ ID NO: 2503 | Nga03541 | 2442.793 | 3708.4264 | cdgsh iron sulfur domain-containing protein 1 |
| SEQ ID NO: 2504 | Nga03550 | 210.5263 | 111.91306 | enoyl- hydratase isomerase family protein |
| SEQ ID NO: 2505 | Nga03547 | 1858.561 | 2198.723 | thiol-disulfide oxidoreductase dcc |
| SEQ ID NO: 2506 | Nga03546 | 184.5343 | 184.66378 | zinc cchc domain containing 9 |
| SEQ ID NO: 2507 | Nga04457.2 | 1102.609 | 1434.2645 | ---NA--- |
| SEQ ID NO: 2508 | Nga00990.01 | 1366.231 | 1281.5907 | cytochrome b5 |
| SEQ ID NO: 2509 | Nga06569.2 | 706.0878 | 732.69641 | tripeptidyl peptidase ii |
| SEQ ID NO: 2510 | Nga00998 | 102.5641 | 101.84251 | ---NA--- |
| SEQ ID NO: 2511 | Nga20640 | 156.4626 | 180.53899 | peroxisomal membrane protein pmp34 |
| SEQ ID NO: 2512 | Nga00989 | 510.4816 | 506.32748 | lipin-like protein |
| SEQ ID NO: 2513 | Nga00991 | 2583.47 | 2934.2774 | ---NA--- |
| SEQ ID NO: 2514 | Nga00993 | 600.6006 | 585.53186 | phosphoribosylformylglycinamidine cyclo-ligase |
| SEQ ID NO: 2515 | Nga04244 | 236.0248 | 284.82549 | ---NA--- |
| SEQ ID NO: 2516 | Nga04624 | 241.573 | 312.10352 | protein |
| SEQ ID NO: 2517 | Nga04625 | 132.5648 | 124.86847 | 5 -nucleotidase domain-containing |
| SEQ ID NO: 2518 | Nga04623 | 1235.252 | 1008.4207 | short-chain dehydrogenase reductase sdr |
| SEQ ID NO: 2519 | Nga04626 | 277.4869 | 317.59739 | pleckstrin g- interacting region; mechanosensitive ion channel |
| SEQ ID NO: 2520 | Nga01963 | 2960.99 | 3505.3079 | 60s ribosomal protein l5 |
| SEQ ID NO: 2521 | Nga06074.2 | 512.7389 | 293.23212 | ---NA--- |
| SEQ ID NO: 2522 | Nga01964 | 362.5 | 537.97147 | ---NA--- |
| SEQ ID NO: 2523 | Nga04810 | 71.2743 | 121.6591 | u3 snornp protein utp20 |
| SEQ ID NO: 2524 | Nga04809 | 276.6204 | 326.28661 | protein |
| SEQ ID NO: 2525 | Nga05692.2 | 399.6479 | 446.26187 | ---NA--- |
| SEQ ID NO: 2526 | Nga05689.2 | 698.0803 | 782.6507 | ---NA--- |

FIGURE 24 AN

| # | Nga model | +N rpkb | -N rpkb | GO |
|---|---|---|---|---|
| SEQ ID NO: 2527 | Nga01860 | 1737.3 | 1309.6283 | ---NA--- |
| SEQ ID NO: 2528 | Nga01861 | 181.6881 | 194.48621 | ---NA--- |
| SEQ ID NO: 2529 | Nga06578 | 170.7989 | 183.02575 | cell division cycle associated 8 |
| SEQ ID NO: 2530 | Nga02397.2 | 1196.039 | 1347.6936 | pre-mrna-splicing factor syf2 |
| SEQ ID NO: 2531 | Nga02397.1 | 1196.039 | 1347.6936 | myosin light chain kinase |
| SEQ ID NO: 2532 | Nga02398 | 351.3028 | 416.55357 | programmed cell death protein 2 |
| SEQ ID NO: 2533 | Nga02396 | 1347.325 | 1529.9008 | protein |
| SEQ ID NO: 2534 | Nga04880 | 1498.534 | 1405.6628 | ---NA--- |
| SEQ ID NO: 2535 | Nga20325 | 672.0947 | 742.46827 | shikimate kinase |
| SEQ ID NO: 2536 | Nga02079.1 | 798.7761 | 894.11642 | c2h2 zinc-finger protein |
| SEQ ID NO: 2537 | Nga02079.2 | 798.7761 | 894.11642 | weakly similar glutamic acid-rich protein precursor |
| SEQ ID NO: 2538 | Nga06541 | 984.4444 | 989.35367 | polymerase ii (dna directed) polypeptide h |
| SEQ ID NO: 2539 | Nga06539 | 1020.164 | 975.63864 | pyridoxamine 5 -phosphate oxidase-related fmn-binding protein |
| SEQ ID NO: 2540 | Nga06548 | 91.30435 | 64.366075 | set and mynd domain containing 3 |
| SEQ ID NO: 2541 | Nga06540 | 2596.288 | 2201.6541 | small nuclear ribonucleoprotein f |
| SEQ ID NO: 2542 | Nga06546.2 | 2396.192 | 2573.5399 | cell division protein |
| SEQ ID NO: 2543 | Nga06558 | 283.1858 | 338.71032 | iduronate 2-sulfatase |
| SEQ ID NO: 2544 | Nga05620.02 | 2161.398 | 1892.5052 | polyubiquitin-like protein |
| SEQ ID NO: 2545 | Nga06549 | 250.9713 | 216.31012 | uncharacterized protein |
| SEQ ID NO: 2546 | Nga06546.1 | 2396.192 | 2573.5399 | cell division protein |
| SEQ ID NO: 2547 | Nga06543 | 1036.622 | 914.83883 | protein |
| SEQ ID NO: 2548 | Nga06542 | 555.6309 | 532.79824 | suppressor of g2 allele of skp1 ( cerevisiae) |
| SEQ ID NO: 2549 | Nga01694.1 | 1476.454 | 1599.9455 | rna binding protein |
| SEQ ID NO: 2550 | Nga01693 | 954.9072 | 1114.8402 | charged multivesicular body protein 4b |
| SEQ ID NO: 2551 | Nga02094 | 347.6085 | 497.03448 | protein kinase domain containing protein |
| SEQ ID NO: 2552 | Nga02095 | 572.973 | 626.51909 | ankyrin partial |
| SEQ ID NO: 2553 | Nga20495 | 107.4074 | 122.36532 | esterase |
| SEQ ID NO: 2554 | Nga05689.1 | 698.0803 | 782.6507 | guanylate kinase |
| SEQ ID NO: 2555 | Nga05692.1 | 399.6479 | 446.26187 | conserved unknown protein [Ectocarpus siliculosus] |
| SEQ ID NO: 2556 | Nga05693 | 159.7542 | 148.09189 | ---NA--- |
| SEQ ID NO: 2557 | Nga05688.2 | 652.6846 | 705.19257 | cu-zn superoxide dismutase |
| SEQ ID NO: 2558 | Nga05690 | 1421.274 | 1611.446 | major facilitator superfamily domain-containing protein 1 isoform 1 |
| SEQ ID NO: 2559 | Nga05688.1 | 652.6846 | 705.19257 | superoxide dismutase |
| SEQ ID NO: 2560 | Nga03579 | 1093.254 | 1058.1591 | eh-domain containing 4 |
| SEQ ID NO: 2561 | Nga03578 | 400.8594 | 434.8895 | unknown [Medicago truncatula] |
| SEQ ID NO: 2562 | Nga03580.1 | 576.8143 | 436.96902 | wd-40 repeat protein |
| SEQ ID NO: 2563 | Nga02228.02 | 58.99705 | 67.102987 | protein unc-45 homolog a |
| SEQ ID NO: 2564 | Nga20560 | 123.2394 | 133.49714 | ---NA--- |
| SEQ ID NO: 2565 | Nga06082 | 218.9817 | 191.69439 | glycyl-trna synthetase |
| SEQ ID NO: 2566 | Nga07221 | 3385.086 | 3252.0431 | protein |
| SEQ ID NO: 2567 | Nga20322 | 191.6488 | 180.92558 | type a von willebrand factor domain-containing protein |
| SEQ ID NO: 2568 | Nga02379 | 428.0394 | 401.13372 | calcium-independent phospholipase a2-gamma |
| SEQ ID NO: 2569 | Nga02377 | 2793.417 | 3212.8153 | major facilitator superfamily mfs_1 |
| SEQ ID NO: 2570 | Nga02378.1 | 371.0451 | 370.77135 | 2-acylglycerol o-acyltransferase 1 |
| SEQ ID NO: 2571 | Nga04821 | 10536.7 | 9367.171 | predicted protein [Thalassiosira pseudonana CCMP1335] |
| SEQ ID NO: 2572 | Nga04822 | 459.364 | 514.8232 | protein |
| SEQ ID NO: 2573 | Nga20117 | 204.4674 | 284.76769 | rna recognition motif-containing protein |
| SEQ ID NO: 2574 | Nga20058 | 463.0119 | 441.45003 | conserved unknown protein [Ectocarpus siliculosus] |
| SEQ ID NO: 2575 | Nga04577 | 104.7254 | 150.79502 | expressed unknown protein [Ectocarpus siliculosus] |
| SEQ ID NO: 2576 | Nga05046 | 663.8388 | 631.79074 | ---NA--- |
| SEQ ID NO: 2577 | Nga04839 | 513.2743 | 520.847 | ---NA--- |
| SEQ ID NO: 2578 | Nga20042 | 1100.407 | 1156.7234 | mitogen-activated protein kinase kinase |
| SEQ ID NO: 2579 | Nga20593 | 241.1924 | 187.87797 | choline transporter-like protein 1-like |
| SEQ ID NO: 2580 | Nga20685 | 233.1288 | 222.62783 | isoform a |
| SEQ ID NO: 2581 | Nga20352 | 259.6401 | 297.95895 | choline transporter-like protein 5- partial |
| SEQ ID NO: 2582 | Nga04840 | 555.7743 | 428.60241 | developmentally regulated gtp binding protein 1 |
| SEQ ID NO: 2583 | Nga04897.1 | 463.7346 | 488.95977 | dnaj-like protein |
| SEQ ID NO: 2584 | Nga04896 | 378.3133 | 311.48414 | nicotinate-nucleotide--dimethylbenzimidazole phosphoribosyltransferase |
| SEQ ID NO: 2585 | Nga04895 | 13996.1 | 11049.711 | geranylgeranyl reductase |
| SEQ ID NO: 2586 | Nga04961.01 | 314.1487 | 311.722 | glutathione s-transferase |
| SEQ ID NO: 2587 | Nga04357 | 225.2066 | 234.9991 | hypothetical protein GSI_13513 [Acromyrmex echinatior] |
| SEQ ID NO: 2588 | Nga04358 | 21801.05 | 17643.669 | ---NA--- |
| SEQ ID NO: 2589 | Nga01960 | 155.9203 | 165.08841 | ---NA--- |

FIGURE 24 AO

| # | Nga model | +N rpkb | -N rpkb | GO |
|---|---|---|---|---|
| SEQ ID NO: 2590 | Nga01958 | 82.98755 | 122.85641 | arabinogalactan protein |
| SEQ ID NO: 2591 | Nga01957 | 320.197 | 341.51218 | ---NA--- |
| SEQ ID NO: 2592 | Nga01959 | 82.6972 | 100.6057 | arabinogalactan protein |
| SEQ ID NO: 2593 | Nga04506 | 441.9476 | 413.81971 | ---NA--- |
| SEQ ID NO: 2594 | Nga04296 | 349.0967 | 432.83312 | ---NA--- |
| SEQ ID NO: 2595 | Nga04297 | 169.6751 | 294.59792 | ---NA--- |
| SEQ ID NO: 2596 | Nga06925 | 1358.559 | 1357.458 | methyltransferase family |
| SEQ ID NO: 2597 | Nga06924 | 916.9454 | 1000.5121 | ---NA--- |
| SEQ ID NO: 2598 | Nga06419 | 868.0702 | 811.09517 | conserved unknown protein [Ectocarpus siliculosus] |
| SEQ ID NO: 2599 | Nga06423 | 172.2275 | 155.58365 | tbc domain-containing protein kinase-like protein |
| SEQ ID NO: 2600 | Nga06422 | 506.1444 | 586.12774 | galactose-binding protein |
| SEQ ID NO: 2601 | Nga06420 | 766.4179 | 859.3117 | sin3 histone deacetylase corepressor complex component sds3 |
| SEQ ID NO: 2602 | Nga04593 | 223.236 | 164.72536 | protein |
| SEQ ID NO: 2603 | Nga20413 | 165.6535 | 156.39396 | ---NA--- |
| SEQ ID NO: 2604 | Nga00990.02 | 1366.231 | 1281.5907 | cytochrome b5 |
| SEQ ID NO: 2605 | Nga03513 | 351.5483 | 340.68924 | ---NA--- |
| SEQ ID NO: 2606 | Nga02387 | 708.3333 | 999.73466 | chaperonin |
| SEQ ID NO: 2607 | Nga02388 | 521.3033 | 697.72211 | chaperonin |
| SEQ ID NO: 2608 | Nga02386 | 291.6667 | 258.32441 | protein fam98a |
| SEQ ID NO: 2609 | Nga04448 | 228.6213 | 228.74574 | ---NA--- |
| SEQ ID NO: 2610 | Nga06961 | 99.29078 | 119.07891 | ---NA--- |
| SEQ ID NO: 2611 | Nga20989 | 86.58744 | 110.34641 | hypothetical tyrosinase-like protein in chromosome |
| SEQ ID NO: 2612 | Nga01633 | 155.8266 | 170.26441 | ketose-bisphosphate aldolase class-ii family protein |
| SEQ ID NO: 2613 | Nga01632 | 259.058 | 253.14706 | ketose-bisphosphate aldolase class-ii-like protein |
| SEQ ID NO: 2614 | Nga01634.01 | 76.14213 | 67.816677 | ---NA--- |
| SEQ ID NO: 2615 | Nga01631 | 2312.641 | 1491.5862 | thioredoxin-1 |
| SEQ ID NO: 2616 | Nga06509 | 5954.505 | 5683.8377 | protein disulfide isomerase |
| SEQ ID NO: 2617 | Nga06510 | 164.6916 | 152.72578 | structural maintenance of chromosomes protein 5 puta |
| SEQ ID NO: 2618 | Nga06508 | 524.0156 | 596.69269 | kelch-like protein 17-like |
| SEQ ID NO: 2619 | Nga21004 | 27437.72 | 30045.686 | expressed unknown protein [Ectocarpus siliculosus] |
| SEQ ID NO: 2620 | Nga20930 | 9981.41 | 11227.442 | ---NA--- |
| SEQ ID NO: 2621 | Nga06513 | 1293.001 | 1322.2393 | protein |
| SEQ ID NO: 2622 | Nga06512 | 634.9593 | 582.12816 | peptidyl-prolyl cis-trans isomerase |
| SEQ ID NO: 2623 | Nga06511 | 363.5417 | 341.89571 | abortive infection protein |
| SEQ ID NO: 2624 | Nga02307 | 388.3735 | 466.25283 | wd repeat domain 74 |
| SEQ ID NO: 2625 | Nga02309 | 394.6557 | 473.14946 | gram domain-containing protein 1a-like |
| SEQ ID NO: 2626 | Nga02308 | 3384.735 | 3135.8104 | hypothetical protein BRAFLDRAFT_228541 [Branchiostoma floridae] |
| SEQ ID NO: 2627 | Nga02306 | 502.5773 | 681.20897 | protein |
| SEQ ID NO: 2628 | Nga02312 | 307.5506 | 307.21552 | ---NA--- |
| SEQ ID NO: 2629 | Nga05655 | 121.5278 | 116.5981 | ---NA--- |
| SEQ ID NO: 2630 | Nga05656 | 153.8462 | 111.10092 | ---NA--- |
| SEQ ID NO: 2631 | Nga05651 | 1848.282 | 2867.0607 | cbl-interacting serine threonine-protein kinase 15 |
| SEQ ID NO: 2632 | Nga04606.2 | 91.6129 | 101.33479 | intraflagellar transport |
| SEQ ID NO: 2633 | Nga05652 | 293.9189 | 376.93613 | exosome complex exonuclease rrp41 |
| SEQ ID NO: 2634 | Nga04607.02 | 198.1567 | 219.64191 | ---NA--- |
| SEQ ID NO: 2635 | Nga05653 | 35.38175 | 48.41269 | intraflagellar transport 52 homolog |
| SEQ ID NO: 2636 | Nga07057 | 250.6394 | 274.27151 | ---NA--- |
| SEQ ID NO: 2637 | Nga07058 | 62.5 | 140.6121 | ---NA--- |
| SEQ ID NO: 2638 | Nga05481 | 466.4311 | 329.18063 | smap1 protein |
| SEQ ID NO: 2639 | Nga05480 | 1415.033 | 1495.0516 | conserved unknown protein [Ectocarpus siliculosus] |
| SEQ ID NO: 2640 | Nga03875 | 29.70297 | 25.025207 | cell division cycle protein 23 |
| SEQ ID NO: 2641 | Nga03874 | 162.4549 | 218.99314 | anaphase promoting complex subunit 8 |
| SEQ ID NO: 2642 | Nga03876 | 132.3529 | 172.57403 | protoporphyrinogen oxidase |
| SEQ ID NO: 2643 | Nga03879 | 28.57143 | 5.1582569 | protoporphyrinogen oxidase |
| SEQ ID NO: 2644 | Nga03873 | 989.6319 | 939.47661 | protoporphyrinogen oxidase |
| SEQ ID NO: 2645 | Nga20695 | 43.34365 | 36.89032 | ---NA--- |
| SEQ ID NO: 2646 | Nga06011 | 158.2492 | 218.83514 | zinc knuckle family expressed |
| SEQ ID NO: 2647 | Nga06006 | 673.8411 | 512.92203 | mitochondrial ribosomal protein l37 |
| SEQ ID NO: 2648 | Nga06010 | 264.5432 | 221.15128 | abc transporter |
| SEQ ID NO: 2649 | Nga06008 | 1333.333 | 1637.341 | srrm2 protein |
| SEQ ID NO: 2650 | Nga06020 | 304.3478 | 321.83037 | ---NA--- |
| SEQ ID NO: 2651 | Nga06009 | 795.6989 | 937.63798 | ubiquitin-fold modifier 1 |
| SEQ ID NO: 2652 | Nga06019 | 213.2616 | 279.54424 | ---NA--- |
| SEQ ID NO: 2653 | Nga06007 | 837.5559 | 761.97678 | soluble nsf attachment protein receptor |

FIGURE 24 AP

| # | Nga model | +N rpkb | -N rpkb | GO |
|---|---|---|---|---|
| SEQ ID NO: 2654 | Nga06012 | 4748.494 | 4214.3891 | 40s ribosomal protein |
| SEQ ID NO: 2655 | Nga20247 | 369.2596 | 363.44681 | brca1-associated protein |
| SEQ ID NO: 2656 | Nga02429 | 875.9843 | 1018.1973 | ---NA--- |
| SEQ ID NO: 2657 | Nga03210.01 | 259.3477 | 279.21066 | protein |
| SEQ ID NO: 2658 | Nga03211 | 321.7391 | 329.6799 | ---NA--- |
| SEQ ID NO: 2659 | Nga03207 | 273.3214 | 300.5765 | major facilitator superfamily mfs_1 |
| SEQ ID NO: 2660 | Nga03209.01 | 131.5789 | 98.187872 | ---NA--- |
| SEQ ID NO: 2661 | Nga03208 | 292.1028 | 255.94966 | protein |
| SEQ ID NO: 2662 | Nga06410.1 | 353.6379 | 377.57393 | nicotinate-nucleotide pyrophosphorylase |
| SEQ ID NO: 2663 | Nga06413 | 62.5 | 87.045585 | ---NA--- |
| SEQ ID NO: 2664 | Nga06411 | 399.2347 | 425.55619 | oxidoreductase htatip2 |
| SEQ ID NO: 2665 | Nga06412 | 157.6422 | 237.58387 | ---NA--- |
| SEQ ID NO: 2666 | Nga07135 | 624.8694 | 691.5945 | protein |
| SEQ ID NO: 2667 | Nga07143.2 | 2920.635 | 3402.8864 | ---NA--- |
| SEQ ID NO: 2668 | Nga20477 | 168.3673 | 163.03776 | ribonuclease z |
| SEQ ID NO: 2669 | Nga20031 | 69.76744 | 67.177299 | ---NA--- |
| SEQ ID NO: 2670 | Nga01967 | 533.1205 | 518.70739 | serine protease family s09x |
| SEQ ID NO: 2671 | Nga20952 | 175.2888 | 229.05148 | exportin 6 |
| SEQ ID NO: 2672 | Nga04472 | 3549.561 | 3367.9469 | steroid 5-alpha reductase c-terminal domain-containing protein |
| SEQ ID NO: 2673 | Nga03949 | 464.1745 | 563.55161 | ---NA--- |
| SEQ ID NO: 2674 | Nga20493 | 258.3222 | 200.49203 | ---NA--- |
| SEQ ID NO: 2675 | Nga03948 | 90.7173 | 123.4064 | ---NA--- |
| SEQ ID NO: 2676 | Nga03947 | 197.8495 | 291.19192 | ---NA--- |
| SEQ ID NO: 2677 | Nga01165 | 923.6948 | 981.72607 | conserved unknown protein [Ectocarpus siliculosus] |
| SEQ ID NO: 2678 | Nga20602 | 278.157 | 290.21797 | fad-binding protein |
| SEQ ID NO: 2679 | Nga01164 | 585.1359 | 551.53009 | homogentisate -dioxygenase |
| SEQ ID NO: 2680 | Nga01163 | 156.3574 | 260.57174 | gtp-binding protein |
| SEQ ID NO: 2681 | Nga01166 | 165.9292 | 145.38981 | atp binding |
| SEQ ID NO: 2682 | Nga02416 | 567.0816 | 170.05125 | ---NA--- |
| SEQ ID NO: 2683 | Nga02414 | 4454.155 | 4187.0561 | succinate dehydrogenase cytochrome b subunit |
| SEQ ID NO: 2684 | Nga02415 | 438.6217 | 489.12717 | protein serine threonine kinase |
| SEQ ID NO: 2685 | Nga06834 | 350.9572 | 356.46987 | npc21_dicdi ame: full= phosphatidylglycerol phosphatidylinositol transfer protein 1 short=pg pi-tp flags: precursor |
| SEQ ID NO: 2686 | Nga20065 | 339.8058 | 428.6862 | signal recognition particle 68 kda protein |
| SEQ ID NO: 2687 | Nga01600.1 | 492.209 | 441.83236 | developmentally regulated g-protein 1 |
| SEQ ID NO: 2688 | Nga01597.01 | 519.4468 | 640.39068 | nucleoside diphosphate-linked moiety x motif 6 |
| SEQ ID NO: 2689 | Nga01598 | 136.5926 | 163.36773 | beach domain-containing protein |
| SEQ ID NO: 2690 | Nga01600.2 | 492.209 | 441.83236 | developmentally regulated g-protein 1 |
| SEQ ID NO: 2691 | Nga01601 | 1119.43 | 1158.539 | iron-sulfur protein |
| SEQ ID NO: 2692 | Nga05013 | 988.2254 | 1032.2154 | protein |
| SEQ ID NO: 2693 | Nga05015 | 4648.446 | 4934.3454 | atp-dependent clp protease proteolytic subunit |
| SEQ ID NO: 2694 | Nga05014 | 2759.637 | 2990.1514 | lysosomal acid phosphatase |
| SEQ ID NO: 2695 | Nga20169 | 160.8315 | 180.14394 | rrna processing protein |
| SEQ ID NO: 2696 | Nga20798 | 220.8545 | 216.48991 | protein |
| SEQ ID NO: 2697 | Nga01662 | 130.9942 | 79.817238 | ---NA--- |
| SEQ ID NO: 2698 | Nga01661.2 | 222.8571 | 313.62202 | serine threonine-protein kinase rio3 |
| SEQ ID NO: 2699 | Nga01661.1 | 222.8571 | 313.62202 | serine threonine-protein kinase rio3 |
| SEQ ID NO: 2700 | Nga01659 | 160.6805 | 153.57759 | ---NA--- |
| SEQ ID NO: 2701 | Nga01701 | 449.3088 | 743.78736 | ---NA--- |
| SEQ ID NO: 2702 | Nga01700 | 733.3333 | 783.47109 | otu domain-containing protein 6b |
| SEQ ID NO: 2703 | Nga20460 | 121.6578 | 102.82033 | ---NA--- |
| SEQ ID NO: 2704 | Nga01124.02 | 1733.86 | 1392.9332 | mannose-p-dolichol utilization defect 1 |
| SEQ ID NO: 2705 | Nga02234.01 | 420.6049 | 304.08363 | ---NA--- |
| SEQ ID NO: 2706 | Nga07107 | 2516.19 | 2632.7743 | ---NA--- |
| SEQ ID NO: 2707 | Nga20678 | 129.1667 | 63.188647 | ---NA--- |
| SEQ ID NO: 2708 | Nga04348 | 651.8987 | 662.281 | protein phosphatase |
| SEQ ID NO: 2709 | Nga06033.02 | 1056.995 | 1318.0282 | gtp-binding protein |
| SEQ ID NO: 2710 | Nga20451 | 49.85337 | 76.239339 | protein |
| SEQ ID NO: 2711 | Nga06356 | 25081.14 | 25774.316 | p-type h+-atpase |
| SEQ ID NO: 2712 | Nga06354.1 | 15057.44 | 14114.816 | p-type h+-atpase |
| SEQ ID NO: 2713 | Nga06358 | 696.6667 | 877.41949 | ---NA--- |
| SEQ ID NO: 2714 | Nga06354.2 | 15057.44 | 14114.816 | p-type h+-atpase |
| SEQ ID NO: 2715 | Nga06357 | 17908.3 | 20710.739 | p-type h+-atpase |
| SEQ ID NO: 2716 | Nga05597 | 17.40295 | 23.926854 | amp-dependent synthetase and ligase |

FIGURE 24 AQ

| # | Nga model | +N rpkb | -N rpkb | GO |
|---|---|---|---|---|
| SEQ ID NO: 2717 | Nga05596 | 195.8457 | 295.71965 | dna cross-link repair protein pso2 |
| SEQ ID NO: 2718 | Nga05595 | 355.4084 | 362.2736 | ---NA--- |
| SEQ ID NO: 2719 | Nga05594 | 213.1148 | 168.70037 | ---NA--- |
| SEQ ID NO: 2720 | Nga04924 | 154.386 | 148.23201 | dna mismatch repair protein homolog |
| SEQ ID NO: 2721 | Nga04923 | 1275.352 | 1606.5427 | hypothetical protein ACP_2683 [Acidobacterium capsulatum ATCC 51196] |
| SEQ ID NO: 2722 | Nga02014 | 3.703704 | 0 | ---NA--- |
| SEQ ID NO: 2723 | Nga03694 | 1089.73 | 1128.7433 | gcn5-related n-acetyltransferase |
| SEQ ID NO: 2724 | Nga03695 | 399.8624 | 388.41355 | hydrolase |
| SEQ ID NO: 2725 | Nga03693 | 1649.215 | 1905.5843 | electron-transferring-flavoprotein dehydrogenase |
| SEQ ID NO: 2726 | Nga03696.01 | 1150.15 | 933.59802 | ---NA--- |
| SEQ ID NO: 2727 | Nga01832.2 | 96.84685 | 89.049637 | protein phosphatase 2c containing protein |
| SEQ ID NO: 2728 | Nga01830 | 146.4968 | 136.84165 | smad nuclear interacting protein 1 |
| SEQ ID NO: 2729 | Nga01831 | 2487.594 | 2280.9845 | protein |
| SEQ ID NO: 2730 | Nga01832.1 | 96.84685 | 89.049637 | protein phosphatase |
| SEQ ID NO: 2731 | Nga01440 | 2914.552 | 2853.7991 | ---NA--- |
| SEQ ID NO: 2732 | Nga01442 | 810.9375 | 855.58556 | deoxycytidylate deaminase |
| SEQ ID NO: 2733 | Nga01441 | 440.5797 | 372.74043 | ---NA--- |
| SEQ ID NO: 2734 | Nga01444 | 1043.956 | 778.8401 | cell division topological specificity factor |
| SEQ ID NO: 2735 | Nga05996.2 | 576.412 | 509.22792 | cytosolic phosphoglucose isomerase |
| SEQ ID NO: 2736 | Nga20997 | 1196.833 | 1477.8056 | ankyrin |
| SEQ ID NO: 2737 | Nga20158 | 1311.456 | 1472.3192 | ankyrin repeat-containing protein |
| SEQ ID NO: 2738 | Nga20833 | 394.2112 | 443.36196 | indigoidine synthase a family protein |
| SEQ ID NO: 2739 | Nga05980.02 | 464.0523 | 445.02608 | gcn5-like n-acetyltransferase |
| SEQ ID NO: 2740 | Nga05979.02 | 323.0303 | 344.9936 | peptidase m1 membrane alanine aminopeptidase |
| SEQ ID NO: 2741 | Nga01890.1 | 3082.353 | 4085.3394 | ---NA--- |
| SEQ ID NO: 2742 | Nga01891.01 | 302.9661 | 327.03567 | protein |
| SEQ ID NO: 2743 | Nga01892 | 534.3915 | 555.94546 | ca -dependent phospholipid-binding family protein |
| SEQ ID NO: 2744 | Nga20357 | 160.1732 | 161.78169 | tubulin-specific chaperone c |
| SEQ ID NO: 2745 | Nga07021 | 47.4359 | 43.051605 | high-affinity glucose |
| SEQ ID NO: 2746 | Nga02279 | 260.8868 | 331.05962 | phytanoyl- dioxygenase domain-containing protein 1 homolog |
| SEQ ID NO: 2747 | Nga02278.1 | 881.6348 | 1017.113 | fe-only |
| SEQ ID NO: 2748 | Nga04069 | 258.9532 | 293.93538 | ---NA--- |
| SEQ ID NO: 2749 | Nga04068 | 547.8088 | 564.27425 | mitochondrial 2-oxoglutarate malate carrier protein |
| SEQ ID NO: 2750 | Nga06942 | 384.2593 | 481.43731 | ---NA--- |
| SEQ ID NO: 2751 | Nga05513 | 611.7216 | 484.08257 | ---NA--- |
| SEQ ID NO: 2752 | Nga05510 | 614.4578 | 611.22236 | ---NA--- |
| SEQ ID NO: 2753 | Nga05512 | 3160.804 | 3242.444 | ---NA--- |
| SEQ ID NO: 2754 | Nga20580 | 136.5854 | 171.73221 | rrna processing protein rrp17 |
| SEQ ID NO: 2755 | Nga05511 | 330.4196 | 312.47133 | prp4 pre-mrna processing factor 4 homolog |
| SEQ ID NO: 2756 | Nga05518 | 121.5805 | 154.74771 | ---NA--- |
| SEQ ID NO: 2757 | Nga02770 | 320.5538 | 333.96829 | tpr repeat-containing protein |
| SEQ ID NO: 2758 | Nga02772 | 592.4479 | 476.73577 | had family hydrolase |
| SEQ ID NO: 2759 | Nga02779 | 627.6648 | 586.46081 | alkyl sulfatase or beta-lactamase |
| SEQ ID NO: 2760 | Nga02778 | 352.349 | 407.12148 | methionyl-trna synthetase |
| SEQ ID NO: 2761 | Nga02767 | 493.6709 | 543.5758 | protein |
| SEQ ID NO: 2762 | Nga02783 | 225.8553 | 291.55161 | argininosuccinate partial |
| SEQ ID NO: 2763 | Nga02774 | 311.0048 | 362.80563 | family s49 |
| SEQ ID NO: 2764 | Nga02771 | 147.6035 | 175.81902 | pyridine nucleotide-disulfide oxidoreductase domain-containing protein 1 |
| SEQ ID NO: 2765 | Nga02782 | 476.5258 | 694.18513 | ---NA--- |
| SEQ ID NO: 2766 | Nga02776 | 771.1214 | 745.45131 | uridine phosphorylase |
| SEQ ID NO: 2767 | Nga02766 | 613.2797 | 1185.6726 | amidophosphoribosyltransferase |
| SEQ ID NO: 2768 | Nga02781 | 213.7255 | 195.40691 | ---NA--- |
| SEQ ID NO: 2769 | Nga02768 | 1876.61 | 1811.7547 | elongation of very long chain fatty acids protein 6 |
| SEQ ID NO: 2770 | Nga02777 | 1653.74 | 1513.8269 | gun4-like protein |
| SEQ ID NO: 2771 | Nga02769 | 676.8061 | 638.40784 | spliceosomal protein |
| SEQ ID NO: 2772 | Nga02773 | 479.4352 | 444.53155 | protein |
| SEQ ID NO: 2773 | Nga02780 | 768.2468 | 724.60118 | protein |
| SEQ ID NO: 2774 | Nga02775 | 2030.822 | 2037.3701 | dna-binding horma domain-containing protein |
| SEQ ID NO: 2775 | Nga01297 | 226.1029 | 232.97495 | ---NA--- |
| SEQ ID NO: 2776 | Nga04742 | 360.2781 | 455.2313 | peptidase s9 prolyl oligopeptidase |
| SEQ ID NO: 2777 | Nga04743 | 221.6117 | 308.50344 | mitogen-activated protein kinase |
| SEQ ID NO: 2778 | Nga04745 | 2363.144 | 1899.3289 | major facilitator superfamily mfs_1 |
| SEQ ID NO: 2779 | Nga04744 | 513.2159 | 656.93923 | ---NA--- |

FIGURE 24 AR

| # | Nga model | +N rpkb | -N rpkb | GO |
|---|---|---|---|---|
| SEQ ID NO: 2780 | Nga04746 | 132.6861 | 150.74129 | ---NA--- |
| SEQ ID NO: 2781 | Nga05945 | 953.3528 | 803.74064 | protein |
| SEQ ID NO: 2782 | Nga05946 | 3405.437 | 3139.5858 | 40s ribosomal protein s10 |
| SEQ ID NO: 2783 | Nga05943 | 1494.771 | 1583.7871 | delta-24-sterol methyltransferase |
| SEQ ID NO: 2784 | Nga05944 | 312.7351 | 292.19959 | ---NA--- |
| SEQ ID NO: 2785 | Nga20773 | 322.4941 | 418.69552 | dna binding |
| SEQ ID NO: 2786 | Nga21148.1 | 365.6286 | 273.61965 | protein phosphatase methylesterase 1 |
| SEQ ID NO: 2787 | Nga05947 | 635.2838 | 702.21963 | chromodomain-helicase-dna-binding protein 7 |
| SEQ ID NO: 2788 | Nga02219.2 | 191.4894 | 269.84817 | peroxisome assembly protein 12 |
| SEQ ID NO: 2789 | Nga02219.1 | 191.4894 | 269.84817 | protein |
| SEQ ID NO: 2790 | Nga05917 | 296.544 | 204.08755 | ---NA--- |
| SEQ ID NO: 2791 | Nga05913 | 747.6636 | 742.40332 | transmembrane protein |
| SEQ ID NO: 2792 | Nga05915 | 766.9841 | 561.90611 | protein |
| SEQ ID NO: 2793 | Nga05916 | 11794.87 | 10263.503 | conserved hypothetical protein [Albugo laibachii Nc14] |
| SEQ ID NO: 2794 | Nga21088 | 1545.657 | 1504.6256 | short-chain dehydrogenase reductase sdr |
| SEQ ID NO: 2795 | Nga05918 | 3097.308 | 3000.7599 | peptidylprolyl isomerase |
| SEQ ID NO: 2796 | Nga05914 | 1546.926 | 1510.9185 | ---NA--- |
| SEQ ID NO: 2797 | Nga05912 | 788.6815 | 781.28493 | eukaryotic peptide chain release factor subunit 1 |
| SEQ ID NO: 2798 | Nga04416 | 2302.682 | 1996.3047 | protein |
| SEQ ID NO: 2799 | Nga04418 | 893.5811 | 1114.3403 | branched-chain amino acid |
| SEQ ID NO: 2800 | Nga04417 | 294.5488 | 234.70896 | fungal zn binuclear cluster domain containing protein |
| SEQ ID NO: 2801 | Nga07186 | 83.33333 | 31.594323 | ---NA--- |
| SEQ ID NO: 2802 | Nga03992 | 243.3862 | 177.67329 | ---NA--- |
| SEQ ID NO: 2803 | Nga03993 | 20.20202 | 21.883514 | ---NA--- |
| SEQ ID NO: 2804 | Nga03991 | 28.67384 | 46.590707 | set domain protein |
| SEQ ID NO: 2805 | Nga03990 | 3169.643 | 3191.6714 | conserved hypothetical protein [Phytophthora infestans T30-4] |
| SEQ ID NO: 2806 | Nga02209.01 | 545.8554 | 533.97511 | mfs monosaccharide |
| SEQ ID NO: 2807 | Nga07113 | 231.0008 | 275.49516 | small ubiquitin-like modifier-1 |
| SEQ ID NO: 2808 | Nga07114 | 62.5 | 33.851061 | ---NA--- |
| SEQ ID NO: 2809 | Nga05250 | 1297.737 | 1237.2156 | ---NA--- |
| SEQ ID NO: 2810 | Nga05252 | 5.50055 | 4.766706 | testis 14 |
| SEQ ID NO: 2811 | Nga05251 | 193.2059 | 234.58569 | inositol monophosphatase |
| SEQ ID NO: 2812 | Nga04832 | 514.4509 | 544.7477 | ---NA--- |
| SEQ ID NO: 2813 | Nga04833 | 289.5377 | 210.84846 | protein |
| SEQ ID NO: 2814 | Nga04481 | 89.20188 | 101.71211 | ---NA--- |
| SEQ ID NO: 2815 | Nga04482 | 192.959 | 190.67621 | sun domain protein |
| SEQ ID NO: 2816 | Nga00852 | 214.2162 | 224.66293 | two component transcriptional family |
| SEQ ID NO: 2817 | Nga00853 | 362.8205 | 399.9633 | retinitis pigmentosa 9 (autosomal dominant) |
| SEQ ID NO: 2818 | Nga00854 | 1463.758 | 1546.7148 | dihydroxy-3-keto-5-methylthiopentene dioxygenase |
| SEQ ID NO: 2819 | Nga07266 | 2168.699 | 2356.6943 | rrna methyltransferase |
| SEQ ID NO: 2820 | Nga04466 | 206.3492 | 189.13608 | hypoxanthine-guanine phosphoribosyltransferase-like |
| SEQ ID NO: 2821 | Nga07307 | 89.65517 | 52.294052 | ---NA--- |
| SEQ ID NO: 2822 | Nga07242 | 1067.751 | 1115.5255 | dephospho- kinase |
| SEQ ID NO: 2823 | Nga06615.2 | 346.6851 | 382.52322 | apicomplexan specific pf 23612804 and py 23478322 |
| SEQ ID NO: 2824 | Nga06970 | 319.8198 | 409.8723 | ---NA--- |
| SEQ ID NO: 2825 | Nga06521 | 333.3333 | 375.61803 | ---NA--- |
| SEQ ID NO: 2826 | Nga06519 | 8847.328 | 9393.5401 | protein |
| SEQ ID NO: 2827 | Nga06522 | 332.2215 | 334.58126 | dash family |
| SEQ ID NO: 2828 | Nga06520 | 448.4127 | 477.13876 | cysteine synthase a |
| SEQ ID NO: 2829 | Nga07144 | 301.8868 | 362.78118 | ---NA--- |
| SEQ ID NO: 2830 | Nga04436 | 39.27492 | 35.998711 | ---NA--- |
| SEQ ID NO: 2831 | Nga02925 | 290.5812 | 256.15552 | aspartyl asparaginyl beta-hydroxylase |
| SEQ ID NO: 2832 | Nga20434 | 19.88636 | 24.618953 | midasin |
| SEQ ID NO: 2833 | Nga02926 | 721.8391 | 763.86669 | duf747 family protein |
| SEQ ID NO: 2834 | Nga21303 | 0 | 21.239881 | ---NA--- |
| SEQ ID NO: 2835 | Nga02924 | 606.8237 | 684.61089 | abc subfamily abcg |
| SEQ ID NO: 2836 | Nga20408 | 431.6667 | 534.39541 | folylpolyglutamate synthase |
| SEQ ID NO: 2837 | Nga02923 | 5602.484 | 5840.0439 | protein |
| SEQ ID NO: 2838 | Nga21309 | 5.076142 | 0 | ---NA--- |
| SEQ ID NO: 2839 | Nga21310 | 15.26718 | 0 | ---NA--- |
| SEQ ID NO: 2840 | Nga06940 | 716.129 | 743.58769 | ---NA--- |
| SEQ ID NO: 2841 | Nga06828 | 369.5652 | 507.76591 | s-adenosylmethionine mitochondrial carrier protein |
| SEQ ID NO: 2842 | Nga04654.01 | 1314.465 | 1350.636 | protein |
| SEQ ID NO: 2843 | Nga04655.01 | 722.8464 | 900.66642 | ---NA--- |

FIGURE 24 AS

| # | Nga model | +N rpkb | -N rpkb | GO |
|---|---|---|---|---|
| SEQ ID NO: 2844 | Nga02434 | 764.3396 | 771.15179 | 116 kda u5 small nuclear ribonucleoprotein component |
| SEQ ID NO: 2845 | Nga02430 | 1029.206 | 1034.4024 | protein |
| SEQ ID NO: 2846 | Nga02431 | 126.1172 | 162.16238 | ap3d1 protein |
| SEQ ID NO: 2847 | Nga04064 | 575.227 | 559.88162 | predicted protein [Nematostella vectensis] |
| SEQ ID NO: 2848 | Nga20067 | 193.1385 | 199.57932 | protein |
| SEQ ID NO: 2849 | Nga04065 | 253.5613 | 217.88124 | protein |
| SEQ ID NO: 2850 | Nga06847 | 52.63158 | 38.008208 | ---NA--- |
| SEQ ID NO: 2851 | Nga21215.1 | 599.1903 | 469.25519 | uncharacterized protein |
| SEQ ID NO: 2852 | Nga20817 | 66.86047 | 91.31914 | ---NA--- |
| SEQ ID NO: 2853 | Nga07122 | 642.2535 | 576.70765 | ---NA--- |
| SEQ ID NO: 2854 | Nga04813.01 | 691.4095 | 580.0135 | protein |
| SEQ ID NO: 2855 | Nga20574.1 | 116.7883 | 229.2977 | purine nucleoside phosphoramidase |
| SEQ ID NO: 2856 | Nga20513.1 | 198.3806 | 188.57919 | aprataxin |
| SEQ ID NO: 2857 | Nga07236 | 1196.078 | 1241.0159 | ---NA--- |
| SEQ ID NO: 2858 | Nga07235 | 795.3504 | 700.51966 | subtilisin-like serine peptidase |
| SEQ ID NO: 2859 | Nga06808 | 249.4005 | 179.24015 | ---NA--- |
| SEQ ID NO: 2860 | Nga20567 | 118.9591 | 208.05609 | ---NA--- |
| SEQ ID NO: 2861 | Nga20260 | 145.5274 | 231.39844 | conserved unknown protein [Ectocarpus siliculosus] |
| SEQ ID NO: 2862 | Nga20195 | 119.403 | 176.37459 | predicted protein [Phaeodactylum tricornutum CCAP 1055/1] |
| SEQ ID NO: 2863 | Nga07074 | 190.7895 | 153.22059 | protein |
| SEQ ID NO: 2864 | Nga07117 | 47.72234 | 35.246224 | ---NA--- |
| SEQ ID NO: 2865 | Nga07098 | 2193.076 | 2747.7505 | ---NA--- |
| SEQ ID NO: 2866 | Nga03634 | 169.6833 | 183.80666 | ---NA--- |
| SEQ ID NO: 2867 | Nga20224 | 317.0732 | 453.21045 | translation elongation factor 1- |
| SEQ ID NO: 2868 | Nga20431 | 362.4242 | 456.92777 | hbs1-like protein |
| SEQ ID NO: 2869 | Nga03633 | 263.6816 | 309.88036 | ---NA--- |
| SEQ ID NO: 2870 | Nga21198 | 436.0313 | 477.98051 | expressed unknown protein [Ectocarpus siliculosus] |
| SEQ ID NO: 2871 | Nga06898 | 110.5121 | 131.38956 | tether containing ubx domain for glut4 |
| SEQ ID NO: 2872 | Nga07027 | 1959.77 | 2037.8079 | ---NA--- |
| SEQ ID NO: 2873 | Nga04958 | 219.0476 | 20.633027 | ---NA--- |
| SEQ ID NO: 2874 | Nga04957 | 356.236 | 544.44843 | di-n-acetylchitobiase |
| SEQ ID NO: 2875 | Nga04183.1 | 125 | 114.24733 | ---NA--- |
| SEQ ID NO: 2876 | Nga04182 | 712.931 | 563.09488 | ---NA--- |
| SEQ ID NO: 2877 | Nga06984 | 1474.164 | 1790.2993 | ---NA--- |
| SEQ ID NO: 2878 | Nga06858.2 | 154.5894 | 167.45645 | snf2 family helicase atpase |
| SEQ ID NO: 2879 | Nga06856 | 162.1005 | 153.33448 | chromatin-remodeling factor chd3 |
| SEQ ID NO: 2880 | Nga06857 | 172.5888 | 109.97299 | phosphoinositol transporter |
| SEQ ID NO: 2881 | Nga06858.1 | 154.5894 | 167.45645 | snf2 family helicase atpase |
| SEQ ID NO: 2882 | Nga05021 | 496.769 | 465.4931 | protein |
| SEQ ID NO: 2883 | Nga05023 | 468.1335 | 561.34202 | ---NA--- |
| SEQ ID NO: 2884 | Nga04423.2 | 220.405 | 345.89246 | calmodulin-like protein 12 |
| SEQ ID NO: 2885 | Nga04425.02 | 316.0377 | 226.09954 | ---NA--- |
| SEQ ID NO: 2886 | Nga04408.2 | 740.3509 | 847.58305 | ribosome biogenesis protein brx1 homolog |
| SEQ ID NO: 2887 | Nga03704.1 | 92.89617 | 119.57009 | ---NA--- |
| SEQ ID NO: 2888 | Nga07048 | 12838.98 | 18994.625 | ---NA--- |
| SEQ ID NO: 2889 | Nga07047 | 274.6365 | 257.24619 | ---NA--- |
| SEQ ID NO: 2890 | Nga01920 | 613.9438 | 566.97885 | ---NA--- |
| SEQ ID NO: 2891 | Nga03290 | 131.5789 | 102.62216 | ---NA--- |
| SEQ ID NO: 2892 | Nga03289 | 3990.159 | 5229.2073 | alternative oxidase mitochondrial |
| SEQ ID NO: 2893 | Nga03291 | 202.1277 | 159.41209 | ---NA--- |
| SEQ ID NO: 2894 | Nga03287 | 132.1696 | 108.05326 | ---NA--- |
| SEQ ID NO: 2895 | Nga03288 | 513.7514 | 738.83943 | protein kinase domain containing protein |
| SEQ ID NO: 2896 | Nga03293 | 351.9695 | 349.6079 | expressed unknown protein [Ectocarpus siliculosus] |
| SEQ ID NO: 2897 | Nga03286 | 324.7588 | 271.67925 | sh2 domain containing protein |
| SEQ ID NO: 2898 | Nga03292 | 64.10256 | 32.404434 | ---NA--- |
| SEQ ID NO: 2899 | Nga20423 | 304.3478 | 353.22846 | novel protein anaphase promoting complex subunit 1 |
| SEQ ID NO: 2900 | Nga01496 | 8046.358 | 8891.8442 | heat shock protein hsp20 |
| SEQ ID NO: 2901 | Nga05016 | 1983.957 | 1758.4047 | manganese lipoxygenase |
| SEQ ID NO: 2902 | Nga20995 | 73.02534 | 122.69118 | hect e3 ubiquitin |
| SEQ ID NO: 2903 | Nga01838 | 1139.481 | 1079.7202 | protein |
| SEQ ID NO: 2904 | Nga01840 | 11.49425 | 49.803859 | ---NA--- |
| SEQ ID NO: 2905 | Nga01839 | 246.1629 | 266.65204 | myb-like protein |
| SEQ ID NO: 2906 | Nga21255 | 98.03922 | 117.99934 | wd repeat-containing protein 3 |
| SEQ ID NO: 2907 | Nga01037 | 206.4057 | 236.4354 | c-5 sterol desaturase |

FIGURE 24 AT

| # | Nga model | +N rpkb | -N rpkb | GO |
|---|---|---|---|---|
| SEQ ID NO: 2908 | Nga01035 | 418.2622 | 531.24728 | ---NA--- |
| SEQ ID NO: 2909 | Nga01036 | 247.7341 | 222.53749 | ---NA--- |
| SEQ ID NO: 2910 | Nga20476 | 121.6216 | 156.14183 | ---NA--- |
| SEQ ID NO: 2911 | Nga07014 | 273.9726 | 430.32581 | ---NA--- |
| SEQ ID NO: 2912 | Nga07191 | 324.3243 | 529.23072 | lipase family protein |
| SEQ ID NO: 2913 | Nga20843 | 195.4315 | 206.19935 | ---NA--- |
| SEQ ID NO: 2914 | Nga00195.02 | 617.7215 | 606.06253 | conserved hypothetical protein [Phytophthora infestans T30-4] |
| SEQ ID NO: 2915 | Nga00201.02 | 99.67846 | 118.42429 | dmc1 |
| SEQ ID NO: 2916 | Nga05351 | 2383.464 | 2251.8008 | abortive infection protein |
| SEQ ID NO: 2917 | Nga00204.02 | 1006.969 | 929.74435 | atp-binding cassette transporter |
| SEQ ID NO: 2918 | Nga00199.02 | 1643.221 | 1667.3632 | dna-directed rna polymerase ii 19 kda polypeptide |
| SEQ ID NO: 2919 | Nga00210.02 | 206.4632 | 259.30196 | uncharacterized protein c16orf7 homolog |
| SEQ ID NO: 2920 | Nga05361 | 203.125 | 334.27922 | g-patch domain-contaning protein |
| SEQ ID NO: 2921 | Nga00196.02 | 469.4271 | 500.67626 | ---NA--- |
| SEQ ID NO: 2922 | Nga00197.02 | 501.9973 | 375.74227 | proly 4-hydroxylase |
| SEQ ID NO: 2923 | Nga00207.02 | 2368.566 | 2338.2092 | urease accessory protein ureg |
| SEQ ID NO: 2924 | Nga00200.02 | 608.4316 | 561.54786 | dna gyrase subunit a |
| SEQ ID NO: 2925 | Nga00211.02 | 160.0424 | 132.60574 | nlr card domain containing 3 |
| SEQ ID NO: 2926 | Nga00203.02 | 242.0765 | 225.52575 | beta-adaptin-like protein a |
| SEQ ID NO: 2927 | Nga01268.02 | 330.4843 | 253.83473 | protein |
| SEQ ID NO: 2928 | Nga03485 | 50.13333 | 83.770091 | elongation protein 1 |
| SEQ ID NO: 2929 | Nga03476.01 | 3646.76 | 2977.1728 | predicted protein [Phaeodactylum tricornutum CCAP 1055/1] |
| SEQ ID NO: 2930 | Nga03490.01 | 855.7214 | 986.22792 | dynein light chain roadblock-type 1-like |
| SEQ ID NO: 2931 | Nga03474 | 415.2047 | 530.53124 | ---NA--- |
| SEQ ID NO: 2932 | Nga03481 | 165.7356 | 177.5132 | abc transporter-like protein |
| SEQ ID NO: 2933 | Nga03486 | 98.03922 | 100.40671 | abc atp-binding permease protein |
| SEQ ID NO: 2934 | Nga03484 | 152.9582 | 189.13608 | diacylglycerol acyltransferase |
| SEQ ID NO: 2935 | Nga03489 | 190.4762 | 138.87615 | ---NA--- |
| SEQ ID NO: 2936 | Nga03483 | 221.4664 | 263.64424 | alpha-aminoadipic semialdehyde |
| SEQ ID NO: 2937 | Nga03479 | 108.307 | 152.63233 | atp-binding cassette superfamily |
| SEQ ID NO: 2938 | Nga03498 | 89.14729 | 151.14892 | ---NA--- |
| SEQ ID NO: 2939 | Nga03475 | 172.3164 | 205.01885 | ring finger protein 2 |
| SEQ ID NO: 2940 | Nga20984 | 160.7143 | 166.35378 | saccharopine dehydrogenase |
| SEQ ID NO: 2941 | Nga03480 | 1271.881 | 1551.8957 | trifunctional enzyme subunit alpha |
| SEQ ID NO: 2942 | Nga03672.2 | 490.3226 | 412.32776 | adenosine kinase |
| SEQ ID NO: 2943 | Nga03482 | 1111.396 | 1058.9617 | lipoic acid synthetase |
| SEQ ID NO: 2944 | Nga03488 | 1346.87 | 1479.1367 | ---NA--- |
| SEQ ID NO: 2945 | Nga03487 | 828.6479 | 1048.4312 | multifunctional fatty acid oxidation complex subunit alpha |
| SEQ ID NO: 2946 | Nga20692 | 95.65217 | 62.79617 | ---NA--- |
| SEQ ID NO: 2947 | Nga04849 | 293.5421 | 326.45406 | ankyrin repeat protein |
| SEQ ID NO: 2948 | Nga04846 | 392.7393 | 401.29706 | protein |
| SEQ ID NO: 2949 | Nga04847 | 50.3876 | 82.572096 | meiotic recombination 11 |
| SEQ ID NO: 2950 | Nga04848 | 22.98851 | 26.97709 | meiotic recombination 11 |
| SEQ ID NO: 2951 | Nga04835 | 590.3479 | 751.33398 | cysteine proteinase |
| SEQ ID NO: 2952 | Nga04314 | 476.3077 | 471.29009 | trna-splicing ligase homolog |
| SEQ ID NO: 2953 | Nga21092 | 2297.417 | 2378.7462 | ubiquitin-conjugating enzyme e2 8 |
| SEQ ID NO: 2954 | Nga04313 | 3082.836 | 3356.9226 | ---NA--- |
| SEQ ID NO: 2955 | Nga07085 | 629.0429 | 491.92406 | ---NA--- |
| SEQ ID NO: 2956 | Nga20315 | 272.7273 | 275.39846 | brca1-associated protein 2 containing protein |
| SEQ ID NO: 2957 | Nga07036 | 925.5556 | 872.60512 | ---NA--- |
| SEQ ID NO: 2958 | Nga06821 | 1156.338 | 770.46921 | protein |
| SEQ ID NO: 2959 | Nga06822 | 771.0526 | 839.0312 | expressed unknown protein [Ectocarpus siliculosus] |
| SEQ ID NO: 2960 | Nga04207 | 3638.422 | 4280.7127 | protein |
| SEQ ID NO: 2961 | Nga20435 | 205.4795 | 242.36741 | ---NA--- |
| SEQ ID NO: 2962 | Nga01514.02 | 213.6752 | 291.63991 | ---NA--- |
| SEQ ID NO: 2963 | Nga20472.1 | 106.383 | 98.775131 | cleavage and polyadenylation specificity factor subunit 2 |
| SEQ ID NO: 2964 | Nga20240.1 | 115.0307 | 109.65252 | cleavage and polyadenylation specificity factor subunit 2 |
| SEQ ID NO: 2965 | Nga01511.2 | 643.7423 | 700.00805 | arginine biosynthesis bifunctional protein |
| SEQ ID NO: 2966 | Nga02444 | 119.5499 | 150.83004 | chloride channel 7 |
| SEQ ID NO: 2967 | Nga02445 | 267.6768 | 289.95656 | conserved unknown protein [Ectocarpus siliculosus] |
| SEQ ID NO: 2968 | Nga02443.01 | 1509.804 | 2050.7664 | ---NA--- |
| SEQ ID NO: 2969 | Nga20107 | 535.7711 | 528.70083 | adp-ribosylation factor |
| SEQ ID NO: 2970 | Nga07265 | 156.4417 | 200.47581 | beta-ketoacyl synthase |
| SEQ ID NO: 2971 | Nga06796 | 178.2178 | 107.25089 | ---NA--- |

FIGURE 24 AU

| # | Nga model | +N rpkb | -N rpkb | GO |
|---|---|---|---|---|
| SEQ ID NO: 2972 | Nga01221.02 | 112.069 | 93.382236 | ---NA--- |
| SEQ ID NO: 2973 | Nga01220.02 | 140.8451 | 85.67289 | ---NA--- |
| SEQ ID NO: 2974 | Nga03568 | 101.9417 | 21.033669 | ---NA--- |
| SEQ ID NO: 2975 | Nga03566 | 399.2095 | 563.02476 | dnaj dnaj protein |
| SEQ ID NO: 2976 | Nga05785 | 1039.326 | 1125.833 | ---NA--- |
| SEQ ID NO: 2977 | Nga05782 | 244.6483 | 303.10674 | ---NA--- |
| SEQ ID NO: 2978 | Nga05787 | 271.1111 | 361.07798 | expressed unknown protein [Ectocarpus siliculosus] |
| SEQ ID NO: 2979 | Nga05784 | 297.1014 | 340.14592 | ---NA--- |
| SEQ ID NO: 2980 | Nga05783.01 | 151.2821 | 161.09633 | ---NA--- |
| SEQ ID NO: 2981 | Nga20127 | 247.3934 | 258.74403 | mitochondrial 28s ribosomal protein s29-related |
| SEQ ID NO: 2982 | Nga04168.02 | 1071.701 | 1663.3415 | protein |
| SEQ ID NO: 2983 | Nga06937 | 163.2373 | 222.88764 | hypothetical protein ALO_12346 [Acetonema longum DSM 6540] |
| SEQ ID NO: 2984 | Nga04890 | 490.3581 | 605.77545 | protein |
| SEQ ID NO: 2985 | Nga04888 | 311.0085 | 380.25764 | ---NA--- |
| SEQ ID NO: 2986 | Nga04363 | 490.7407 | 495.47923 | conserved unknown protein [Ectocarpus siliculosus] |
| SEQ ID NO: 2987 | Nga04295 | 286.123 | 587.33285 | hypothetical protein Tcur_2694 [Thermomonospora curvata DSM 43183] |
| SEQ ID NO: 2988 | Nga04644 | 531.1555 | 532.77023 | carboxyl-terminal protease |
| SEQ ID NO: 2989 | Nga05279 | 910.7867 | 1273.8761 | ---NA--- |
| SEQ ID NO: 2990 | Nga20525 | 10541.08 | 9100.0334 | histone h2b |
| SEQ ID NO: 2991 | Nga05286 | 1276.423 | 926.9136 | histone |
| SEQ ID NO: 2992 | Nga05284 | 232.5 | 213.9387 | ---NA--- |
| SEQ ID NO: 2993 | Nga05282 | 472.7011 | 356.40887 | cre-ntl-4 protein |
| SEQ ID NO: 2994 | Nga05281 | 145.9075 | 168.97421 | conserved hypothetical protein [Capsaspora owczarzaki ATCC 30864] |
| SEQ ID NO: 2995 | Nga20474 | 205.6962 | 202.24938 | hydrolase-like protein |
| SEQ ID NO: 2996 | Nga05283 | 2270.396 | 2422.7575 | protein |
| SEQ ID NO: 2997 | Nga05280 | 736.3434 | 611.05504 | abc transporter-like protein |
| SEQ ID NO: 2998 | Nga05285 | 947.1987 | 1056.164 | u2 small nuclear rna auxiliary factor 2 |
| SEQ ID NO: 2999 | Nga05278 | 136.0332 | 179.97656 | ---NA--- |
| SEQ ID NO: 3000 | Nga20520 | 1649.419 | 1528.1949 | cullin a |
| SEQ ID NO: 3001 | Nga01114 | 1269.076 | 1496.516 | poly binding protein 2-like |
| SEQ ID NO: 3002 | Nga01115 | 184.3288 | 203.84556 | transportin 3 |
| SEQ ID NO: 3003 | Nga01113 | 134.0388 | 166.2105 | protein |
| SEQ ID NO: 3004 | Nga04737 | 405.8389 | 571.67784 | ---NA--- |
| SEQ ID NO: 3005 | Nga21298 | 436.2934 | 500.49033 | agmatine deiminase |
| SEQ ID NO: 3006 | Nga06612 | 168.4783 | 229.5985 | ---NA--- |
| SEQ ID NO: 3007 | Nga06613 | 188.0342 | 268.49388 | ---NA--- |
| SEQ ID NO: 3008 | Nga01325.02 | 1065.072 | 1237.6855 | ---NA--- |
| SEQ ID NO: 3009 | Nga01324.02 | 613.4507 | 665.19143 | upf0760 protein c2orf29-like |
| SEQ ID NO: 3010 | Nga01327.02 | 342.3019 | 362.69716 | phosphopantothenoylcysteine decarboxylase |
| SEQ ID NO: 3011 | Nga07278 | 20.83333 | 33.851061 | ---NA--- |
| SEQ ID NO: 3012 | Nga21272 | 591.4221 | 846.04728 | homocysteine s-methyltransferase 1 |
| SEQ ID NO: 3013 | Nga07017 | 596.7994 | 664.65408 | solute carrier family 2 (facilitated glucose transporter) member 13 |
| SEQ ID NO: 3014 | Nga07016 | 834.7826 | 718.56761 | translation elongation factor p |
| SEQ ID NO: 3015 | Nga01953 | 223.0047 | 216.13823 | myosin-like protein |
| SEQ ID NO: 3016 | Nga01955 | 841.5301 | 822.78425 | expressed unknown protein [Ectocarpus siliculosus] |
| SEQ ID NO: 3017 | Nga01956 | 518.2342 | 531.22125 | ---NA--- |
| SEQ ID NO: 3018 | Nga01952 | 292.2002 | 343.00306 | ---NA--- |
| SEQ ID NO: 3019 | Nga01954 | 568.1818 | 527.549 | ---NA--- |
| SEQ ID NO: 3020 | Nga06861 | 369.1814 | 346.00892 | type i fatty acid |
| SEQ ID NO: 3021 | Nga01554 | 487.9852 | 901.02638 | ---NA--- |
| SEQ ID NO: 3022 | Nga01552 | 417.7632 | 424.02908 | wd repeat-containing protein 92 |
| SEQ ID NO: 3023 | Nga01553 | 828.2828 | 927.3139 | membrane protein |
| SEQ ID NO: 3024 | Nga01285 | 151.8207 | 173.25675 | vacuolar protein sorting 41 |
| SEQ ID NO: 3025 | Nga01286 | 6806.387 | 6820.482 | transaldolase |
| SEQ ID NO: 3026 | Nga01288 | 253.9063 | 362.48844 | testes-specific alpha4-t2 proteasome subunit |
| SEQ ID NO: 3027 | Nga01289 | 336.1244 | 390.01605 | sorting and assembly machinery component 50 putativ |
| SEQ ID NO: 3028 | Nga01046.02 | 367.3051 | 362.31286 | aspartate aminotransferase |
| SEQ ID NO: 3029 | Nga01287 | 497.8029 | 701.07608 | major facilitator superfamily |
| SEQ ID NO: 3030 | Nga02147 | 1487.603 | 1703.95 | hypothetical protein CHLNCDRAFT_49994 [Chlorella variabilis] |
| SEQ ID NO: 3031 | Nga02146.1 | 1490.266 | 2171.5862 | cysteine desulfurase |
| SEQ ID NO: 3032 | Nga06938 | 225.8065 | 209.65818 | ---NA--- |
| SEQ ID NO: 3033 | Nga20600 | 474.9722 | 365.09442 | hypothetical protein AURANDRAFT_65325 [Aureococcus anophagefferens] |
| SEQ ID NO: 3034 | Nga06123.02 | 752.5355 | 799.79139 | mitochondrial protein translocase family |

FIGURE 24 AV

| # | Nga model | +N rpkb | -N rpkb | GO |
|---|---|---|---|---|
| SEQ ID NO: 3035 | Nga06905 | 4518.065 | 4449.6455 | protein |
| SEQ ID NO: 3036 | Nga06906 | 146.1596 | 123.59045 | pentatricopeptide repeat-containing protein |
| SEQ ID NO: 3037 | Nga20076 | 1129.648 | 950.41531 | ---NA--- |
| SEQ ID NO: 3038 | Nga21217.1 | 81.08108 | 66.917927 | atp synthase alpha subunit |
| SEQ ID NO: 3039 | Nga06276.02 | 757.3436 | 708.32156 | coiled-coil domain-containing protein 124 |
| SEQ ID NO: 3040 | Nga01355.02 | 490.099 | 633.19273 | chaperone protein |
| SEQ ID NO: 3041 | Nga02122 | 380.9524 | 325.36697 | transcription elongation factor s-ii |
| SEQ ID NO: 3042 | Nga20267 | 249.1228 | 248.95377 | chromatin remodeling complex subunit |
| SEQ ID NO: 3043 | Nga02121 | 250.8961 | 337.78263 | chromatin remodeling complex subunit |
| SEQ ID NO: 3044 | Nga02120 | 485.9649 | 575.82436 | trna pseudouridine synthase |
| SEQ ID NO: 3045 | Nga20897 | 78.68852 | 152.71823 | ---NA--- |
| SEQ ID NO: 3046 | Nga20487 | 183.8741 | 219.41612 | snf2 superfamily rad5 protein |
| SEQ ID NO: 3047 | Nga07272 | 156.7649 | 122.2221 | ---NA--- |
| SEQ ID NO: 3048 | Nga07138 | 2540.96 | 1930.8492 | glycosyl bnr protein |
| SEQ ID NO: 3049 | Nga04328.01 | 440.3748 | 418.89967 | ---NA--- |
| SEQ ID NO: 3050 | Nga04329.01 | 180.8874 | 162.66994 | ---NA--- |
| SEQ ID NO: 3051 | Nga04564 | 455.4125 | 489.70233 | protein |
| SEQ ID NO: 3052 | Nga03757 | 590 | 626.10922 | ---NA--- |
| SEQ ID NO: 3053 | Nga03756 | 724.4526 | 832.1925 | domain protein |
| SEQ ID NO: 3054 | Nga03759 | 1415.07 | 1287.9831 | tubulin--tyrosine ligase-like protein 12 |
| SEQ ID NO: 3055 | Nga03758 | 50.69124 | 74.877922 | ---NA--- |
| SEQ ID NO: 3056 | Nga02378.2 | 371.0451 | 370.77135 | diacylglycerol o- |
| SEQ ID NO: 3057 | Nga07127 | 432.4324 | 522.09924 | ---NA--- |
| SEQ ID NO: 3058 | Nga01500.02 | 378.1903 | 335.94494 | ---NA--- |
| SEQ ID NO: 3059 | Nga05400.2 | 1037.525 | 1019.0529 | proliferation-associated protein 2g4 |
| SEQ ID NO: 3060 | Nga04774.01 | 8119.114 | 8316.7961 | mosc domain protein |
| SEQ ID NO: 3061 | Nga01107.02 | 535.2381 | 451.8633 | isoamyl acetate-hydrolyzing esterase 1 homolog ( cerevisiae) |
| SEQ ID NO: 3062 | Nga01108.02 | 2068.654 | 1876.8227 | predicted protein [Thalassiosira pseudonana CCMP1335] |
| SEQ ID NO: 3063 | Nga01106.02 | 1262.956 | 1069.7195 | chalcone isomerase-like protein |
| SEQ ID NO: 3064 | Nga03574.02 | 344.2249 | 390.16177 | protein |
| SEQ ID NO: 3065 | Nga03575.02 | 352.2388 | 224.1917 | protein |
| SEQ ID NO: 3066 | Nga01066.02 | 143.6782 | 143.1861 | ---NA--- |
| SEQ ID NO: 3067 | Nga01065.02 | 307.4627 | 219.88032 | ---NA--- |
| SEQ ID NO: 3068 | Nga04494.1 | 1548.544 | 1513.1095 | glutaredoxin-like protein |
| SEQ ID NO: 3069 | Nga04497 | 301.5007 | 313.29549 | uncharacterized protein c1orf53-like |
| SEQ ID NO: 3070 | Nga04496 | 9121.803 | 10300.199 | heat shock protein 70 |
| SEQ ID NO: 3071 | Nga04495 | 51.28205 | 127.76605 | fatty acid elongase |
| SEQ ID NO: 3072 | Nga07230 | 651.9274 | 650.92289 | ---NA--- |
| SEQ ID NO: 3073 | Nga07228 | 614.8459 | 699.77823 | heavy metal translocating p-type atpase |
| SEQ ID NO: 3074 | Nga07229 | 4.519774 | 3.6719795 | short-chain dehydrogenase reductase sdr |
| SEQ ID NO: 3075 | Nga06827 | 0 | 2.087156 | glycosyl bnr protein |
| SEQ ID NO: 3076 | Nga07063 | 214.5086 | 234.05289 | capsular associated protein |
| SEQ ID NO: 3077 | Nga06703.2 | 927.3743 | 1104.6472 | uncharacterized protein |
| SEQ ID NO: 3078 | Nga20498.1 | 399.1826 | 472.25458 | ---NA--- |
| SEQ ID NO: 3079 | Nga06266.02 | 780.5841 | 1109.7377 | gdsl lipase acylhydrolase family protein |
| SEQ ID NO: 3080 | Nga06280.02 | 13.10044 | 42.572513 | ---NA--- |
| SEQ ID NO: 3081 | Nga01380.02 | 473.0159 | 387.4424 | conserved unknown protein [Ectocarpus siliculosus] |
| SEQ ID NO: 3082 | Nga04932 | 104.2553 | 70.294969 | ---NA--- |
| SEQ ID NO: 3083 | Nga03763 | 422.5146 | 329.40447 | nedd8-conjugating enzyme ubc12 |
| SEQ ID NO: 3084 | Nga03762.01 | 964.1898 | 915.4636 | subunit of proteaseome activator |
| SEQ ID NO: 3085 | Nga02165 | 1593.186 | 1790.1942 | h aca ribonucleoprotein complex subunit 4 |
| SEQ ID NO: 3086 | Nga02167 | 350.9524 | 301.75803 | tpa: zn 2cys6 transcription factor |
| SEQ ID NO: 3087 | Nga02166 | 754.3398 | 707.15062 | acetyl-coenzyme a synthetase |
| SEQ ID NO: 3088 | Nga20901 | 181.8182 | 154.74771 | ---NA--- |
| SEQ ID NO: 3089 | Nga20699 | 185.1852 | 165.49407 | carbohydrate kinase fggy |
| SEQ ID NO: 3090 | Nga02225 | 713.9241 | 579.55301 | protein |
| SEQ ID NO: 3091 | Nga02224 | 752.7011 | 749.68111 | glycoside |
| SEQ ID NO: 3092 | Nga20410 | 639.7849 | 502.30606 | protein |
| SEQ ID NO: 3093 | Nga07313 | 270.1613 | 428.05212 | ---NA--- |
| SEQ ID NO: 3094 | Nga04806.01 | 6873.897 | 6980.2338 | 60s ribosomal protein l39 |
| SEQ ID NO: 3095 | Nga04005.02 | 1076.887 | 1047.7602 | protease required for anti-sigma degradation |
| SEQ ID NO: 3096 | Nga04140.1 | 262.3336 | 318.9475 | uncharacterized membrane protein |
| SEQ ID NO: 3097 | Nga04138 | 4079.327 | 4002.2369 | proteasome subunit |
| SEQ ID NO: 3098 | Nga03221 | 71.05943 | 141.35223 | ---NA--- |

FIGURE 24 AW

| # | Nga model | +N rpkb | -N rpkb | GO |
|---|---|---|---|---|
| SEQ ID NO: 3099 | Nga03220.01 | 96.58793 | 100.07831 | gc-rich sequence dna-binding factor homolog |
| SEQ ID NO: 3100 | Nga03216.01 | 358.2183 | 431.5267 | aspartyl glutamyl-trna amidotransferase subunit b |
| SEQ ID NO: 3101 | Nga05331.2 | 11.56069 | 0 | ---NA--- |
| SEQ ID NO: 3102 | Nga03219 | 124.8025 | 109.52128 | trna splicing endonuclease 2 homolog ( cerevisiae) |
| SEQ ID NO: 3103 | Nga03214 | 232.4903 | 363.00982 | drug metabolite transporter superfamily |
| SEQ ID NO: 3104 | Nga03217 | 1226.868 | 1062.9956 | protein |
| SEQ ID NO: 3105 | Nga03218 | 2388.649 | 2486.302 | s-adenosylmethionine carrier 1 |
| SEQ ID NO: 3106 | Nga03215.01 | 761.8481 | 870.92112 | ribosomal rna processing 12 homolog ( cerevisiae) |
| SEQ ID NO: 3107 | Nga00165.02 | 1802.676 | 1561.4509 | anion exchanger family |
| SEQ ID NO: 3108 | Nga04641 | 7836.066 | 3891.9471 | light-harvesting protein |
| SEQ ID NO: 3109 | Nga20249 | 210.6406 | 281.0998 | class member 1 |
| SEQ ID NO: 3110 | Nga20094 | 314.7244 | 368.13324 | class member 1 |
| SEQ ID NO: 3111 | Nga04640 | 6783.496 | 8667.3781 | phosphoenolpyruvate carboxykinase |
| SEQ ID NO: 3112 | Nga01812 | 3089.286 | 2748.9211 | pyruvate dehydrogenase e1 component beta subunit |
| SEQ ID NO: 3113 | Nga02830.02 | 727.3567 | 711.81084 | potential ankyrin repeat protein |
| SEQ ID NO: 3114 | Nga02831.02 | 751.5432 | 685.3795 | solute carrier family 25 (mitochondrial carrier citrate transporter) member 1 |
| SEQ ID NO: 3115 | Nga07020 | 322.2836 | 391.00157 | ---NA--- |
| SEQ ID NO: 3116 | Nga04863 | 742.4534 | 754.15902 | adipocyte plasma membrane-associated |
| SEQ ID NO: 3117 | Nga21104 | 2841.988 | 3492.9847 | PREDICTED: hypothetical protein [Saccoglossus kowalevskii] |
| SEQ ID NO: 3118 | Nga04864 | 2982.301 | 2549.9135 | upf0187-containing protein |
| SEQ ID NO: 3119 | Nga04865 | 3609.195 | 3626.7882 | triosephosphate isomerase |
| SEQ ID NO: 3120 | Nga03105.02 | 948.5294 | 915.96988 | conserved unknown protein [Ectocarpus siliculosus] |
| SEQ ID NO: 3121 | Nga00753.02 | 204.0609 | 232.04301 | diacylglycerol acyltransferase family protein |
| SEQ ID NO: 3122 | Nga04643 | 2725.971 | 2711.4077 | protein |
| SEQ ID NO: 3123 | Nga02172 | 285.3387 | 388.49668 | agc family protein kinase |
| SEQ ID NO: 3124 | Nga02171 | 316.0228 | 375.25584 | pyridoxine biosynthesis protein |
| SEQ ID NO: 3125 | Nga20590 | 72.72727 | 59.085488 | type i polyketide synthase |
| SEQ ID NO: 3126 | Nga00314.2 | 772.2772 | 646.0589 | protein |
| SEQ ID NO: 3127 | Nga00318.02 | 315.1042 | 373.77213 | expressed unknown protein [Ectocarpus siliculosus] |
| SEQ ID NO: 3128 | Nga06871 | 21.76871 | 10.316514 | bnr asp-box repeat-containing protein |
| SEQ ID NO: 3129 | Nga01358.02 | 440.5405 | 482.57584 | dna gyrase subunit b |
| SEQ ID NO: 3130 | Nga06626.2 | 314.7903 | 310.38359 | atp-dependent rna helicase ddx1 |
| SEQ ID NO: 3131 | Nga01982 | 21.64502 | 37.514595 | ---NA--- |
| SEQ ID NO: 3132 | Nga06567.02 | 13.7931 | 7.4705789 | ---NA--- |
| SEQ ID NO: 3133 | Nga07223 | 211.1952 | 231.7031 | arginine serine-rich splicing factor |
| SEQ ID NO: 3134 | Nga07224.1 | 147.4954 | 165.80111 | ubiquitin-like protein |
| SEQ ID NO: 3135 | Nga04045 | 4995.287 | 5618.3189 | protein |
| SEQ ID NO: 3136 | Nga04047.1 | 2199.197 | 1649.6478 | anion:sodium symporter |
| SEQ ID NO: 3137 | Nga21283.1 | 1526.012 | 1092.6261 | response regulator receiver domain-containing protein |
| SEQ ID NO: 3138 | Nga02476.02 | 1954.212 | 1454.2316 | response regulator receiver domain-containing protein |
| SEQ ID NO: 3139 | Nga02465.02 | 2351.721 | 2235.209 | ---NA--- |
| SEQ ID NO: 3140 | Nga07187 | 5097.319 | 4308.9481 | ---NA--- |
| SEQ ID NO: 3141 | Nga04874 | 807.4409 | 754.28809 | gtp-binding protein |
| SEQ ID NO: 3142 | Nga04875 | 640.2516 | 647.21525 | ---NA--- |
| SEQ ID NO: 3143 | Nga03775.02 | 595.6679 | 481.0028 | 3 (2) -bisphosphate nucleotidase |
| SEQ ID NO: 3144 | Nga03554 | 809.8464 | 1174.7266 | dead deah box rna |
| SEQ ID NO: 3145 | Nga03555 | 311.0048 | 316.15919 | alkyl sulfatase or beta-lactamase |
| SEQ ID NO: 3146 | Nga03553 | 246.0733 | 218.3482 | ankyrin repeat protein |
| SEQ ID NO: 3147 | Nga03551 | 669.5122 | 735.14596 | ribonucleoside-diphosphate alpha subunit |
| SEQ ID NO: 3148 | Nga03552 | 401.2975 | 444.73831 | |
| SEQ ID NO: 3149 | Nga20767 | 1347.633 | 1246.3108 | atp-binding cassette superfamily |
| SEQ ID NO: 3150 | Nga06946 | 374.5233 | 451.96717 | protein phosphatase 2c |
| SEQ ID NO: 3151 | Nga00641.2 | 534.2137 | 412.22708 | ---NA--- |
| SEQ ID NO: 3152 | Nga04787.1 | 439.3116 | 584.78934 | protein |
| SEQ ID NO: 3153 | Nga04702 | 111.1111 | 76.592299 | hydrolase iia |
| SEQ ID NO: 3154 | Nga05340.02 | 143.7186 | 176.36573 | ---NA--- |
| SEQ ID NO: 3155 | Nga04965 | 1143.646 | 861.79938 | lactoylglutathione lyase |
| SEQ ID NO: 3156 | Nga04964 | 434.6103 | 424.27855 | -like 2 |
| SEQ ID NO: 3157 | Nga04966 | 992.5595 | 912.36668 | ubiquitin carboxyl-terminal hydrolase isozyme l3 |
| SEQ ID NO: 3158 | Nga04967 | 259.1241 | 208.21285 | nicotinamide n-methyltransferase |
| SEQ ID NO: 3159 | Nga00710.2 | 880 | 765.48532 | protein |
| SEQ ID NO: 3160 | Nga00699.02 | 156.6667 | 192.27402 | phosphatidylinositol kinase (pik-k) |
| SEQ ID NO: 3161 | Nga01677.2 | 1513.24 | 1322.8277 | disulfide isomerase |

FIGURE 24 AX

| # | Nga model | +N rpkb | -N rpkb | GO |
|---|---|---|---|---|
| SEQ ID NO: 3162 | Nga01678.02 | 756.1299 | 824.80835 | mitochondrial-processing peptidase subunit beta |
| SEQ ID NO: 3163 | Nga01679.02 | 561.5797 | 630.07383 | pleiotropic regulator 1 |
| SEQ ID NO: 3164 | Nga04323.01 | 677.9089 | 672.83502 | cation diffusion facilitator family |
| SEQ ID NO: 3165 | Nga05773.2 | 490.2676 | 531.73345 | cystathionine gamma-synthase |
| SEQ ID NO: 3166 | Nga02114 | 743.6919 | 739.41865 | wd repeat domain phosphoinositide-interacting protein 3 |
| SEQ ID NO: 3167 | Nga20291 | 616.5919 | 655.76943 | ---NA--- |
| SEQ ID NO: 3168 | Nga02112 | 945.933 | 954.69709 | protein |
| SEQ ID NO: 3169 | Nga02115.2 | 1490.608 | 1340.8512 | protein |
| SEQ ID NO: 3170 | Nga20862.1 | 6250 | 6514.8784 | ---NA--- |
| SEQ ID NO: 3171 | Nga20996 | 172.0698 | 132.36524 | rab alpha subunit |
| SEQ ID NO: 3172 | Nga04980 | 74.07407 | 86.92618 | ---NA--- |
| SEQ ID NO: 3173 | Nga04977 | 987.4715 | 1123.9477 | protein |
| SEQ ID NO: 3174 | Nga20963 | 239.5693 | 414.04904 | activating signal cointegrator 1 complex subunit 3-like 1 |
| SEQ ID NO: 3175 | Nga05818.2 | 586.8373 | 778.59502 | trehalose-phosphate synthase |
| SEQ ID NO: 3176 | Nga00886.02 | 6284.261 | 7991.0382 | isocitrate lyase |
| SEQ ID NO: 3177 | Nga20275.1 | 178.5346 | 155.3865 | upf0533 protein c5orf44 homolog |
| SEQ ID NO: 3178 | Nga20506.1 | 354.1667 | 324.97018 | conserved unknown protein [Ectocarpus siliculosus] |
| SEQ ID NO: 3179 | Nga07161 | 137.3955 | 117.77095 | rna-binding la domain protein |
| SEQ ID NO: 3180 | Nga07162 | 387.1681 | 422.58905 | uncharacterized conserved protein |
| SEQ ID NO: 3181 | Nga07160 | 570.1754 | 755.41314 | epsin 2-like protein |
| SEQ ID NO: 3182 | Nga04943.01 | 365.5395 | 394.2204 | ainteguemnta-like protein |
| SEQ ID NO: 3183 | Nga04942.01 | 2777.103 | 2549.143 | phosphoglucomutase |
| SEQ ID NO: 3184 | Nga04941.01 | 5066.498 | 7316.4598 | wd sam and u-box domain-containing protein 1 |
| SEQ ID NO: 3185 | Nga04456 | 835.1114 | 981.66775 | u5 small nuclear ribonucleoprotein 200 kda helicase |
| SEQ ID NO: 3186 | Nga20274.1 | 132.2506 | 159.17591 | apoptosis-inducing mitochondrion-associated 1 |
| SEQ ID NO: 3187 | Nga03465.02 | 386.4119 | 365.6777 | protein |
| SEQ ID NO: 3188 | Nga03473.02 | 106.7961 | 59.595395 | ---NA--- |
| SEQ ID NO: 3189 | Nga03467.2 | 1522.52 | 1536.9981 | alpha-actinin |
| SEQ ID NO: 3190 | Nga01198.02 | 154.661 | 172.12404 | ---NA--- |
| SEQ ID NO: 3191 | Nga01197.02 | 2927.435 | 2518.5728 | peptide deformylase |
| SEQ ID NO: 3192 | Nga02369 | 262.1871 | 248.33031 | delta( )-delta( )-dienoyl- mitochondrial-like |
| SEQ ID NO: 3193 | Nga03678 | 28.57143 | 20.633027 | ---NA--- |
| SEQ ID NO: 3194 | Nga03677 | 84.65608 | 51.582569 | ---NA--- |
| SEQ ID NO: 3195 | Nga03676 | 1296.296 | 874.18879 | pin1-type peptidyl-prolyl cis-trans in1 |
| SEQ ID NO: 3196 | Nga07053 | 71.49758 | 74.308802 | ---NA--- |
| SEQ ID NO: 3197 | Nga06850 | 332.618 | 413.76747 | ---NA--- |
| SEQ ID NO: 3198 | Nga06851 | 437.3866 | 525.88944 | hypothetical protein Gbem_1483 [Geobacter bemidjiensis Bem] |
| SEQ ID NO: 3199 | Nga04710 | 63.69983 | 76.563656 | helicase domain-containing protein |
| SEQ ID NO: 3200 | Nga04709 | 1077.536 | 1056.5456 | methylmalonate-semialdehyde dehydrogenase |
| SEQ ID NO: 3201 | Nga06146.2 | 1602.181 | 1863.635 | pyrophosphate-dependent phosphofructose kinase |
| SEQ ID NO: 3202 | Nga02136 | 1252.304 | 1138.1444 | dimethyl-8-ribityllumazine synthase |
| SEQ ID NO: 3203 | Nga02138 | 119.8198 | 157.11772 | 3-oxoacyl-(acyl-carrier-protein) synthase 2 |
| SEQ ID NO: 3204 | Nga20125 | 170.7014 | 225.25349 | uncharacterized udp-glucosyltransferase |
| SEQ ID NO: 3205 | Nga20060 | 288.5439 | 266.16937 | protein |
| SEQ ID NO: 3206 | Nga02137 | 993.8776 | 966.06782 | protein |
| SEQ ID NO: 3207 | Nga07192 | 140.3509 | 122.47089 | subtilisin-like serine peptidase |
| SEQ ID NO: 3208 | Nga06969 | 213.3106 | 216.89326 | bacterial transferase hexapeptide repeat-containing protein |
| SEQ ID NO: 3209 | Nga02325.02 | 763.4409 | 183.45091 | rna binding protein |
| SEQ ID NO: 3210 | Nga04368 | 300.1912 | 347.96042 | cleavage stimulation factor subunit 3 |
| SEQ ID NO: 3211 | Nga01100.2 | 489.9206 | 115.80082 | conserved hypothetical protein [Paracoccidioides brasiliensis Pb01] |
| SEQ ID NO: 3212 | Nga05988.2 | 2033.517 | 2206.4515 | protein |
| SEQ ID NO: 3213 | Nga04311 | 60.60606 | 73.85686 | cleavage and polyadenylation specificity factor |
| SEQ ID NO: 3214 | Nga21219.1 | 230.3307 | 228.50431 | augmenter of liver regeneration |
| SEQ ID NO: 3215 | Nga07207 | 64.24242 | 129.98807 | ---NA--- |
| SEQ ID NO: 3216 | Nga04751 | 971.3115 | 1094.3326 | ---NA--- |
| SEQ ID NO: 3217 | Nga06972 | 497.992 | 569.89416 | ---NA--- |
| SEQ ID NO: 3218 | Nga04855.01 | 0 | 66.866293 | ---NA--- |
| SEQ ID NO: 3219 | Nga04854 | 108.1794 | 152.43398 | anthranilate phosphoribosyltransferase |
| SEQ ID NO: 3220 | Nga00679.02 | 1138.103 | 1014.1425 | protein |
| SEQ ID NO: 3221 | Nga04270.02 | 132.8125 | 93.090417 | ---NA--- |
| SEQ ID NO: 3222 | Nga04234 | 262.1083 | 348.73343 | protein |
| SEQ ID NO: 3223 | Nga04236 | 327.381 | 212.7781 | chord family protein |
| SEQ ID NO: 3224 | Nga04233 | 7273.639 | 7017.7419 | atp synthase subunit delta |
| SEQ ID NO: 3225 | Nga04231 | 967.3222 | 1079.4749 | importin beta- |

FIGURE 24 AY

| # | Nga model | +N rpkb | -N rpkb | GO |
|---|---|---|---|---|
| SEQ ID NO: 3226 | Nga04235 | 729.8497 | 701.80833 | cellulose synthase (udp-forming) family gt2 |
| SEQ ID NO: 3227 | Nga04232 | 510.6145 | 515.59515 | calcium calmodulin dependent protein |
| SEQ ID NO: 3228 | Nga04754.1 | 1061.605 | 769.2306 | protein |
| SEQ ID NO: 3229 | Nga04755.01 | 367.3966 | 342.62874 | short-chain dehydrogenase reductase sdr |
| SEQ ID NO: 3230 | Nga20369 | 92.55079 | 136.93251 | pentatricopeptide repeat-containing protein |
| SEQ ID NO: 3231 | Nga02180 | 101.0638 | 59.539454 | ---NA--- |
| SEQ ID NO: 3232 | Nga06879 | 917.4917 | 758.41697 | ---NA--- |
| SEQ ID NO: 3233 | Nga03045.02 | 422.5352 | 411.93403 | proteasome subunit alpha |
| SEQ ID NO: 3234 | Nga03058.02 | 293.4473 | 271.58002 | transmembrane protein 144 |
| SEQ ID NO: 3235 | Nga03049.2 | 1050.495 | 1231.2402 | iron-sulfur cluster scaffold protein nfu-like protein |
| SEQ ID NO: 3236 | Nga07299.1 | 2197.878 | 2503.6802 | solute carrier family 35 member b1 |
| SEQ ID NO: 3237 | Nga05100.2 | 272.9104 | 285.80795 | dna replication licensing factor mcm2 |
| SEQ ID NO: 3238 | Nga04401.01 | 420.6799 | 494.05287 | ---NA--- |
| SEQ ID NO: 3239 | Nga04400.1 | 159.6107 | 175.00422 | minichromosome maintenance protein 2 |
| SEQ ID NO: 3240 | Nga04948 | 238.2979 | 193.59926 | protein |
| SEQ ID NO: 3241 | Nga01903 | 788.8631 | 743.93793 | conserved unknown protein [Ectocarpus siliculosus] |
| SEQ ID NO: 3242 | Nga01904 | 3324.742 | 3802.4862 | ---NA--- |
| SEQ ID NO: 3243 | Nga01901 | 334.9436 | 374.16052 | phosphoacetylglucosamine mutase |
| SEQ ID NO: 3244 | Nga01902 | 2519.75 | 2572.4197 | ---NA--- |
| SEQ ID NO: 3245 | Nga04826 | 947.2934 | 964.41768 | aldo keto reductase |
| SEQ ID NO: 3246 | Nga04499 | 557.5888 | 584.17675 | protein |
| SEQ ID NO: 3247 | Nga04229.01 | 1672.539 | 1881.5102 | ---NA--- |
| SEQ ID NO: 3248 | Nga02099 | 1486.425 | 971.11188 | delta 5 fatty acid desaturase |
| SEQ ID NO: 3249 | Nga02100 | 2967.782 | 2464.4579 | nucleoside diphosphate kinase |
| SEQ ID NO: 3250 | Nga02098 | 857.6779 | 832.71074 | hypothetical protein CHLNCDRAFT_49994 [Chlorella variabilis] |
| SEQ ID NO: 3251 | Nga07072 | 131.4554 | 147.48256 | protein |
| SEQ ID NO: 3252 | Nga04274 | 384.6154 | 351.81957 | ---NA--- |
| SEQ ID NO: 3253 | Nga04272 | 1712.885 | 1696.1562 | ---NA--- |
| SEQ ID NO: 3254 | Nga04271 | 310.6267 | 271.54638 | ---NA--- |
| SEQ ID NO: 3255 | Nga02394 | 740.9396 | 1022.1657 | ---NA--- |
| SEQ ID NO: 3256 | Nga06318.2 | 203.6082 | 234.51456 | adp-ribosylation factor gtpase-activating |
| SEQ ID NO: 3257 | Nga02601.02 | 1569.873 | 1348.6361 | protein |
| SEQ ID NO: 3258 | Nga02061.01 | 3210.618 | 3488.5947 | peptidase s1 and chymotrypsin hap |
| SEQ ID NO: 3259 | Nga01740 | 225.7218 | 222.71214 | molecular chaperone |
| SEQ ID NO: 3260 | Nga02013.02 | 121.3788 | 210.92674 | transducin -like 3 |
| SEQ ID NO: 3261 | Nga20982.1 | 177.2429 | 154.07047 | ---NA--- |
| SEQ ID NO: 3262 | Nga06627.2 | 80.9816 | 152.84896 | transducin-like 3 |
| SEQ ID NO: 3263 | Nga02359.01 | 579.3358 | 642.87869 | u2 small nuclear ribonucleoprotein a |
| SEQ ID NO: 3264 | Nga01155.02 | 3923.423 | 4163.9854 | s-adenosylmethionine mitochondrial carrier protein |
| SEQ ID NO: 3265 | Nga01156.02 | 309.6192 | 286.54685 | ---NA--- |
| SEQ ID NO: 3266 | Nga01151.02 | 2026.278 | 2082.6096 | ribosome biogenesis protein nsa2 homolog |
| SEQ ID NO: 3267 | Nga01149.02 | 371.1584 | 514.72818 | short chain dehydrogenase |
| SEQ ID NO: 3268 | Nga01985 | 2090.659 | 1990.8888 | atp-dependent metalloprotease |
| SEQ ID NO: 3269 | Nga01986 | 3546.392 | 4076.0865 | ---NA--- |
| SEQ ID NO: 3270 | Nga01987 | 291.3486 | 311.46421 | protein |
| SEQ ID NO: 3271 | Nga01983.01 | 1527.665 | 1594.8829 | conserved unknown protein [Ectocarpus siliculosus] |
| SEQ ID NO: 3272 | Nga02022.2 | 988.9503 | 906.68476 | ---NA--- |
| SEQ ID NO: 3273 | Nga04350 | 106.817 | 144.19861 | rna polymerase largest subunit |
| SEQ ID NO: 3274 | Nga04223.02 | 669.0939 | 1243.6157 | trna (guanine-n -)-methyltransferase-like |
| SEQ ID NO: 3275 | Nga04222.02 | 558.6457 | 647.05873 | protein |
| SEQ ID NO: 3276 | Nga04354 | 60.43614 | 60.067178 | rna polymerase largest subunit |
| SEQ ID NO: 3277 | Nga06979 | 241.8112 | 304.72477 | yor006c-like protein |
| SEQ ID NO: 3278 | Nga00389.02 | 155.303 | 164.12635 | eukaryotic translation initiation factor 2-alpha kinase 1 |
| SEQ ID NO: 3279 | Nga00368.02 | 282.2528 | 304.32702 | eukaryotic translation initiation factor 2-alpha kinase 1 |
| SEQ ID NO: 3280 | Nga07040 | 142.3565 | 176.50592 | dna repair protein rev1 |
| SEQ ID NO: 3281 | Nga03469.2 | 369.7825 | 427.30745 | fad-dependent pyridine nucleotide-disulphide oxidoreductase |
| SEQ ID NO: 3282 | Nga20233.1 | 404.2934 | 389.49915 | protein |
| SEQ ID NO: 3283 | Nga03468.2 | 2891.089 | 2994.981 | small nuclear ribonucleoprotein sm d1 |
| SEQ ID NO: 3284 | Nga01209 | 1266.129 | 1068.4923 | na+-dependent inorganic phosphate cotransporter |
| SEQ ID NO: 3285 | Nga01208 | 1284.963 | 1131.0739 | coatomer subunit epsilon |
| SEQ ID NO: 3286 | Nga01211 | 207.9439 | 120.21872 | protein |
| SEQ ID NO: 3287 | Nga01210 | 659.8425 | 672.11681 | protein |
| SEQ ID NO: 3288 | Nga07168 | 91.60305 | 115.76546 | ---NA--- |
| SEQ ID NO: 3289 | Nga06803 | 171.7246 | 206.86481 | ---NA--- |

FIGURE 24 AZ

| # | Nga model | +N rpkb | -N rpkb | GO |
|---|---|---|---|---|
| SEQ ID NO: 3290 | Nga01937 | 449.5356 | 539.94014 | ariadne-like ubiquitin ligase |
| SEQ ID NO: 3291 | Nga06813.1 | 1161.026 | 1004.3523 | protein |
| SEQ ID NO: 3292 | Nga20727 | 523.0179 | 422.48894 | nad-dependent epimerase dehydratase |
| SEQ ID NO: 3293 | Nga20248 | 1464.933 | 1592.8405 | ---NA--- |
| SEQ ID NO: 3294 | Nga03691 | 87.78626 | 66.151691 | ---NA--- |
| SEQ ID NO: 3295 | Nga07131 | 697.5309 | 815.76877 | ---NA--- |
| SEQ ID NO: 3296 | Nga21232 | 236.9403 | 309.2067 | protein |
| SEQ ID NO: 3297 | Nga21270 | 147.8261 | 197.80794 | phenazine biosynthesis protein family |
| SEQ ID NO: 3298 | Nga03131.2 | 4353.203 | 4000.4485 | protein |
| SEQ ID NO: 3299 | Nga07239.1 | 581.0306 | 773.39182 | splicing factor 3b |
| SEQ ID NO: 3300 | Nga20967 | 401.7372 | 416.35702 | myb dna binding protein transcription factor-like protein |
| SEQ ID NO: 3301 | Nga01158.02 | 874.8002 | 1073.4231 | dihydroorotate dehydrogenase |
| SEQ ID NO: 3302 | Nga01162.02 | 958.1056 | 808.97252 | ---NA--- |
| SEQ ID NO: 3303 | Nga01161.02 | 1189.836 | 1233.818 | protein |
| SEQ ID NO: 3304 | Nga02719.02 | 441.8052 | 429.69137 | ---NA--- |
| SEQ ID NO: 3305 | Nga02714.2 | 1736.949 | 1771.3629 | protein |
| SEQ ID NO: 3306 | Nga03317.2 | 646.7331 | 730.55312 | splicing factor subunit 49kda |
| SEQ ID NO: 3307 | Nga03322.02 | 2959.641 | 2797.9496 | ubiquitin-conjugating enzyme |
| SEQ ID NO: 3308 | Nga01883.01 | 88.70968 | 270.80849 | ---NA--- |
| SEQ ID NO: 3309 | Nga02364 | 209.5727 | 269.21381 | translation initiation factor if-2 |
| SEQ ID NO: 3310 | Nga02187 | 149.9579 | 167.91495 | conserved unknown protein [Ectocarpus siliculosus] |
| SEQ ID NO: 3311 | Nga02184 | 514.6667 | 626.83137 | ---NA--- |
| SEQ ID NO: 3312 | Nga00157.02 | 2288.21 | 2909.1217 | protein |
| SEQ ID NO: 3313 | Nga02186 | 114.3791 | 95.579465 | pci domain-containing protein 2 |
| SEQ ID NO: 3314 | Nga02192 | 357.6288 | 316.86435 | pci domain-containing protein 2 |
| SEQ ID NO: 3315 | Nga00774.02 | 7425.419 | 5973.5619 | light-harvesting protein |
| SEQ ID NO: 3316 | Nga04588 | 98.63211 | 139.59602 | ArfGAP [Ectocarpus siliculosus] |
| SEQ ID NO: 3317 | Nga04460 | 314.3483 | 274.07124 | lysine decarboxylase-like protein |
| SEQ ID NO: 3318 | Nga04459 | 623.3635 | 776.69946 | sedoheptulose- -bisphosphatase |
| SEQ ID NO: 3319 | Nga04458.01 | 20072.77 | 23208.969 | inorganic phosphate |
| SEQ ID NO: 3320 | Nga20288.1 | 379.5276 | 370.17601 | chaperone protein |
| SEQ ID NO: 3321 | Nga20445.1 | 348.9499 | 446.24338 | heat shock protein 40 like protein domain containing protein |
| SEQ ID NO: 3322 | Nga00677.2 | 184.0234 | 226.5232 | asparagine synthetase domain-containing protein 1-like |
| SEQ ID NO: 3323 | Nga06922 | 1067.395 | 892.50058 | arachidonate 5-lipoxygenase |
| SEQ ID NO: 3324 | Nga03592 | 16.94915 | 36.719795 | ---NA--- |
| SEQ ID NO: 3325 | Nga03591.01 | 688.0223 | 748.30646 | possible sulfotransferase |
| SEQ ID NO: 3326 | Nga06913 | 256.8149 | 307.71925 | ---NA--- |
| SEQ ID NO: 3327 | Nga02426.01 | 2195.592 | 2118.722 | ---NA--- |
| SEQ ID NO: 3328 | Nga20378.1 | 105.9432 | 156.74703 | conserved unknown protein [Ectocarpus siliculosus] |
| SEQ ID NO: 3329 | Nga04766.01 | 235.0908 | 237.8059 | 2-dehydropantoate 2-reductase |
| SEQ ID NO: 3330 | Nga04767.01 | 387.6488 | 415.88446 | ---NA--- |
| SEQ ID NO: 3331 | Nga04799 | 1072.936 | 964.97262 | protein |
| SEQ ID NO: 3332 | Nga03929.02 | 1365.455 | 1483.0457 | -dihydroxy-2-butanone 4-phosphate synthase |
| SEQ ID NO: 3333 | Nga07271 | 3179.048 | 5255.2321 | phosphate dikinase |
| SEQ ID NO: 3334 | Nga05037 | 1363.601 | 1487.6525 | otu-like cysteine protease family protein |
| SEQ ID NO: 3335 | Nga05038 | 2161.337 | 1494.1701 | uncharacterized protein |
| SEQ ID NO: 3336 | Nga03852.02 | 338.7755 | 446.55767 | ---NA--- |
| SEQ ID NO: 3337 | Nga04285 | 262.4878 | 262.05562 | amino acid-polyamine-organocation family |
| SEQ ID NO: 3338 | Nga04284 | 226.219 | 207.81466 | amino acid-polyamine-organocation family |
| SEQ ID NO: 3339 | Nga07159 | 78.57143 | 123.79816 | ---NA--- |
| SEQ ID NO: 3340 | Nga03699.2 | 613.3829 | 865.78177 | n-acetyltransferase esco2 |
| SEQ ID NO: 3341 | Nga03700.02 | 801.2232 | 1132.9236 | n-acetyltransferase esco2 |
| SEQ ID NO: 3342 | Nga02485.2 | 1718.162 | 1876.166 | sorbitol transporter |
| SEQ ID NO: 3343 | Nga02328.01 | 304.9645 | 320.61676 | signal recognition particle 72kda |
| SEQ ID NO: 3344 | Nga01479.02 | 3896.409 | 4264.1115 | translationally controlled tumor protein |
| SEQ ID NO: 3345 | Nga04914 | 473.6025 | 487.79168 | glycerol-3-phosphate mitochondrial precursor |
| SEQ ID NO: 3346 | Nga20634.1 | 81.15942 | 94.194256 | protein |
| SEQ ID NO: 3347 | Nga21107.1 | 325.6113 | 338.772 | histidine kinase |
| SEQ ID NO: 3348 | Nga05829.2 | 946.2366 | 938.39761 | myb-like dna-binding domain containing protein |
| SEQ ID NO: 3349 | Nga06976 | 66203.17 | 80596.044 | ---NA--- |
| SEQ ID NO: 3350 | Nga00103.02 | 2716.834 | 3062.5209 | protein |
| SEQ ID NO: 3351 | Nga00099.02 | 257.2877 | 207.31093 | protein |
| SEQ ID NO: 3352 | Nga04793 | 1349.398 | 1631.3764 | ---NA--- |
| SEQ ID NO: 3353 | Nga01305.2 | 2472.452 | 2697.7859 | adp atp carrier protein |

FIGURE 24 BA

| # | Nga model | +N rpkb | -N rpkb | GO |
|---|---|---|---|---|
| SEQ ID NO: 3354 | Nga01309.02 | 1077.348 | 825.89107 | protein |
| SEQ ID NO: 3355 | Nga01314.02 | 517.0604 | 329.80351 | conserved unknown protein [Ectocarpus siliculosus] |
| SEQ ID NO: 3356 | Nga00425.02 | 135.4738 | 105.18481 | ---NA--- |
| SEQ ID NO: 3357 | Nga00409.02 | 677.7188 | 774.35424 | protein |
| SEQ ID NO: 3358 | Nga00411.02 | 482.5374 | 523.47299 | werner syndrome atp-dependent helicase |
| SEQ ID NO: 3359 | Nga00412.02 | 1750 | 1613.6836 | hsp12 variant c |
| SEQ ID NO: 3360 | Nga00424.02 | 745.6395 | 614.0425 | ---NA--- |
| SEQ ID NO: 3361 | Nga03843 | 297.4359 | 203.31468 | expressed unknown protein [Ectocarpus siliculosus] |
| SEQ ID NO: 3362 | Nga03844.01 | 2072.273 | 1940.1417 | 10 kda heat shock mitochondrial |
| SEQ ID NO: 3363 | Nga04391.2 | 223.2754 | 293.1976 | protein |
| SEQ ID NO: 3364 | Nga01922 | 531.2661 | 503.26993 | atp-binding sub-family f member 1 |
| SEQ ID NO: 3365 | Nga01924 | 11714.29 | 10956.849 | phosphoribulokinase |
| SEQ ID NO: 3366 | Nga01921 | 376.8977 | 408.98338 | ---NA--- |
| SEQ ID NO: 3367 | Nga01923 | 775.9197 | 947.37684 | protein |
| SEQ ID NO: 3368 | Nga01925 | 68.37607 | 104.92864 | swr1 complex snf2 family dna-dependent atpase |
| SEQ ID NO: 3369 | Nga02321 | 681.1071 | 620.48057 | zinc and ring finger 4 |
| SEQ ID NO: 3370 | Nga02320.01 | 509.7907 | 517.11438 | duf1688 domain-containing protein |
| SEQ ID NO: 3371 | Nga04993.01 | 384.5455 | 226.49437 | tpr domain-containing protein |
| SEQ ID NO: 3372 | Nga05006 | 358.2888 | 366.09832 | protein ddi1 homolog 2 |
| SEQ ID NO: 3373 | Nga01865.1 | 128.6667 | 163.9294 | protein |
| SEQ ID NO: 3374 | Nga04258 | 122.6252 | 134.70267 | ---NA--- |
| SEQ ID NO: 3375 | Nga04255 | 113.4259 | 116.58313 | dna mismatch repair protein |
| SEQ ID NO: 3376 | Nga03309 | 221.3542 | 267.98756 | ---NA--- |
| SEQ ID NO: 3377 | Nga03304 | 1223.118 | 1278.3325 | s-adenosylmethionine synthetase |
| SEQ ID NO: 3378 | Nga03308 | 1223.118 | 1278.3325 | protease subunit of atp-dependent clp protease |
| SEQ ID NO: 3379 | Nga03307 | 1223.118 | 1278.3325 | atp-dependent protease atp-binding subunit |
| SEQ ID NO: 3380 | Nga03305 | 1223.118 | 1278.3325 | rna pseudouridylate synthase family protein |
| SEQ ID NO: 3381 | Nga03303 | 1223.118 | 1278.3325 | carbamoyl-phosphate small subunit |
| SEQ ID NO: 3382 | Nga03306 | 1223.118 | 1278.3325 | thymidylate synthase |
| SEQ ID NO: 3383 | Nga03310 | 221.3542 | 267.98756 | dihydrofolate reductase |
| SEQ ID NO: 3384 | Nga07312.1 | 1236.999 | 1185.7395 | conserved unknown protein [Ectocarpus siliculosus] |
| SEQ ID NO: 3385 | Nga07311 | 1276.129 | 1329.2329 | ---NA--- |
| SEQ ID NO: 3386 | Nga04551 | 2950.104 | 2844.3336 | unknown [Picea sitchensis] |
| SEQ ID NO: 3387 | Nga04552 | 296.5779 | 238.88809 | ---NA--- |
| SEQ ID NO: 3388 | Nga20677 | 7001.497 | 7504.8004 | macrophage migration inhibitory factor |
| SEQ ID NO: 3389 | Nga07064 | 693.7442 | 764.63572 | 30s ribosomal protein s18 |
| SEQ ID NO: 3390 | Nga01991 | 5806.005 | 6485.6443 | ---NA--- |
| SEQ ID NO: 3391 | Nga01992 | 543.1818 | 767.29071 | kua-ubiquitin conjugating enzyme hybrid localisation domain-containing protein |
| SEQ ID NO: 3392 | Nga01996 | 118.8341 | 110.91409 | ethanolamine kinase 1 isoform 1 |
| SEQ ID NO: 3393 | Nga04567 | 1794.793 | 1862.897 | stomatin prohibitin-family membrane protease subunit |
| SEQ ID NO: 3394 | Nga20316 | 537.7778 | 483.0421 | protein |
| SEQ ID NO: 3395 | Nga04566 | 260.0671 | 310.79363 | cytochrome p450 |
| SEQ ID NO: 3396 | Nga01972 | 202.1661 | 172.06604 | ---NA--- |
| SEQ ID NO: 3397 | Nga01976 | 68.37607 | 55.550459 | ---NA--- |
| SEQ ID NO: 3398 | Nga01971.01 | 447.2843 | 422.21898 | nucleolar basal body binding protein bn46 51 large subunit |
| SEQ ID NO: 3399 | Nga20776 | 313.8402 | 425.12885 | riboflavin transporter 2-like |
| SEQ ID NO: 3400 | Nga05741 | 487.9867 | 481.9359 | golgi reassembly stacking protein 2 |
| SEQ ID NO: 3401 | Nga05744 | 8398.503 | 8321.3444 | member ras oncogene family |
| SEQ ID NO: 3402 | Nga05745 | 804.8048 | 722.15596 | mitochondrial import inner membrane translocase subunit tim22 |
| SEQ ID NO: 3403 | Nga05740 | 555.7075 | 693.77321 | protein |
| SEQ ID NO: 3404 | Nga05743 | 691.358 | 675.34956 | ---NA--- |
| SEQ ID NO: 3405 | Nga20306 | 382.3976 | 269.57567 | dyslexia susceptibility 1 candidate 1 |
| SEQ ID NO: 3406 | Nga20190 | 530.1103 | 519.10702 | conserved oligomeric golgi complex subunit 5 |
| SEQ ID NO: 3407 | Nga20769 | 429.3139 | 419.4435 | expressed unknown protein [Ectocarpus siliculosus] |
| SEQ ID NO: 3408 | Nga05747 | 212.1372 | 262.94861 | ---NA--- |
| SEQ ID NO: 3409 | Nga05742 | 2707.911 | 3325.14 | serine threonine-protein kinase ctr1 |
| SEQ ID NO: 3410 | Nga05746 | 1422.93 | 1370.2564 | calciumdependent protein 4 |
| SEQ ID NO: 3411 | Nga20811 | 464.0199 | 587.3117 | ---NA--- |
| SEQ ID NO: 3412 | Nga05739 | 1214.47 | 1431.4363 | ribosomal biogenesis gtpase |
| SEQ ID NO: 3413 | Nga20231.1 | 190.9161 | 226.82035 | tbc1 domain family member 23-like |
| SEQ ID NO: 3414 | Nga04988.01 | 75.51385 | 103.09599 | translation elongation factor g |
| SEQ ID NO: 3415 | Nga04987 | 79.2393 | 104.71834 | conserved unknown protein [Ectocarpus siliculosus] |
| SEQ ID NO: 3416 | Nga00841.01 | 1149.094 | 1359.2105 | inorganic pyrophosphatase |

FIGURE 24 BB

| # | Nga model | +N rpkb | -N rpkb | GO |
|---|---|---|---|---|
| SEQ ID NO: 3417 | Nga00843 | 738.5965 | 613.83257 | 2og-fe oxygenase family family |
| SEQ ID NO: 3418 | Nga00842 | 88.3874 | 109.49473 | like protein |
| SEQ ID NO: 3419 | Nga00844.01 | 102.0408 | 51.582569 | ---NA--- |
| SEQ ID NO: 3420 | Nga06806 | 357.5677 | 509.0412 | loc496093 protein |
| SEQ ID NO: 3421 | Nga04390 | 3.100775 | 1.6794325 | peroxiredoxin |
| SEQ ID NO: 3422 | Nga20465.1 | 166.6667 | 150.99625 | ---NA--- |
| SEQ ID NO: 3423 | Nga04736.2 | 79.41653 | 108.85009 | ---NA--- |
| SEQ ID NO: 3424 | Nga01835 | 211.4014 | 234.1432 | ---NA--- |
| SEQ ID NO: 3425 | Nga04083.1 | 948.0088 | 1692.7527 | sec14p-like phosphatidylinositol transfer family protein |
| SEQ ID NO: 3426 | Nga04086.1 | 245.9517 | 278.99976 | sh2 domain containing protein |
| SEQ ID NO: 3427 | Nga04085 | 279.3427 | 244.10906 | ---NA--- |
| SEQ ID NO: 3428 | Nga04087 | 247.2527 | 329.33486 | protein |
| SEQ ID NO: 3429 | Nga04084.1 | 1391.663 | 1262.367 | pyridoxal kinase |
| SEQ ID NO: 3430 | Nga20766.1 | 244.6853 | 316.07493 | ubiquitin ligase e3 |
| SEQ ID NO: 3431 | Nga20105.1 | 431.4346 | 543.90227 | protein |
| SEQ ID NO: 3432 | Nga01079 | 895.3049 | 827.77078 | rossmann-fold nad -binding domain-containing protein |
| SEQ ID NO: 3433 | Nga20022 | 581.9328 | 516.58425 | 3-hydroxybutyrate dehydrogenase |
| SEQ ID NO: 3434 | Nga01078 | 20.23988 | 25.172603 | kinesin family member 19 |
| SEQ ID NO: 3435 | Nga01077 | 269.2046 | 331.3768 | protein |
| SEQ ID NO: 3436 | Nga01076 | 3688.772 | 3663.2311 | elegans protein confirmed by transcript evidence |
| SEQ ID NO: 3437 | Nga04509 | 103.6585 | 92.47119 | ---NA--- |
| SEQ ID NO: 3438 | Nga04508 | 84.82143 | 48.358658 | ---NA--- |
| SEQ ID NO: 3439 | Nga01591.01 | 93.19899 | 98.227763 | vacuolar membrane protein |
| SEQ ID NO: 3440 | Nga20940 | 702.5365 | 830.11855 | n-acetylglucosaminyltransferase-like protein |
| SEQ ID NO: 3441 | Nga21188 | 552.8846 | 762.08285 | ---NA--- |
| SEQ ID NO: 3442 | Nga01592 | 32.95311 | 37.068842 | sumo-activating enzyme subunit 1 |
| SEQ ID NO: 3443 | Nga01590 | 322.695 | 520.49007 | squalene monooxygenase |
| SEQ ID NO: 3444 | Nga01870 | 192.3688 | 115.38422 | phosphoglycerate mutase |
| SEQ ID NO: 3445 | Nga01868 | 638.914 | 353.8891 | ---NA--- |
| SEQ ID NO: 3446 | Nga01869 | 328 | 407.29596 | glycerol-3-phosphate dehydrogenase |
| SEQ ID NO: 3447 | Nga04536.01 | 8371.486 | 3099.6152 | light-harvesting protein |
| SEQ ID NO: 3448 | Nga04535 | 744.136 | 748.48162 | acyltransferase 3 |
| SEQ ID NO: 3449 | Nga04764 | 636.1502 | 771.74061 | nitroreductase-like protein |
| SEQ ID NO: 3450 | Nga04664 | 814.5161 | 1003.1562 | protein |
| SEQ ID NO: 3451 | Nga01916.02 | 4258.001 | 4114.7956 | dynamin-like protein |
| SEQ ID NO: 3452 | Nga20936.1 | 4845.533 | 5109.6176 | dynamin-like protein |
| SEQ ID NO: 3453 | Nga01918.02 | 520.4678 | 576.45783 | protein |
| SEQ ID NO: 3454 | Nga04665.1 | 487.3418 | 523.33454 | dna-directed rna polymerase i and iii subunit |
| SEQ ID NO: 3455 | Nga20230 | 227.0742 | 304.31463 | ---NA--- |
| SEQ ID NO: 3456 | Nga03457.2 | 132.216 | 183.56478 | protein |
| SEQ ID NO: 3457 | Nga01617 | 1908.297 | 1609.8717 | clathrin assembly protein ap19 |
| SEQ ID NO: 3458 | Nga04170 | 695.6886 | 835.2101 | protein |
| SEQ ID NO: 3459 | Nga07176 | 139.726 | 166.1948 | ---NA--- |
| SEQ ID NO: 3460 | Nga01576 | 683.8235 | 618.61154 | gnat family |
| SEQ ID NO: 3461 | Nga01575.01 | 767.9924 | 915.00443 | tumor protein p53 inducible protein 3 |
| SEQ ID NO: 3462 | Nga01577.01 | 349.4624 | 423.68424 | ---NA--- |
| SEQ ID NO: 3463 | Nga01574.01 | 1614.892 | 1529.24 | kazal-type serine protease inhibitor domain |
| SEQ ID NO: 3464 | Nga01578.01 | 240.8027 | 119.55425 | auxin efflux carrier-like protein |
| SEQ ID NO: 3465 | Nga04278 | 158.3333 | 192.57492 | coproporphyrinogen oxidase |
| SEQ ID NO: 3466 | Nga04275 | 1023.415 | 815.8601 | lipolytic protein g-d-s-l family |
| SEQ ID NO: 3467 | Nga04277 | 113.6364 | 218.83514 | ---NA--- |
| SEQ ID NO: 3468 | Nga04276 | 531.5006 | 475.23322 | expressed unknown protein [Ectocarpus siliculosus] |
| SEQ ID NO: 3469 | Nga04927 | 762.3457 | 746.39499 | protein |
| SEQ ID NO: 3470 | Nga00293.02 | 1144.668 | 1073.5406 | hypoxia-inducible factor alpha subunit |
| SEQ ID NO: 3471 | Nga03786.02 | 991.1003 | 1203.3011 | pas pac sensor hybrid histidine kinase |
| SEQ ID NO: 3472 | Nga04253 | 334.7488 | 411.67489 | chromosome 20 open reading frame 4 |
| SEQ ID NO: 3473 | Nga04251 | 840.3263 | 994.22696 | serine threonine-protein phosphatase 5 |
| SEQ ID NO: 3474 | Nga04478 | 300.3072 | 379.38147 | hypothetical protein NAEGRDRAFT_78553 [Naegleria gruberi] |
| SEQ ID NO: 3475 | Nga05004 | 4582.453 | 4206.2212 | ---NA--- |
| SEQ ID NO: 3476 | Nga05003 | 2337.49 | 2567.7786 | protein |
| SEQ ID NO: 3477 | Nga00161.02 | 760.492 | 1253.322 | had-superfamily subfamily iia hydrolase |
| SEQ ID NO: 3478 | Nga07032 | 289.0947 | 325.97318 | ---NA--- |
| SEQ ID NO: 3479 | Nga04871 | 1281.218 | 1246.4457 | alcohol dehydrogenase zinc-binding domain protein |
| SEQ ID NO: 3480 | Nga04869 | 111.9792 | 93.090417 | ---NA--- |

FIGURE 24 BC

| # | Nga model | +N rpkb | -N rpkb | GO |
|---|---|---|---|---|
| SEQ ID NO: 3481 | Nga04870 | 3139.659 | 3368.6497 | 60s ribosomal protein l26 |
| SEQ ID NO: 3482 | Nga02126 | 105.8394 | 115.52738 | dna replication licensing factor mcm8 |
| SEQ ID NO: 3483 | Nga21077 | 78.21229 | 60.515863 | ---NA--- |
| SEQ ID NO: 3484 | Nga01897.01 | 683.237 | 641.17431 | yip1 domain-containing protein |
| SEQ ID NO: 3485 | Nga06537.02 | 6065.217 | 6723.115 | ribosomal protein l22 |
| SEQ ID NO: 3486 | Nga07303 | 190.4762 | 213.69921 | ---NA--- |
| SEQ ID NO: 3487 | Nga07212 | 160.5996 | 132.21485 | ---NA--- |
| SEQ ID NO: 3488 | Nga04283.2 | 960.6513 | 930.37596 | peptidyl-prolyl cis-trans fkbp-type |
| SEQ ID NO: 3489 | Nga03731 | 554.5809 | 550.06324 | protein |
| SEQ ID NO: 3490 | Nga02818.2 | 566.3377 | 582.59457 | threonine synthase |
| SEQ ID NO: 3491 | Nga07067 | 285.3437 | 236.03541 | tripeptidyl peptidase i |
| SEQ ID NO: 3492 | Nga04515.1 | 179.1725 | 196.74445 | ---NA--- |
| SEQ ID NO: 3493 | Nga04514 | 652.8146 | 594.77301 | uracil-dna glycosylase |
| SEQ ID NO: 3494 | Nga04516 | 373.9837 | 362.83934 | ---NA--- |
| SEQ ID NO: 3495 | Nga20658 | 84.375 | 145.55956 | ---NA--- |
| SEQ ID NO: 3496 | Nga20455 | 96.21993 | 145.17568 | ---NA--- |
| SEQ ID NO: 3497 | Nga06668 | 1501.706 | 1565.6982 | (aldo keto reductase ) |
| SEQ ID NO: 3498 | Nga06672 | 55.01618 | 49.07856 | ---NA--- |
| SEQ ID NO: 3499 | Nga20453.1 | 37.63441 | 34.94303 | wd repeat domain 19 |
| SEQ ID NO: 3500 | Nga20409.1 | 85.06224 | 53.93696 | elegans protein confirmed by transcript evidence |
| SEQ ID NO: 3501 | Nga06671 | 187.0748 | 156.58994 | gdp-mannose transporter |
| SEQ ID NO: 3502 | Nga06673 | 606.7616 | 333.45102 | ---NA--- |
| SEQ ID NO: 3503 | Nga03822.02 | 8692.898 | 8393.5037 | gtp-binding nuclear protein ran |
| SEQ ID NO: 3504 | Nga06670.1 | 496.124 | 501.27408 | mitochondrial phosphate carrier 1 |
| SEQ ID NO: 3505 | Nga04936 | 417.4265 | 396.19803 | conserved unknown protein [Ectocarpus siliculosus] |
| SEQ ID NO: 3506 | Nga04937 | 267.2414 | 339.91134 | ---NA--- |
| SEQ ID NO: 3507 | Nga04906 | 134.0206 | 174.95531 | ---NA--- |
| SEQ ID NO: 3508 | Nga07129 | 1189.989 | 1041.3341 | cyanate hydratase |
| SEQ ID NO: 3509 | Nga04264 | 331.4763 | 274.58019 | peroxisomal membrane protein pmp47b |
| SEQ ID NO: 3510 | Nga04265.1 | 125.0936 | 116.84321 | isoform b |
| SEQ ID NO: 3511 | Nga01687 | 1350.056 | 1463.6338 | fgd6 protein |
| SEQ ID NO: 3512 | Nga01686 | 211.6 | 204.08127 | transposon en spm sub- expressed |
| SEQ ID NO: 3513 | Nga04127.02 | 203.4483 | 291.35258 | growth arrest-specific 7 |
| SEQ ID NO: 3514 | Nga04126.02 | 3030.083 | 2953.0485 | ---NA--- |
| SEQ ID NO: 3515 | Nga02105 | 1335.992 | 1101.5938 | protein |
| SEQ ID NO: 3516 | Nga02106 | 1777.108 | 1977.2282 | ---NA--- |
| SEQ ID NO: 3517 | Nga06855 | 5806.202 | 6511.9994 | ribosomal protein l37a |
| SEQ ID NO: 3518 | Nga01733 | 1046.306 | 949.71992 | flavodoxin |
| SEQ ID NO: 3519 | Nga00787 | 683.0295 | 618.33971 | ---NA--- |
| SEQ ID NO: 3520 | Nga00786 | 171.4719 | 208.75677 | ---NA--- |
| SEQ ID NO: 3521 | Nga00785 | 11.36364 | 12.309477 | ---NA--- |
| SEQ ID NO: 3522 | Nga01410 | 179.7235 | 159.73957 | ---NA--- |
| SEQ ID NO: 3523 | Nga06989.2 | 71.9697 | 53.341065 | dna replication licensing factor mcm5 |
| SEQ ID NO: 3524 | Nga20757 | 78.94737 | 66.514365 | phytoene dehydrogenase |
| SEQ ID NO: 3525 | Nga01409 | 587.3306 | 740.53379 | dna replication licensing factor mcm5 |
| SEQ ID NO: 3526 | Nga06849 | 474.918 | 802.39551 | carbon catabolite repressor protein 4-like 4 |
| SEQ ID NO: 3527 | Nga06848 | 548.2124 | 529.29416 | ---NA--- |
| SEQ ID NO: 3528 | Nga03379.02 | 1003.876 | 948.87934 | conserved hypothetical protein [Phytophthora infestans T30-4] |
| SEQ ID NO: 3529 | Nga06792 | 2909.871 | 2800.2915 | small nuclear ribonucleoprotein sm d3 |
| SEQ ID NO: 3530 | Nga06951 | 65.57377 | 104.5745 | ---NA--- |
| SEQ ID NO: 3531 | Nga06950 | 258.1699 | 350.45804 | aldehyde oxidase |
| SEQ ID NO: 3532 | Nga03771 | 69.44444 | 77.373853 | abc transporter family protein |
| SEQ ID NO: 3533 | Nga03769 | 1673.188 | 2114.1137 | ---NA--- |
| SEQ ID NO: 3534 | Nga04548 | 149.0683 | 198.85454 | snare associated golgi protein |
| SEQ ID NO: 3535 | Nga07175 | 125.9968 | 129.57344 | ---NA--- |
| SEQ ID NO: 3536 | Nga07174 | 182.2289 | 316.48702 | p-type had subfamily ic |
| SEQ ID NO: 3537 | Nga04014 | 201.1785 | 243.45409 | conserved hypothetical protein [Phytophthora infestans T30-4] |
| SEQ ID NO: 3538 | Nga04015 | 225 | 291.87137 | ---NA--- |
| SEQ ID NO: 3539 | Nga04017 | 289.4376 | 265.97925 | ---NA--- |
| SEQ ID NO: 3540 | Nga02339 | 286.6817 | 486.59945 | n-terminal domain-containing protein |
| SEQ ID NO: 3541 | Nga02343 | 146.4646 | 196.95163 | ---NA--- |
| SEQ ID NO: 3542 | Nga02341 | 243.5897 | 254.60627 | ---NA--- |
| SEQ ID NO: 3543 | Nga02340 | 464.4128 | 380.99509 | carboxyl-terminal processing protease |
| SEQ ID NO: 3544 | Nga02338 | 451.9812 | 544.16319 | zinc finger ccch domain-containing protein 63 |

FIGURE 24 BD

| # | Nga model | +N rpkb | -N rpkb | GO |
|---|---|---|---|---|
| SEQ ID NO: 3545 | Nga04345.01 | 633.4215 | 637.85789 | amine oxidase |
| SEQ ID NO: 3546 | Nga20713 | 560.3448 | 513.6023 | ---NA--- |
| SEQ ID NO: 3547 | Nga04099 | 494.5848 | 568.33935 | conserved hypothetical protein [Albugo laibachii Nc14] |
| SEQ ID NO: 3548 | Nga01771.02 | 653.7196 | 566.93284 | protein |
| SEQ ID NO: 3549 | Nga04098.1 | 440.7895 | 793.71829 | phosphoribosylformylglycinamidine cyclo-ligase |
| SEQ ID NO: 3550 | Nga04432 | 125.2556 | 143.98815 | ---NA--- |
| SEQ ID NO: 3551 | Nga04433 | 69.95231 | 111.93991 | heat repeat containing 1 |
| SEQ ID NO: 3552 | Nga04431.1 | 381.5514 | 374.70356 | upf0598 protein c8orf82-like |
| SEQ ID NO: 3553 | Nga04765 | 49.75124 | 72.754518 | ---NA--- |
| SEQ ID NO: 3554 | Nga01549.2 | 559.9022 | 716.85897 | protein |
| SEQ ID NO: 3555 | Nga03984 | 235.6747 | 194.22124 | galactosyl transferase gma12 mnn10 family protein |
| SEQ ID NO: 3556 | Nga03982 | 298.9418 | 424.12334 | hypothetical protein Esi_0162_0021 [Ectocarpus siliculosus] |
| SEQ ID NO: 3557 | Nga03981 | 830.8622 | 854.21413 | monooxygenase fad-binding |
| SEQ ID NO: 3558 | Nga20219 | 120.4453 | 123.89214 | periplasmic protease |
| SEQ ID NO: 3559 | Nga03983 | 1810.987 | 1696.4613 | cell differentiation protein |
| SEQ ID NO: 3560 | Nga04770 | 225.976 | 181.35223 | ---NA--- |
| SEQ ID NO: 3561 | Nga03711 | 180.8279 | 162.83909 | ---NA--- |
| SEQ ID NO: 3562 | Nga20959 | 174.9681 | 175.69695 | intraflagellar transport 140 homolog |
| SEQ ID NO: 3563 | Nga04023 | 676.6382 | 924.29791 | protein |
| SEQ ID NO: 3564 | Nga04024 | 964.8241 | 1172.1426 | ---NA--- |
| SEQ ID NO: 3565 | Nga04022 | 1061.728 | 1346.8782 | ---NA--- |
| SEQ ID NO: 3566 | Nga06820 | 795.8697 | 850.92801 | 3-ketoacyl- thiolase peroxisomal |
| SEQ ID NO: 3567 | Nga04747 | 30.30303 | 32.825271 | ---NA--- |
| SEQ ID NO: 3568 | Nga04750 | 44.55446 | 66.138046 | sulfate transporter |
| SEQ ID NO: 3569 | Nga04748 | 1053.208 | 882.86109 | ---NA--- |
| SEQ ID NO: 3570 | Nga01721 | 258.3587 | 216.20779 | dc12 family protein |
| SEQ ID NO: 3571 | Nga01723 | 387.4346 | 249.5408 | ---NA--- |
| SEQ ID NO: 3572 | Nga01722 | 228.4153 | 317.27508 | hypothetical protein CHLNCDRAFT_135021 [Chlorella variabilis] |
| SEQ ID NO: 3573 | Nga04616 | 2117.958 | 2147.3969 | ---NA--- |
| SEQ ID NO: 3574 | Nga04585 | 641.2078 | 636.8569 | ankyrin unc44 |
| SEQ ID NO: 3575 | Nga06885 | 341.4376 | 301.15278 | ribosome recycling factor |
| SEQ ID NO: 3576 | Nga06886 | 306.7649 | 322.14057 | hypothetical protein HMPREF9446_02801 [Bacteroides fluxus YIT 12057] |
| SEQ ID NO: 3577 | Nga01184 | 191.7808 | 247.31369 | histone demethylase jarid1a |
| SEQ ID NO: 3578 | Nga01186 | 2016.822 | 2289.9768 | ---NA--- |
| SEQ ID NO: 3579 | Nga01187 | 225.1082 | 299.03461 | rna helicase |
| SEQ ID NO: 3580 | Nga01190 | 228.9562 | 317.31095 | atp-dependent chaperone protein |
| SEQ ID NO: 3581 | Nga20704 | 90.90909 | 203.51668 | ---NA--- |
| SEQ ID NO: 3582 | Nga01029.2 | 376.3713 | 480.82789 | pilus assembly protein |
| SEQ ID NO: 3583 | Nga04789 | 721.4171 | 769.25309 | 30s ribosomal protein s16 |
| SEQ ID NO: 3584 | Nga06790 | 167.5774 | 163.76761 | cleavage and polyadenylation specificity factor subunit 3 |
| SEQ ID NO: 3585 | Nga06791 | 692.6606 | 875.15861 | fmu domain-containing protein |
| SEQ ID NO: 3586 | Nga04410 | 3388.502 | 3763.0113 | 60s ribosomal protein |
| SEQ ID NO: 3587 | Nga04412 | 567.9012 | 677.57843 | ---NA--- |
| SEQ ID NO: 3588 | Nga04411 | 824.7214 | 812.15108 | mitochondrial carrier domain-containing protein |
| SEQ ID NO: 3589 | Nga01715 | 289.8551 | 185.02443 | phosphatidylinositol synthase |
| SEQ ID NO: 3590 | Nga05466 | 1365.177 | 1538.8932 | dj-1 family protein |
| SEQ ID NO: 3591 | Nga05478 | 175.5725 | 214.993 | ---NA--- |
| SEQ ID NO: 3592 | Nga05464 | 726.3844 | 838.00671 | farnesyl-protein transferase alpha-subunit |
| SEQ ID NO: 3593 | Nga05467 | 345.9916 | 326.79843 | 9-cis-epoxycarotenoid dioxygenase |
| SEQ ID NO: 3594 | Nga05465 | 635.7724 | 494.94104 | acyl- :lysophosphatidylglycerol acyltransferase 1 |
| SEQ ID NO: 3595 | Nga02421.01 | 1065.574 | 1197.3921 | phosphoglycerate kinase |
| SEQ ID NO: 3596 | Nga06599.2 | 176.8293 | 249.95032 | chromosome region maintenance protein 5 exportin |
| SEQ ID NO: 3597 | Nga02422 | 164.4144 | 224.45388 | ---NA--- |
| SEQ ID NO: 3598 | Nga04699 | 306.2693 | 381.85945 | ---NA--- |
| SEQ ID NO: 3599 | Nga04700 | 335.5978 | 431.23308 | trna splicing endonuclease 34 homolog |
| SEQ ID NO: 3600 | Nga04463.1 | 12506.97 | 12153.356 | 60s ribosomal protein l36 |
| SEQ ID NO: 3601 | Nga03751.02 | 6433.283 | 6577.3575 | 60s ribosomal protein l34 |
| SEQ ID NO: 3602 | Nga02087.01 | 1572.414 | 1402.3344 | conserved unknown protein [Ectocarpus siliculosus] |
| SEQ ID NO: 3603 | Nga03622 | 2187.368 | 2100.3336 | ---NA--- |
| SEQ ID NO: 3604 | Nga06161.2 | 196.2216 | 248.36708 | pescadillo-like protein |
| SEQ ID NO: 3605 | Nga02808.02 | 152.0681 | 125.19127 | cysteine synthase |
| SEQ ID NO: 3606 | Nga02803.02 | 1532.258 | 2007.8153 | x-pro dipeptidyl-peptidase domain-containing protein |
| SEQ ID NO: 3607 | Nga07109 | 97.28507 | 144.59458 | pathogenesis-related transcriptional factor and erf |
| SEQ ID NO: 3608 | Nga06272.2 | 183.6115 | 300.39606 | ---NA--- |

FIGURE 24 BE

| # | Nga model | +N rpkb | -N rpkb | GO |
|---|---|---|---|---|
| SEQ ID NO: 3609 | Nga07110.1 | 99.28571 | 177.95986 | bromodomain-containing protein |
| SEQ ID NO: 3610 | Nga04451.1 | 984.6697 | 1532.1933 | deah (asp-glu-ala-his) box polypeptide 36 |
| SEQ ID NO: 3611 | Nga01641 | 137.2549 | 164.60908 | purple acid |
| SEQ ID NO: 3612 | Nga01639 | 1829.268 | 2223.712 | thioredoxin-like protein 4a |
| SEQ ID NO: 3613 | Nga20688 | 154.4715 | 158.52204 | calcineurin-like phosphoesterase domain-containing protein 1-like |
| SEQ ID NO: 3614 | Nga01640 | 145.5939 | 128.65997 | protein |
| SEQ ID NO: 3615 | Nga01272.02 | 459.9904 | 547.58592 | trehalose-6-phosphate synthase |
| SEQ ID NO: 3616 | Nga05096.2 | 346.4912 | 404.62905 | retinoblastoma binding protein 4 |
| SEQ ID NO: 3617 | Nga01988 | 260.3406 | 303.09466 | ---NA--- |
| SEQ ID NO: 3618 | Nga01989 | 2468.966 | 2614.7026 | ---NA--- |
| SEQ ID NO: 3619 | Nga03556 | 8799.642 | 8762.7619 | ---NA--- |
| SEQ ID NO: 3620 | Nga21202 | 351.1604 | 395.69191 | abc subfamily abcg |
| SEQ ID NO: 3621 | Nga20196 | 403.0227 | 399.05029 | white |
| SEQ ID NO: 3622 | Nga03559 | 1389.234 | 1308.6273 | ---NA--- |
| SEQ ID NO: 3623 | Nga03558 | 1039.095 | 1515.636 | dna polymerase i |
| SEQ ID NO: 3624 | Nga21182 | 73.52941 | 87.61451 | tpr repeat-containing protein |
| SEQ ID NO: 3625 | Nga20302 | 95.2381 | 99.941227 | hypothetical protein AURANDRAFT_39295 [Aureococcus anophagefferens] |
| SEQ ID NO: 3626 | Nga21256 | 68.96552 | 67.23521 | conserved unknown protein [Ectocarpus siliculosus] |
| SEQ ID NO: 3627 | Nga20904 | 97.56098 | 215.13705 | tetratricopeptide repeat family protein |
| SEQ ID NO: 3628 | Nga21301 | 103.2258 | 153.74933 | ---NA--- |
| SEQ ID NO: 3629 | Nga03557 | 672.0779 | 852.28471 | bruno-like protein |
| SEQ ID NO: 3630 | Nga06985.1 | 125.9058 | 156.00924 | dead deah box helicase |
| SEQ ID NO: 3631 | Nga04715 | 1070.451 | 1197.3366 | ---NA--- |
| SEQ ID NO: 3632 | Nga04717 | 324.3243 | 310.65718 | and domain-containing protein |
| SEQ ID NO: 3633 | Nga04718 | 806.3241 | 453.84505 | ---NA--- |
| SEQ ID NO: 3634 | Nga04716 | 526.7118 | 669.17612 | loc495015 protein |
| SEQ ID NO: 3635 | Nga00015.02 | 3272.989 | 2182.0316 | ferredoxin |
| SEQ ID NO: 3636 | Nga20915 | 33.78378 | 117.10637 | ---NA--- |
| SEQ ID NO: 3637 | Nga01719 | 963.964 | 814.86517 | ---NA--- |
| SEQ ID NO: 3638 | Nga01720 | 174.8634 | 278.20762 | ---NA--- |
| SEQ ID NO: 3639 | Nga06889 | 30.81232 | 69.788181 | ---NA--- |
| SEQ ID NO: 3640 | Nga04518 | 482.3151 | 609.53678 | vacuolar protein sorting-associated protein 29 |
| SEQ ID NO: 3641 | Nga04520 | 65.42056 | 70.865772 | protein |
| SEQ ID NO: 3642 | Nga02651.02 | 1413.223 | 1125.0116 | 2c-methyl-d-erythritol -cyclodiphosphate synthase |
| SEQ ID NO: 3643 | Nga04522 | 57.97101 | 73.262199 | ---NA--- |
| SEQ ID NO: 3644 | Nga01343.01 | 695.6522 | 897.88395 | ---NA--- |
| SEQ ID NO: 3645 | Nga01344 | 833.1893 | 912.83759 | carboxyl-terminal protease |
| SEQ ID NO: 3646 | Nga05025 | 2699.13 | 2812.6405 | copper chaperone |
| SEQ ID NO: 3647 | Nga01308.2 | 383.8764 | 369.2226 | methionyl-trna synthetase |
| SEQ ID NO: 3648 | Nga04503 | 915.2047 | 1067.3972 | protein |
| SEQ ID NO: 3649 | Nga20880 | 248.7437 | 348.37674 | ---NA--- |
| SEQ ID NO: 3650 | Nga03670 | 11666.67 | 13470.616 | ---NA--- |
| SEQ ID NO: 3651 | Nga03669 | 572.2071 | 649.35005 | uv-damaged dna-binding |
| SEQ ID NO: 3652 | Nga02262 | 2375.631 | 2214.3381 | riboflavin kinase |
| SEQ ID NO: 3653 | Nga04371 | 22211.21 | 17915.683 | protein |
| SEQ ID NO: 3654 | Nga04372 | 314.4208 | 261.20535 | phosphoribosylformimino-5-aminoimidazole carboxamide ribotide isomerase |
| SEQ ID NO: 3655 | Nga04373 | 918.5004 | 808.67342 | protein |
| SEQ ID NO: 3656 | Nga04012.01 | 785.3695 | 857.9792 | t-complex protein 1 subunit alpha |
| SEQ ID NO: 3657 | Nga03868 | 5450.746 | 4067.786 | predicted protein [Thalassiosira pseudonana CCMP1335] |
| SEQ ID NO: 3658 | Nga03867 | 4748.598 | 4730.7965 | ---NA--- |
| SEQ ID NO: 3659 | Nga03869 | 99.35897 | 135.40424 | nicotinamide n-methyltransferase |
| SEQ ID NO: 3660 | Nga01643 | 275 | 352.05103 | ---NA--- |
| SEQ ID NO: 3661 | Nga01644 | 275 | 352.05103 | ---NA--- |
| SEQ ID NO: 3662 | Nga20626 | 304.2071 | 371.59481 | ribosomal rna large subunit methyltransferase n |
| SEQ ID NO: 3663 | Nga07015 | 274.5098 | 491.17225 | from coli sequence gb |
| SEQ ID NO: 3664 | Nga20526 | 117.6471 | 164.92143 | ---NA--- |
| SEQ ID NO: 3665 | Nga02263.01 | 11320.72 | 10950.608 | fructose-bisphosphate aldolase |
| SEQ ID NO: 3666 | Nga02264.01 | 153.2385 | 168.5601 | cyclopropane-fatty-acyl-phospholipid synthase |
| SEQ ID NO: 3667 | Nga02265 | 225.1244 | 245.20967 | lysocardiolipin and lysophospholipid acyltransferase |
| SEQ ID NO: 3668 | Nga20791 | 198.9967 | 271.7142 | amp-dependent synthetase and ligase |
| SEQ ID NO: 3669 | Nga04476 | 571.6599 | 497.32279 | ---NA--- |
| SEQ ID NO: 3670 | Nga04781 | 506.3841 | 568.8376 | transcription elongation factor spt6 |

FIGURE 24 BF

| # | Nga model | +N rpkb | -N rpkb | GO |
|---|---|---|---|---|
| SEQ ID NO: 3671 | Nga07149 | 391.1765 | 328.15616 | ---NA--- |
| SEQ ID NO: 3672 | Nga06235.02 | 963.3508 | 921.59956 | signal peptidase |
| SEQ ID NO: 3673 | Nga06999 | 127.3408 | 159.57753 | ---NA--- |
| SEQ ID NO: 3674 | Nga00443.2 | 195.2645 | 257.81767 | serine threonine protein |
| SEQ ID NO: 3675 | Nga04305 | 231.405 | 190.98339 | pseudouridine synthase |
| SEQ ID NO: 3676 | Nga04307 | 131.2336 | 180.53899 | ---NA--- |
| SEQ ID NO: 3677 | Nga01743 | 1891.407 | 1745.0398 | ---NA--- |
| SEQ ID NO: 3678 | Nga06826 | 116.0221 | 89.770769 | ---NA--- |
| SEQ ID NO: 3679 | Nga21196.1 | 181.1927 | 168.94474 | yth domain containing 2 |
| SEQ ID NO: 3680 | Nga01453.1 | 470.6239 | 390.38413 | dnaj domain |
| SEQ ID NO: 3681 | Nga01455.01 | 100.6711 | 87.240317 | ---NA--- |
| SEQ ID NO: 3682 | Nga01456.01 | 131.9444 | 90.269495 | ---NA--- |
| SEQ ID NO: 3683 | Nga01450.01 | 127.0627 | 184.11402 | ---NA--- |
| SEQ ID NO: 3684 | Nga01454.1 | 106.3566 | 85.986942 | phosphopantothenate--cysteine ligase |
| SEQ ID NO: 3685 | Nga01448.01 | 1506.52 | 2076.0676 | phosphoserine aminotransferase |
| SEQ ID NO: 3686 | Nga01452.01 | 175.9259 | 164.12635 | snf2 family dna-dependent atpase |
| SEQ ID NO: 3687 | Nga01451.01 | 769.6314 | 823.70914 | protein |
| SEQ ID NO: 3688 | Nga20182 | 233.0559 | 264.04632 | major intrinsic protein |
| SEQ ID NO: 3689 | Nga04330 | 1133.706 | 1708.8332 | ---NA--- |
| SEQ ID NO: 3690 | Nga04332 | 683.4925 | 1114.2679 | ---NA--- |
| SEQ ID NO: 3691 | Nga04331 | 267.4897 | 213.97214 | signal recognition particle 14kda (homologous alu rna binding protein) |
| SEQ ID NO: 3692 | Nga04784 | 602.108 | 558.02961 | protein |
| SEQ ID NO: 3693 | Nga04990 | 183.0065 | 173.45903 | histone arginine |
| SEQ ID NO: 3694 | Nga00731 | 309.2269 | 270.13315 | ---NA--- |
| SEQ ID NO: 3695 | Nga00732 | 5.733006 | 10.646034 | ---NA--- |
| SEQ ID NO: 3696 | Nga00733 | 3797.364 | 4109.8645 | ---NA--- |
| SEQ ID NO: 3697 | Nga00734 | 338.5417 | 372.36167 | surfeit locus 1 |
| SEQ ID NO: 3698 | Nga04110 | 170 | 191.37133 | ---NA--- |
| SEQ ID NO: 3699 | Nga04109 | 1478.605 | 1471.2068 | cysteine-rich pdz-binding protein |
| SEQ ID NO: 3700 | Nga20566 | 162.6374 | 180.93578 | ---NA--- |
| SEQ ID NO: 3701 | Nga20679 | 310 | 308.72167 | ataxin 3 variant ref |
| SEQ ID NO: 3702 | Nga03832 | 427.5742 | 321.37831 | sulfotransferase |
| SEQ ID NO: 3703 | Nga07304 | 213.5417 | 239.77835 | acetyl-coenzyme a transporter 1 |
| SEQ ID NO: 3704 | Nga06607 | 818.9781 | 708.45081 | hepatocyte growth factor-regulated tyrosine kinase substrate |
| SEQ ID NO: 3705 | Nga06606 | 417.2235 | 482.50955 | ---NA--- |
| SEQ ID NO: 3706 | Nga21264 | 459.8436 | 478.87101 | sec24-like transport protein |
| SEQ ID NO: 3707 | Nga03528 | 120.2186 | 100.62829 | ---NA--- |
| SEQ ID NO: 3708 | Nga20899 | 212.1212 | 339.19447 | elmo domain-containing protein 2 |
| SEQ ID NO: 3709 | Nga06881 | 448.6934 | 515.72706 | serine hydroxymethyltransferase |
| SEQ ID NO: 3710 | Nga02257 | 149.5972 | 137.11822 | ---NA--- |
| SEQ ID NO: 3711 | Nga20250 | 201.3058 | 238.0993 | protein |
| SEQ ID NO: 3712 | Nga20707 | 195.5307 | 233.99467 | trna (adenine-n -)-methyltransferase non-catalytic subunit trm6 |
| SEQ ID NO: 3713 | Nga21121 | 348.3309 | 484.2323 | conserved unknown protein [Ectocarpus siliculosus] |
| SEQ ID NO: 3714 | Nga01949 | 165.9919 | 170.15983 | ---NA--- |
| SEQ ID NO: 3715 | Nga01947 | 149.8258 | 230.23439 | ---NA--- |
| SEQ ID NO: 3716 | Nga01948 | 45.19774 | 116.27935 | ---NA--- |
| SEQ ID NO: 3717 | Nga02404 | 6454.039 | 5838.6008 | er lumen protein retaining receptor |
| SEQ ID NO: 3718 | Nga02405 | 112.7098 | 127.28648 | ---NA--- |
| SEQ ID NO: 3719 | Nga20310 | 544.9309 | 516.65766 | protein |
| SEQ ID NO: 3720 | Nga02354 | 413.7267 | 405.08364 | arsenical-resistance protein |
| SEQ ID NO: 3721 | Nga04610.2 | 184.9837 | 172.09157 | pectinacetylesterase family protein |
| SEQ ID NO: 3722 | Nga04713 | 436.4929 | 440.48091 | splicing factor 3a |
| SEQ ID NO: 3723 | Nga04879 | 828.9624 | 973.30484 | protein |
| SEQ ID NO: 3724 | Nga05028 | 474.1784 | 520.42695 | ---NA--- |
| SEQ ID NO: 3725 | Nga05026 | 115.7025 | 205.90397 | ---NA--- |
| SEQ ID NO: 3726 | Nga04919.1 | 1002.747 | 818.37729 | protein nef1 |
| SEQ ID NO: 3727 | Nga00476.02 | 472.374 | 546.54973 | 4-hydroxyphenylpyruvate dioxygenase |
| SEQ ID NO: 3728 | Nga00482.02 | 3534.884 | 2768.9643 | beta-hydroxyacyl-acp dehydratase precursor |
| SEQ ID NO: 3729 | Nga00477.02 | 134.8601 | 100.80258 | conserved hypothetical protein [Phytophthora infestans T30-4] |
| SEQ ID NO: 3730 | Nga00737 | 4459.658 | 4097.2198 | wos2 protein |
| SEQ ID NO: 3731 | Nga00740 | 1663.889 | 1366.0784 | ---NA--- |
| SEQ ID NO: 3732 | Nga00739 | 417.1322 | 399.40469 | dna-directed rna polymerase ii |
| SEQ ID NO: 3733 | Nga00738 | 312.2677 | 246.64713 | hypothetical protein Esi_0097_0005 [Ectocarpus siliculosus] |

FIGURE 24 BG

| # | Nga model | +N rpkb | -N rpkb | GO |
|---|---|---|---|---|
| SEQ ID NO: 3734 | Nga04961.02 | 314.1487 | 311.722 | glutathione s-transferase |
| SEQ ID NO: 3735 | Nga07199 | 7737.634 | 8206.9531 | 40s ribosomal protein s12 |
| SEQ ID NO: 3736 | Nga07200 | 2886.71 | 2230.1875 | conserved unknown protein [Ectocarpus siliculosus] |
| SEQ ID NO: 3737 | Nga07198 | 1092.063 | 1145.133 | queuosine biosynthesis protein |
| SEQ ID NO: 3738 | Nga03618 | 81.87135 | 107.68992 | ---NA--- |
| SEQ ID NO: 3739 | Nga03617 | 108.3845 | 106.32971 | ---NA--- |
| SEQ ID NO: 3740 | Nga03616 | 164.3836 | 201.80797 | ---NA--- |
| SEQ ID NO: 3741 | Nga03619 | 66.66667 | 165.06422 | ---NA--- |
| SEQ ID NO: 3742 | Nga21208 | 160.7143 | 162.80748 | duf51 family protein |
| SEQ ID NO: 3743 | Nga05311 | 633.0409 | 658.01711 | conserved oligomeric golgi complex |
| SEQ ID NO: 3744 | Nga05313 | 287.1972 | 172.41786 | ---NA--- |
| SEQ ID NO: 3745 | Nga05312 | 47.00855 | 37.033639 | ---NA--- |
| SEQ ID NO: 3746 | Nga05314 | 25.42373 | 27.539846 | ---NA--- |
| SEQ ID NO: 3747 | Nga04837 | 13.33333 | 0 | ---NA--- |
| SEQ ID NO: 3748 | Nga07315 | 152.5424 | 142.2892 | ---NA--- |
| SEQ ID NO: 3749 | Nga04292.01 | 3421.419 | 3302.4323 | conserved unknown protein [Ectocarpus siliculosus] |
| SEQ ID NO: 3750 | Nga02736.02 | 3124.7 | 3021.1057 | conserved unknown protein [Ectocarpus siliculosus] |
| SEQ ID NO: 3751 | Nga04982.1 | 877.3449 | 673.69961 | isoform a |
| SEQ ID NO: 3752 | Nga01259 | 355.5957 | 329.46736 | leucine rich repeat containing 5G |
| SEQ ID NO: 3753 | Nga01258 | 270.2703 | 304.96451 | ---NA--- |
| SEQ ID NO: 3754 | Nga06396 | 288.8889 | 312.93425 | ---NA--- |
| SEQ ID NO: 3755 | Nga01849.2 | 165.4275 | 245.64041 | ---NA--- |
| SEQ ID NO: 3756 | Nga06397 | 260.355 | 335.43931 | ---NA--- |
| SEQ ID NO: 3757 | Nga06395 | 142.1801 | 193.37352 | set domain protein |
| SEQ ID NO: 3758 | Nga20708 | 320.8469 | 317.56044 | protein |
| SEQ ID NO: 3759 | Nga04885 | 113.7629 | 133.573 | potassium subfamily member 2 |
| SEQ ID NO: 3760 | Nga04884 | 161.2903 | 204.78241 | trna pseudouridine synthase 3 |
| SEQ ID NO: 3761 | Nga01798.01 | 636.5233 | 572.52575 | ---NA--- |
| SEQ ID NO: 3762 | Nga01797.01 | 530.6824 | 593.46543 | serine threonine-protein kinase 4 |
| SEQ ID NO: 3763 | Nga01799.01 | 279.3522 | 276.29044 | nuclear receptor 2c2-associated protein |
| SEQ ID NO: 3764 | Nga02089.01 | 2821.918 | 2368.0285 | rhamnose biosynthetic enzyme expressed |
| SEQ ID NO: 3765 | Nga02093.01 | 595.3109 | 560.94072 | short-chain dehydrogenase |
| SEQ ID NO: 3766 | Nga02090.1 | 59.20206 | 83.647409 | nudix hydrolase 3 |
| SEQ ID NO: 3767 | Nga02091.01 | 212.4183 | 166.37907 | ---NA--- |
| SEQ ID NO: 3768 | Nga02152 | 351.4493 | 392.47607 | ---NA--- |
| SEQ ID NO: 3769 | Nga02149 | 1727.941 | 1667.3307 | ubiquitin conjugating enzyme |
| SEQ ID NO: 3770 | Nga21147 | 3329.71 | 3116.26 | ubiquitin conjugating enzyme |
| SEQ ID NO: 3771 | Nga02025.01 | 940.1709 | 742.98738 | signal peptidase complex subunit 1 |
| SEQ ID NO: 3772 | Nga02024.1 | 257.9473 | 334.51366 | histone acetyltransferase |
| SEQ ID NO: 3773 | Nga04852 | 669.3548 | 816.79333 | ---NA--- |
| SEQ ID NO: 3774 | Nga20198 | 204.8847 | 216.79377 | protein with ppr repeats |
| SEQ ID NO: 3775 | Nga04851 | 1563.241 | 1352.972 | lipolytic protein g-d-s-l family |
| SEQ ID NO: 3776 | Nga04853 | 129.771 | 186.05163 | ---NA--- |
| SEQ ID NO: 3777 | Nga02108.1 | 580.3595 | 681.99438 | swi snf-related matrix-associated actin-dependent regulator of chromatin a1 isoform a isoform 19 |
| SEQ ID NO: 3778 | Nga02109.01 | 1408.063 | 1229.1563 | gualynate kinase-1 |
| SEQ ID NO: 3779 | Nga02110.01 | 210.356 | 183.1682 | phosphoinositol transporter |
| SEQ ID NO: 3780 | Nga02578.2 | 520.9165 | 520.55346 | protein |
| SEQ ID NO: 3781 | Nga03653 | 3556.531 | 3903.8495 | heat shock protein 90 |
| SEQ ID NO: 3782 | Nga03652 | 547.5305 | 626.46934 | threonine dehydratase |
| SEQ ID NO: 3783 | Nga03650 | 1789.264 | 1493.4846 | ---NA--- |
| SEQ ID NO: 3784 | Nga03655 | 290.0543 | 298.93727 | tetratricopeptide repeat domain-containing protein |
| SEQ ID NO: 3785 | Nga03654 | 2394.02 | 2737.9548 | cug-bp- and etr-3-like |
| SEQ ID NO: 3786 | Nga03651 | 879.7386 | 875.7911 | histidinol dehydrogenase |
| SEQ ID NO: 3787 | Nga01247 | 710.4762 | 528.2055 | hypothetical protein AURANDRAFT_64930 [Aureococcus anophagefferens] |
| SEQ ID NO: 3788 | Nga01248 | 84.88613 | 58.31073 | cl- voltage gated |
| SEQ ID NO: 3789 | Nga01249 | 74.95069 | 117.51059 | cl- voltage gated |
| SEQ ID NO: 3790 | Nga01252 | 125 | 111.50938 | ---NA--- |
| SEQ ID NO: 3791 | Nga01250.01 | 11149.22 | 11737.134 | ---NA--- |
| SEQ ID NO: 3792 | Nga01251 | 2889.744 | 3635.7775 | ferredoxin component |
| SEQ ID NO: 3793 | Nga03790 | 585.5199 | 560.56567 | sac3 ganp domain protein |
| SEQ ID NO: 3794 | Nga03791 | 121.1454 | 136.00074 | conserved unknown protein [Ectocarpus siliculosus] |
| SEQ ID NO: 3795 | Nga03792 | 347.0052 | 299.0177 | glucosaminyl (n-acetyl) transferase i-branching enzyme |

FIGURE 24 BH

| # | Nga model | +N rpkb | -N rpkb | GO |
|---|---|---|---|---|
| SEQ ID NO: 3796 | Nga06966 | 276.9231 | 183.31651 | gtp-binding protein 128up |
| SEQ ID NO: 3797 | Nga06965 | 228.9973 | 256.86442 | developmentally regulated gtp binding protein 1 |
| SEQ ID NO: 3798 | Nga02375 | 300.4484 | 497.89901 | protein |
| SEQ ID NO: 3799 | Nga20666 | 19.37984 | 25.191487 | ---NA--- |
| SEQ ID NO: 3800 | Nga00986 | 844.8637 | 1179.37 | acetylornithine aminotransferase |
| SEQ ID NO: 3801 | Nga00987 | 144.7964 | 200.96195 | ---NA--- |
| SEQ ID NO: 3802 | Nga03961 | 12.39157 | 32.215136 | hypothetical protein RTM1035_12233 [Roseovarius sp. TM1035] |
| SEQ ID NO: 3803 | Nga06375.2 | 985.9296 | 1047.8519 | prolyl 4-hydroxylase |
| SEQ ID NO: 3804 | Nga02345.01 | 1162.684 | 1729.2092 | glutamate dehydrogenase |
| SEQ ID NO: 3805 | Nga02350 | 223.5772 | 281.81696 | conserved unknown protein [Ectocarpus siliculosus] |
| SEQ ID NO: 3806 | Nga02351 | 620.8651 | 686.32379 | fk506 binding protein 12-rapamycin associated protein 1 |
| SEQ ID NO: 3807 | Nga02347 | 456.4498 | 603.12364 | conserved unknown protein [Ectocarpus siliculosus] |
| SEQ ID NO: 3808 | Nga02344 | 258.7621 | 338.19086 | protein atypical group |
| SEQ ID NO: 3809 | Nga02349 | 120.108 | 198.08124 | protein atypical group |
| SEQ ID NO: 3810 | Nga03801 | 166.6667 | 159.39478 | ---NA--- |
| SEQ ID NO: 3811 | Nga03802 | 179.4872 | 175.90979 | ---NA--- |
| SEQ ID NO: 3812 | Nga02332 | 186.9984 | 204.30175 | pirin |
| SEQ ID NO: 3813 | Nga07099 | 221.519 | 169.11247 | ---NA--- |
| SEQ ID NO: 3814 | Nga03596 | 2224.111 | 1833.2939 | glutaredoxin-related protein |
| SEQ ID NO: 3815 | Nga20234 | 117.8121 | 112.4254 | ubiquinone menaquinone biosynthesis methyltransferase |
| SEQ ID NO: 3816 | Nga03595 | 55.7971 | 59.656362 | queuine trna-ribosyltransferase |
| SEQ ID NO: 3817 | Nga06982 | 2052.863 | 1911.1683 | ubiquitin-protein ligase e3 rbbp6 family involved in mrna cleavage |
| SEQ ID NO: 3818 | Nga04217 | 220.202 | 301.99249 | v-myb myeloblastosis viral oncogene homologue |
| SEQ ID NO: 3819 | Nga04218 | 286.0082 | 286.41062 | type ii alternative rna polymerase sigma sigma-70 family protein |
| SEQ ID NO: 3820 | Nga04106 | 124.1237 | 165.57473 | nxn protein |
| SEQ ID NO: 3821 | Nga20174 | 359.3482 | 327.01402 | nxn protein |
| SEQ ID NO: 3822 | Nga04107 | 377.3585 | 483.70824 | protein |
| SEQ ID NO: 3823 | Nga04102 | 555.2354 | 613.93662 | nxn protein |
| SEQ ID NO: 3824 | Nga04101 | 1836.299 | 1703.8769 | enhancer of rudimentary homolog |
| SEQ ID NO: 3825 | Nga04594 | 941.954 | 934.44491 | acyltransferase family protein |
| SEQ ID NO: 3826 | Nga03891 | 44.32624 | 78.74573 | 3-isopropylmalate dehydrogenase |
| SEQ ID NO: 3827 | Nga04199.02 | 844.1128 | 731.138 | protein |
| SEQ ID NO: 3828 | Nga20123.1 | 500.4739 | 556.50502 | predicted protein [Thalassiosira pseudonana CCMP1335] |
| SEQ ID NO: 3829 | Nga04200.02 | 2435.262 | 2111.2617 | glycine cleavage system h protein |
| SEQ ID NO: 3830 | Nga03739.02 | 7230.616 | 8437.329 | malate synthase |
| SEQ ID NO: 3831 | Nga07288 | 78.53403 | 116.26333 | ---NA--- |
| SEQ ID NO: 3832 | Nga07101 | 1471.218 | 4118.3191 | ---NA--- |
| SEQ ID NO: 3833 | Nga03906 | 477.305 | 371.06524 | aldo keto reductase |
| SEQ ID NO: 3834 | Nga03907 | 524.1302 | 560.46111 | nad-dependent deacetylase sirtuin-5 |
| SEQ ID NO: 3835 | Nga03905 | 120.9068 | 73.670822 | mad2 mitotic arrest deficient-like 2 |
| SEQ ID NO: 3836 | Nga03904 | 4352.507 | 4118.8453 | ribosomal protein l35 |
| SEQ ID NO: 3837 | Nga02053.2 | 2867.55 | 3311.3959 | ---NA--- |
| SEQ ID NO: 3838 | Nga03603.1 | 1104.2 | 1236.3567 | lipase family protein |
| SEQ ID NO: 3839 | Nga02055.02 | 56.06061 | 65.650542 | cathepsin l-like proteinase |
| SEQ ID NO: 3840 | Nga02052.02 | 8390.187 | 12092.738 | ---NA--- |
| SEQ ID NO: 3841 | Nga06957 | 244.2159 | 144.80248 | ---NA--- |
| SEQ ID NO: 3842 | Nga06958 | 160.3053 | 128.1689 | ---NA--- |
| SEQ ID NO: 3843 | Nga00906 | 213.2616 | 174.71515 | ---NA--- |
| SEQ ID NO: 3844 | Nga00904 | 1502.256 | 983.86962 | ---NA--- |
| SEQ ID NO: 3845 | Nga00905 | 308.1444 | 377.44927 | type iii restriction res subunit |
| SEQ ID NO: 3846 | Nga04631 | 3986.096 | 4091.9597 | nadh ubiquinone oxidoreductase |
| SEQ ID NO: 3847 | Nga04632 | 190.0726 | 150.81344 | ---NA--- |
| SEQ ID NO: 3848 | Nga07118 | 558.6854 | 628.91986 | ---NA--- |
| SEQ ID NO: 3849 | Nga03586 | 156.669 | 240.03914 | alpha beta hydrolase fold protein |
| SEQ ID NO: 3850 | Nga03585 | 1.491424 | 0.4038904 | kinesin-like protein kif6 |
| SEQ ID NO: 3851 | Nga04668 | 147.001 | 131.54316 | major facilitator superfamily |
| SEQ ID NO: 3852 | Nga04667 | 95.89041 | 123.65684 | ankyrin unc44 |
| SEQ ID NO: 3853 | Nga03794 | 2080.334 | 1635.2934 | zinc metalloendopeptidase |
| SEQ ID NO: 3854 | Nga03797 | 452.6316 | 543.51738 | probable e3 ubiquitin-protein ligase herc3 |
| SEQ ID NO: 3855 | Nga03798 | 119.3416 | 209.51438 | ---NA--- |
| SEQ ID NO: 3856 | Nga03796 | 988.806 | 957.93449 | protein |
| SEQ ID NO: 3857 | Nga03795 | 365.9976 | 532.02517 | ---NA--- |
| SEQ ID NO: 3858 | Nga01817 | 101.1058 | 77.007152 | amp-dependent synthetase and ligase |
| SEQ ID NO: 3859 | Nga03918.2 | 275.0166 | 319.44275 | structural maintenance of chromosomes 1 |

FIGURE 24 BI

| # | Nga model | +N rpkb | -N rpkb | GO |
|---|---|---|---|---|
| SEQ ID NO: 3860 | Nga03915.2 | 268.4073 | 229.09125 | 2 protease |
| SEQ ID NO: 3861 | Nga01386 | 301.0753 | 170.05608 | ---NA--- |
| SEQ ID NO: 3862 | Nga01390 | 108.046 | 57.274438 | ---NA--- |
| SEQ ID NO: 3863 | Nga01389 | 2416.268 | 2285.6754 | cyclin-dependent kinases regulatory subunit |
| SEQ ID NO: 3864 | Nga01391 | 249.3113 | 167.11047 | manganese-dependent inorganic pyrophosphatase |
| SEQ ID NO: 3865 | Nga04544 | 135.2941 | 143.3692 | ---NA--- |
| SEQ ID NO: 3866 | Nga02153 | 5733.068 | 5998.7856 | protein |
| SEQ ID NO: 3867 | Nga02154 | 1238.028 | 1058.823 | n-methyl-d-aspartate receptor nmdar2c subunit |
| SEQ ID NO: 3868 | Nga02156 | 1468.072 | 1981.0868 | ornithine decarboxylase |
| SEQ ID NO: 3869 | Nga02155 | 352.4306 | 372.36167 | usp37 protein |
| SEQ ID NO: 3870 | Nga01384 | 240.2235 | 401.42189 | ---NA--- |
| SEQ ID NO: 3871 | Nga20829 | 466.0033 | 499.40139 | proteasome component c11 |
| SEQ ID NO: 3872 | Nga01357.2 | 879.9571 | 986.86908 | ---NA--- |
| SEQ ID NO: 3873 | Nga05131.2 | 333.6481 | 322.89032 | calcium-transporting atpase type 2c member 1-like |
| SEQ ID NO: 3874 | Nga01085 | 797.1888 | 787.41102 | mediator of rna polymerase ii transcription |
| SEQ ID NO: 3875 | Nga01087.1 | 793.6937 | 779.73326 | trna specific adenosine deaminase |
| SEQ ID NO: 3876 | Nga01088.01 | 700.4539 | 686.64905 | protein |
| SEQ ID NO: 3877 | Nga05122.2 | 256.9061 | 266.31995 | ---NA--- |
| SEQ ID NO: 3878 | Nga01811 | 500 | 463.38341 | phenylalanyl-trna synthetase alpha chain |
| SEQ ID NO: 3879 | Nga01809 | 405.0926 | 529.07954 | conserved unknown protein [Ectocarpus siliculosus] |
| SEQ ID NO: 3880 | Nga01808 | 397.0856 | 463.67937 | phenylalanyl-trna synthetase alpha chain |
| SEQ ID NO: 3881 | Nga20564 | 235.4839 | 297.01576 | hect e3 ubiquitin |
| SEQ ID NO: 3882 | Nga20496 | 328.2675 | 352.29797 | ---NA--- |
| SEQ ID NO: 3883 | Nga03827 | 2344.978 | 2206.6753 | protein |
| SEQ ID NO: 3884 | Nga03828 | 783.4586 | 618.99082 | thioredoxin-like protein 1 |
| SEQ ID NO: 3885 | Nga03193 | 306.8783 | 171.9419 | ---NA--- |
| SEQ ID NO: 3886 | Nga03195 | 140.1869 | 161.97891 | ---NA--- |
| SEQ ID NO: 3887 | Nga03191 | 227.0742 | 222.32312 | ---NA--- |
| SEQ ID NO: 3888 | Nga20910 | 673.9812 | 631.60349 | dna mismatch repair protein msh2 |
| SEQ ID NO: 3889 | Nga04975.2 | 82.99595 | 157.88025 | ---NA--- |
| SEQ ID NO: 3890 | Nga03190 | 145.0382 | 190.18611 | ---NA--- |
| SEQ ID NO: 3891 | Nga03194 | 11947.44 | 12371.041 | ---NA--- |
| SEQ ID NO: 3892 | Nga03196 | 250 | 488.51727 | ---NA--- |
| SEQ ID NO: 3893 | Nga01557 | 805.5556 | 816.43743 | protein |
| SEQ ID NO: 3894 | Nga01559 | 241.6049 | 236.20452 | protein |
| SEQ ID NO: 3895 | Nga01558 | 978.3514 | 883.00252 | chromate transporter |
| SEQ ID NO: 3896 | Nga02003 | 427.673 | 484.68149 | zinc finger cchc domain-containing protein 7-like |
| SEQ ID NO: 3897 | Nga02004 | 206.4018 | 235.53762 | polyol transporter |
| SEQ ID NO: 3898 | Nga20703 | 133.3333 | 132.39526 | polyol monosaccharide transporter |
| SEQ ID NO: 3899 | Nga04147 | 72.89294 | 103.63514 | atp-dependent rna |
| SEQ ID NO: 3900 | Nga04146 | 25.80645 | 81.533737 | atp-dependent rna |
| SEQ ID NO: 3901 | Nga04148 | 1669.749 | 1317.9108 | ---NA--- |
| SEQ ID NO: 3902 | Nga04145 | 329.2469 | 356.65146 | tpr repeat protein |
| SEQ ID NO: 3903 | Nga01141 | 75.41899 | 66.567449 | ---NA--- |
| SEQ ID NO: 3904 | Nga01145 | 2108.824 | 2153.724 | ---NA--- |
| SEQ ID NO: 3905 | Nga01140 | 559.633 | 493.34704 | ---NA--- |
| SEQ ID NO: 3906 | Nga01142 | 406.1224 | 386.86926 | ---NA--- |
| SEQ ID NO: 3907 | Nga01146 | 193.8776 | 165.80111 | ---NA--- |
| SEQ ID NO: 3908 | Nga01144 | 209.8139 | 238.27481 | tpr repeat-containing protein |
| SEQ ID NO: 3909 | Nga01143 | 172.3164 | 192.77892 | aspartyl glutamyl-trna amidotransferase subunit b |
| SEQ ID NO: 3910 | Nga01566 | 200.4831 | 273.42499 | ---NA--- |
| SEQ ID NO: 3911 | Nga01567 | 271.1443 | 350.29953 | molybdopterin biosynthesis |
| SEQ ID NO: 3912 | Nga01568 | 332.618 | 246.40085 | ---NA--- |
| SEQ ID NO: 3913 | Nga20402 | 227.9412 | 151.33415 | c2h2 zinc finger protein |
| SEQ ID NO: 3914 | Nga01569 | 169.8113 | 183.94539 | ---NA--- |
| SEQ ID NO: 3915 | Nga01564 | 558.802 | 640.92001 | ---NA--- |
| SEQ ID NO: 3916 | Nga01565 | 409.4551 | 301.18764 | cop9 signalosome complex subunit 2 |
| SEQ ID NO: 3917 | Nga04054 | 202.381 | 219.22592 | 39s ribosomal protein mitochondrial-like |
| SEQ ID NO: 3918 | Nga04053 | 356.9068 | 390.90927 | morn repeat protein |
| SEQ ID NO: 3919 | Nga04038 | 903.8462 | 1229.0539 | ---NA--- |
| SEQ ID NO: 3920 | Nga02490.2 | 186.1925 | 169.96348 | ---NA--- |
| SEQ ID NO: 3921 | Nga02489.02 | 709.0239 | 658.31897 | ---NA--- |
| SEQ ID NO: 3922 | Nga06750 | 610.2004 | 580.09249 | signal recognition particle 19 kda |
| SEQ ID NO: 3923 | Nga06751.1 | 215.6057 | 248.62727 | nucleolar protein |

FIGURE 24 BJ

| # | Nga model | +N rpkb | -N rpkb | GO |
|---|---|---|---|---|
| SEQ ID NO: 3924 | Nga06753 | 118.608 | 117.70937 | ---NA--- |
| SEQ ID NO: 3925 | Nga06748 | 1096.591 | 900.64337 | major facilitator superfamily mfs_1 |
| SEQ ID NO: 3926 | Nga07243 | 1.754386 | 0 | inositol monophosphatase family protein |
| SEQ ID NO: 3927 | Nga00768 | 604.9383 | 713.24045 | ---NA--- |
| SEQ ID NO: 3928 | Nga00770 | 118.7215 | 183.01213 | ---NA--- |
| SEQ ID NO: 3929 | Nga00769 | 625.4296 | 409.46987 | set domain containing protein |
| SEQ ID NO: 3930 | Nga00767 | 445.7547 | 454.75387 | predicted protein [Phaeodactylum tricornutum CCAP 1055/1] |
| SEQ ID NO: 3931 | Nga20454 | 348.8024 | 285.40295 | ---NA--- |
| SEQ ID NO: 3932 | Nga00766 | 341.7031 | 402.07373 | origin recognition complex 1 protein |
| SEQ ID NO: 3933 | Nga06255 | 893.1751 | 723.22741 | tata box binding protein -associated factor |
| SEQ ID NO: 3934 | Nga06258 | 292.3351 | 282.8766 | bifunctional apoptosis regulator |
| SEQ ID NO: 3935 | Nga06257 | 560.5307 | 646.70683 | alpha beta-hydrolase domain-containing protein |
| SEQ ID NO: 3936 | Nga06259 | 116.9591 | 114.02463 | domain-containing protein |
| SEQ ID NO: 3937 | Nga02366.2 | 334.6614 | 379.77923 | ---NA--- |
| SEQ ID NO: 3938 | Nga05721 | 194.8901 | 239.43139 | poly polymerase gamma |
| SEQ ID NO: 3939 | Nga01130.2 | 2190.024 | 2291.2585 | heat shock protein 70 |
| SEQ ID NO: 3940 | Nga05725 | 1367.041 | 1541.6813 | atp-dependent metalloprotease |
| SEQ ID NO: 3941 | Nga05726 | 6136.434 | 6301.2306 | s-adenosylmethionine synthetase |
| SEQ ID NO: 3942 | Nga05727 | 8834.264 | 8308.8279 | methionine s-adenosyl transferase |
| SEQ ID NO: 3943 | Nga05723 | 310.9541 | 352.14672 | methionine aminopeptidase |
| SEQ ID NO: 3944 | Nga05722 | 102.1505 | 93.181414 | ---NA--- |
| SEQ ID NO: 3945 | Nga05738 | 1290.509 | 1381.6248 | atp-dependent metalloprotease |
| SEQ ID NO: 3946 | Nga04598 | 331.3953 | 365.27656 | ---NA--- |
| SEQ ID NO: 3947 | Nga05938 | 403.3829 | 503.02919 | protein |
| SEQ ID NO: 3948 | Nga05937 | 424.7021 | 347.77717 | translation initiation factor fusion with methylthioribose kinase |
| SEQ ID NO: 3949 | Nga05936 | 776.6082 | 733.55842 | hypothetical protein Esi_0462_0008 [Ectocarpus siliculosus] |
| SEQ ID NO: 3950 | Nga05935 | 645.6759 | 669.40401 | ---NA--- |
| SEQ ID NO: 3951 | Nga00925 | 290.8654 | 298.58371 | protein |
| SEQ ID NO: 3952 | Nga21056.1 | 42.73504 | 74.067278 | ---NA--- |
| SEQ ID NO: 3953 | Nga21047.1 | 63.82979 | 51.856944 | ---NA--- |
| SEQ ID NO: 3954 | Nga21078 | 172.4138 | 236.56833 | serine threonine protein kinase mst4 |
| SEQ ID NO: 3955 | Nga00927 | 86.95652 | 112.62357 | protein |
| SEQ ID NO: 3956 | Nga00928 | 271.0526 | 220.92271 | beta- -endoglucanase |
| SEQ ID NO: 3957 | Nga20203 | 171.0817 | 209.23393 | small nucleolar ribonucleoprotein complex subunit |
| SEQ ID NO: 3958 | Nga00929 | 187.9223 | 220.03189 | protein |
| SEQ ID NO: 3959 | Nga00926 | 508.4175 | 536.14609 | transcription factor protein |
| SEQ ID NO: 3960 | Nga01663 | 496.2406 | 613.56108 | ---NA--- |
| SEQ ID NO: 3961 | Nga01665 | 168.1416 | 178.9413 | ---NA--- |
| SEQ ID NO: 3962 | Nga01666 | 224.2424 | 210.08173 | ---NA--- |
| SEQ ID NO: 3963 | Nga01667 | 370.6897 | 420.22006 | ---NA--- |
| SEQ ID NO: 3964 | Nga01664 | 406.893 | 490.35281 | ---NA--- |
| SEQ ID NO: 3965 | Nga00825 | 343.0556 | 361.07798 | ---NA--- |
| SEQ ID NO: 3966 | Nga20313 | 370.2479 | 350.93199 | conserved unknown protein [Ectocarpus siliculosus] |
| SEQ ID NO: 3967 | Nga00829 | 124.7849 | 131.44233 | ---NA--- |
| SEQ ID NO: 3968 | Nga00828.01 | 6466.377 | 6095.2469 | ---NA--- |
| SEQ ID NO: 3969 | Nga00827 | 439.3939 | 416.88094 | transcription elongation factor spt4 |
| SEQ ID NO: 3970 | Nga00826 | 537.5 | 607.06235 | ---NA--- |
| SEQ ID NO: 3971 | Nga00761 | 542.6573 | 465.10884 | heat shock protein |
| SEQ ID NO: 3972 | Nga00759 | 3177.602 | 3462.9176 | nucleoredoxin-like protein 2 |
| SEQ ID NO: 3973 | Nga00760 | 129.8701 | 164.12635 | ---NA--- |
| SEQ ID NO: 3974 | Nga00764 | 409.7808 | 420.14133 | ---NA--- |
| SEQ ID NO: 3975 | Nga00763 | 562.6615 | 617.89119 | thermostable carboxypeptidase |
| SEQ ID NO: 3976 | Nga00762 | 727.0341 | 710.78343 | protein |
| SEQ ID NO: 3977 | Nga01753 | 92.59259 | 70.209607 | dnak protein |
| SEQ ID NO: 3978 | Nga01751 | 297.619 | 261.13675 | ccaat-box dna binding protein subunit b |
| SEQ ID NO: 3979 | Nga01752 | 86.07595 | 106.95221 | hsp70-like protein |
| SEQ ID NO: 3980 | Nga04908.01 | 6196.842 | 5891.6524 | sugar nucleotide epimerase |
| SEQ ID NO: 3981 | Nga04909.01 | 769.6335 | 764.50228 | nudix hydrolase |
| SEQ ID NO: 3982 | Nga02060 | 374.1188 | 405.80365 | oxidoreductase domain protein |
| SEQ ID NO: 3983 | Nga02059 | 78.26087 | 83.204926 | dna ligase 4-like |
| SEQ ID NO: 3984 | Nga20998 | 811.0236 | 879.7468 | acetyl- acetyltransferase |
| SEQ ID NO: 3985 | Nga20377 | 726.9373 | 833.41062 | ---NA--- |
| SEQ ID NO: 3986 | Nga01778 | 120.4819 | 95.707416 | dna replication licensing factor mcm3 |
| SEQ ID NO: 3987 | Nga01777 | 153.0139 | 140.07817 | protein |

FIGURE 24 BK

| # | Nga model | +N rpkb | -N rpkb | GO |
|---|---|---|---|---|
| SEQ ID NO: 3988 | Nga01369 | 314.1487 | 389.6525 | ---NA--- |
| SEQ ID NO: 3989 | Nga01371 | 176.4706 | 99.119446 | ---NA--- |
| SEQ ID NO: 3990 | Nga01370 | 105.8952 | 95.788154 | ---NA--- |
| SEQ ID NO: 3991 | Nga02435 | 587.5486 | 556.36918 | ---NA--- |
| SEQ ID NO: 3992 | Nga02437 | 2538.813 | 1953.7781 | 26s proteasome regulatory atpase subunit |
| SEQ ID NO: 3993 | Nga02436 | 963.3028 | 1146.1741 | 26s protease regulatory subunit 7 |
| SEQ ID NO: 3994 | Nga00887 | 521.7391 | 509.34672 | myst esa1-associated factor 6-like |
| SEQ ID NO: 3995 | Nga00888 | 3.642987 | 5.9193112 | chc1-b-prov partial |
| SEQ ID NO: 3996 | Nga01335.01 | 703.7594 | 567.67974 | protein |
| SEQ ID NO: 3997 | Nga01334.01 | 6031.915 | 6632.5672 | 40s ribosomal protein s2 |
| SEQ ID NO: 3998 | Nga01337 | 115.3846 | 62.494266 | ---NA--- |
| SEQ ID NO: 3999 | Nga01333 | 1655.844 | 1540.4431 | sulfate adenylyltransferase |
| SEQ ID NO: 4000 | Nga01336 | 1202.649 | 1265.4468 | protein |
| SEQ ID NO: 4001 | Nga06454 | 40266.56 | 27658.345 | light harvesting complex protein |
| SEQ ID NO: 4002 | Nga06455 | 417.9293 | 263.96989 | protein |
| SEQ ID NO: 4003 | Nga06453 | 426.0355 | 472.1789 | short-chain dehydrogenase reductase sdr |
| SEQ ID NO: 4004 | Nga04399 | 80 | 115.54495 | ---NA--- |
| SEQ ID NO: 4005 | Nga07309 | 162.6016 | 250.99323 | pyruvate kinase |
| SEQ ID NO: 4006 | Nga21007 | 7077.947 | 6816.5482 | ---NA--- |
| SEQ ID NO: 4007 | Nga07308 | 2.743484 | 1.4859176 | protein |
| SEQ ID NO: 4008 | Nga01473 | 1552.809 | 1304.7492 | enhancer of yellow 2 transcription factor homolog |
| SEQ ID NO: 4009 | Nga01474 | 299.9185 | 326.64756 | ubiquitin-like modifier-activating enzyme 5 |
| SEQ ID NO: 4010 | Nga01061 | 86.629 | 148.91917 | ---NA--- |
| SEQ ID NO: 4011 | Nga05569 | 66.26506 | 47.853708 | ---NA--- |
| SEQ ID NO: 4012 | Nga05568 | 1938.776 | 1691.1714 | peroxiredoxin q |
| SEQ ID NO: 4013 | Nga03517 | 129.9435 | 101.99943 | nedd8 activating enzyme |
| SEQ ID NO: 4014 | Nga03518 | 117.76 | 125.47 | ---NA--- |
| SEQ ID NO: 4015 | Nga03527 | 86.96 | 36.63 | ---NA--- |
| SEQ ID NO: 4016 | Nga02193.02 | 1625.66 | 1479.54 | upf0414 transmembrane protein c20orf30-like protein |
| SEQ ID NO: 4017 | Nga04468 | 220.27 | 214.45 | nucleic acid binding |
| SEQ ID NO: 4018 | Nga02195.02 | 3082.66 | 3114.42 | pyruvate kinase |
| SEQ ID NO: 4019 | Nga05956 | 145.90 | 199.38 | crooked neck |
| SEQ ID NO: 4020 | Nga05957 | 25.00 | 27.08 | ---NA--- |
| SEQ ID NO: 4021 | Nga05955 | 427.45 | 454.53 | crooked neck |
| SEQ ID NO: 4022 | Nga05953 | 936.88 | 918.34 | histone acetyltransferase |
| SEQ ID NO: 4023 | Nga05966 | 483.97 | 555.50 | crooked neck |
| SEQ ID NO: 4024 | Nga05958 | 486.34 | 645.20 | ---NA--- |
| SEQ ID NO: 4025 | Nga05954 | 444.66 | 445.91 | gpr7 transmembrane protein |
| SEQ ID NO: 4026 | Nga04051 | 396.06 | 485.32 | ---NA--- |
| SEQ ID NO: 4027 | Nga06172 | 96.62 | 104.66 | ---NA--- |
| SEQ ID NO: 4028 | Nga20735 | 117.12 | 185.42 | ---NA--- |
| SEQ ID NO: 4029 | Nga06168 | 168.10 | 135.40 | ---NA--- |
| SEQ ID NO: 4030 | Nga06169 | 826.09 | 894.85 | ---NA--- |
| SEQ ID NO: 4031 | Nga06170 | 1119.50 | 1243.33 | splicing arginine serine- |
| SEQ ID NO: 4032 | Nga06171 | 584.39 | 397.64 | ---NA--- |
| SEQ ID NO: 4033 | Nga01180 | 1065.11 | 795.70 | ---NA--- |
| SEQ ID NO: 4034 | Nga01181 | 315.79 | 321.71 | ---NA--- |
| SEQ ID NO: 4035 | Nga01183 | 263.57 | 159.55 | ---NA--- |
| SEQ ID NO: 4036 | Nga06911.2 | 280.63 | 95.67 | ankyrin repeat protein |
| SEQ ID NO: 4037 | Nga03806 | 138.67 | 109.77 | ---NA--- |
| SEQ ID NO: 4038 | Nga01735 | 97.13 | 105.21 | ---NA--- |
| SEQ ID NO: 4039 | Nga20200.1 | 661.93 | 594.95 | zn-binding protein |
| SEQ ID NO: 4040 | Nga05031.1 | 529.19 | 471.59 | conserved unknown protein [Ectocarpus siliculosus] |
| SEQ ID NO: 4041 | Nga01791.2 | 2943.87 | 3333.48 | protein |
| SEQ ID NO: 4042 | Nga05147 | 2930.80 | 2813.66 | PREDICTED: hypothetical protein [Vitis vinifera] |
| SEQ ID NO: 4043 | Nga05149 | 249.21 | 254.63 | ---NA--- |
| SEQ ID NO: 4044 | Nga05146 | 1294.99 | 1060.30 | protein |
| SEQ ID NO: 4045 | Nga05148 | 305.99 | 314.38 | s-adenosylmethionine decarboxylase proenzyme |
| SEQ ID NO: 4046 | Nga05150 | 1697.78 | 1537.00 | proteasome ( macropain) alpha 6 |
| SEQ ID NO: 4047 | Nga05152 | 195.15 | 252.53 | protein |
| SEQ ID NO: 4048 | Nga05145 | 1531.84 | 1892.40 | protein |
| SEQ ID NO: 4049 | Nga05151 | 2610.41 | 2552.10 | coproporphyrinogen iii oxidase |
| SEQ ID NO: 4050 | Nga04027 | 200.17 | 250.83 | ribosome biogenesis protein nob1 |
| SEQ ID NO: 4051 | Nga04026 | 531.87 | 559.47 | ---NA--- |

FIGURE 24 BL

| # | Nga model | +N rpkb | -N rpkb | GO |
|---|---|---|---|---|
| SEQ ID NO: 4052 | Nga04025 | 137.19 | 141.64 | inositol oxygenase |
| SEQ ID NO: 4053 | Nga02276.01 | 390.35 | 299.31 | phosphatidylinositol-4-phosphate 5- |
| SEQ ID NO: 4054 | Nga20053.1 | 1379.41 | 1452.23 | hypothetical protein AURANDRAFT_70731 [Aureococcus anophagefferens] |
| SEQ ID NO: 4055 | Nga02277.01 | 1101.16 | 1216.17 | hypothetical protein AURANDRAFT_70731 [Aureococcus anophagefferens] |
| SEQ ID NO: 4056 | Nga21136 | 166.15 | 129.99 | ---NA--- |
| SEQ ID NO: 4057 | Nga07268 | 251.43 | 148.56 | fatty-acyl elongase |
| SEQ ID NO: 4058 | Nga06186 | 126.71 | 279.13 | protein |
| SEQ ID NO: 4059 | Nga06195 | 280.49 | 158.52 | ---NA--- |
| SEQ ID NO: 4060 | Nga06185 | 5908.55 | 6087.20 | histone h3 |
| SEQ ID NO: 4061 | Nga06187 | 514.65 | 586.46 | ---NA--- |
| SEQ ID NO: 4062 | Nga06188 | 599.07 | 580.75 | methionine sulfoxide reductase b |
| SEQ ID NO: 4063 | Nga06189 | 25.72 | 20.90 | ankyrin repeat protein |
| SEQ ID NO: 4064 | Nga06194 | 34.19 | 27.78 | ---NA--- |
| SEQ ID NO: 4065 | Nga01096.2 | 560.46 | 617.98 | dna topoisomerase i |
| SEQ ID NO: 4066 | Nga04622.2 | 578.17 | 558.10 | ---NA--- |
| SEQ ID NO: 4067 | Nga01127 | 103.24 | 83.08 | riken cdna isoform cra_b |
| SEQ ID NO: 4068 | Nga06501 | 452.53 | 507.70 | ---NA--- |
| SEQ ID NO: 4069 | Nga06500 | 725.15 | 772.83 | eukaryotic translation initiation factor 4e |
| SEQ ID NO: 4070 | Nga03180 | 133.78 | 146.12 | transaminase transferring nitrogenous groups |
| SEQ ID NO: 4071 | Nga03179 | 3084.26 | 2892.00 | proteasome subunit beta 7 |
| SEQ ID NO: 4072 | Nga03189 | 405.34 | 341.80 | ---NA--- |
| SEQ ID NO: 4073 | Nga03181 | 1414.57 | 1544.44 | aldehyde dehydrogenase |
| SEQ ID NO: 4074 | Nga03177 | 894.74 | 963.86 | ---NA--- |
| SEQ ID NO: 4075 | Nga03178 | 240.68 | 275.40 | ---NA--- |
| SEQ ID NO: 4076 | Nga05164 | 111.50 | 143.42 | denn domain-containing protein 4b |
| SEQ ID NO: 4077 | Nga05161 | 2560.64 | 2199.93 | proteasome subunit alpha type 3 |
| SEQ ID NO: 4078 | Nga05166 | 178.95 | 267.96 | ---NA--- |
| SEQ ID NO: 4079 | Nga05163 | 95.98 | 100.61 | dynein intermediate chain 3 |
| SEQ ID NO: 4080 | Nga05162 | 160.00 | 151.65 | phospholipase carboxylesterase family expressed |
| SEQ ID NO: 4081 | Nga05165 | 98.14 | 110.14 | ---NA--- |
| SEQ ID NO: 4082 | Nga03640 | 118.81 | 85.80 | ---NA--- |
| SEQ ID NO: 4083 | Nga03639 | 256.10 | 242.63 | ---NA--- |
| SEQ ID NO: 4084 | Nga01782.1 | 159.75 | 158.63 | nad-dependent histone deacetylase sir2-like protein |
| SEQ ID NO: 4085 | Nga01783.01 | 1437.13 | 1556.74 | tim10-like protein |
| SEQ ID NO: 4086 | Nga01781.01 | 1005.47 | 838.99 | endomembrane protein 70 containing expressed |
| SEQ ID NO: 4087 | Nga04063 | 174.48 | 157.97 | dihydroxy-acid dehydratase |
| SEQ ID NO: 4088 | Nga04061 | 685.82 | 697.25 | protein |
| SEQ ID NO: 4089 | Nga04060 | 283.96 | 262.47 | fg-gap repeat domain protein |
| SEQ ID NO: 4090 | Nga04062 | 14320.21 | 12391.52 | protein |
| SEQ ID NO: 4091 | Nga20354 | 139.53 | 139.70 | ---NA--- |
| SEQ ID NO: 4092 | Nga03977 | 78.95 | 79.18 | ylr143w-like protein |
| SEQ ID NO: 4093 | Nga03980 | 111.80 | 80.74 | ---NA--- |
| SEQ ID NO: 4094 | Nga01652 | 1432.46 | 1310.09 | ---NA--- |
| SEQ ID NO: 4095 | Nga01653 | 64.52 | 78.62 | ---NA--- |
| SEQ ID NO: 4096 | Nga21299 | 260.00 | 184.15 | ---NA--- |
| SEQ ID NO: 4097 | Nga05463 | 84.85 | 75.50 | ---NA--- |
| SEQ ID NO: 4098 | Nga05452 | 627.16 | 530.47 | short-chain dehydrogenase reductase sdr |
| SEQ ID NO: 4099 | Nga05453 | 397.31 | 501.50 | soluble pyridine nucleotide transhydrogenase stha |
| SEQ ID NO: 4100 | Nga20645 | 143.65 | 137.65 | ---NA--- |
| SEQ ID NO: 4101 | Nga03969 | 639.71 | 642.51 | ---NA--- |
| SEQ ID NO: 4102 | Nga02385 | 610.79 | 768.07 | alpha beta hydrolase fold protein |
| SEQ ID NO: 4103 | Nga02374 | 69.31 | 85.80 | ---NA--- |
| SEQ ID NO: 4104 | Nga02230.01 | 1230.58 | 956.34 | ---NA--- |
| SEQ ID NO: 4105 | Nga02229 | 1983.22 | 1792.06 | conserved unknown protein [Ectocarpus siliculosus] |
| SEQ ID NO: 4106 | Nga02334.01 | 26634.92 | 28408.62 | uncharacterized protein conserved in bacteria with a cystatin-like fold |
| SEQ ID NO: 4107 | Nga02335.01 | 1068.17 | 1077.20 | ---NA--- |
| SEQ ID NO: 4108 | Nga01635.02 | 777.33 | 582.68 | ---NA--- |
| SEQ ID NO: 4109 | Nga06461 | 107.14 | 96.72 | ---NA--- |
| SEQ ID NO: 4110 | Nga06459 | 135.78 | 157.02 | ---NA--- |
| SEQ ID NO: 4111 | Nga06462 | 1379.48 | 1425.64 | ---NA--- |
| SEQ ID NO: 4112 | Nga06463 | 783.25 | 1083.23 | ---NA--- |
| SEQ ID NO: 4113 | Nga06458 | 674.36 | 633.28 | predicted protein [Phaeodactylum tricornutum CCAP 1055/1] |

FIGURE 24 BM

| # | Nga model | +N rpkb | -N rpkb | GO |
|---|---|---|---|---|
| SEQ ID NO: 4114 | Nga06464 | 240.34 | 199.91 | ---NA--- |
| SEQ ID NO: 4115 | Nga06460 | 162.02 | 171.73 | ---NA--- |
| SEQ ID NO: 4116 | Nga06076 | 1824.13 | 2040.20 | 60s ribosomal protein l5 |
| SEQ ID NO: 4117 | Nga06074.1 | 512.74 | 293.23 | ---NA--- |
| SEQ ID NO: 4118 | Nga06072 | 177.08 | 170.87 | polymerase (dna directed) alpha 2 (70kd subunit) |
| SEQ ID NO: 4119 | Nga06075 | 1240.74 | 1277.81 | 60s ribosomal protein l5 |
| SEQ ID NO: 4120 | Nga06073 | 197.99 | 160.18 | conserved unknown protein [Ectocarpus siliculosus] |
| SEQ ID NO: 4121 | Nga06071 | 232.06 | 196.95 | ---NA--- |
| SEQ ID NO: 4122 | Nga04905 | 134.02 | 174.96 | ---NA--- |
| SEQ ID NO: 4123 | Nga06120.2 | 290.91 | 317.94 | protein |
| SEQ ID NO: 4124 | Nga01815.01 | 774.27 | 649.59 | cral n-terminus family protein |
| SEQ ID NO: 4125 | Nga03737.01 | 99.17 | 102.95 | ---NA--- |
| SEQ ID NO: 4126 | Nga03736 | 141.84 | 199.75 | ---NA--- |
| SEQ ID NO: 4127 | Nga03735 | 324.73 | 316.82 | nacht and ankyrin domain protein |
| SEQ ID NO: 4128 | Nga03734 | 257.91 | 368.14 | protein fam102b-like |
| SEQ ID NO: 4129 | Nga02908.2 | 1334.95 | 1391.30 | ras-related protein rab-7a |
| SEQ ID NO: 4130 | Nga01432.01 | 137.79 | 204.38 | amidophosphoribosyltransferase |
| SEQ ID NO: 4131 | Nga01427.01 | 422.55 | 474.99 | mitochondrial inner membrane protease atp23 homolog |
| SEQ ID NO: 4132 | Nga01426.01 | 551.80 | 429.80 | udp-glucose 4-epimerase |
| SEQ ID NO: 4133 | Nga01425.01 | 1500.78 | 1598.82 | protein |
| SEQ ID NO: 4134 | Nga01431.01 | 8.44 | 7.31 | protein |
| SEQ ID NO: 4135 | Nga01428.01 | 796.54 | 725.67 | snf7 family protein |
| SEQ ID NO: 4136 | Nga01429.01 | 3957.89 | 4347.07 | xylulose kinase |
| SEQ ID NO: 4137 | Nga06021 | 4816.12 | 4517.89 | gamma-butyrobetaine dioxygenase |
| SEQ ID NO: 4138 | Nga06026 | 119.32 | 125.15 | n-acetyltransferase 9 |
| SEQ ID NO: 4139 | Nga06023.1 | 1939.29 | 2664.40 | protein |
| SEQ ID NO: 4140 | Nga06025 | 239.55 | 288.66 | calcium calmodulin-dependent protein kinase i |
| SEQ ID NO: 4141 | Nga06022 | 607.42 | 694.43 | rna binding s1 domain-containing protein |
| SEQ ID NO: 4142 | Nga06027 | 259.69 | 258.21 | paired amphipathic helix repeat-containing protein |
| SEQ ID NO: 4143 | Nga06990.2 | 221.78 | 232.49 | transcriptional repressor sin3p |
| SEQ ID NO: 4144 | Nga01393 | 173.59 | 216.05 | hydroxyacid oxidase |
| SEQ ID NO: 4145 | Nga01394 | 221.43 | 147.01 | ---NA--- |
| SEQ ID NO: 4146 | Nga01392 | 137.93 | 127.00 | ---NA--- |
| SEQ ID NO: 4147 | Nga01395 | 81.08 | 175.66 | ---NA--- |
| SEQ ID NO: 4148 | Nga07156.2 | 329.26 | 355.64 | protein |
| SEQ ID NO: 4149 | Nga05559 | 150.38 | 160.86 | ---NA--- |
| SEQ ID NO: 4150 | Nga05566 | 201.26 | 292.95 | amidase |
| SEQ ID NO: 4151 | Nga05557 | 147.77 | 253.13 | amidase |
| SEQ ID NO: 4152 | Nga05567 | 641.38 | 560.29 | ---NA--- |
| SEQ ID NO: 4153 | Nga05036.02 | 303.62 | 307.90 | ---NA--- |
| SEQ ID NO: 4154 | Nga05556 | 201.60 | 156.40 | magnesium and cobalt efflux protein |
| SEQ ID NO: 4155 | Nga04246 | 70.06 | 100.04 | expressed unknown protein [Ectocarpus siliculosus] |
| SEQ ID NO: 4156 | Nga04247 | 131.16 | 97.76 | dna repair protein rad51 |
| SEQ ID NO: 4157 | Nga06068.2 | 668.74 | 647.92 | ---NA--- |
| SEQ ID NO: 4158 | Nga03890 | 44.33 | 78.75 | 60s ribosomal export protein |
| SEQ ID NO: 4159 | Nga03889 | 110.61 | 173.25 | 60s ribosomal export protein |
| SEQ ID NO: 4160 | Nga03882 | 176.99 | 233.04 | tfiih and nucleotide excision repair factor 3 complexes subunit |
| SEQ ID NO: 4161 | Nga03881 | 180.12 | 248.49 | syntaxin-like protein |
| SEQ ID NO: 4162 | Nga03883 | 152.09 | 116.29 | ribosomal rna-processing |
| SEQ ID NO: 4163 | Nga21284 | 175.68 | 204.94 | at2g47330-like protein |
| SEQ ID NO: 4164 | Nga21297 | 195.65 | 247.26 | atp-dependent rna helicase ddx42 |
| SEQ ID NO: 4165 | Nga21083 | 66.67 | 20.63 | peptide chain release factor 2 |
| SEQ ID NO: 4166 | Nga02236 | 138.61 | 169.49 | rna polymerase i subunit |
| SEQ ID NO: 4167 | Nga02802 | 292.00 | 226.76 | ---NA--- |
| SEQ ID NO: 4168 | Nga02799 | 382.88 | 790.47 | protein |
| SEQ ID NO: 4169 | Nga02800 | 218.71 | 276.19 | ---NA--- |
| SEQ ID NO: 4170 | Nga02798 | 2581.80 | 2745.92 | hypothetical protein FRAAL3804 [Frankia alni ACN14a] |
| SEQ ID NO: 4171 | Nga02801 | 894.36 | 1143.05 | protein |
| SEQ ID NO: 4172 | Nga04558 | 242.68 | 95.18 | ---NA--- |
| SEQ ID NO: 4173 | Nga05575 | 154.59 | 172.69 | ---NA--- |
| SEQ ID NO: 4174 | Nga04669 | 94.41 | 132.56 | ---NA--- |
| SEQ ID NO: 4175 | Nga04556 | 556.86 | 606.61 | o-acetylhomoserine o-acetylserine sulfhydrylase |
| SEQ ID NO: 4176 | Nga04557 | 180.56 | 131.64 | 4-hydroxybenzoyl- thioesterase family active site protein |
| SEQ ID NO: 4177 | Nga03690.1 | 1274.73 | 1353.05 | protein |

FIGURE 24 BN

| # | Nga model | +N rpkb | -N rpkb | GO |
|---|---|---|---|---|
| SEQ ID NO: 4178 | Nga03689 | 424.80 | 440.15 | pabp-dependent poly nuclease 3 isoform 2 |
| SEQ ID NO: 4179 | Nga03686 | 308.99 | 379.82 | lipase-related protein |
| SEQ ID NO: 4180 | Nga03688 | 588.61 | 479.91 | ---NA--- |
| SEQ ID NO: 4181 | Nga03687 | 378.26 | 322.84 | glycoside |
| SEQ ID NO: 4182 | Nga04186 | 22.82 | 33.93 | ---NA--- |
| SEQ ID NO: 4183 | Nga20482 | 381.68 | 304.30 | ---NA--- |
| SEQ ID NO: 4184 | Nga04081 | 209.15 | 251.34 | ---NA--- |
| SEQ ID NO: 4185 | Nga04080 | 250.48 | 200.37 | snare ykt6 |
| SEQ ID NO: 4186 | Nga04079 | 2622.49 | 2201.27 | predicted protein [Phaeodactylum tricornutum CCAP 1055/1] |
| SEQ ID NO: 4187 | Nga02406 | 2021.81 | 1602.92 | tim10 ddp zinc finger domain-containing protein |
| SEQ ID NO: 4188 | Nga04992.02 | 200.00 | 256.04 | ---NA--- |
| SEQ ID NO: 4189 | Nga20747 | 288.95 | 346.76 | protein |
| SEQ ID NO: 4190 | Nga04991.2 | 177.95 | 180.89 | beta like 1 |
| SEQ ID NO: 4191 | Nga05174 | 21.28 | 30.73 | ---NA--- |
| SEQ ID NO: 4192 | Nga06489 | 94.02 | 115.73 | ---NA--- |
| SEQ ID NO: 4193 | Nga06491 | 1149.32 | 1548.88 | ---NA--- |
| SEQ ID NO: 4194 | Nga06490 | 51.28 | 138.88 | ---NA--- |
| SEQ ID NO: 4195 | Nga06488 | 174.96 | 178.09 | gamma-tubulin complex component 4 |
| SEQ ID NO: 4196 | Nga07034 | 1482.27 | 1361.72 | glycosyl hydrolase |
| SEQ ID NO: 4197 | Nga07211 | 139.39 | 196.95 | ---NA--- |
| SEQ ID NO: 4198 | Nga21126.1 | 152.35 | 114.02 | ---NA--- |
| SEQ ID NO: 4199 | Nga02383 | 337.02 | 418.93 | ---NA--- |
| SEQ ID NO: 4200 | Nga02382 | 331.33 | 396.27 | ---NA--- |
| SEQ ID NO: 4201 | Nga04696.2 | 255.49 | 258.36 | duf1212 domain membrane protein |
| SEQ ID NO: 4202 | Nga20818 | 728.78 | 748.22 | atp binding protein |
| SEQ ID NO: 4203 | Nga02289 | 8268.79 | 8215.05 | protein |
| SEQ ID NO: 4204 | Nga02291 | 1539.47 | 1618.20 | ---NA--- |
| SEQ ID NO: 4205 | Nga02293 | 729.97 | 754.35 | protein |
| SEQ ID NO: 4206 | Nga21209 | 536.25 | 685.61 | aminotransferase class iv |
| SEQ ID NO: 4207 | Nga02297 | 180.49 | 165.57 | at2g30800-like protein |
| SEQ ID NO: 4208 | Nga02290 | 893.10 | 778.45 | protein |
| SEQ ID NO: 4209 | Nga02292 | 111.78 | 121.08 | atp-dependent rna helicase dhx57 |
| SEQ ID NO: 4210 | Nga01585 | 183.62 | 126.48 | glycoprotein 3-alpha-l-fucosyltransferase |
| SEQ ID NO: 4211 | Nga01586 | 220.83 | 191.82 | at5g52030 msg15_11 |
| SEQ ID NO: 4212 | Nga01584 | 1170.34 | 1282.95 | mitochondrial ribosomal protein l53-like |
| SEQ ID NO: 4213 | Nga01583 | 7583.92 | 8057.97 | ---NA--- |
| SEQ ID NO: 4214 | Nga06713 | 1007.35 | 910.00 | dihydrolipoamide s-succinyltransferase |
| SEQ ID NO: 4215 | Nga06144.2 | 861.43 | 810.33 | hydroxyacyl-coenzyme a mitochondrial precursor |
| SEQ ID NO: 4216 | Nga20440 | 186.58 | 252.07 | ---NA--- |
| SEQ ID NO: 4217 | Nga06712 | 527.61 | 469.62 | protein |
| SEQ ID NO: 4218 | Nga06715 | 791.58 | 836.88 | adenylyl cyclase-associated protein 1 |
| SEQ ID NO: 4219 | Nga01790 | 311.85 | 317.40 | kynurenine 3-monooxygenase |
| SEQ ID NO: 4220 | Nga01759.02 | 1722.32 | 1588.87 | hypersensitive-induced response protein |
| SEQ ID NO: 4221 | Nga01761.02 | 3718.91 | 3827.70 | enoyl- hydratase isomerase |
| SEQ ID NO: 4222 | Nga04382 | 531.86 | 574.12 | ---NA--- |
| SEQ ID NO: 4223 | Nga01762.02 | 101.10 | 76.18 | ---NA--- |
| SEQ ID NO: 4224 | Nga03028.02 | 324.19 | 305.47 | protein |
| SEQ ID NO: 4225 | Nga03505 | 844.74 | 939.76 | protein |
| SEQ ID NO: 4226 | Nga03023.02 | 1230.97 | 1157.16 | protein |
| SEQ ID NO: 4227 | Nga03506 | 2623.25 | 2613.09 | abc subfamily abcg |
| SEQ ID NO: 4228 | Nga03027.02 | 1082.49 | 1021.23 | protein |
| SEQ ID NO: 4229 | Nga03025.02 | 1242.21 | 1453.40 | protein |
| SEQ ID NO: 4230 | Nga06862 | 9.30 | 45.34 | ---NA--- |
| SEQ ID NO: 4231 | Nga00958.01 | 980.74 | 1281.43 | ribosome biogenesis regulatory protein |
| SEQ ID NO: 4232 | Nga00957 | 2070.46 | 2101.51 | ferredoxin-thioredoxin catalytic chain |
| SEQ ID NO: 4233 | Nga20802 | 185.37 | 291.74 | rrna processing protein |
| SEQ ID NO: 4234 | Nga00959 | 89.06 | 135.06 | ---NA--- |
| SEQ ID NO: 4235 | Nga06800 | 543.11 | 590.24 | puff-specific protein bx42 |
| SEQ ID NO: 4236 | Nga00429.02 | 7422.34 | 5958.48 | thioredoxin f |
| SEQ ID NO: 4237 | Nga04442.2 | 326.91 | 360.01 | sh2 domain containing protein |
| SEQ ID NO: 4238 | Nga04300.01 | 4487.61 | 4325.42 | conserved hypothetical protein [Phytophthora infestans T30-4] |
| SEQ ID NO: 4239 | Nga04301.01 | 421.84 | 328.82 | udp-n-acetylglucosamine transporter |
| SEQ ID NO: 4240 | Nga04299.01 | 10843.09 | 11728.31 | 40s ribosomal protein |
| SEQ ID NO: 4241 | Nga06995 | 1080.94 | 937.10 | protein |

FIGURE 24 BO

| # | Nga model | +N rpkb | -N rpkb | GO |
|---|---|---|---|---|
| SEQ ID NO: 4242 | Nga02623.2 | 3232.20 | 3711.72 | molybdenum cofactor synthesis 1 |
| SEQ ID NO: 4243 | Nga01767.01 | 2941.61 | 3178.54 | h aca ribonucleoprotein complex subunit 2-like protein |
| SEQ ID NO: 4244 | Nga01765.01 | 492.62 | 522.68 | cystathionine gamma-lyase |
| SEQ ID NO: 4245 | Nga01764.01 | 4929.60 | 5797.47 | protein |
| SEQ ID NO: 4246 | Nga04484 | 3847.96 | 3777.47 | soul heme-binding protein |
| SEQ ID NO: 4247 | Nga04485 | 4519.55 | 4143.06 | ribosomal protein l7ae l30e s12e gadd45 family protein |
| SEQ ID NO: 4248 | Nga04486 | 5580.20 | 5582.36 | protein tyrosine phosphatase type iva protein 1 |
| SEQ ID NO: 4249 | Nga04340.1 | 661.33 | 756.32 | mitochondrion protein |
| SEQ ID NO: 4250 | Nga06844.1 | 3618.52 | 7053.06 | ferredoxin (2fe-2s) |
| SEQ ID NO: 4251 | Nga01222.02 | 694.92 | 575.64 | uv excision repair protein |
| SEQ ID NO: 4252 | Nga04202.01 | 741.78 | 699.29 | udp-glucuronate decarboxylase 1 |
| SEQ ID NO: 4253 | Nga04201.01 | 917.26 | 756.97 | 3-oxoacyl-(acyl-carrier-protein) synthase 2 |
| SEQ ID NO: 4254 | Nga04206.01 | 698.41 | 747.95 | ---NA--- |
| SEQ ID NO: 4255 | Nga04203.01 | 23497.08 | 20695.47 | ---NA--- |
| SEQ ID NO: 4256 | Nga02299 | 2695.44 | 2560.89 | amp-dependent synthetase and ligase |
| SEQ ID NO: 4257 | Nga02300 | 416.47 | 356.03 | udp-n-acetylglucosamine--dolichyl-phosphate n-acetylglucosaminephosphotransferase |
| SEQ ID NO: 4258 | Nga02302 | 6893.55 | 7685.14 | 60s ribosomal protein l6 |
| SEQ ID NO: 4259 | Nga02301 | 597.28 | 518.04 | peptidyl-prolyl cis-trans isomerase d-like |
| SEQ ID NO: 4260 | Nga02298 | 834.60 | 1019.95 | nacht and ankyrin domain protein |
| SEQ ID NO: 4261 | Nga01929 | 653.16 | 606.67 | leucine carboxyl methyltransferase |
| SEQ ID NO: 4262 | Nga01930 | 3133.33 | 2946.86 | protein |
| SEQ ID NO: 4263 | Nga01932 | 905.41 | 1044.20 | protein |
| SEQ ID NO: 4264 | Nga01931 | 609.03 | 758.26 | phosphoribosylaminoimidazole carboxylase |
| SEQ ID NO: 4265 | Nga20865 | 657.84 | 769.18 | protein |
| SEQ ID NO: 4266 | Nga01732 | 294.22 | 318.71 | ---NA--- |
| SEQ ID NO: 4267 | Nga01728 | 409.67 | 370.73 | ---NA--- |
| SEQ ID NO: 4268 | Nga01731 | 492.46 | 563.16 | dimethyladenosine transferase |
| SEQ ID NO: 4269 | Nga01727 | 341.69 | 344.99 | retinol retinaldehyde reductase |
| SEQ ID NO: 4270 | Nga07148 | 643.20 | 828.31 | ectonucleoside triphosphate diphosphohydrolase 7 |
| SEQ ID NO: 4271 | Nga07286 | 159.37 | 127.65 | ---NA--- |
| SEQ ID NO: 4272 | Nga05414.02 | 2174.78 | 2062.85 | peptide methionine sulfoxide reductase |
| SEQ ID NO: 4273 | Nga04891 | 838.80 | 842.75 | saccharopine dehydrogenase |
| SEQ ID NO: 4274 | Nga04892.1 | 449.06 | 410.90 | pentatricopeptide repeat-containing protein |
| SEQ ID NO: 4275 | Nga20558.1 | 308.61 | 329.47 | b chain snapshots of the rna processing factor scaf8 bound to different phosphorylated forms of the carboxy-terminal domain of rna-polymerase ii |
| SEQ ID NO: 4276 | Nga00516.02 | 4916.85 | 4334.15 | expressed unknown protein [Ectocarpus siliculosus] |
| SEQ ID NO: 4277 | Nga20382.1 | 238.26 | 167.21 | conserved unknown protein [Ectocarpus siliculosus] |
| SEQ ID NO: 4278 | Nga21003.1 | 174.83 | 208.31 | conserved unknown protein [Ectocarpus siliculosus] |
| SEQ ID NO: 4279 | Nga20361.1 | 321.43 | 236.67 | conserved unknown protein [Ectocarpus siliculosus] |
| SEQ ID NO: 4280 | Nga03718 | 904.31 | 1005.07 | endonuclease iii |
| SEQ ID NO: 4281 | Nga00522.02 | 15290.02 | 7760.55 | chloroplast light harvesting protein isoform 4 |
| SEQ ID NO: 4282 | Nga03717.1 | 403.36 | 506.72 | ankyrin repeat-containing protein |
| SEQ ID NO: 4283 | Nga06867 | 785.48 | 937.37 | ---NA--- |
| SEQ ID NO: 4284 | Nga06863 | 591.27 | 558.81 | ferredoxin |
| SEQ ID NO: 4285 | Nga07010 | 53127.19 | 15716.39 | protein fucoxanthin chlorophyll a c protein |
| SEQ ID NO: 4286 | Nga01818 | 2764.95 | 2945.25 | mitogen-activated protein kinase 4 |
| SEQ ID NO: 4287 | Nga01819 | 480.42 | 477.23 | vacuolar protein sorting-associated protein 53 homolog |
| SEQ ID NO: 4288 | Nga20522 | 174.56 | 132.37 | protein |
| SEQ ID NO: 4289 | Nga07123 | 496.11 | 554.25 | 2-alkenal reductase |
| SEQ ID NO: 4290 | Nga07124 | 297.50 | 318.20 | c3hc zinc finger-like protein |
| SEQ ID NO: 4291 | Nga04438 | 65.04 | 70.45 | ---NA--- |
| SEQ ID NO: 4292 | Nga00983.02 | 1637.10 | 1510.56 | peptidyl-prolyl cis-trans isomerase |
| SEQ ID NO: 4293 | Nga07249 | 1277.35 | 1160.41 | two component regulator propeller domain-containing protein |
| SEQ ID NO: 4294 | Nga00141 | 106.27 | 164.80 | cobalamin synthesis protein p47k |
| SEQ ID NO: 4295 | Nga20147 | 432.21 | 472.13 | hypothetical protein MMP0558 [Methanococcus maripaludis S2] |
| SEQ ID NO: 4296 | Nga00120 | 777.78 | 671.23 | protein |
| SEQ ID NO: 4297 | Nga00121 | 251.31 | 334.61 | ---NA--- |
| SEQ ID NO: 4298 | Nga20133 | 428.45 | 516.23 | e3 ubiquitin-protein ligase upl6 |
| SEQ ID NO: 4299 | Nga00123 | 4518.17 | 4161.81 | protein |
| SEQ ID NO: 4300 | Nga00115 | 5554.31 | 5648.21 | protein |
| SEQ ID NO: 4301 | Nga00124 | 919.72 | 95.41 | ---NA--- |
| SEQ ID NO: 4302 | Nga00118 | 144.66 | 132.70 | nuclear serine protease 2 |

FIGURE 24 BP

| # | Nga model | +N rpkb | -N rpkb | GO |
|---|---|---|---|---|
| SEQ ID NO: 4303 | Nga00122 | 233.72 | 219.97 | ---NA--- |
| SEQ ID NO: 4304 | Nga00117 | 3161.26 | 2770.22 | phosphoadenosine phosphosulfate reductase |
| SEQ ID NO: 4305 | Nga20939 | 595.41 | 509.42 | polycomb group ring finger protein 3 |
| SEQ ID NO: 4306 | Nga00119 | 857.71 | 819.37 | programmed cell death 6-interacting |
| SEQ ID NO: 4307 | Nga20539 | 181.11 | 167.12 | e3 ubiquitin-protein ligase listerin |
| SEQ ID NO: 4308 | Nga00116 | 1334.46 | 1362.92 | heat shock protein atpase subunit |
| SEQ ID NO: 4309 | Nga06866 | 355.79 | 322.71 | gtp-binding protein |
| SEQ ID NO: 4310 | Nga02286 | 165.08 | 123.80 | transcriptional family |
| SEQ ID NO: 4311 | Nga20034 | 234.53 | 250.52 | protein |
| SEQ ID NO: 4312 | Nga02283 | 125.38 | 162.32 | ---NA--- |
| SEQ ID NO: 4313 | Nga02284 | 199.75 | 171.92 | protein |
| SEQ ID NO: 4314 | Nga06309 | 299.35 | 291.42 | beta- -endoglucanase |
| SEQ ID NO: 4315 | Nga06308 | 1155.72 | 1408.86 | ---NA--- |
| SEQ ID NO: 4316 | Nga00357.02 | 1129.63 | 1157.86 | dihydrolipoyllysine-residue acetyltransferase component of pyruvate dehydrogenase mitochondrial |
| SEQ ID NO: 4317 | Nga00351.02 | 7803.56 | 7858.48 | atp synthase gamma |
| SEQ ID NO: 4318 | Nga00390.02 | 251.80 | 311.72 | ---NA--- |
| SEQ ID NO: 4319 | Nga03353.2 | 115.18 | 79.63 | insulin degrading enzyme |
| SEQ ID NO: 4320 | Nga00003.02 | 13762.20 | 16785.78 | ethylmalonic encephalopathy 1 |
| SEQ ID NO: 4321 | Nga03123 | 397.98 | 348.53 | hypothetical protein (Partial) [Ectocarpus siliculosus] |
| SEQ ID NO: 4322 | Nga03931 | 3914.89 | 3541.64 | ---NA--- |
| SEQ ID NO: 4323 | Nga01497 | 570.00 | 483.84 | retinoblastoma binding protein 9 |
| SEQ ID NO: 4324 | Nga05340.01 | 143.72 | 176.37 | ---NA--- |
| SEQ ID NO: 4325 | Nga03146.1 | 107.14 | 107.46 | ---NA--- |
| SEQ ID NO: 4326 | Nga06544 | 364.22 | 410.68 | auxin efflux carrier |
| SEQ ID NO: 4327 | Nga00213 | 140.63 | 263.76 | g-patch domain-contaning protein |
| SEQ ID NO: 4328 | Nga20612.1 | 157.69 | 166.65 | predicted protein [Thalassiosira pseudonana CCMP1335] |
| SEQ ID NO: 4329 | Nga01560 | 1751.16 | 1458.59 | translocase of inner mitochondrial membrane 13 homolog |
| SEQ ID NO: 4330 | Nga01545 | 99.50 | 106.17 | ---NA--- |
| SEQ ID NO: 4331 | Nga02805.1 | 1504.93 | 1312.22 | uncharacterized fam18-like protein cg5021 |
| SEQ ID NO: 4332 | Nga20318.1 | 568.29 | 583.89 | lyr family of fe s cluster biogenesis protein |
| SEQ ID NO: 4333 | Nga06421 | 1570.30 | 1529.52 | fk506-binding protein fkbp59 |
| SEQ ID NO: 4334 | Nga01185 | 3774.81 | 3533.60 | tha4 hcf106 protein |
| SEQ ID NO: 4335 | Nga01449 | 565.66 | 635.58 | pre-mrna-splicing factor sf2 |
| SEQ ID NO: 4336 | Nga20586 | 154.17 | 361.08 | ---NA--- |
| SEQ ID NO: 4337 | Nga00540 | 66.03 | 54.36 | ash1 ( or homeotic)-like |
| SEQ ID NO: 4338 | Nga00566.01 | 651.76 | 609.10 | protein bud31 homolog |
| SEQ ID NO: 4339 | Nga03403 | 151.02 | 115.69 | enoyl-(acyl-carrier-protein) reductase ii |
| SEQ ID NO: 4340 | Nga01433.01 | 155.32 | 150.82 | ---NA--- |
| SEQ ID NO: 4341 | Nga20556 | 74.58 | 128.52 | ---NA--- |
| SEQ ID NO: 4342 | Nga06659 | 112.61 | 68.31 | kinesin family member 17 |
| SEQ ID NO: 4343 | Nga20999 | 2334.57 | 2600.46 | lanc-like protein 2-like |
| SEQ ID NO: 4344 | Nga01457.02 | 2910.32 | 2344.79 | ---NA--- |
| SEQ ID NO: 4345 | Nga06215.2 | 576.74 | 467.58 | conserved unknown protein [Ectocarpus siliculosus] |
| SEQ ID NO: 4346 | Nga20279 | 226.64 | 303.71 | vacuolar protein sorting-associated protein 13b-like |
| SEQ ID NO: 4347 | Nga00860.01 | 675.03 | 625.47 | ribosomal protein l22 |
| SEQ ID NO: 4348 | Nga20485 | 390.56 | 357.98 | l-aminoadipate-semialdehyde dehydrogenase-phosphopantetheinyl |
| SEQ ID NO: 4349 | Nga02880.1 | 960.14 | 1295.31 | ras-related protein rab-2-a |
| SEQ ID NO: 4350 | Nga05781 | 1355.28 | 1178.35 | tryptophan-rich sensory-like protein |
| SEQ ID NO: 4351 | Nga01466 | 235.52 | 281.81 | ---NA--- |
| SEQ ID NO: 4352 | Nga06310 | 299.35 | 291.42 | cobalamin synthesis protein p47k |
| SEQ ID NO: 4353 | Nga05671 | 1965.21 | 1963.54 | protein |
| SEQ ID NO: 4354 | Nga00605 | 2069.28 | 1513.53 | brain protein 44 |
| SEQ ID NO: 4355 | Nga00047 | 177.27 | 169.43 | ---NA--- |
| SEQ ID NO: 4356 | Nga00019 | 220.19 | 326.12 | ---NA--- |
| SEQ ID NO: 4357 | Nga05939 | 550.22 | 691.84 | ---NA--- |
| SEQ ID NO: 4358 | Nga06378 | 319.62 | 317.54 | nucleolar complex protein 4 homolog |
| SEQ ID NO: 4359 | Nga00555 | 17193.81 | 16126.38 | ---NA--- |
| SEQ ID NO: 4360 | Nga20118.1 | 493.58 | 483.69 | protein |
| SEQ ID NO: 4361 | Nga02826.1 | 58.44 | 112.54 | ---NA--- |
| SEQ ID NO: 4362 | Nga05423 | 1400.86 | 1322.40 | short-chain dehydrogenase reductase sdr |
| SEQ ID NO: 4363 | Nga06112 | 161.70 | 208.46 | ccaat enhancer-binding protein zeta |
| SEQ ID NO: 4364 | Nga05385 | 57.32 | 85.02 | histone-lysine n- h3 lysine-36 and h4 lysine-20 specific |
| SEQ ID NO: 4365 | Nga00410 | 231.54 | 254.81 | anthranilate anthranilate chorismate lyase |

FIGURE 24 BQ

| # | Nga model | +N rpkb | -N rpkb | GO |
|---|---|---|---|---|
| SEQ ID NO: 4366 | Nga21031 | 824.51 | 617.82 | integral membrane protein |
| SEQ ID NO: 4367 | Nga00419 | 235.82 | 258.32 | protein |
| SEQ ID NO: 4368 | Nga00417.01 | 2296.52 | 2372.48 | ubiquitin domain containing protein |
| SEQ ID NO: 4369 | Nga00421 | 1069.33 | 1057.11 | protein |
| SEQ ID NO: 4370 | Nga00415 | 92.24 | 118.09 | fructose- -bisphosphatase |
| SEQ ID NO: 4371 | Nga00423 | 9133.82 | 9269.43 | ---NA--- |
| SEQ ID NO: 4372 | Nga00418 | 376.79 | 369.46 | potential zinc ring finger protein |
| SEQ ID NO: 4373 | Nga00424.01 | 745.64 | 614.04 | ---NA--- |
| SEQ ID NO: 4374 | Nga00416 | 1058.60 | 1189.17 | regulator of nonsense |
| SEQ ID NO: 4375 | Nga00426.1 | 1419.72 | 1439.10 | ---NA--- |
| SEQ ID NO: 4376 | Nga00414 | 1534.76 | 1211.72 | uncharacterized protein |
| SEQ ID NO: 4377 | Nga00412.01 | 1750.00 | 1613.68 | hsp12 variant c |
| SEQ ID NO: 4378 | Nga00427 | 709.52 | 593.20 | ---NA--- |
| SEQ ID NO: 4379 | Nga20881 | 546.32 | 601.41 | cerebion |
| SEQ ID NO: 4380 | Nga00420 | 576.55 | 556.48 | peptide chain release factor 3 |
| SEQ ID NO: 4381 | Nga00411.01 | 482.54 | 523.47 | werner syndrome atp-dependent helicase |
| SEQ ID NO: 4382 | Nga20806 | 2332.13 | 2153.72 | zinc finger family protein |
| SEQ ID NO: 4383 | Nga20973 | 2628.27 | 2906.41 | epidermal retinol dehydrogenase 2-like |
| SEQ ID NO: 4384 | Nga00422 | 5301.78 | 5447.64 | 40s ribosomal protein s6 |
| SEQ ID NO: 4385 | Nga00409.01 | 677.72 | 774.35 | protein |
| SEQ ID NO: 4386 | Nga00413 | 1640.72 | 1670.37 | ---NA--- |
| SEQ ID NO: 4387 | Nga00425.01 | 135.47 | 105.18 | ---NA--- |
| SEQ ID NO: 4388 | Nga20006.1 | 310.25 | 339.07 | trafficking protein particle complex subunit 2-like protein |
| SEQ ID NO: 4389 | Nga20233.1 | 404.29 | 389.50 | protein |
| SEQ ID NO: 4390 | Nga03468.1 | 2891.09 | 2994.98 | small nuclear ribonucleoprotein sm d1 |
| SEQ ID NO: 4391 | Nga03467.1 | 1522.52 | 1537.00 | alpha-actinin |
| SEQ ID NO: 4392 | Nga03473.01 | 106.80 | 59.60 | ---NA--- |
| SEQ ID NO: 4393 | Nga03471 | 133.69 | 193.48 | ---NA--- |
| SEQ ID NO: 4394 | Nga03465.01 | 386.41 | 365.68 | protein |
| SEQ ID NO: 4395 | Nga03463 | 900.83 | 971.74 | protein |
| SEQ ID NO: 4396 | Nga03464 | 1042.75 | 1005.51 | protein |
| SEQ ID NO: 4397 | Nga20702 | 174.11 | 169.26 | protein |
| SEQ ID NO: 4398 | Nga03466 | 334.64 | 374.53 | plasma glutamate carboxypeptidase |
| SEQ ID NO: 4399 | Nga03472 | 826.67 | 730.58 | molybdenum cofactor sulfurase |
| SEQ ID NO: 4400 | Nga20274.1 | 132.25 | 159.18 | apoptosis-inducing mitochondrion-associated 1 |
| SEQ ID NO: 4401 | Nga03469.1 | 369.78 | 427.31 | fad-dependent pyridine nucleotide-disulphide oxidoreductase |
| SEQ ID NO: 4402 | Nga03470 | 164.07 | 184.16 | mate efflux family protein |
| SEQ ID NO: 4403 | Nga05434 | 232.64 | 246.27 | ---NA--- |
| SEQ ID NO: 4404 | Nga05428.01 | 459.75 | 494.95 | aminotransferase class i and ii |
| SEQ ID NO: 4405 | Nga05436 | 11618.52 | 12300.72 | 40s ribosomal protein s28 |
| SEQ ID NO: 4406 | Nga20121.1 | 450.83 | 415.57 | oxidoreductase |
| SEQ ID NO: 4407 | Nga20193.1 | 334.91 | 301.25 | gtp-binding protein 1 |
| SEQ ID NO: 4408 | Nga05435 | 90.49 | 95.55 | nol1 nop2 sun domain member 5-like |
| SEQ ID NO: 4409 | Nga05437 | 153.65 | 180.54 | gtp-binding protein 2 |
| SEQ ID NO: 4410 | Nga05429 | 541.34 | 651.25 | trna uridine 5-carboxymethylaminomethyl modification enzyme |
| SEQ ID NO: 4411 | Nga05431 | 489.38 | 569.05 | protein |
| SEQ ID NO: 4412 | Nga05432 | 966.40 | 1017.72 | dna rna helicase |
| SEQ ID NO: 4413 | Nga05427 | 486.71 | 476.27 | transcription initiation factor tfiid subunit 13 |
| SEQ ID NO: 4414 | Nga05430 | 1323.53 | 1158.69 | transferase-like protein |
| SEQ ID NO: 4415 | Nga05433 | 729.61 | 1246.63 | phosphatidylinositol 3-and 4-kinase family protein |
| SEQ ID NO: 4416 | Nga05773.1 | 490.27 | 531.73 | cystathionine gamma-synthase |
| SEQ ID NO: 4417 | Nga05778 | 221.46 | 295.54 | conserved hypothetical protein [Albugo laibachii Nc14] |
| SEQ ID NO: 4418 | Nga20968.1 | 333.78 | 290.13 | dna methyltransferase 1-associated protein 1 |
| SEQ ID NO: 4419 | Nga05774.1 | 266.18 | 279.07 | protein |
| SEQ ID NO: 4420 | Nga04323.02 | 677.91 | 672.84 | cation diffusion facilitator family |
| SEQ ID NO: 4421 | Nga05776 | 834.76 | 1014.57 | aldehyde dehydrogenase |
| SEQ ID NO: 4422 | Nga04909.02 | 769.63 | 764.50 | nudix hydrolase |
| SEQ ID NO: 4423 | Nga04908.02 | 6196.84 | 5891.65 | sugar nucleotide epimerase |
| SEQ ID NO: 4424 | Nga04786.02 | 69.89 | 75.71 | ---NA--- |
| SEQ ID NO: 4425 | Nga05775.1 | 126.41 | 162.74 | rep helicase |
| SEQ ID NO: 4426 | Nga21302.1 | 526.74 | 512.65 | protein |
| SEQ ID NO: 4427 | Nga21093 | 138.78 | 97.27 | glucose-methanol-choline oxidoreductase |
| SEQ ID NO: 4428 | Nga21305 | 127.43 | 191.85 | glucose-methanol-choline oxidoreductase |
| SEQ ID NO: 4429 | Nga04299.02 | 10843.09 | 11728.31 | 40s ribosomal protein |

FIGURE 24 BR

| # | Nga model | +N rpkb | -N rpkb | GO |
|---|---|---|---|---|
| SEQ ID NO: 4430 | Nga21262 | 183.27 | 211.47 | chloride channel protein |
| SEQ ID NO: 4431 | Nga04301.02 | 421.84 | 328.82 | udp-n-acetylglucosamine transporter |
| SEQ ID NO: 4432 | Nga20502 | 115.27 | 115.50 | chloride channel protein |
| SEQ ID NO: 4433 | Nga21098 | 366.91 | 293.21 | cyclase dehydrase |
| SEQ ID NO: 4434 | Nga05113 | 93.48 | 98.90 | chloride channel |
| SEQ ID NO: 4435 | Nga04300.02 | 4487.61 | 4325.42 | conserved hypothetical protein [Phytophthora infestans T30-4] |
| SEQ ID NO: 4436 | Nga05110 | 177.26 | 222.47 | kynurenine-oxoglutarate transaminase |
| SEQ ID NO: 4437 | Nga04404.02 | 605.65 | 741.74 | alpha beta hydrolase fold-3 domain protein |
| SEQ ID NO: 4438 | Nga05114 | 189.72 | 256.89 | ---NA--- |
| SEQ ID NO: 4439 | Nga04403.02 | 6167.72 | 5668.70 | conserved unknown protein [Ectocarpus siliculosus] |
| SEQ ID NO: 4440 | Nga05106 | 330.77 | 385.93 | hypothetical protein LEPBi_I1092 [Leptospira biflexa serovar Patoc strain 'Patoc 1 (Paris)'] |
| SEQ ID NO: 4441 | Nga05105.1 | 914.78 | 737.06 | ---NA--- |
| SEQ ID NO: 4442 | Nga05107 | 156.93 | 100.15 | n-alpha-acetyltransferase catalytic subunit |
| SEQ ID NO: 4443 | Nga05111 | 185.93 | 126.29 | conserved unknown protein [Ectocarpus siliculosus] |
| SEQ ID NO: 4444 | Nga05126 | 399.22 | 372.03 | myo-inositol monophosphatase 1 |
| SEQ ID NO: 4445 | Nga01091.02 | 876.21 | 843.98 | ---NA--- |
| SEQ ID NO: 4446 | Nga01342.02 | 7.94 | 30.09 | urease accessory protein ured |
| SEQ ID NO: 4447 | Nga05127 | 53.65 | 42.87 | protein |
| SEQ ID NO: 4448 | Nga05130 | 1046.38 | 985.70 | methyltransferase type 11 |
| SEQ ID NO: 4449 | Nga20004.1 | 185.85 | 183.29 | cwf19-like protein 1-like |
| SEQ ID NO: 4450 | Nga02425.02 | 694.25 | 646.58 | er lumen protein retaining receptor |
| SEQ ID NO: 4451 | Nga05143 | 1353.40 | 1646.58 | hypothetical protein CHLNCDRAFT_49994 [Chlorella variabilis] |
| SEQ ID NO: 4452 | Nga02423.2 | 477.62 | 861.12 | methylenetetrahydrofolate dehydrogenase |
| SEQ ID NO: 4453 | Nga04766.02 | 235.09 | 237.81 | 2-dehydropantoate 2-reductase |
| SEQ ID NO: 4454 | Nga04767.02 | 387.65 | 415.88 | ---NA--- |
| SEQ ID NO: 4455 | Nga20746 | 207.37 | 189.69 | ---NA--- |
| SEQ ID NO: 4456 | Nga05141 | 4366.45 | 3933.67 | plastid transcriptionally active 4 |
| SEQ ID NO: 4457 | Nga02146.2 | 1490.27 | 2171.59 | cysteine desulfurase |
| SEQ ID NO: 4458 | Nga06064 | 1678.05 | 192.34 | protein |
| SEQ ID NO: 4459 | Nga06065 | 824.32 | 607.47 | nad-dependent epimerase dehydratase family protein |
| SEQ ID NO: 4460 | Nga06069 | 197.22 | 72.22 | protein |
| SEQ ID NO: 4461 | Nga06066 | 339.36 | 340.75 | sphingosine-1-phosphate lyase |
| SEQ ID NO: 4462 | Nga06068.1 | 668.74 | 647.92 | ---NA--- |
| SEQ ID NO: 4463 | Nga06070 | 74.73 | 115.65 | nonsense-mediated mrna decay protein |
| SEQ ID NO: 4464 | Nga06067 | 774.94 | 1146.49 | 3-hydroxyisobutyrate dehydrogenase |
| SEQ ID NO: 4465 | Nga06471 | 6546.79 | 6513.89 | ---NA--- |
| SEQ ID NO: 4466 | Nga06473 | 519.48 | 539.27 | protein |
| SEQ ID NO: 4467 | Nga06470 | 408.66 | 467.06 | ---NA--- |
| SEQ ID NO: 4468 | Nga04013.2 | 410.44 | 447.00 | conserved hypothetical protein [Phytophthora infestans T30-4] |
| SEQ ID NO: 4469 | Nga06595 | 378.47 | 425.02 | ---NA--- |
| SEQ ID NO: 4470 | Nga20074.1 | 1108.25 | 1092.17 | hypothetical protein CHLNCDRAFT_136236 [Chlorella variabilis] |
| SEQ ID NO: 4471 | Nga06591 | 709.87 | 546.67 | amidase |
| SEQ ID NO: 4472 | Nga06594 | 289.70 | 301.99 | protein |
| SEQ ID NO: 4473 | Nga06596 | 547.04 | 411.40 | ---NA--- |
| SEQ ID NO: 4474 | Nga00042.02 | 832.16 | 913.49 | dna replication licensing factor mcm9 |
| SEQ ID NO: 4475 | Nga00043.02 | 365.38 | 399.82 | myosin light chain kinase |
| SEQ ID NO: 4476 | Nga06254 | 1104.17 | 1431.27 | sorting nexin-16-like |
| SEQ ID NO: 4477 | Nga01897.02 | 683.24 | 641.17 | yip1 domain-containing protein |
| SEQ ID NO: 4478 | Nga20112 | 494.72 | 530.40 | transcription initiation factor subunit taf1 |
| SEQ ID NO: 4479 | Nga06253 | 51.48 | 78.61 | conserved unknown protein [Ectocarpus siliculosus] |
| SEQ ID NO: 4480 | Nga20231.1 | 190.92 | 226.82 | tbc1 domain family member 23-like |
| SEQ ID NO: 4481 | Nga04988.02 | 75.51 | 103.10 | translation elongation factor g |
| SEQ ID NO: 4482 | Nga06274 | 3964.88 | 3658.18 | ---NA--- |
| SEQ ID NO: 4483 | Nga06278 | 1836.55 | 1524.71 | choline dehydrogenase |
| SEQ ID NO: 4484 | Nga06276.01 | 757.34 | 708.32 | coiled-coil domain-containing protein 124 |
| SEQ ID NO: 4485 | Nga06279 | 5742.72 | 6029.65 | protein |
| SEQ ID NO: 4486 | Nga21217.1 | 81.08 | 66.92 | atp synthase alpha subunit |
| SEQ ID NO: 4487 | Nga06275.01 | 1840.26 | 1797.89 | protein rer1a |
| SEQ ID NO: 4488 | Nga06277 | 192.05 | 277.38 | u3 small nucleolar rna-associated |
| SEQ ID NO: 4489 | Nga06439 | 641.27 | 626.94 | ---NA--- |
| SEQ ID NO: 4490 | Nga06440 | 1500.00 | 1348.22 | protein prune homolog |
| SEQ ID NO: 4491 | Nga06444 | 368.75 | 426.52 | s-adenosylmethionine carrier 1 |
| SEQ ID NO: 4492 | Nga06443 | 1355.93 | 1356.59 | ---NA--- |

FIGURE 24 BS

| # | Nga model | +N rpkb | -N rpkb | GO |
|---|---|---|---|---|
| SEQ ID NO: 4493 | Nga06441 | 1895.96 | 2273.77 | protein |
| SEQ ID NO: 4494 | Nga06442 | 847.27 | 917.16 | topoisomerase 6 subunit a |
| SEQ ID NO: 4495 | Nga06446 | 1223.10 | 1075.87 | protein |
| SEQ ID NO: 4496 | Nga06445 | 862.99 | 860.61 | cg6554 |
| SEQ ID NO: 4497 | Nga01313 | 273.58 | 284.43 | ---NA--- |
| SEQ ID NO: 4498 | Nga01311 | 8863.72 | 10690.35 | protein kinase |
| SEQ ID NO: 4499 | Nga01310.01 | 1417.46 | 1344.22 | mfs transporter |
| SEQ ID NO: 4500 | Nga01312 | 1972.04 | 2248.00 | protein |
| SEQ ID NO: 4501 | Nga00798 | 174.16 | 178.29 | protein |
| SEQ ID NO: 4502 | Nga00800.01 | 375.00 | 371.91 | metal ion transporter family |
| SEQ ID NO: 4503 | Nga00799 | 348.12 | 409.85 | trans- -dihydrobenzene- -diol dehydrogenase |
| SEQ ID NO: 4504 | Nga00801 | 154.42 | 162.14 | serine threonine protein kinase |
| SEQ ID NO: 4505 | Nga01159 | 475.41 | 510.54 | carbohydrate kinase |
| SEQ ID NO: 4506 | Nga01161.01 | 1189.84 | 1233.82 | protein |
| SEQ ID NO: 4507 | Nga01162.01 | 958.11 | 808.97 | ---NA--- |
| SEQ ID NO: 4508 | Nga01158.01 | 874.80 | 1073.42 | dihydroorotate dehydrogenase |
| SEQ ID NO: 4509 | Nga01160.01 | 45.20 | 57.53 | ---NA--- |
| SEQ ID NO: 4510 | Nga01157.01 | 962.03 | 991.06 | ---NA--- |
| SEQ ID NO: 4511 | Nga01530.01 | 735.04 | 701.58 | tpr repeat-containing protein |
| SEQ ID NO: 4512 | Nga01528 | 567.63 | 753.30 | protein |
| SEQ ID NO: 4513 | Nga01529 | 992.28 | 949.40 | predicted protein [Phaeodactylum tricornutum CCAP 1055/1] |
| SEQ ID NO: 4514 | Nga20244 | 417.46 | 361.08 | ribosomal large subunit pseudouridine synthase a |
| SEQ ID NO: 4515 | Nga01531 | 122.58 | 142.94 | protein |
| SEQ ID NO: 4516 | Nga01526 | 713.66 | 542.80 | probable ubiquinone menaquinone biosynthesis methyltransferase |
| SEQ ID NO: 4517 | Nga01527 | 5342.92 | 5794.00 | transporter component |
| SEQ ID NO: 4518 | Nga01195 | 802.88 | 763.43 | ---NA--- |
| SEQ ID NO: 4519 | Nga01196.01 | 576.98 | 703.95 | cop9 signalosome complex subunit 2 |
| SEQ ID NO: 4520 | Nga02128.2 | 271.83 | 466.39 | ---NA--- |
| SEQ ID NO: 4521 | Nga01132 | 3546.71 | 3590.54 | cold-inducible rna-binding protein |
| SEQ ID NO: 4522 | Nga01139 | 100.36 | 89.30 | phosphatidylinositol 3-kinase vps34 |
| SEQ ID NO: 4523 | Nga01136 | 147.26 | 127.61 | phosphatidylinositol 3- |
| SEQ ID NO: 4524 | Nga01133 | 284.97 | 314.35 | pre-rrna-processing protein esf2 |
| SEQ ID NO: 4525 | Nga20418 | 385.21 | 402.25 | dienoyl- reductase |
| SEQ ID NO: 4526 | Nga01135 | 391.26 | 368.39 | dienoyl- reductase |
| SEQ ID NO: 4527 | Nga01268.01 | 330.48 | 253.83 | protein |
| SEQ ID NO: 4528 | Nga01271 | 806.70 | 798.89 | ---NA--- |
| SEQ ID NO: 4529 | Nga01270 | 954.00 | 922.69 | dna-directed rna polymerase ii subunit rpb11-a |
| SEQ ID NO: 4530 | Nga01269 | 464.29 | 499.35 | esterase lipase thioesterase family protein |
| SEQ ID NO: 4531 | Nga01267 | 217.68 | 243.85 | ras-related gtp binding c |
| SEQ ID NO: 4532 | Nga01272.01 | 459.99 | 547.59 | trehalose-6-phosphate synthase |
| SEQ ID NO: 4533 | Nga00581.02 | 395.78 | 432.88 | dna polymerase v family |
| SEQ ID NO: 4534 | Nga00757.1 | 503.26 | 513.37 | protein |
| SEQ ID NO: 4535 | Nga00754 | 771.63 | 874.00 | 50s ribosomal protein l1 |
| SEQ ID NO: 4536 | Nga00752 | 1885.25 | 2756.29 | bifunctional purine biosynthesis |
| SEQ ID NO: 4537 | Nga00758 | 51.80 | 35.29 | lamin-b receptor |
| SEQ ID NO: 4538 | Nga00756 | 653.85 | 626.51 | translocase of inner mitochondrial membrane 50 homolog |
| SEQ ID NO: 4539 | Nga00753.01 | 204.06 | 232.04 | diacylglycerol acyltransferase family protein |
| SEQ ID NO: 4540 | Nga00840.01 | 285.71 | 424.31 | ---NA--- |
| SEQ ID NO: 4541 | Nga00839 | 119.62 | 129.57 | ---NA--- |
| SEQ ID NO: 4542 | Nga20551 | 516.34 | 463.74 | clathrin-adaptor gamma chain |
| SEQ ID NO: 4543 | Nga00837 | 798.26 | 812.88 | atp dependent rna helicase |
| SEQ ID NO: 4544 | Nga00836 | 4880.46 | 5754.68 | mitochondrial-processing peptidase subunit beta |
| SEQ ID NO: 4545 | Nga00864.02 | 471.93 | 552.11 | ---NA--- |
| SEQ ID NO: 4546 | Nga01493.01 | 10521.37 | 10349.58 | triosephosphate isomerase |
| SEQ ID NO: 4547 | Nga01495 | 7157.23 | 6952.45 | ---NA--- |
| SEQ ID NO: 4548 | Nga01494 | 279.75 | 281.39 | ---NA--- |
| SEQ ID NO: 4549 | Nga00863.02 | 442.76 | 488.39 | deoxyhypusine hydroxylase monooxygenase |
| SEQ ID NO: 4550 | Nga00865.02 | 668.39 | 480.81 | expressed unknown protein [Ectocarpus siliculosus] |
| SEQ ID NO: 4551 | Nga01110 | 184.47 | 131.46 | ---NA--- |
| SEQ ID NO: 4552 | Nga01109.01 | 824.94 | 859.83 | ---NA--- |
| SEQ ID NO: 4553 | Nga01112.01 | 117.65 | 180.54 | ---NA--- |
| SEQ ID NO: 4554 | Nga01111.01 | 72.07 | 78.07 | ---NA--- |
| SEQ ID NO: 4555 | Nga01046.01 | 367.31 | 362.31 | aspartate aminotransferase |
| SEQ ID NO: 4556 | Nga01048 | 594.70 | 581.83 | histone deacetylase 1 |

FIGURE 24 BT

| # | Nga model | +N rpkb | -N rpkb | GO |
|---|---|---|---|---|
| SEQ ID NO: 4557 | Nga21294 | 426.01 | 398.43 | lysophospholipase-like 1 |
| SEQ ID NO: 4558 | Nga01047 | 4088.63 | 4213.50 | ---NA--- |
| SEQ ID NO: 4559 | Nga01049 | 149.56 | 181.00 | PREDICTED: hypothetical protein LOC100637372 [Amphimedon queenslandica] |
| SEQ ID NO: 4560 | Nga01514.01 | 213.68 | 291.64 | ---NA--- |
| SEQ ID NO: 4561 | Nga20240.1 | 115.03 | 109.65 | cleavage and polyadenylation specificity factor subunit 2 |
| SEQ ID NO: 4562 | Nga20472.1 | 106.38 | 98.78 | cleavage and polyadenylation specificity factor subunit 2 |
| SEQ ID NO: 4563 | Nga01511.1 | 643.74 | 700.01 | arginine biosynthesis bifunctional protein |
| SEQ ID NO: 4564 | Nga01513 | 7359.91 | 7656.66 | ---NA--- |
| SEQ ID NO: 4565 | Nga01512 | 566.41 | 496.51 | dna repair protein |
| SEQ ID NO: 4566 | Nga01482 | 442.07 | 548.38 | aspartate-semialdehyde dehydrogenase |
| SEQ ID NO: 4567 | Nga01484.01 | 310.61 | 434.34 | mitochondrial phosphate carrier protein 2 |
| SEQ ID NO: 4568 | Nga01483 | 1662.75 | 1524.87 | at4g01940 t7b11_20 |
| SEQ ID NO: 4569 | Nga01481 | 1622.23 | 1683.48 | peptidase u34 dipeptidase |
| SEQ ID NO: 4570 | Nga06985.2 | 125.91 | 156.01 | protein |
| SEQ ID NO: 4571 | Nga04167 | 206.67 | 173.32 | ---NA--- |
| SEQ ID NO: 4572 | Nga04168.01 | 1071.70 | 1663.34 | protein |
| SEQ ID NO: 4573 | Nga04164 | 1052.82 | 954.10 | alanine aminotransferase |
| SEQ ID NO: 4574 | Nga04165 | 220.04 | 217.12 | magnesium and cobalt transport protein |
| SEQ ID NO: 4575 | Nga04169 | 164.86 | 133.44 | coenzyme q10 homolog a |
| SEQ ID NO: 4576 | Nga03958.01 | 971.34 | 986.64 | ---NA--- |
| SEQ ID NO: 4577 | Nga03957 | 950.78 | 1078.56 | monoglyceride lipase |
| SEQ ID NO: 4578 | Nga03959 | 812.23 | 676.44 | domain protein dehydratase |
| SEQ ID NO: 4579 | Nga03960 | 12.39 | 32.22 | protein |
| SEQ ID NO: 4580 | Nga20517 | 396.40 | 513.04 | sorting and assembly machinery 35kda protein |
| SEQ ID NO: 4581 | Nga20545 | 546.01 | 568.20 | ---NA--- |
| SEQ ID NO: 4582 | Nga03504 | 1283.17 | 1202.42 | thioredoxin |
| SEQ ID NO: 4583 | Nga03538 | 1608.68 | 1943.41 | ---NA--- |
| SEQ ID NO: 4584 | Nga03540 | 440.77 | 542.36 | ---NA--- |
| SEQ ID NO: 4585 | Nga03539 | 252.70 | 218.35 | conserved unknown protein [Ectocarpus siliculosus] |
| SEQ ID NO: 4586 | Nga04228.01 | 902.97 | 885.89 | expressed unknown protein [Ectocarpus siliculosus] |
| SEQ ID NO: 4587 | Nga04227.01 | 1197.11 | 1442.35 | aaa-type atpase family protein |
| SEQ ID NO: 4588 | Nga04226.01 | 2703.62 | 3063.23 | peroxisomal biogenesis factor 11 domain-containing protein |
| SEQ ID NO: 4589 | Nga21079.1 | 17.86 | 29.02 | ---NA--- |
| SEQ ID NO: 4590 | Nga20524.1 | 29.30 | 75.39 | dna-directed rna polymerase iii largest |
| SEQ ID NO: 4591 | Nga04224.01 | 7724.92 | 8189.01 | hybrid cluster protein |
| SEQ ID NO: 4592 | Nga20726 | 231.98 | 265.93 | ankyrin repeat-containing protein |
| SEQ ID NO: 4593 | Nga04225 | 4987.96 | 2414.19 | low molecular mass early light-inducible protein hv60 |
| SEQ ID NO: 4594 | Nga03919.01 | 883.08 | 870.36 | like protein |
| SEQ ID NO: 4595 | Nga03917.01 | 409.64 | 453.68 | structural maintenance of chromosomes 1 |
| SEQ ID NO: 4596 | Nga03918.1 | 275.02 | 319.44 | structural maintenance of chromosomes 1 |
| SEQ ID NO: 4597 | Nga03916 | 173.43 | 267.81 | structural maintenance of chromosomes 1 |
| SEQ ID NO: 4598 | Nga03915.1 | 268.41 | 229.09 | trypsin family |
| SEQ ID NO: 4599 | Nga20105.1 | 431.43 | 543.90 | protein |
| SEQ ID NO: 4600 | Nga20766.1 | 244.69 | 316.07 | ubiquitin ligase e3 |
| SEQ ID NO: 4601 | Nga20378.1 | 105.94 | 156.75 | conserved unknown protein [Ectocarpus siliculosus] |
| SEQ ID NO: 4602 | Nga03631 | 141.94 | 132.78 | hypothetical protein FIC_00832 [Flavobacteriaceae bacterium 3519-10] |
| SEQ ID NO: 4603 | Nga02426.02 | 2195.59 | 2118.72 | ---NA--- |
| SEQ ID NO: 4604 | Nga21010.1 | 1209.77 | 1048.99 | gag-pol polyprotein |
| SEQ ID NO: 4605 | Nga21011.1 | 964.77 | 1131.99 | copia ltr rider |
| SEQ ID NO: 4606 | Nga21013.1 | 801.39 | 1023.19 | hypothetical protein VITISV_004538 [Vitis vinifera] |
| SEQ ID NO: 4607 | Nga03030.02 | 609.79 | 759.79 | peptidase u34 dipeptidase |
| SEQ ID NO: 4608 | Nga03037.02 | 415.64 | 402.61 | protein |
| SEQ ID NO: 4609 | Nga03041.02 | 422.87 | 487.28 | calcium calmodulin-dependent protein kinase type 1 |
| SEQ ID NO: 4610 | Nga03040.02 | 193.55 | 227.13 | ---NA--- |
| SEQ ID NO: 4611 | Nga03038.02 | 1745.28 | 1917.36 | conserved unknown protein [Ectocarpus siliculosus] |
| SEQ ID NO: 4612 | Nga03935 | 227.47 | 222.52 | glutamyl-trna a subunit |
| SEQ ID NO: 4613 | Nga03033.02 | 251.53 | 367.69 | biotin lipoate protein ligase-like protein |
| SEQ ID NO: 4614 | Nga20830.1 | 373.53 | 270.81 | retrovirus-related pol polyprotein from transposon tnt 1-94 |
| SEQ ID NO: 4615 | Nga03900 | 921.31 | 950.17 | adhesion regulating molecule 1 |
| SEQ ID NO: 4616 | Nga03902 | 209.58 | 168.65 | btb and poz domain-containing |
| SEQ ID NO: 4617 | Nga20849 | 346.85 | 290.17 | binding protein |
| SEQ ID NO: 4618 | Nga03897 | 4605.01 | 3295.67 | ---NA--- |
| SEQ ID NO: 4619 | Nga03903 | 10836.67 | 11262.96 | ribosomal protein l29 |

FIGURE 24 BU

| # | Nga model | +N rpkb | -N rpkb | GO |
|---|---|---|---|---|
| SEQ ID NO: 4620 | Nga03898 | 3971.50 | 4971.87 | 40s ribosomal protein s14 |
| SEQ ID NO: 4621 | Nga03901 | 1042.75 | 1022.53 | protein |
| SEQ ID NO: 4622 | Nga03899 | 1572.27 | 1211.05 | ubiquitin family protein |
| SEQ ID NO: 4623 | Nga01891.02 | 302.97 | 327.04 | protein |
| SEQ ID NO: 4624 | Nga01890.2 | 3082.35 | 4085.34 | ---NA--- |
| SEQ ID NO: 4625 | Nga20820 | 705.83 | 852.92 | l-galactono- -lactone dehydrogenase |
| SEQ ID NO: 4626 | Nga03974 | 1203.34 | 1430.83 | atp-binding cassette sub-family g member 2 |
| SEQ ID NO: 4627 | Nga03973 | 182.72 | 153.43 | protein prenyltransferase alpha subunit repeat-containing protein 1 |
| SEQ ID NO: 4628 | Nga03726 | 859.56 | 816.45 | transitional endoplasmic reticulum atpase |
| SEQ ID NO: 4629 | Nga03728 | 3444.44 | 3364.59 | protein |
| SEQ ID NO: 4630 | Nga03690.2 | 1274.73 | 1353.05 | translation initiation factor if-3 |
| SEQ ID NO: 4631 | Nga04195 | 3906.48 | 3301.03 | glucokinase |
| SEQ ID NO: 4632 | Nga04196 | 2274.73 | 2230.45 | r- vamp71-family |
| SEQ ID NO: 4633 | Nga02087.02 | 1572.41 | 1402.33 | conserved unknown protein [Ectocarpus siliculosus] |
| SEQ ID NO: 4634 | Nga04193 | 726.66 | 905.69 | protein |
| SEQ ID NO: 4635 | Nga03786.01 | 991.10 | 1203.30 | pas pac sensor hybrid histidine kinase |
| SEQ ID NO: 4636 | Nga20140 | 361.77 | 363.09 | protein |
| SEQ ID NO: 4637 | Nga20888 | 180.85 | 233.36 | trna (uracil-5-)-methyltransferase |
| SEQ ID NO: 4638 | Nga03787 | 58.49 | 81.75 | ---NA--- |
| SEQ ID NO: 4639 | Nga03789 | 31.75 | 94.57 | ---NA--- |
| SEQ ID NO: 4640 | Nga03788 | 342.27 | 372.69 | retinoblastoma-binding protein 8 |
| SEQ ID NO: 4641 | Nga03857.1 | 105.93 | 100.30 | 72 kda inositol polyphosphate 5-phosphatase-like |
| SEQ ID NO: 4642 | Nga03856 | 151.69 | 164.11 | dna repair protein rad50 |
| SEQ ID NO: 4643 | Nga03854 | 1672.72 | 1712.55 | conserved hypothetical protein [Albugo laibachii Nc14] |
| SEQ ID NO: 4644 | Nga20238 | 224.43 | 195.15 | phosphoglycerate bisphosphoglycerate mutase family protein |
| SEQ ID NO: 4645 | Nga03855 | 642.32 | 632.90 | ribosome biogenesis gtp-binding protein |
| SEQ ID NO: 4646 | Nga03751.01 | 6433.28 | 6577.36 | 60s ribosomal protein l34 |
| SEQ ID NO: 4647 | Nga04463.2 | 12506.97 | 12153.36 | 60s ribosomal protein l36 |
| SEQ ID NO: 4648 | Nga02335.02 | 1068.17 | 1077.20 | ---NA--- |
| SEQ ID NO: 4649 | Nga02334.02 | 26634.92 | 28408.62 | uncharacterized protein conserved in bacteria with a cystatin-like fold |
| SEQ ID NO: 4650 | Nga03753 | 912.20 | 1017.95 | protein |
| SEQ ID NO: 4651 | Nga20610 | 169.31 | 206.33 | anaphase-promoting complex |
| SEQ ID NO: 4652 | Nga04092 | 733.16 | 661.50 | 26s proteasome non-atpase regulatory subunit 13 |
| SEQ ID NO: 4653 | Nga04094 | 382.94 | 317.02 | ---NA--- |
| SEQ ID NO: 4654 | Nga04095 | 450.39 | 470.97 | ---NA--- |
| SEQ ID NO: 4655 | Nga04091 | 2566.76 | 2362.99 | eukaryotic initiation factor 4a-iii |
| SEQ ID NO: 4656 | Nga04093 | 152.61 | 87.01 | uncharacterized oxidoreductase yrbe-like |
| SEQ ID NO: 4657 | Nga04096 | 70.18 | 66.51 | ---NA--- |
| SEQ ID NO: 4658 | Nga20465.1 | 166.67 | 151.00 | ---NA--- |
| SEQ ID NO: 4659 | Nga03672.1 | 490.32 | 412.33 | adenosine kinase |
| SEQ ID NO: 4660 | Nga03490.02 | 855.72 | 986.23 | dynein light chain roadblock-type 1-like |
| SEQ ID NO: 4661 | Nga03476.02 | 3646.76 | 2977.17 | predicted protein [Phaeodactylum tricornutum CCAP 1055/1] |
| SEQ ID NO: 4662 | Nga03675 | 208.99 | 283.70 | protein |
| SEQ ID NO: 4663 | Nga04020.01 | 723.88 | 825.90 | short chain dehydrogenase reductase family |
| SEQ ID NO: 4664 | Nga02443.02 | 1509.80 | 2050.77 | ---NA--- |
| SEQ ID NO: 4665 | Nga04021 | 917.79 | 759.14 | nitric oxide synthase interacting protein |
| SEQ ID NO: 4666 | Nga01853 | 118.42 | 114.02 | ---NA--- |
| SEQ ID NO: 4667 | Nga01854 | 832.67 | 958.07 | protein |
| SEQ ID NO: 4668 | Nga01852.1 | 640.29 | 945.30 | nli interacting factor family protein |
| SEQ ID NO: 4669 | Nga01775 | 487.72 | 432.03 | protein |
| SEQ ID NO: 4670 | Nga01774 | 83.13 | 70.63 | dash family |
| SEQ ID NO: 4671 | Nga01776 | 872.69 | 769.80 | transmembrane protein |
| SEQ ID NO: 4672 | Nga20172 | 356.19 | 251.82 | pleckstriny domain-containing expressed |
| SEQ ID NO: 4673 | Nga01762.01 | 101.10 | 76.18 | ---NA--- |
| SEQ ID NO: 4674 | Nga01760 | 494.68 | 476.32 | ---NA--- |
| SEQ ID NO: 4675 | Nga01761.01 | 3718.91 | 3827.70 | enoyl- hydratase isomerase |
| SEQ ID NO: 4676 | Nga01759.01 | 1722.32 | 1588.87 | hypersensitive-induced response protein |
| SEQ ID NO: 4677 | Nga01763 | 792.11 | 893.49 | ---NA--- |
| SEQ ID NO: 4678 | Nga01758 | 416.95 | 436.25 | nuclear distribution protein |
| SEQ ID NO: 4679 | Nga01858 | 1650.13 | 1445.25 | ubiquitin-conjugating enzyme |
| SEQ ID NO: 4680 | Nga21281 | 973.57 | 722.95 | lung cancer oncogene 5 |
| SEQ ID NO: 4681 | Nga01857 | 504.96 | 548.06 | ribosomal rna methyltransferase |
| SEQ ID NO: 4682 | Nga01859 | 114.29 | 145.90 | gtpase activating protein |
| SEQ ID NO: 4683 | Nga20461 | 85.31 | 92.41 | mon1 homolog a |

FIGURE 24 BV

| # | Nga model | +N rpkb | -N rpkb | GO |
|---|---|---|---|---|
| SEQ ID NO: 4684 | Nga01856 | 326.39 | 388.85 | taz1-interacting factor 1 |
| SEQ ID NO: 4685 | Nga02002.1 | 273.62 | 277.56 | sorting nexin 1 |
| SEQ ID NO: 4686 | Nga02000 | 2244.35 | 2721.04 | ion channel |
| SEQ ID NO: 4687 | Nga01603.02 | 228.78 | 321.85 | ---NA--- |
| SEQ ID NO: 4688 | Nga02163 | 136.70 | 135.55 | fip1 motif protein family protein |
| SEQ ID NO: 4689 | Nga02161 | 222.81 | 213.58 | 2og-fe oxygenase |
| SEQ ID NO: 4690 | Nga02162 | 1247.47 | 1654.94 | predicted protein [Phaeodactylum tricornutum CCAP 1055/1] |
| SEQ ID NO: 4691 | Nga02164 | 230.48 | 261.05 | protein |
| SEQ ID NO: 4692 | Nga20269 | 143.08 | 163.60 | likely protein kinase endoribonuclease ire1 |
| SEQ ID NO: 4693 | Nga02175 | 141.55 | 165.89 | ---NA--- |
| SEQ ID NO: 4694 | Nga02197.1 | 43.30 | 47.78 | dmt superfamily drug metabolite transporter |
| SEQ ID NO: 4695 | Nga02196.01 | 1176.23 | 1143.45 | ---NA--- |
| SEQ ID NO: 4696 | Nga01670.01 | 29.53 | 27.12 | ---NA--- |
| SEQ ID NO: 4697 | Nga01671.01 | 508.33 | 559.67 | ---NA--- |
| SEQ ID NO: 4698 | Nga01739 | 409.52 | 486.25 | ---NA--- |
| SEQ ID NO: 4699 | Nga01738 | 791.79 | 815.63 | multidrug resistance protein |
| SEQ ID NO: 4700 | Nga01737 | 1210.26 | 992.50 | protein |
| SEQ ID NO: 4701 | Nga02053.1 | 2867.55 | 3311.40 | ---NA--- |
| SEQ ID NO: 4702 | Nga02055.01 | 56.06 | 65.65 | cathepsin l-like proteinase |
| SEQ ID NO: 4703 | Nga03603.2 | 1104.20 | 1236.36 | lipase class 3 |
| SEQ ID NO: 4704 | Nga02056 | 42.32 | 56.52 | hi0933 family protein |
| SEQ ID NO: 4705 | Nga02052.01 | 8390.19 | 12092.74 | ---NA--- |
| SEQ ID NO: 4706 | Nga01675.01 | 238.79 | 327.29 | ---NA--- |
| SEQ ID NO: 4707 | Nga01674 | 637.41 | 737.12 | dep domain containing 5 |
| SEQ ID NO: 4708 | Nga01676 | 27.27 | 49.24 | ---NA--- |
| SEQ ID NO: 4709 | Nga21017.1 | 312.18 | 316.17 | nad-dependent epimerase dehydratase |
| SEQ ID NO: 4710 | Nga01711 | 606.55 | 639.05 | cbl-interacting serine threonine-protein kinase 9 |
| SEQ ID NO: 4711 | Nga01710 | 825.19 | 870.96 | 3-ketoacyl- thiolase peroxisomal |
| SEQ ID NO: 4712 | Nga02135 | 457.26 | 536.22 | single-stranded dna-binding protein |
| SEQ ID NO: 4713 | Nga20200.1 | 661.93 | 594.95 | zn-binding protein |
| SEQ ID NO: 4714 | Nga05031.2 | 529.19 | 471.59 | conserved unknown protein [Ectocarpus siliculosus] |
| SEQ ID NO: 4715 | Nga00238.02 | 4637.01 | 3068.52 | ---NA--- |
| SEQ ID NO: 4716 | Nga00242.2 | 4126.60 | 2518.87 | ---NA--- |
| SEQ ID NO: 4717 | Nga00249.02 | 2197.10 | 1291.92 | ---NA--- |
| SEQ ID NO: 4718 | Nga00243.02 | 5108.95 | 1993.66 | ---NA--- |
| SEQ ID NO: 4719 | Nga04370.2 | 676.10 | 700.21 | peroxisomal acyl-coenzyme a |
| SEQ ID NO: 4720 | Nga02326 | 1515.15 | 1586.55 | spliceosomal protein |
| SEQ ID NO: 4721 | Nga01799.02 | 279.35 | 276.29 | nuclear receptor 2c2-associated protein |
| SEQ ID NO: 4722 | Nga01797.02 | 530.68 | 593.47 | serine threonine-protein kinase 4 |
| SEQ ID NO: 4723 | Nga01798.02 | 636.52 | 572.53 | ---NA--- |
| SEQ ID NO: 4724 | Nga02041 | 157.45 | 446.20 | hypothetical protein F82170_06015 [Maribacter sp. HTCC2170] |
| SEQ ID NO: 4725 | Nga02039 | 2390.75 | 5095.11 | ---NA--- |
| SEQ ID NO: 4726 | Nga02040 | 223.71 | 142.98 | ribonucleoside-diphosphate reductase |
| SEQ ID NO: 4727 | Nga02413 | 609.36 | 694.77 | protein |
| SEQ ID NO: 4728 | Nga20385 | 243.84 | 261.47 | cryptic tubulin |
| SEQ ID NO: 4729 | Nga21135 | 105.11 | 152.89 | beta-tubulin |
| SEQ ID NO: 4730 | Nga02412.1 | 517.93 | 535.71 | argonaute 1 |
| SEQ ID NO: 4731 | Nga04862 | 138.89 | 140.42 | ---NA--- |
| SEQ ID NO: 4732 | Nga04859 | 112.40 | 172.14 | ---NA--- |
| SEQ ID NO: 4733 | Nga04860 | 137.31 | 156.83 | phosphorylated ctd-interacting |
| SEQ ID NO: 4734 | Nga04861 | 176.64 | 288.55 | ---NA--- |
| SEQ ID NO: 4735 | Nga21129 | 370.02 | 287.77 | cbs domain multi-pass transmembrane |
| SEQ ID NO: 4736 | Nga05035 | 112.34 | 104.73 | protein |
| SEQ ID NO: 4737 | Nga05036.01 | 303.62 | 307.90 | ---NA--- |
| SEQ ID NO: 4738 | Nga04269.01 | 42.42 | 52.52 | kinesin-like protein |
| SEQ ID NO: 4739 | Nga04268 | 273.33 | 306.14 | conserved hypothetical protein [Albugo laibachii Nc14] |
| SEQ ID NO: 4740 | Nga04917 | 260.14 | 224.92 | ---NA--- |
| SEQ ID NO: 4741 | Nga04916 | 342.26 | 347.11 | ---NA--- |
| SEQ ID NO: 4742 | Nga04918 | 2397.29 | 2310.37 | ---NA--- |
| SEQ ID NO: 4743 | Nga05019 | 689.52 | 689.48 | u3 small nucleolar rna-associated protein 10 and nuc211 domain-containing protein |
| SEQ ID NO: 4744 | Nga20083 | 214.62 | 166.78 | conserved unknown protein [Ectocarpus siliculosus] |
| SEQ ID NO: 4745 | Nga04608.01 | 2033.00 | 1573.72 | protein |
| SEQ ID NO: 4746 | Nga04609.1 | 635.63 | 716.60 | ---NA--- |

FIGURE 24 BW

| # | Nga model | +N rpkb | -N rpkb | GO |
|---|---|---|---|---|
| SEQ ID NO: 4747 | Nga04639 | 116.75 | 148.46 | ---NA--- |
| SEQ ID NO: 4748 | Nga04637 | 1771.46 | 1571.64 | protein |
| SEQ ID NO: 4749 | Nga04638 | 389.75 | 351.47 | permease (major facilitator superfamily) |
| SEQ ID NO: 4750 | Nga04636 | 852.86 | 888.25 | ---NA--- |
| SEQ ID NO: 4751 | Nga04541 | 161.23 | 135.14 | adenylate kinase |
| SEQ ID NO: 4752 | Nga04542 | 40.74 | 41.72 | mitogen-activated protein kinase 2 |
| SEQ ID NO: 4753 | Nga03737.02 | 99.17 | 102.95 | ---NA--- |
| SEQ ID NO: 4754 | Nga04528 | 156.23 | 95.14 | dna primase small subunit |
| SEQ ID NO: 4755 | Nga04526 | 2913.15 | 2981.01 | fructosamine 3 kinase |
| SEQ ID NO: 4756 | Nga04527 | 270.24 | 270.81 | cyclin-dependent kinase 10 |
| SEQ ID NO: 4757 | Nga21218 | 346.56 | 429.85 | protein phosphatase |
| SEQ ID NO: 4758 | Nga04445 | 676.64 | 729.13 | platelet glycoprotein 4 |
| SEQ ID NO: 4759 | Nga04444 | 5514.61 | 8756.03 | phosphate dikinase |
| SEQ ID NO: 4760 | Nga04546.1 | 609.28 | 509.25 | tetratricopeptide repeat domain protein |
| SEQ ID NO: 4761 | Nga03594.02 | 586.49 | 374.75 | protein |
| SEQ ID NO: 4762 | Nga20538.1 | 195.09 | 227.58 | ---NA--- |
| SEQ ID NO: 4763 | Nga02043.02 | 344.34 | 345.90 | protein phosphatase 1a isoform 2 |
| SEQ ID NO: 4764 | Nga05000 | 234.35 | 296.48 | histone deacetylase |
| SEQ ID NO: 4765 | Nga04408.1 | 740.35 | 847.58 | ribosome biogenesis protein brx1 homolog |
| SEQ ID NO: 4766 | Nga03704.2 | 92.90 | 119.57 | ---NA--- |
| SEQ ID NO: 4767 | Nga20624.1 | 58.82 | 95.58 | ---NA--- |
| SEQ ID NO: 4768 | Nga21047.1 | 63.83 | 51.86 | ---NA--- |
| SEQ ID NO: 4769 | Nga21056.1 | 42.74 | 74.07 | ---NA--- |
| SEQ ID NO: 4770 | Nga20623 | 1184.96 | 1008.30 | protein |
| SEQ ID NO: 4771 | Nga04592 | 1082.87 | 987.48 | protein |
| SEQ ID NO: 4772 | Nga04762.01 | 191.69 | 140.79 | ---NA--- |
| SEQ ID NO: 4773 | Nga04763.01 | 1319.20 | 1103.65 | ---NA--- |
| SEQ ID NO: 4774 | Nga07095.2 | 625.00 | 780.99 | ---NA--- |
| SEQ ID NO: 4775 | Nga04442 | 83.90 | 63.86 | hypothetical protein AURANDRAFT_64743 [Aureococcus anophagefferens] |
| SEQ ID NO: 4776 | Nga04582 | 441.92 | 366.46 | patatin-like phospholipase domain-containing protein |
| SEQ ID NO: 4777 | Nga04584.1 | 488.89 | 422.59 | 4-diphosphocytidyl-2c-methyl-d-erythritol kinase |
| SEQ ID NO: 4778 | Nga04583 | 523.56 | 506.81 | ring-finger-containing e3 ubiquitin |
| SEQ ID NO: 4779 | Nga04706 | 239.39 | 219.93 | ---NA--- |
| SEQ ID NO: 4780 | Nga04707 | 349.21 | 401.20 | ---NA--- |
| SEQ ID NO: 4781 | Nga04708 | 676.61 | 589.44 | ---NA--- |
| SEQ ID NO: 4782 | Nga04289 | 1298.36 | 1551.51 | protein |
| SEQ ID NO: 4783 | Nga21090.1 | 1181.82 | 1503.22 | ankyrin repeat protein |
| SEQ ID NO: 4784 | Nga05002 | 754.42 | 845.40 | ---NA--- |
| SEQ ID NO: 4785 | Nga04492 | 883.78 | 840.44 | acetyl- hydrolase transferase |
| SEQ ID NO: 4786 | Nga04493 | 900.75 | 966.47 | protein |
| SEQ ID NO: 4787 | Nga05042 | 1484.75 | 1797.43 | glycine-rich rna-binding protein 4 |
| SEQ ID NO: 4788 | Nga05043 | 433.33 | 558.28 | ---NA--- |
| SEQ ID NO: 4789 | Nga05044.1 | 479.70 | 517.63 | homing endonuclease rb16 2 |
| SEQ ID NO: 4790 | Nga05045 | 116.43 | 79.47 | ---NA--- |
| SEQ ID NO: 4791 | Nga04555 | 1641.61 | 2128.71 | protein |
| SEQ ID NO: 4792 | Nga04769 | 193.59 | 226.37 | ---NA--- |
| SEQ ID NO: 4793 | Nga04736.1 | 79.42 | 108.85 | ---NA--- |
| SEQ ID NO: 4794 | Nga04362 | 40.82 | 36.84 | ---NA--- |
| SEQ ID NO: 4795 | Nga02232.2 | 22.22 | 6.88 | ---NA--- |
| SEQ ID NO: 4796 | Nga04976 | 71.53 | 106.93 | ---NA--- |
| SEQ ID NO: 4797 | Nga04975.1 | 83.00 | 157.88 | ---NA--- |
| SEQ ID NO: 4798 | Nga03845.02 | 493.55 | 405.34 | AF391290_4unknown [Branchiostoma floridae] |
| SEQ ID NO: 4799 | Nga03848.02 | 156.46 | 132.64 | ankyrin repeat-containing protein |
| SEQ ID NO: 4800 | Nga04758 | 158.91 | 205.73 | 1-acyl-sn-glycerol-3-phosphate acyltransferase |
| SEQ ID NO: 4801 | Nga04759 | 224.42 | 253.83 | 1-acyl-sn-glycerol-3-phosphate acyltransferase family protein |
| SEQ ID NO: 4802 | Nga07094 | 243.80 | 170.09 | ---NA--- |
| SEQ ID NO: 4803 | Nga04838.2 | 179.49 | 147.21 | ---NA--- |
| SEQ ID NO: 4804 | Nga07092 | 1163.48 | 1182.13 | cytochrome p450 |
| SEQ ID NO: 4805 | Nga07055 | 5.49 | 59.52 | ---NA--- |
| SEQ ID NO: 4806 | Nga05783.02 | 151.28 | 161.10 | ---NA--- |
| SEQ ID NO: 4807 | Nga06928 | 747.83 | 742.88 | smu-1 suppressor of mec-8 and unc-52 homolog ( elegans) |
| SEQ ID NO: 4808 | Nga07218 | 707.47 | 773.84 | serine long chain base subunit 1 |
| SEQ ID NO: 4809 | Nga00828.02 | 6466.38 | 6095.25 | ---NA--- |

FIGURE 24 BX

| # | Nga model | +N rpkb | -N rpkb | GO |
|---|---|---|---|---|
| SEQ ID NO: 4810 | Nga06895.1 | 912.42 | 1157.40 | histone deacetylase superfamily protein |
| SEQ ID NO: 4811 | Nga07250 | 1609.90 | 1613.77 | protein |
| SEQ ID NO: 4812 | Nga01718.02 | 1024.82 | 1024.72 | glutathione s-transferase |
| SEQ ID NO: 4813 | Nga20014.1 | 604.32 | 833.86 | ---NA--- |
| SEQ ID NO: 4814 | Nga20398 | 298.94 | 214.93 | udp-galactose translocator |
| SEQ ID NO: 4815 | Nga20411 | 236.26 | 172.60 | udp-galactose transporter |
| SEQ ID NO: 4816 | Nga07234 | 160.92 | 148.03 | zinc finger bed domain-containing protein 1-like |
| SEQ ID NO: 4817 | Nga00251.02 | 8641.55 | 8947.81 | redoxin domain protein |
| SEQ ID NO: 4818 | Nga20464 | 104.11 | 160.26 | regulator of chromosome condensation -like protein |
| SEQ ID NO: 4819 | Nga07165 | 224.24 | 245.58 | protein |
| SEQ ID NO: 4820 | Nga20294 | 426.64 | 474.70 | uv radiation resistance-associated gene protein |
| SEQ ID NO: 4821 | Nga06959 | 425.23 | 304.48 | kelch repeat protein |
| SEQ ID NO: 4822 | Nga07116 | 234.62 | 270.81 | ---NA--- |
| SEQ ID NO: 4823 | Nga04515.2 | 179.17 | 196.74 | ---NA--- |
| SEQ ID NO: 4824 | Nga07293 | 6025.11 | 6897.93 | 40s ribosomal protein s9 |
| SEQ ID NO: 4825 | Nga00982.02 | 2877.19 | 2455.92 | ---NA--- |
| SEQ ID NO: 4826 | Nga07142 | 2374.10 | 1778.76 | predicted protein [Thalassiosira pseudonana CCMP1335] |
| SEQ ID NO: 4827 | Nga07140 | 3466.43 | 3304.05 | conserved hypothetical protein [Phytophthora infestans T30-4] |
| SEQ ID NO: 4828 | Nga07030 | 89.33 | 127.10 | para-aminobenzoate synthase |
| SEQ ID NO: 4829 | Nga07029 | 1135.86 | 1241.26 | ---NA--- |
| SEQ ID NO: 4830 | Nga07169 | 691.11 | 599.92 | ---NA--- |
| SEQ ID NO: 4831 | Nga07170 | 190.14 | 167.82 | ---NA--- |
| SEQ ID NO: 4832 | Nga07171 | 813.48 | 608.56 | ---NA--- |
| SEQ ID NO: 4833 | Nga01168.2 | 652.21 | 843.10 | ---NA--- |
| SEQ ID NO: 4834 | Nga06974 | 187.07 | 175.12 | protein |
| SEQ ID NO: 4835 | Nga07045 | 333.33 | 369.83 | hypothetical protein CHLNCDRAFT_138448 [Chlorella variabilis] |
| SEQ ID NO: 4836 | Nga07046 | 49.28 | 48.67 | ---NA--- |
| SEQ ID NO: 4837 | Nga07252 | 253.16 | 308.52 | ---NA--- |
| SEQ ID NO: 4838 | Nga06911.1 | 280.63 | 95.67 | ankyrin repeat and kh domain-containing protein 1 |
| SEQ ID NO: 4839 | Nga20211 | 259.74 | 290.74 | rbm25 protein |
| SEQ ID NO: 4840 | Nga21204 | 144.21 | 189.50 | rbm25 protein |
| SEQ ID NO: 4841 | Nga04183.2 | 125.00 | 114.25 | ---NA--- |
| SEQ ID NO: 4842 | Nga07281 | 252.53 | 246.19 | ---NA--- |
| SEQ ID NO: 4843 | Nga07280 | 144.85 | 118.15 | domain-containing protein |
| SEQ ID NO: 4844 | Nga06838 | 159.02 | 158.38 | protein |
| SEQ ID NO: 4845 | Nga06968 | 633.18 | 573.77 | ---NA--- |
| SEQ ID NO: 4846 | Nga07179 | 2634.35 | 1732.42 | protein |
| SEQ ID NO: 4847 | Nga06990.1 | 221.78 | 232.49 | transcriptional repressor sin3p |
| SEQ ID NO: 4848 | Nga07143.1 | 2920.63 | 3402.89 | ---NA--- |
| SEQ ID NO: 4849 | Nga07215 | 2.49 | 5.39 | bacteriocin o-metyltransferase |
| SEQ ID NO: 4850 | Nga06892 | 4293.51 | 4089.45 | ---NA--- |
| SEQ ID NO: 4851 | Nga06902 | 398.84 | 312.20 | dna replication licensing factor mcm3 |
| SEQ ID NO: 4852 | Nga07173 | 227.12 | 165.24 | ---NA--- |
| SEQ ID NO: 4853 | Nga06960 | 474.07 | 473.41 | ---NA--- |
| SEQ ID NO: 4854 | Nga20857 | 648.22 | 808.76 | rna-binding expressed |
| SEQ ID NO: 4855 | Nga07190 | 420.33 | 387.12 | major facilitator superfamily mfs_1 |
| SEQ ID NO: 4856 | Nga07009 | 1154.20 | 1313.11 | ---NA--- |
| SEQ ID NO: 4857 | Nga07008 | 474.64 | 622.07 | hypothetical protein AURANDRAFT_66301 [Aureococcus anophagefferens] |
| SEQ ID NO: 4858 | Nga06987 | 1000.00 | 1179.80 | peroxiredoxin 1 |
| SEQ ID NO: 4859 | Nga07051 | 1245.02 | 1395.81 | ---NA--- |
| SEQ ID NO: 4860 | Nga07103 | 198.31 | 169.11 | ---NA--- |
| SEQ ID NO: 4861 | Nga20013.1 | 62.02 | 41.99 | ---NA--- |
| SEQ ID NO: 4862 | Nga20228 | 392.49 | 392.88 | insulin-degrading enzyme |
| SEQ ID NO: 4863 | Nga06989.1 | 71.97 | 53.34 | dna replication licensing factor mcm5 |
| SEQ ID NO: 4864 | Nga06870 | 173.01 | 146.18 | ---NA--- |
| SEQ ID NO: 4865 | Nga06932 | 238.99 | 245.26 | ---NA--- |
| SEQ ID NO: 4866 | Nga06991 | 273.76 | 313.03 | ---NA--- |
| SEQ ID NO: 4867 | Nga07246 | 264.07 | 246.19 | transcription factor |
| SEQ ID NO: 4868 | Nga07276 | 34.83 | 18.86 | zinc finger bed domain-containing protein 1-like |
| SEQ ID NO: 4869 | Nga07254 | 722.22 | 819.95 | ---NA--- |
| SEQ ID NO: 4870 | Nga07255 | 506.60 | 725.73 | ---NA--- |
| SEQ ID NO: 4871 | Nga07011 | 180.81 | 272.86 | ---NA--- |
| SEQ ID NO: 4872 | Nga06931 | 67.96 | 73.62 | ---NA--- |

FIGURE 24 BY

| # | Nga model | +N rpkb | -N rpkb | GO |
|---|---|---|---|---|
| SEQ ID NO: 4873 | Nga06930 | 439.02 | 356.67 | ---NA--- |
| SEQ ID NO: 4874 | Nga07296 | 894.60 | 941.94 | ---NA--- |
| SEQ ID NO: 4875 | Nga21275 | 161.20 | 201.26 | protein |
| SEQ ID NO: 4876 | Nga21101 | 281.90 | 298.93 | ---NA--- |
| SEQ ID NO: 4877 | Nga07090 | 22322.94 | 21377.69 | actin |
| SEQ ID NO: 4878 | Nga06992 | 81.76 | 149.88 | ---NA--- |
| SEQ ID NO: 4879 | Nga21143 | 690.14 | 570.60 | ku p70 dna |
| SEQ ID NO: 4880 | Nga00461.01 | 902.98 | 815.05 | abc subfamily abcg |
| SEQ ID NO: 4881 | Nga20932 | 1639.90 | 1233.23 | protein |
| SEQ ID NO: 4882 | Nga00457 | 780.92 | 850.46 | mitochondrial 2-oxoglutarate malate carrier |
| SEQ ID NO: 4883 | Nga00446 | 1303.08 | 1446.65 | gtp-binding protein sar1 |
| SEQ ID NO: 4884 | Nga00451 | 3271.98 | 3103.50 | fatty-acyl |
| SEQ ID NO: 4885 | Nga00462 | 4341.30 | 3758.35 | ferredoxin |
| SEQ ID NO: 4886 | Nga00448.01 | 26082.30 | 12065.79 | light harvesting complex protein |
| SEQ ID NO: 4887 | Nga21052 | 380.80 | 338.84 | 2og-fe oxygenase |
| SEQ ID NO: 4888 | Nga00463 | 408.07 | 289.83 | aminoglycoside phosphotransferase |
| SEQ ID NO: 4889 | Nga00468 | 2122.19 | 2160.81 | [Fe] hydrogenase maturation protein [Naegleria gruberi] |
| SEQ ID NO: 4890 | Nga00466 | 298.93 | 333.45 | beta subunit of the capping protein heterodimer (cap1p and cap2p) |
| SEQ ID NO: 4891 | Nga21094 | 621.35 | 697.84 | 30s ribosomal protein s5 |
| SEQ ID NO: 4892 | Nga00465 | 1218.96 | 1144.36 | splicing factor 3b subunit 5 |
| SEQ ID NO: 4893 | Nga00449 | 1092.59 | 738.87 | ---NA--- |
| SEQ ID NO: 4894 | Nga00454 | 903.74 | 975.07 | protein |
| SEQ ID NO: 4895 | Nga00455 | 209.00 | 183.02 | katanin p60 atpase-containing subunit a-like 1 |
| SEQ ID NO: 4896 | Nga00459 | 923.14 | 875.08 | cdk5 regulatory subunit associated protein 1 |
| SEQ ID NO: 4897 | Nga00453 | 3230.58 | 3154.99 | nose resistant to fluoxetine protein 6-like |
| SEQ ID NO: 4898 | Nga00464 | 1014.49 | 934.70 | ankyrin repeat and btb poz domain-containing protein 1 |
| SEQ ID NO: 4899 | Nga00456 | 118.14 | 130.37 | protein |
| SEQ ID NO: 4900 | Nga00450 | 462.02 | 361.58 | sam-dependent methyltransferase |
| SEQ ID NO: 4901 | Nga00460 | 633.47 | 500.53 | glucose-methanol-choline oxidoreductase |
| SEQ ID NO: 4902 | Nga00469 | 403.47 | 401.51 | ---NA--- |
| SEQ ID NO: 4903 | Nga00467 | 172.77 | 211.73 | dna-directed rna polymerase i subunit |
| SEQ ID NO: 4904 | Nga00458.01 | 9447.11 | 8268.63 | chaperonin 10 |
| SEQ ID NO: 4905 | Nga00452 | 542.35 | 516.92 | metal-dependent hydrolase |
| SEQ ID NO: 4906 | Nga00285 | 2874.65 | 2792.47 | 26s protease regulatory subunit 8 |
| SEQ ID NO: 4907 | Nga00303.1 | 394.52 | 401.64 | cytochrome c biogenesis protein transmembrane region |
| SEQ ID NO: 4908 | Nga00287 | 1338.96 | 1332.18 | protein |
| SEQ ID NO: 4909 | Nga00308 | 998.21 | 1193.99 | phage spo1 dna polymerase-related protein |
| SEQ ID NO: 4910 | Nga00289 | 563.75 | 494.23 | fad dependent oxidoreductase |
| SEQ ID NO: 4911 | Nga00292 | 1769.69 | 2002.31 | calcium-binding protein 39-like |
| SEQ ID NO: 4912 | Nga20284.1 | 439.26 | 454.07 | ubiquitin carboxyl-terminal hydrolase family protein |
| SEQ ID NO: 4913 | Nga00291 | 362.53 | 483.63 | uncharacterized protein |
| SEQ ID NO: 4914 | Nga20037.1 | 190.70 | 217.98 | ubiquitinspecific protease |
| SEQ ID NO: 4915 | Nga00300 | 1287.13 | 1236.96 | myo-inositol 2-dehydrogenase |
| SEQ ID NO: 4916 | Nga00307 | 2052.27 | 2104.51 | protein |
| SEQ ID NO: 4917 | Nga20603.1 | 82.49 | 125.83 | conserved unknown protein [Ectocarpus siliculosus] |
| SEQ ID NO: 4918 | Nga00296 | 1260.08 | 1291.59 | sporangia induced mitogen-activated protein |
| SEQ ID NO: 4919 | Nga00305 | 89.60 | 97.05 | conserved unknown protein [Ectocarpus siliculosus] |
| SEQ ID NO: 4920 | Nga00306 | 899.87 | 915.61 | ---NA--- |
| SEQ ID NO: 4921 | Nga00288 | 1530.67 | 1294.10 | fructose- -bisphosphatase |
| SEQ ID NO: 4922 | Nga00290 | 445.33 | 405.85 | ---NA--- |
| SEQ ID NO: 4923 | Nga00299 | 723.15 | 897.51 | adenosine trna methylthiotransferase |
| SEQ ID NO: 4924 | Nga20173 | 657.87 | 744.17 | ---NA--- |
| SEQ ID NO: 4925 | Nga00297 | 1102.27 | 1289.21 | chloroplast envelope protein translocase (cept or tic-toc) family protein |
| SEQ ID NO: 4926 | Nga00286 | 226.00 | 213.72 | ---NA--- |
| SEQ ID NO: 4927 | Nga21019 | 115.52 | 230.72 | protein |
| SEQ ID NO: 4928 | Nga00302 | 493.54 | 428.26 | phd finger-like domain-containing protein 5a |
| SEQ ID NO: 4929 | Nga00298 | 1575.73 | 1632.15 | protein |
| SEQ ID NO: 4930 | Nga00294 | 409.40 | 270.35 | lysosomal aspartic protease |
| SEQ ID NO: 4931 | Nga00295 | 1149.81 | 1389.82 | rna polymerase sigma factor |
| SEQ ID NO: 4932 | Nga00301 | 2595.06 | 2361.08 | h - or na -translocating f- v-type and a-type atpase (f-atpase) superfamily |
| SEQ ID NO: 4933 | Nga00293.01 | 1144.67 | 1073.54 | hypoxia-inducible factor alpha subunit |
| SEQ ID NO: 4934 | Nga21274 | 388.59 | 309.07 | ---NA--- |

FIGURE 24 BZ

| # | Nga model | +N rpkb | -N rpkb | GO |
|---|---|---|---|---|
| SEQ ID NO: 4935 | Nga00304 | 106.31 | 137.60 | ---NA--- |
| SEQ ID NO: 4936 | Nga20530 | 968.98 | 1062.91 | dihydrouridine synthase |
| SEQ ID NO: 4937 | Nga00518 | 17666.67 | 14291.52 | ---NA--- |
| SEQ ID NO: 4938 | Nga00517 | 706.27 | 757.04 | threonyl-trna synthetase |
| SEQ ID NO: 4939 | Nga20447 | 294.99 | 239.65 | transducin wd-40 repeat-containing protein |
| SEQ ID NO: 4940 | Nga00492 | 460.76 | 448.10 | aldo keto reductase |
| SEQ ID NO: 4941 | Nga00490.01 | 783.65 | 773.93 | adenine phosphoribosyltransferase |
| SEQ ID NO: 4942 | Nga00496 | 914.65 | 1123.17 | protein |
| SEQ ID NO: 4943 | Nga21241 | 1043.73 | 967.05 | holliday junction resolvase |
| SEQ ID NO: 4944 | Nga00519 | 8718.01 | 8478.83 | 60s ribosomal protein l14 |
| SEQ ID NO: 4945 | Nga00531 | 597.40 | 729.97 | bromodomain protein |
| SEQ ID NO: 4946 | Nga00527 | 459.72 | 588.61 | na+ h+ antiporter |
| SEQ ID NO: 4947 | Nga03717.2 | 403.36 | 506.72 | ---NA--- |
| SEQ ID NO: 4948 | Nga20867 | 338.66 | 528.64 | s-adenosylmethionine-dependent methyltransferase methyltransferase |
| SEQ ID NO: 4949 | Nga20803 | 915.05 | 952.95 | sideroflexin 5 |
| SEQ ID NO: 4950 | Nga00525 | 684.88 | 784.77 | phosphopantothenate--cysteine ligase |
| SEQ ID NO: 4951 | Nga00493.01 | 4304.25 | 4488.03 | mago nashi |
| SEQ ID NO: 4952 | Nga00522.01 | 15290.02 | 7760.55 | chloroplast light harvesting protein isoform 4 |
| SEQ ID NO: 4953 | Nga00523 | 783.31 | 931.87 | set domain |
| SEQ ID NO: 4954 | Nga00526 | 1180.56 | 1326.96 | arginase |
| SEQ ID NO: 4955 | Nga00528 | 381.82 | 518.64 | protein |
| SEQ ID NO: 4956 | Nga00489 | 1519.87 | 1523.04 | histone-lysine n-methyltransferase setd3 |
| SEQ ID NO: 4957 | Nga00521 | 688.05 | 648.58 | t-complex protein 1 subunit epsilon |
| SEQ ID NO: 4958 | Nga00497 | 262.56 | 348.81 | transcription initiation factor tfiid subunit |
| SEQ ID NO: 4959 | Nga00494.01 | 791.11 | 849.77 | serine threonine protein phosphatase |
| SEQ ID NO: 4960 | Nga00530 | 260.12 | 278.40 | endonuclease iii-like protein 1-like |
| SEQ ID NO: 4961 | Nga00524 | 5705.77 | 4778.72 | stearoyl- desaturase 5 |
| SEQ ID NO: 4962 | Nga00532.01 | 423.08 | 522.87 | sdhfb_dicdi ame: full=succinate dehydrogenase assembly factor 1 homolog mitochondrial short=sdh assembly factor 1b |
| SEQ ID NO: 4963 | Nga21212 | 432.94 | 506.36 | proteasome a type |
| SEQ ID NO: 4964 | Nga20491 | 1342.57 | 1430.90 | fad linked oxidase family protein |
| SEQ ID NO: 4965 | Nga20361.1 | 321.43 | 236.67 | conserved unknown protein [Ectocarpus siliculosus] |
| SEQ ID NO: 4966 | Nga21003.1 | 174.83 | 208.31 | conserved unknown protein [Ectocarpus siliculosus] |
| SEQ ID NO: 4967 | Nga20382.1 | 238.26 | 167.21 | conserved unknown protein [Ectocarpus siliculosus] |
| SEQ ID NO: 4968 | Nga00520 | 1748.94 | 1539.86 | aspartate aminotransferase |
| SEQ ID NO: 4969 | Nga00516.01 | 4916.85 | 4334.15 | expressed unknown protein [Ectocarpus siliculosus] |
| SEQ ID NO: 4970 | Nga00684 | 247.11 | 281.02 | thyroid hormone receptor interactor 4 isoform 4 |
| SEQ ID NO: 4971 | Nga20445.1 | 348.95 | 446.24 | heat shock protein 40 like protein domain containing protein |
| SEQ ID NO: 4972 | Nga20288.1 | 379.53 | 370.18 | chaperone protein |
| SEQ ID NO: 4973 | Nga00685 | 118.25 | 116.96 | predicted protein [Phaeodactylum tricornutum CCAP 1055/1] |
| SEQ ID NO: 4974 | Nga00681.1 | 1095.08 | 1240.40 | abc transporter atp-binding protein |
| SEQ ID NO: 4975 | Nga00674 | 2802.27 | 2544.18 | protein |
| SEQ ID NO: 4976 | Nga00676 | 2045.79 | 1962.28 | proteasome subunit alpha type 7 |
| SEQ ID NO: 4977 | Nga00687 | 339.22 | 361.44 | ---NA--- |
| SEQ ID NO: 4978 | Nga00675 | 3949.23 | 4216.28 | long chain acyl-coa synthetase |
| SEQ ID NO: 4979 | Nga00682 | 1447.58 | 1611.75 | ---NA--- |
| SEQ ID NO: 4980 | Nga00677.1 | 184.02 | 226.52 | asparagine synthase related protein |
| SEQ ID NO: 4981 | Nga00690 | 1457.98 | 1661.26 | farnesyltransferase beta subunit |
| SEQ ID NO: 4982 | Nga20956 | 1140.94 | 1446.74 | protein farnesyltransferase subunit beta |
| SEQ ID NO: 4983 | Nga00680 | 2569.25 | 2674.29 | protein |
| SEQ ID NO: 4984 | Nga00689 | 177.17 | 146.42 | asparagine-linked glycosylation 1 homolog ( beta- -mannosyltransferase) |
| SEQ ID NO: 4985 | Nga00686 | 1233.25 | 1236.45 | ---NA--- |
| SEQ ID NO: 4986 | Nga00683 | 514.49 | 499.01 | protein |
| SEQ ID NO: 4987 | Nga00679.01 | 1138.10 | 1014.14 | protein |
| SEQ ID NO: 4988 | Nga00691 | 222.22 | 235.81 | leucine-rich transmembrane protein |
| SEQ ID NO: 4989 | Nga00678 | 706.07 | 826.57 | rpot-like rna polymerase |
| SEQ ID NO: 4990 | Nga20458 | 203.19 | 94.94 | chaperone protein |
| SEQ ID NO: 4991 | Nga20427 | 419.24 | 409.47 | abc transporter atp-binding protein |
| SEQ ID NO: 4992 | Nga20508 | 152.17 | 160.92 | ---NA--- |
| SEQ ID NO: 4993 | Nga21170 | 120.16 | 109.16 | n-terminal kinase-like protein |
| SEQ ID NO: 4994 | Nga00026 | 470.44 | 508.83 | transcription factor jumonji family protein |
| SEQ ID NO: 4995 | Nga04261.2 | 719.39 | 1022.90 | adenosine deaminase |

FIGURE 24 CA

| # | Nga model | +N rpkb | -N rpkb | GO |
|---|---|---|---|---|
| SEQ ID NO: 4996 | Nga00032 | 265.24 | 305.02 | ---NA--- |
| SEQ ID NO: 4997 | Nga00031 | 1100.64 | 1026.74 | glutaredoxin 3 |
| SEQ ID NO: 4998 | Nga00020 | 154.96 | 111.91 | pyruvate kinase |
| SEQ ID NO: 4999 | Nga00028.01 | 32.92 | 84.70 | ---NA--- |
| SEQ ID NO: 5000 | Nga00035 | 345.79 | 448.82 | nuclear control of atpase protein |
| SEQ ID NO: 5001 | Nga00037 | 832.58 | 722.97 | ---NA--- |
| SEQ ID NO: 5002 | Nga20737 | 601.03 | 503.65 | fumarylacetoacetate hydrolase domain-containing protein 1 |
| SEQ ID NO: 5003 | Nga00029.01 | 164.38 | 136.85 | mmp37-like mitochondrial precursor |
| SEQ ID NO: 5004 | Nga00021 | 483.47 | 504.69 | ---NA--- |
| SEQ ID NO: 5005 | Nga20582 | 145.99 | 134.42 | conserved protein with yshh some fused to polo |
| SEQ ID NO: 5006 | Nga00025 | 328.14 | 353.20 | s-adenosylmethionine-dependent methyltransferase domain-containing protein |
| SEQ ID NO: 5007 | Nga00034 | 561.04 | 524.74 | cytochrome b5 |
| SEQ ID NO: 5008 | Nga00023 | 201.52 | 153.08 | dna primase large subunit |
| SEQ ID NO: 5009 | Nga00036 | 820.92 | 782.81 | ---NA--- |
| SEQ ID NO: 5010 | Nga00039 | 288.14 | 293.76 | chloride channel family |
| SEQ ID NO: 5011 | Nga00033 | 242.88 | 232.27 | chloride channel protein |
| SEQ ID NO: 5012 | Nga00022.01 | 707.38 | 651.38 | hemolysin iii |
| SEQ ID NO: 5013 | Nga00030 | 415.47 | 517.43 | ---NA--- |
| SEQ ID NO: 5014 | Nga00027.01 | 6926.51 | 8021.43 | fad-dependent pyridine nucleotide-disulfide oxidoreductase |
| SEQ ID NO: 5015 | Nga06088.2 | 397.20 | 587.17 | glycerophosphoryl diester phosphodiesterase |
| SEQ ID NO: 5016 | Nga21197.1 | 401.91 | 501.77 | conserved unknown protein [Ectocarpus siliculosus] |
| SEQ ID NO: 5017 | Nga02898 | 112.19 | 111.37 | myosin-like protein |
| SEQ ID NO: 5018 | Nga06085.2 | 358.28 | 384.12 | ---NA--- |
| SEQ ID NO: 5019 | Nga02885.01 | 3260.95 | 3187.80 | conserved hypothetical protein [Sporisorium reilianum SRZ2] |
| SEQ ID NO: 5020 | Nga20728 | 175.00 | 194.77 | endonuclease exonuclease phosphatase family |
| SEQ ID NO: 5021 | Nga02892.02 | 1310.42 | 1685.03 | abc transporter family protein |
| SEQ ID NO: 5022 | Nga02897 | 145.73 | 87.09 | ---NA--- |
| SEQ ID NO: 5023 | Nga02891 | 8330.79 | 7764.55 | conserved hypothetical protei |
| SEQ ID NO: 5024 | Nga02888 | 6533.13 | 7733.52 | protein |
| SEQ ID NO: 5025 | Nga02889 | 440.99 | 620.41 | protein |
| SEQ ID NO: 5026 | Nga02893 | 529.91 | 495.32 | ---NA--- |
| SEQ ID NO: 5027 | Nga02886 | 23360.30 | 24857.58 | translation elongation factor 1- |
| SEQ ID NO: 5028 | Nga20827 | 598.11 | 634.25 | nudix hydrolase |
| SEQ ID NO: 5029 | Nga02890 | 2427.10 | 3682.70 | ---NA--- |
| SEQ ID NO: 5030 | Nga02887 | 875.80 | 1112.71 | predicted protein [Phaeodactylum tricornutum CCAP 1055/1] |
| SEQ ID NO: 5031 | Nga20473 | 175.31 | 217.03 | rna 3'-terminal phosphate cyclase |
| SEQ ID NO: 5032 | Nga02892.01 | 1310.42 | 1685.03 | abc transporter family protein |
| SEQ ID NO: 5033 | Nga00186 | 123.89 | 177.80 | sulfate permease family |
| SEQ ID NO: 5034 | Nga20120 | 409.62 | 532.63 | methyltransferase |
| SEQ ID NO: 5035 | Nga00157.01 | 2288.21 | 2909.12 | protein |
| SEQ ID NO: 5036 | Nga00175.01 | 273.43 | 269.47 | alpha beta hydrolase |
| SEQ ID NO: 5037 | Nga00181 | 528.94 | 558.70 | magnesium and cobalt transport protein |
| SEQ ID NO: 5038 | Nga00156 | 389.41 | 357.70 | pci domain-containing protein 2 |
| SEQ ID NO: 5039 | Nga00178 | 191.73 | 208.88 | ---NA--- |
| SEQ ID NO: 5040 | Nga00183.1 | 199.22 | 194.04 | imidazoleglycerol phosphate cyclase subunit |
| SEQ ID NO: 5041 | Nga20540 | 219.44 | 189.57 | homolog dmc1 |
| SEQ ID NO: 5042 | Nga00185 | 670.43 | 543.01 | nadh-cytochrome b5 reductase 2-like isoform 1 |
| SEQ ID NO: 5043 | Nga20339 | 477.04 | 418.85 | protein |
| SEQ ID NO: 5044 | Nga00190 | 256.94 | 203.11 | ---NA--- |
| SEQ ID NO: 5045 | Nga00155 | 754.01 | 840.82 | hydantoin utilization protein a |
| SEQ ID NO: 5046 | Nga00159 | 851.85 | 682.79 | solute carrier family member 36 |
| SEQ ID NO: 5047 | Nga00153 | 1754.02 | 1741.53 | glyceraldehyde-3-phosphate dehydrogenase |
| SEQ ID NO: 5048 | Nga00152 | 1670.31 | 1425.83 | beta-ketoacyl synthase |
| SEQ ID NO: 5049 | Nga00177 | 688.12 | 744.47 | aspartic proteinase |
| SEQ ID NO: 5050 | Nga00191 | 6106.93 | 4806.98 | ---NA--- |
| SEQ ID NO: 5051 | Nga00189 | 475.27 | 327.68 | phosphatidylinositol class b |
| SEQ ID NO: 5052 | Nga00160 | 966.46 | 898.29 | serine threonine protein |
| SEQ ID NO: 5053 | Nga00154 | 283.26 | 297.12 | gluconate kinase |
| SEQ ID NO: 5054 | Nga00188 | 313.04 | 254.32 | phosphatidylinositol class b |
| SEQ ID NO: 5055 | Nga00179 | 333.69 | 340.23 | snf2 super family |
| SEQ ID NO: 5056 | Nga00176 | 674.73 | 759.45 | ---NA--- |
| SEQ ID NO: 5057 | Nga00184 | 409.55 | 372.09 | cytidine deaminase |
| SEQ ID NO: 5058 | Nga21039 | 350.81 | 355.98 | mg(2+) transport atpase protein c |

FIGURE 24 CB

| # | Nga model | +N rpkb | -N rpkb | GO |
|---|---|---|---|---|
| SEQ ID NO: 5059 | Nga00180 | 1155.15 | 1006.77 | retinol retinaldehyde reductase |
| SEQ ID NO: 5060 | Nga00187 | 337.80 | 296.60 | oligosaccharide translocation protein rft1 |
| SEQ ID NO: 5061 | Nga00158 | 1151.20 | 1085.10 | membrane protein |
| SEQ ID NO: 5062 | Nga03285 | 855.40 | 873.76 | histidine acid |
| SEQ ID NO: 5063 | Nga03281 | 561.47 | 520.12 | predicted protein [Thalassiosira pseudonana CCMP1335] |
| SEQ ID NO: 5064 | Nga03269 | 7940.70 | 7722.11 | receptor accessory protein 6 |
| SEQ ID NO: 5065 | Nga01741.02 | 975.28 | 958.57 | pap fibrillin family protein |
| SEQ ID NO: 5066 | Nga20687 | 289.92 | 282.19 | ---NA--- |
| SEQ ID NO: 5067 | Nga20062 | 547.85 | 533.39 | tesmin tso1-like cxc domain-containing protein |
| SEQ ID NO: 5068 | Nga03272 | 1167.81 | 1158.82 | trehalase |
| SEQ ID NO: 5069 | Nga03282 | 348.30 | 270.27 | ---NA--- |
| SEQ ID NO: 5070 | Nga03277 | 701.39 | 913.67 | atpase ii |
| SEQ ID NO: 5071 | Nga21252 | 184.43 | 235.29 | conserved unknown protein [Ectocarpus siliculosus] |
| SEQ ID NO: 5072 | Nga21138 | 178.92 | 214.84 | inositol-pentakisphosphate 2-kinase-like protein |
| SEQ ID NO: 5073 | Nga03283 | 704.79 | 670.24 | short-chain dehydrogenase reductase sdr |
| SEQ ID NO: 5074 | Nga03275 | 2491.04 | 2182.00 | proteasome subunit beta type 5 |
| SEQ ID NO: 5075 | Nga03270 | 875.96 | 885.98 | valosin containing protein p47 complex interacting protein 1 |
| SEQ ID NO: 5076 | Nga03268 | 519.31 | 457.67 | poly + rna transport protein |
| SEQ ID NO: 5077 | Nga20201 | 224.37 | 213.44 | protein |
| SEQ ID NO: 5078 | Nga03279 | 1010.13 | 1100.79 | ribonuclease p protein subunit p38-like |
| SEQ ID NO: 5079 | Nga03280 | 179.90 | 146.38 | protein |
| SEQ ID NO: 5080 | Nga03273 | 392.62 | 349.64 | 1-family small gtpase |
| SEQ ID NO: 5081 | Nga03278 | 224.81 | 224.62 | protein |
| SEQ ID NO: 5082 | Nga03271 | 164.47 | 173.39 | protein |
| SEQ ID NO: 5083 | Nga03274 | 12610.72 | 11455.70 | 40s ribosomal protein s15 |
| SEQ ID NO: 5084 | Nga00225.1 | 267.29 | 320.52 | protein |
| SEQ ID NO: 5085 | Nga00218.01 | 1682.69 | 1001.99 | protein |
| SEQ ID NO: 5086 | Nga00219 | 596.03 | 631.89 | protein binding protein |
| SEQ ID NO: 5087 | Nga00215 | 3847.65 | 4595.83 | protein |
| SEQ ID NO: 5088 | Nga00220 | 1055.87 | 1016.56 | ribosomal rna processing protein 1 homolog b-like |
| SEQ ID NO: 5089 | Nga00228 | 74.63 | 43.11 | dynein regulator |
| SEQ ID NO: 5090 | Nga00226 | 9489.18 | 9952.21 | 60s ribosomal protein l17-2 |
| SEQ ID NO: 5091 | Nga00229 | 653.70 | 653.95 | uncharacterized protein |
| SEQ ID NO: 5092 | Nga00217.01 | 13677.11 | 13639.38 | myo-inositol 2-dehydrogenase |
| SEQ ID NO: 5093 | Nga00222 | 83.21 | 66.94 | myosin-like antigen |
| SEQ ID NO: 5094 | Nga00214.01 | 684.27 | 683.71 | pleckstrin domain-containing protein |
| SEQ ID NO: 5095 | Nga00221 | 352.94 | 356.62 | peptidyl-trna hydrolase |
| SEQ ID NO: 5096 | Nga20072.1 | 318.39 | 347.35 | chloride channel 7 |
| SEQ ID NO: 5097 | Nga20531 | 207.87 | 265.55 | kinesin-like protein |
| SEQ ID NO: 5098 | Nga21229.1 | 348.84 | 268.71 | chloride channel protein 7 |
| SEQ ID NO: 5099 | Nga21126.1 | 152.35 | 114.02 | ---NA--- |
| SEQ ID NO: 5100 | Nga00231.01 | 129.11 | 317.85 | phd zinc finger-containing protein |
| SEQ ID NO: 5101 | Nga00227.01 | 631.30 | 781.54 | predicted protein [Thalassiosira pseudonana CCMP1335] |
| SEQ ID NO: 5102 | Nga00216 | 320.47 | 241.08 | sec1 family domain containing 1 |
| SEQ ID NO: 5103 | Nga21225.1 | 229.03 | 262.07 | ribosomal rna large subunit methyltransferase f |
| SEQ ID NO: 5104 | Nga00224.01 | 2630.54 | 2139.15 | alanine-2-oxoglutarate aminotransferase 2 |
| SEQ ID NO: 5105 | Nga00234.01 | 163.78 | 204.54 | methyltransferase mett10d |
| SEQ ID NO: 5106 | Nga00230.01 | 292.04 | 421.79 | amino acid permease family protein |
| SEQ ID NO: 5107 | Nga00232.01 | 3023.75 | 2957.22 | hypothetical protein tll0394 [Thermosynechococcus elongatus BP-1] |
| SEQ ID NO: 5108 | Nga20001 | 1521.93 | 1225.76 | transmembrane protein 167 precursor |
| SEQ ID NO: 5109 | Nga20338.1 | 945.78 | 846.23 | ctf2a like oxidoreductase |
| SEQ ID NO: 5110 | Nga00233.01 | 365.97 | 281.46 | ---NA--- |
| SEQ ID NO: 5111 | Nga00223.01 | 647.29 | 827.95 | serine acetyltransferase |
| SEQ ID NO: 5112 | Nga01769.2 | 448.64 | 619.83 | 5-oxoprolinase |
| SEQ ID NO: 5113 | Nga01768.02 | 13904.11 | 18448.36 | heat shock protein hsp20 |
| SEQ ID NO: 5114 | Nga02641 | 704.34 | 721.43 | mgc82338 protein |
| SEQ ID NO: 5115 | Nga02643 | 216.31 | 321.43 | protein |
| SEQ ID NO: 5116 | Nga01770.02 | 189.25 | 218.98 | zinc transport |
| SEQ ID NO: 5117 | Nga20175.1 | 274.30 | 357.71 | protein |
| SEQ ID NO: 5118 | Nga02639 | 1339.04 | 1328.07 | soluble nsf attachment protein receptor |
| SEQ ID NO: 5119 | Nga20309 | 1726.28 | 1666.79 | protein |
| SEQ ID NO: 5120 | Nga02638 | 195.42 | 176.79 | sphingosine kinase 1 |
| SEQ ID NO: 5121 | Nga02635 | 418.48 | 477.59 | ring finger domain protein |
| SEQ ID NO: 5122 | Nga02634 | 857.80 | 849.18 | elongation factor ts |

FIGURE 24 CC

| # | Nga model | +N rpkb | -N rpkb | GO |
|---|---|---|---|---|
| SEQ ID NO: 5123 | Nga02642 | 302.36 | 341.85 | aminophospholipid transporter- class type member 2 |
| SEQ ID NO: 5124 | Nga02636 | 1207.30 | 1209.58 | geranylgeranyl pyrophosphate synthase |
| SEQ ID NO: 5125 | Nga02637 | 745.43 | 669.30 | phosphoribosylglycinamide synthetase |
| SEQ ID NO: 5126 | Nga20516 | 241.99 | 215.88 | ---NA--- |
| SEQ ID NO: 5127 | Nga21184.1 | 36.04 | 9.76 | serine threonine-protein kinase eg2-like |
| SEQ ID NO: 5128 | Nga20012.1 | 68.63 | 21.24 | a chain crystal structure of the mouse aurora-a catalytic domain (asn186- |
| SEQ ID NO: 5129 | Nga05092 | 128.80 | 162.78 | sentrin-specific protease 1 |
| SEQ ID NO: 5130 | Nga20340.1 | 95.93 | 63.41 | protein kinase p46 g22 |
| SEQ ID NO: 5131 | Nga05091 | 464.45 | 470.60 | short-chain dehydrogenase reductase sdr |
| SEQ ID NO: 5132 | Nga05090 | 2040.24 | 2166.87 | mei2-like protein |
| SEQ ID NO: 5133 | Nga05089 | 302.13 | 341.51 | trna (uracil-5-)-methyltransferase |
| SEQ ID NO: 5134 | Nga02987 | 430.32 | 464.24 | myb dna binding protein transcription factor-like protein |
| SEQ ID NO: 5135 | Nga02981 | 1070.31 | 1018.61 | protein |
| SEQ ID NO: 5136 | Nga02983 | 818.87 | 805.42 | family exonuclease |
| SEQ ID NO: 5137 | Nga02990 | 1731.36 | 2821.59 | protein |
| SEQ ID NO: 5138 | Nga02984 | 413.11 | 482.58 | telomerase-binding protein est1a |
| SEQ ID NO: 5139 | Nga02994 | 323.94 | 361.08 | protein |
| SEQ ID NO: 5140 | Nga02986 | 213.51 | 234.21 | peptide chain release factor 1 |
| SEQ ID NO: 5141 | Nga02992 | 196.37 | 189.48 | protein |
| SEQ ID NO: 5142 | Nga02991 | 37.04 | 8.02 | ---NA--- |
| SEQ ID NO: 5143 | Nga02988 | 896.35 | 993.96 | 3-hydroxybutyryl- dehydratase |
| SEQ ID NO: 5144 | Nga21033 | 283.19 | 190.25 | hypothetical protein AURANDRAFT_66840 [Aureococcus anophagefferens] |
| SEQ ID NO: 5145 | Nga20263 | 186.60 | 156.19 | 72 kda inositol polyphosphate 5-phosphatase |
| SEQ ID NO: 5146 | Nga02989 | 76.30 | 100.18 | elac homolog 2 ( coli) |
| SEQ ID NO: 5147 | Nga02982 | 1058.13 | 1109.91 | cral trio domain containing protein |
| SEQ ID NO: 5148 | Nga21040 | 962.69 | 931.66 | methyltransferase type 11 |
| SEQ ID NO: 5149 | Nga02985 | 804.30 | 864.17 | rna polymerase ii largest subunit |
| SEQ ID NO: 5150 | Nga03014 | 3975.51 | 4120.71 | dienelactone hydrolase family protein |
| SEQ ID NO: 5151 | Nga21160 | 182.44 | 156.61 | setx protein |
| SEQ ID NO: 5152 | Nga21276 | 210.53 | 175.42 | trna-splicing endonuclease positive effector-related |
| SEQ ID NO: 5153 | Nga03018 | 111.11 | 82.60 | dna2 nam7 helicase family protein |
| SEQ ID NO: 5154 | Nga03015 | 96.67 | 46.94 | protein kinase wee1 |
| SEQ ID NO: 5155 | Nga03019 | 47.62 | 44.88 | ---NA--- |
| SEQ ID NO: 5156 | Nga03011 | 499.59 | 530.60 | ring u-box domain-containing protein |
| SEQ ID NO: 5157 | Nga03010 | 1041.63 | 1351.86 | dihydrolipoamide branched chain transacylase e2 |
| SEQ ID NO: 5158 | Nga01582.02 | 532.14 | 464.71 | ---NA--- |
| SEQ ID NO: 5159 | Nga03009 | 1024.57 | 1099.99 | ---NA--- |
| SEQ ID NO: 5160 | Nga03017.1 | 404.03 | 455.47 | cell division cycle 16 |
| SEQ ID NO: 5161 | Nga03012 | 466.72 | 381.46 | nicotinate-nucleotide adenylyltransferase |
| SEQ ID NO: 5162 | Nga03013 | 241.58 | 300.98 | splicing factor 3a |
| SEQ ID NO: 5163 | Nga03360.02 | 1681.41 | 1926.98 | protein |
| SEQ ID NO: 5164 | Nga00850.2 | 1465.64 | 1654.48 | ---NA--- |
| SEQ ID NO: 5165 | Nga03366 | 1547.98 | 1043.31 | tissue specific transplantation antigen p35b |
| SEQ ID NO: 5166 | Nga03360.01 | 1681.41 | 1926.98 | protein |
| SEQ ID NO: 5167 | Nga03375 | 174.57 | 119.22 | protein |
| SEQ ID NO: 5168 | Nga03362 | 1326.99 | 1314.42 | aldehyde dehydrogenase |
| SEQ ID NO: 5169 | Nga00846.02 | 193.32 | 915.00 | ---NA--- |
| SEQ ID NO: 5170 | Nga03368 | 658.30 | 546.96 | periplasmic binding protein |
| SEQ ID NO: 5171 | Nga00845.02 | 388.86 | 398.35 | at4g35080-like protein |
| SEQ ID NO: 5172 | Nga00849.02 | 242.17 | 287.01 | set domain-containing protein |
| SEQ ID NO: 5173 | Nga03378 | 205.39 | 218.84 | mixed-lineage leukemia |
| SEQ ID NO: 5174 | Nga03371 | 28.53 | 15.45 | ---NA--- |
| SEQ ID NO: 5175 | Nga03364 | 1139.26 | 1237.23 | protein |
| SEQ ID NO: 5176 | Nga03376 | 63.38 | 42.38 | ---NA--- |
| SEQ ID NO: 5177 | Nga03373 | 65.54 | 83.59 | histone-lysine n- |
| SEQ ID NO: 5178 | Nga03361 | 880.00 | 786.35 | protein |
| SEQ ID NO: 5179 | Nga20063 | 1441.67 | 1145.42 | zip transporter |
| SEQ ID NO: 5180 | Nga20510 | 245.10 | 159.30 | chaperone protein dnaj 15 |
| SEQ ID NO: 5181 | Nga20341 | 184.44 | 221.64 | chaperone protein dnaj 16 |
| SEQ ID NO: 5182 | Nga20312.1 | 213.58 | 236.73 | wd40 repeat-containing protein |
| SEQ ID NO: 5183 | Nga00851.02 | 151.62 | 199.44 | ---NA--- |
| SEQ ID NO: 5184 | Nga00848.02 | 912.07 | 750.95 | ubiquitin-conjugating enzyme |

FIGURE 24 CD

| # | Nga model | +N rpkb | -N rpkb | GO |
|---|---|---|---|---|
| SEQ ID NO: 5185 | Nga03367 | 888.69 | 1008.26 | ---NA--- |
| SEQ ID NO: 5186 | Nga20634.1 | 81.16 | 94.19 | protein |
| SEQ ID NO: 5187 | Nga03137 | 439.05 | 556.44 | cysteinyl-trna synthetase |
| SEQ ID NO: 5188 | Nga03140 | 235.55 | 258.43 | molybdenum cofactor sulfurase |
| SEQ ID NO: 5189 | Nga03132 | 784.40 | 697.31 | protein |
| SEQ ID NO: 5190 | Nga03134 | 3020.45 | 2652.70 | nuclear distribution gene c homolog (nidulans) |
| SEQ ID NO: 5191 | Nga20507 | 523.54 | 687.48 | dual specificity phosphatase 19 |
| SEQ ID NO: 5192 | Nga03129 | 958.31 | 868.88 | haloacid dehalogenase-like hydrolase domain containing 3 |
| SEQ ID NO: 5193 | Nga03142 | 985.13 | 1119.25 | nucleotide-binding protein 1 |
| SEQ ID NO: 5194 | Nga03136 | 2128.02 | 1590.84 | mitochondrial import inner membrane translocase subunit tim16 |
| SEQ ID NO: 5195 | Nga20948 | 1559.44 | 1541.97 | alpha- -mannosyltransferase |
| SEQ ID NO: 5196 | Nga03143 | 294.72 | 281.60 | fusaric acid resistance protein conserved region |
| SEQ ID NO: 5197 | Nga03130 | 1880.21 | 1739.94 | polyadenylate-binding protein 2 |
| SEQ ID NO: 5198 | Nga20786 | 554.50 | 540.45 | centromere protein v-like |
| SEQ ID NO: 5199 | Nga03135 | 5236.96 | 4477.76 | uncharacterized protein |
| SEQ ID NO: 5200 | Nga03133 | 175.61 | 191.61 | dead deah box rna |
| SEQ ID NO: 5201 | Nga03141 | 161.46 | 149.82 | poc1 centriolar protein homolog a |
| SEQ ID NO: 5202 | Nga03139 | 1266.67 | 1354.04 | protein |
| SEQ ID NO: 5203 | Nga03131.1 | 4353.20 | 4000.45 | protein |
| SEQ ID NO: 5204 | Nga21021 | 450.47 | 471.36 | trna-specific adenosine deaminase |
| SEQ ID NO: 5205 | Nga21107.1 | 325.61 | 338.77 | histidine kinase |
| SEQ ID NO: 5206 | Nga02569 | 2515.44 | 2336.77 | expressed unknown protein [Ectocarpus siliculosus] |
| SEQ ID NO: 5207 | Nga02568 | 7730.28 | 7752.15 | 60s ribosomal protein l18a |
| SEQ ID NO: 5208 | Nga02559 | 1343.94 | 1059.01 | archain 1 |
| SEQ ID NO: 5209 | Nga02560 | 1332.36 | 1147.83 | protein |
| SEQ ID NO: 5210 | Nga20256 | 407.14 | 410.26 | aaa family cdc48 subfamily |
| SEQ ID NO: 5211 | Nga02571 | 291.49 | 334.19 | cell division cycle atpase |
| SEQ ID NO: 5212 | Nga02570 | 2636.36 | 2515.90 | crai n-terminus family protein |
| SEQ ID NO: 5213 | Nga02557 | 1664.90 | 1453.90 | betaine aldehyde dehydrogenase |
| SEQ ID NO: 5214 | Nga02566 | 446.76 | 513.11 | protein |
| SEQ ID NO: 5215 | Nga20011.1 | 326.19 | 355.92 | e3 ubiquitin-protein ligase march6 (membrane-associated ring finger protein 6) |
| SEQ ID NO: 5216 | Nga02564.1 | 844.61 | 826.95 | protein |
| SEQ ID NO: 5217 | Nga02558 | 2034.23 | 1866.51 | protein |
| SEQ ID NO: 5218 | Nga02572 | 912.85 | 662.42 | ---NA--- |
| SEQ ID NO: 5219 | Nga02563.01 | 1646.55 | 1120.59 | ---NA--- |
| SEQ ID NO: 5220 | Nga02567 | 697.11 | 623.46 | lethal leaf-spot 1 |
| SEQ ID NO: 5221 | Nga02562 | 357.70 | 401.13 | in family member (ttn-1) |
| SEQ ID NO: 5222 | Nga02561 | 712.13 | 691.44 | conserved unknown protein [Ectocarpus siliculosus] |
| SEQ ID NO: 5223 | Nga02565 | 1241.35 | 1275.61 | like dehydratase |
| SEQ ID NO: 5224 | Nga02712 | 1198.88 | 1171.68 | protein |
| SEQ ID NO: 5225 | Nga20789.1 | 176.68 | 187.44 | proteasome component ecm29 |
| SEQ ID NO: 5226 | Nga02709 | 398.46 | 474.10 | tpr repeat protein |
| SEQ ID NO: 5227 | Nga02719.01 | 441.81 | 429.69 | ---NA--- |
| SEQ ID NO: 5228 | Nga20861 | 971.41 | 793.44 | nad-dependent epimerase dehydratase |
| SEQ ID NO: 5229 | Nga02708 | 985.63 | 1077.40 | xylose isomerase |
| SEQ ID NO: 5230 | Nga02707 | 249.07 | 240.46 | tryptophanyl-trna synthetase |
| SEQ ID NO: 5231 | Nga02714.1 | 1736.95 | 1771.36 | protein |
| SEQ ID NO: 5232 | Nga02711 | 810.37 | 876.47 | hypothetical protein [Aegilops comosa] |
| SEQ ID NO: 5233 | Nga02720 | 866.17 | 646.00 | conserved unknown protein [Ectocarpus siliculosus] |
| SEQ ID NO: 5234 | Nga02716 | 1045.79 | 1275.68 | mitochondrial carrier family |
| SEQ ID NO: 5235 | Nga20870 | 1167.54 | 1234.47 | mitochondrial deoxynucleotide carrier |
| SEQ ID NO: 5236 | Nga02718 | 1444.86 | 1312.03 | clathrin coat assembly protein |
| SEQ ID NO: 5237 | Nga02713 | 5202.71 | 6201.40 | cellulase 2 |
| SEQ ID NO: 5238 | Nga02722 | 550.94 | 590.67 | 8-amino-7-oxononanoate synthase |
| SEQ ID NO: 5239 | Nga02710 | 1948.09 | 2440.72 | rna binding |
| SEQ ID NO: 5240 | Nga20660.1 | 186.38 | 198.01 | incenp-like protein |
| SEQ ID NO: 5241 | Nga21207 | 200.93 | 318.90 | methyltransferase type 12 |
| SEQ ID NO: 5242 | Nga20724 | 852.33 | 823.76 | rrna-processing protein utp23 homolog |
| SEQ ID NO: 5243 | Nga02721 | 475.73 | 452.22 | nucleic-acid-binding contains pin domain |
| SEQ ID NO: 5244 | Nga02706 | 620.17 | 641.06 | cleavage stimulation factor subunit 2-like |
| SEQ ID NO: 5245 | Nga02715 | 7392.93 | 6832.71 | s-adenosyl homocysteine hydrolase |
| SEQ ID NO: 5246 | Nga02323.02 | 2494.69 | 2768.12 | elongation factor 1- |
| SEQ ID NO: 5247 | Nga05333.2 | 798.92 | 827.30 | amp deaminase |

FIGURE 24 CE

| # | Nga model | +N rpkb | -N rpkb | GO |
|---|---|---|---|---|
| SEQ ID NO: 5248 | Nga05331.1 | 11.56 | 0.00 | ---NA--- |
| SEQ ID NO: 5249 | Nga05336 | 504.17 | 437.81 | amp deaminase |
| SEQ ID NO: 5250 | Nga03220.02 | 96.59 | 100.08 | gc-rich sequence dna-binding factor homolog |
| SEQ ID NO: 5251 | Nga03216.02 | 358.22 | 431.53 | aspartyl glutamyl-trna amidotransferase subunit b |
| SEQ ID NO: 5252 | Nga05332 | 2441.03 | 2962.63 | glycolipid 2-alpha-mannosyltransferase |
| SEQ ID NO: 5253 | Nga03215.02 | 761.85 | 870.92 | ribosomal rna processing 12 homolog ( cerevisiae) |
| SEQ ID NO: 5254 | Nga05333.1 | 798.92 | 827.30 | protein |
| SEQ ID NO: 5255 | Nga04346.02 | 876.42 | 824.31 | dna replication complex gins protein psf3 |
| SEQ ID NO: 5256 | Nga05344 | 317.68 | 345.82 | upf0187-containing protein |
| SEQ ID NO: 5257 | Nga05345 | 207.25 | 213.28 | predicted protein [Naegleria gruberi] |
| SEQ ID NO: 5258 | Nga05347 | 120.69 | 127.18 | regulator of telomere elongation helicase 1 |
| SEQ ID NO: 5259 | Nga05342 | 463.75 | 292.55 | ---NA--- |
| SEQ ID NO: 5260 | Nga05346 | 619.90 | 605.46 | ---NA--- |
| SEQ ID NO: 5261 | Nga20942 | 682.31 | 722.73 | conserved unknown protein [Ectocarpus siliculosus] |
| SEQ ID NO: 5262 | Nga03073 | 821.51 | 669.27 | conserved unknown protein [Ectocarpus siliculosus] |
| SEQ ID NO: 5263 | Nga03083 | 815.85 | 888.39 | tim17_caeel ame: full=probable mitochondrial import inner membrane translocase subunit tim17 |
| SEQ ID NO: 5264 | Nga06389.2 | 645.23 | 635.62 | supt16h protein |
| SEQ ID NO: 5265 | Nga20365 | 112.39 | 144.10 | m3g-cap-specific nuclear import receptor |
| SEQ ID NO: 5266 | Nga03069 | 2784.42 | 3048.95 | nadh-ubiquinone reductase 75 kda subunit precursor |
| SEQ ID NO: 5267 | Nga03076 | 555.19 | 570.83 | pyrroline-5-carboxylate reductase |
| SEQ ID NO: 5268 | Nga03070 | 850.52 | 1031.86 | asparaginyl-trna synthetase |
| SEQ ID NO: 5269 | Nga03065.01 | 525.64 | 552.61 | adenosine 3 -phospho 5 -phosphosulfate transporter 2 |
| SEQ ID NO: 5270 | Nga03067 | 479.46 | 488.89 | phosphatidylinositol-4-phosphate 5-kinase its3 |
| SEQ ID NO: 5271 | Nga03077 | 411.33 | 398.63 | asparagine-linked glycosylation protein 11 homolog |
| SEQ ID NO: 5272 | Nga03066.01 | 1130.43 | 1118.00 | coiled-coil domain 6-like protein |
| SEQ ID NO: 5273 | Nga20129 | 333.33 | 415.24 | conserved unknown protein [Ectocarpus siliculosus] |
| SEQ ID NO: 5274 | Nga03078 | 1458.71 | 1454.39 | eukaryotic translation initiation factor 6 |
| SEQ ID NO: 5275 | Nga03072.01 | 1389.98 | 1476.31 | ---NA--- |
| SEQ ID NO: 5276 | Nga03063.01 | 1093.05 | 887.33 | ---NA--- |
| SEQ ID NO: 5277 | Nga03075 | 281.63 | 255.61 | fad dependent oxidoreductase |
| SEQ ID NO: 5278 | Nga04730.2 | 247.45 | 315.99 | sorting nexin 16 isoform 1 |
| SEQ ID NO: 5279 | Nga03074 | 741.21 | 888.44 | actin-related protein 6 |
| SEQ ID NO: 5280 | Nga03081 | 58.67 | 94.91 | ---NA--- |
| SEQ ID NO: 5281 | Nga03071 | 6554.83 | 6984.82 | 14-3-3-like protein |
| SEQ ID NO: 5282 | Nga03064 | 470.09 | 271.14 | protein of hypothetical function duf1445 |
| SEQ ID NO: 5283 | Nga00377 | 162.23 | 190.84 | rna-binding protein 26 |
| SEQ ID NO: 5284 | Nga00385 | 392.86 | 430.39 | conserved unknown protein [Ectocarpus siliculosus] |
| SEQ ID NO: 5285 | Nga00384 | 2918.39 | 2733.34 | prefoldin subunit 1 |
| SEQ ID NO: 5286 | Nga00376.01 | 2173.73 | 2140.08 | centrin 3 |
| SEQ ID NO: 5287 | Nga00373 | 762.09 | 1087.48 | 50s ribosomal protein l21 |
| SEQ ID NO: 5288 | Nga20414 | 174.11 | 280.48 | rna binding motif protein 34 |
| SEQ ID NO: 5289 | Nga00374 | 384.47 | 358.41 | sf- |
| SEQ ID NO: 5290 | Nga20509 | 250.35 | 325.42 | rna recognition motif-containing protein |
| SEQ ID NO: 5291 | Nga00379.01 | 689.68 | 757.11 | protein |
| SEQ ID NO: 5292 | Nga00383 | 463.08 | 537.05 | ---NA--- |
| SEQ ID NO: 5293 | Nga00380 | 444.30 | 528.29 | protein |
| SEQ ID NO: 5294 | Nga00386 | 835.92 | 1075.75 | ubiquinone biosynthesis protein coq9 |
| SEQ ID NO: 5295 | Nga00375 | 592.97 | 769.27 | mechanosensitive ion channel |
| SEQ ID NO: 5296 | Nga00388 | 332.64 | 331.62 | prenylcysteine oxidase |
| SEQ ID NO: 5297 | Nga20710 | 111.11 | 140.91 | phycoerythrobilin:ferredoxin oxidoreductase |
| SEQ ID NO: 5298 | Nga00378 | 824.62 | 558.14 | serologically defined breast cancer antigen ny-br-84 |
| SEQ ID NO: 5299 | Nga00387 | 559.09 | 534.05 | ribosomal rna-processing protein 7 homolog a-like |
| SEQ ID NO: 5300 | Nga00382 | 257.19 | 243.77 | protein |
| SEQ ID NO: 5301 | Nga20036 | 277.78 | 334.48 | tnf receptor-associated factor 4 |
| SEQ ID NO: 5302 | Nga00381 | 973.76 | 1309.47 | carbamoyl-phosphate synthase |
| SEQ ID NO: 5303 | Nga02488 | 102.22 | 88.58 | cof-like hydrolase |
| SEQ ID NO: 5304 | Nga02487 | 173.19 | 142.28 | ---NA--- |
| SEQ ID NO: 5305 | Nga02494 | 374.76 | 359.72 | sua5 family protein |
| SEQ ID NO: 5306 | Nga02493.1 | 102.33 | 114.38 | wd repeat-containing protein ybr281c |
| SEQ ID NO: 5307 | Nga02330.02 | 2612.90 | 2387.77 | nadh-ubiquinone oxidoreductase kda subunit |
| SEQ ID NO: 5308 | Nga06751.2 | 215.61 | 248.63 | nucleolar protein |
| SEQ ID NO: 5309 | Nga02489.01 | 709.02 | 658.32 | ---NA--- |
| SEQ ID NO: 5310 | Nga02490.1 | 186.19 | 169.96 | hypothetical protein CAOG_06333 [Capsaspora owczarzaki ATCC 30864] |

FIGURE 24 CF

| # | Nga model | +N rpkb | -N rpkb | GO |
|---|---|---|---|---|
| SEQ ID NO: 5311 | Nga02610 | 1611.61 | 1457.21 | 26s proteasome subunit 4 |
| SEQ ID NO: 5312 | Nga02609 | 1449.69 | 1763.66 | dioxygenase-like protein |
| SEQ ID NO: 5313 | Nga02615 | 510.10 | 483.69 | protein |
| SEQ ID NO: 5314 | Nga02612 | 418.81 | 317.67 | protein |
| SEQ ID NO: 5315 | Nga02617 | 295.04 | 362.02 | ---NA--- |
| SEQ ID NO: 5316 | Nga02613 | 980.62 | 971.27 | pre-mrna-splicing factor |
| SEQ ID NO: 5317 | Nga02608.01 | 5491.92 | 5974.05 | expressed unknown protein [Ectocarpus siliculosus] |
| SEQ ID NO: 5318 | Nga02616 | 136.70 | 139.97 | ---NA--- |
| SEQ ID NO: 5319 | Nga02614.01 | 352.17 | 411.06 | choline ethanolaminephosphotransferase 1 |
| SEQ ID NO: 5320 | Nga02611 | 727.27 | 997.89 | ---NA--- |
| SEQ ID NO: 5321 | Nga00554.2 | 187.18 | 217.34 | dihydrouridine synthase |
| SEQ ID NO: 5322 | Nga00585 | 1501.49 | 1132.45 | delta-aminolevulinic acid dehydratase |
| SEQ ID NO: 5323 | Nga00757.2 | 503.26 | 513.37 | protein |
| SEQ ID NO: 5324 | Nga00583 | 214.56 | 209.89 | cg9383-pa |
| SEQ ID NO: 5325 | Nga20689 | 333.33 | 380.98 | ---NA--- |
| SEQ ID NO: 5326 | Nga00589 | 414.81 | 437.31 | ---NA--- |
| SEQ ID NO: 5327 | Nga21194 | 451.30 | 517.70 | expressed unknown protein [Ectocarpus siliculosus] |
| SEQ ID NO: 5328 | Nga00545 | 802.40 | 773.47 | kinesin heavy chain |
| SEQ ID NO: 5329 | Nga00547 | 239.90 | 271.98 | protein |
| SEQ ID NO: 5330 | Nga00593 | 204.70 | 242.35 | polyribonucleotide nucleotidyltransferase |
| SEQ ID NO: 5331 | Nga00590 | 717.56 | 726.29 | low psii accumulation 3 protein |
| SEQ ID NO: 5332 | Nga21110 | 126.20 | 173.04 | polyribonucleotide nucleotidyltransferase |
| SEQ ID NO: 5333 | Nga00574 | 2288.15 | 2147.37 | aspartate aminotransferase |
| SEQ ID NO: 5334 | Nga00575 | 976.41 | 799.73 | microtubule -associated protein eb1 |
| SEQ ID NO: 5335 | Nga00591 | 1143.99 | 1161.90 | g u mismatch-specific dna glycosylase |
| SEQ ID NO: 5336 | Nga00577 | 537.44 | 447.83 | protein |
| SEQ ID NO: 5337 | Nga00584 | 1501.51 | 1661.40 | nudix hydrolase 13 |
| SEQ ID NO: 5338 | Nga00551 | 310.09 | 345.75 | xanthine molybdopterin binding subunit |
| SEQ ID NO: 5339 | Nga00587 | 1667.35 | 1980.41 | adenylosuccinate lyase |
| SEQ ID NO: 5340 | Nga00548 | 1566.67 | 1390.15 | conserved unknown protein [Ectocarpus siliculosus] |
| SEQ ID NO: 5341 | Nga20846 | 414.01 | 494.47 | tubby-like protein |
| SEQ ID NO: 5342 | Nga00597 | 363.64 | 496.03 | cleavage induced conserved hypothetical protein [Albugo laibachii Nc14] |
| SEQ ID NO: 5343 | Nga00586.1 | 3477.54 | 3371.74 | thioredoxin |
| SEQ ID NO: 5344 | Nga00544 | 1830.57 | 1760.08 | ornithine aminotransferase |
| SEQ ID NO: 5345 | Nga00553 | 503.34 | 480.90 | protein arginine n-methyltransferase 10 |
| SEQ ID NO: 5346 | Nga20965 | 921.92 | 1034.44 | predicted protein [Thalassiosira pseudonana CCMP1335] |
| SEQ ID NO: 5347 | Nga00592 | 384.76 | 386.91 | protein |
| SEQ ID NO: 5348 | Nga21289 | 1169.44 | 1207.37 | protein |
| SEQ ID NO: 5349 | Nga00543 | 3443.12 | 2936.35 | ef-1 guanine nucleotide exchange domain-containing |
| SEQ ID NO: 5350 | Nga00588 | 1016.95 | 965.42 | protein |
| SEQ ID NO: 5351 | Nga00554.1 | 187.18 | 217.34 | protein |
| SEQ ID NO: 5352 | Nga00576 | 1134.83 | 1363.17 | protein |
| SEQ ID NO: 5353 | Nga00579 | 9785.98 | 9944.01 | mitochondrial phosphate transporter |
| SEQ ID NO: 5354 | Nga00582 | 793.36 | 708.55 | methylenetetrahydrofolate reductase |
| SEQ ID NO: 5355 | Nga00550 | 605.26 | 690.98 | atp-binding cassette |
| SEQ ID NO: 5356 | Nga00546 | 1581.98 | 1639.49 | vacuolar protein sorting-associated protein 25 |
| SEQ ID NO: 5357 | Nga00580 | 665.14 | 435.61 | conserved hypothetical protein [Albugo laibachii Nc14] |
| SEQ ID NO: 5358 | Nga03390 | 839.33 | 905.57 | abc1 family protein |
| SEQ ID NO: 5359 | Nga03391 | 891.97 | 704.23 | dnaj-like protein |
| SEQ ID NO: 5360 | Nga03392 | 15773.63 | 14925.45 | chloroplast sedoheptulose- -bisphosphatase |
| SEQ ID NO: 5361 | Nga03393 | 751.24 | 703.55 | ap-2 complex subunit |
| SEQ ID NO: 5362 | Nga20087 | 435.68 | 458.01 | protein |
| SEQ ID NO: 5363 | Nga21048 | 361.18 | 393.90 | dead-box atp-dependent rna helicase 50 |
| SEQ ID NO: 5364 | Nga21124 | 4855.17 | 5145.36 | related to single-stranded dna binding protein 12k chain |
| SEQ ID NO: 5365 | Nga03394 | 449.02 | 570.99 | protein |
| SEQ ID NO: 5366 | Nga03397.1 | 957.21 | 1058.84 | ribulose-phosphate 3-epimerase |
| SEQ ID NO: 5367 | Nga03396 | 1058.46 | 1206.72 | ---NA--- |
| SEQ ID NO: 5368 | Nga03398.01 | 2625.09 | 3123.45 | ---NA--- |
| SEQ ID NO: 5369 | Nga03395.01 | 617.11 | 421.31 | alkaline phosphatase d |
| SEQ ID NO: 5370 | Nga02916 | 468.93 | 503.42 | ---NA--- |
| SEQ ID NO: 5371 | Nga01439.02 | 6.01 | 9.76 | mismatch repair protein 5 |
| SEQ ID NO: 5372 | Nga02915 | 1330.78 | 1278.30 | family with sequence similarity member a |
| SEQ ID NO: 5373 | Nga02918 | 206.71 | 173.51 | gcn5-related n-acetyltransferase |

FIGURE 24 CG

| # | Nga model | +N rpkb | -N rpkb | GO |
|---|---|---|---|---|
| SEQ ID NO: 5374 | Nga01434.02 | 1309.20 | 1273.96 | zip zinc transporter family protein |
| SEQ ID NO: 5375 | Nga01435.02 | 321.71 | 320.46 | protein polybromo-1 |
| SEQ ID NO: 5376 | Nga01436.02 | 370.20 | 472.56 | inosine triphosphate pyrophosphatase |
| SEQ ID NO: 5377 | Nga02912 | 11436.47 | 12996.71 | superoxide dismutase |
| SEQ ID NO: 5378 | Nga01437.02 | 304.95 | 306.79 | alpha beta hydrolase fold family |
| SEQ ID NO: 5379 | Nga02913 | 2211.64 | 2238.77 | abc subfamily abcg |
| SEQ ID NO: 5380 | Nga01438.02 | 276.63 | 247.29 | protein phosphatase 1 beta |
| SEQ ID NO: 5381 | Nga20379.1 | 138.85 | 143.64 | protein |
| SEQ ID NO: 5382 | Nga06732 | 855.97 | 857.37 | fatty-acyl elongase |
| SEQ ID NO: 5383 | Nga06737 | 282.11 | 272.30 | ---NA--- |
| SEQ ID NO: 5384 | Nga06735 | 8771.85 | 9608.65 | heat shock protein 70 |
| SEQ ID NO: 5385 | Nga04494.2 | 1548.54 | 1513.11 | glutaredoxin-like protein |
| SEQ ID NO: 5386 | Nga06730 | 110.98 | 128.53 | dna polymerase alpha catalytic subunit |
| SEQ ID NO: 5387 | Nga06731.1 | 552.46 | 538.02 | fad-linked oxidoreductase |
| SEQ ID NO: 5388 | Nga06733 | 227.40 | 204.90 | expressed unknown protein [Ectocarpus siliculosus] |
| SEQ ID NO: 5389 | Nga06736 | 640.06 | 815.39 | wd repeat protein 12 |
| SEQ ID NO: 5390 | Nga21263 | 893.11 | 920.14 | serine threonine protein kinase |
| SEQ ID NO: 5391 | Nga21116 | 2007.27 | 1836.25 | lipid phosphate phosphatase 3 |
| SEQ ID NO: 5392 | Nga20103 | 344.83 | 415.55 | cytochrome b5-related protein |
| SEQ ID NO: 5393 | Nga20366 | 459.00 | 468.82 | ubiquitin-conjugating enzyme e2 j1 |
| SEQ ID NO: 5394 | Nga01815.02 | 774.27 | 649.59 | cral n-terminus family protein |
| SEQ ID NO: 5395 | Nga06120.1 | 290.91 | 317.94 | protein |
| SEQ ID NO: 5396 | Nga06117 | 485.28 | 547.67 | diphthine synthase |
| SEQ ID NO: 5397 | Nga06119 | 4204.07 | 4735.95 | lipase domain-containing protein |
| SEQ ID NO: 5398 | Nga20836 | 1088.88 | 1119.58 | protein |
| SEQ ID NO: 5399 | Nga20258 | 430.41 | 399.09 | atp-binding cassette subfamily member group wbc protein 2 |
| SEQ ID NO: 5400 | Nga20166 | 377.57 | 336.72 | abc subfamily abcg |
| SEQ ID NO: 5401 | Nga06122 | 613.80 | 736.47 | alkylated dna repair protein |
| SEQ ID NO: 5402 | Nga06121 | 264.98 | 292.52 | carboxyl-terminal protease |
| SEQ ID NO: 5403 | Nga03175 | 654.28 | 665.96 | protein |
| SEQ ID NO: 5404 | Nga03165.1 | 277.12 | 337.58 | glycoside hydrolase family 37 |
| SEQ ID NO: 5405 | Nga03158 | 8200.95 | 8424.20 | 40s ribosomal protein |
| SEQ ID NO: 5406 | Nga03163 | 2082.76 | 2372.01 | cysteine desulfurase |
| SEQ ID NO: 5407 | Nga03172 | 194.95 | 189.01 | tripeptidyl peptidase i |
| SEQ ID NO: 5408 | Nga20554 | 297.49 | 283.43 | protein |
| SEQ ID NO: 5409 | Nga03161 | 333.96 | 341.36 | leucine carboxyl methyltransferase |
| SEQ ID NO: 5410 | Nga02542.02 | 3636.79 | 3271.84 | ferredoxin |
| SEQ ID NO: 5411 | Nga03162 | 536.93 | 534.44 | ureidoglycolate dehydrogenase |
| SEQ ID NO: 5412 | Nga03159 | 879.61 | 1062.02 | ---NA--- |
| SEQ ID NO: 5413 | Nga03166 | 7892.28 | 8094.39 | gtp-binding protein sas1 |
| SEQ ID NO: 5414 | Nga03168 | 332.43 | 303.66 | gtp-binding protein |
| SEQ ID NO: 5415 | Nga03160 | 1284.64 | 1150.72 | protein |
| SEQ ID NO: 5416 | Nga03169 | 1995.61 | 2344.90 | protein |
| SEQ ID NO: 5417 | Nga03170 | 362.50 | 366.88 | conserved unknown protein [Ectocarpus siliculosus] |
| SEQ ID NO: 5418 | Nga03176 | 168.75 | 142.17 | ---NA--- |
| SEQ ID NO: 5419 | Nga03167 | 4364.02 | 4906.08 | guanine nucleotide binding protein (g protein) beta polypeptide 2-like 1 |
| SEQ ID NO: 5420 | Nga03174 | 291.90 | 220.44 | gram domain family protein |
| SEQ ID NO: 5421 | Nga03164 | 375.49 | 382.49 | amino acid transporter |
| SEQ ID NO: 5422 | Nga03171 | 427.00 | 283.72 | clathrin coat assembly protein ap-1 |
| SEQ ID NO: 5423 | Nga01450.02 | 127.06 | 184.11 | ---NA--- |
| SEQ ID NO: 5424 | Nga01456.02 | 131.94 | 90.27 | ---NA--- |
| SEQ ID NO: 5425 | Nga01455.02 | 100.67 | 87.24 | ---NA--- |
| SEQ ID NO: 5426 | Nga01453.2 | 470.62 | 390.38 | dnaj domain |
| SEQ ID NO: 5427 | Nga05272 | 151.79 | 204.43 | ---NA--- |
| SEQ ID NO: 5428 | Nga05275 | 200.00 | 292.91 | adp-ribosylation factor gtpase-activating protein agd6 |
| SEQ ID NO: 5429 | Nga21196.1 | 181.19 | 168.94 | yth domain containing 2 |
| SEQ ID NO: 5430 | Nga05267 | 487.04 | 524.97 | pre-mrna-splicing factor sf2 |
| SEQ ID NO: 5431 | Nga20318.1 | 568.29 | 583.89 | lyr family of fe s cluster biogenesis protein |
| SEQ ID NO: 5432 | Nga01451.02 | 769.63 | 823.71 | protein |
| SEQ ID NO: 5433 | Nga20298 | 578.13 | 395.33 | c transferase |
| SEQ ID NO: 5434 | Nga20314 | 389.06 | 358.82 | c transferase |
| SEQ ID NO: 5435 | Nga01452.02 | 175.93 | 164.13 | snf2 family dna-dependent atpase |
| SEQ ID NO: 5436 | Nga01448.02 | 1506.52 | 2076.07 | phosphoserine aminotransferase |

FIGURE 24 CH

| # | Nga model | +N rpkb | -N rpkb | GO |
|---|---|---|---|---|
| SEQ ID NO: 5437 | Nga05264 | 183.79 | 168.17 | t-snare family protein |
| SEQ ID NO: 5438 | Nga20698 | 627.80 | 547.28 | protein |
| SEQ ID NO: 5439 | Nga05643 | 502.30 | 465.78 | pre-mrna cleavage complex ii protein |
| SEQ ID NO: 5440 | Nga05650 | 1037.45 | 883.41 | transmembrane protein 128 |
| SEQ ID NO: 5441 | Nga05644 | 399.35 | 380.72 | protein |
| SEQ ID NO: 5442 | Nga05648 | 254.80 | 335.87 | protein |
| SEQ ID NO: 5443 | Nga04808.02 | 871.60 | 961.00 | mg-protoporphyrin ix methyl transferase |
| SEQ ID NO: 5444 | Nga05647 | 804.55 | 688.80 | protein |
| SEQ ID NO: 5445 | Nga04807.02 | 788.12 | 811.47 | uncharacterized protein |
| SEQ ID NO: 5446 | Nga05642 | 900.27 | 963.32 | ccaat-box binding factor hap3 |
| SEQ ID NO: 5447 | Nga04993.02 | 384.55 | 226.49 | tpr domain-containing protein |
| SEQ ID NO: 5448 | Nga20145 | 140.26 | 152.83 | sentrin-specific protease 7 |
| SEQ ID NO: 5449 | Nga02542.01 | 3636.79 | 3271.84 | ferredoxin |
| SEQ ID NO: 5450 | Nga02543 | 65.22 | 102.04 | ---NA--- |
| SEQ ID NO: 5451 | Nga02538 | 2786.50 | 2907.07 | glycosyl hydrolase family 1 |
| SEQ ID NO: 5452 | Nga02540 | 1883.64 | 1799.30 | subfamily member 4 |
| SEQ ID NO: 5453 | Nga02544 | 156.57 | 150.40 | microfibrillar-associated protein 1 |
| SEQ ID NO: 5454 | Nga02533 | 9225.73 | 7041.02 | phosphoglycerate mutase |
| SEQ ID NO: 5455 | Nga02541 | 65.12 | 78.09 | ---NA--- |
| SEQ ID NO: 5456 | Nga20971 | 2024.18 | 2071.83 | ---NA--- |
| SEQ ID NO: 5457 | Nga02539 | 335.74 | 332.40 | ---NA--- |
| SEQ ID NO: 5458 | Nga02534 | 2248.05 | 2311.24 | 24-sterol c-methyltransferase |
| SEQ ID NO: 5459 | Nga02537 | 3500.00 | 3981.18 | hypothetical protein Esi_0341_0019 [Ectocarpus siliculosus] |
| SEQ ID NO: 5460 | Nga02536 | 298.25 | 164.70 | ---NA--- |
| SEQ ID NO: 5461 | Nga02535 | 53.39 | 56.42 | dna repair protein rad51 |
| SEQ ID NO: 5462 | Nga20490 | 396.63 | 424.08 | conserved unknown protein [Ectocarpus siliculosus] |
| SEQ ID NO: 5463 | Nga20283 | 302.97 | 354.15 | nadh dehydrogenase |
| SEQ ID NO: 5464 | Nga21099 | 1258.20 | 1488.40 | cationic amino acid transporter |
| SEQ ID NO: 5465 | Nga02532 | 1146.72 | 1472.88 | predicted protein [Thalassiosira pseudonana CCMP1335] |
| SEQ ID NO: 5466 | Nga05076 | 211.22 | 184.11 | hypothetical protein Esi_0089_0116 [Ectocarpus siliculosus] |
| SEQ ID NO: 5467 | Nga05079 | 83.33 | 112.84 | elegans protein confirmed by transcript evidence |
| SEQ ID NO: 5468 | Nga05077 | 210.76 | 178.85 | protein |
| SEQ ID NO: 5469 | Nga20513.1 | 198.38 | 188.58 | aprataxin |
| SEQ ID NO: 5470 | Nga20574.1 | 116.79 | 229.30 | purine nucleoside phosphoramidase |
| SEQ ID NO: 5471 | Nga05075 | 188.54 | 193.34 | histone deacetylase family protein |
| SEQ ID NO: 5472 | Nga04813.02 | 691.41 | 580.01 | protein |
| SEQ ID NO: 5473 | Nga05080 | 129.25 | 162.12 | ---NA--- |
| SEQ ID NO: 5474 | Nga05067 | 577.78 | 590.69 | zinc iron permease |
| SEQ ID NO: 5475 | Nga05053.02 | 3648.17 | 3444.64 | vacuolar h+ atpase b subunit |
| SEQ ID NO: 5476 | Nga05068 | 59.24 | 81.41 | vacuolar protein sorting protein |
| SEQ ID NO: 5477 | Nga20281.1 | 237.84 | 253.24 | rna-binding protein nova-2 |
| SEQ ID NO: 5478 | Nga05066.01 | 164.88 | 164.69 | ---NA--- |
| SEQ ID NO: 5479 | Nga05062 | 28.80 | 23.40 | inorganic phosphate |
| SEQ ID NO: 5480 | Nga05063 | 1711.60 | 1879.35 | sulfate large subunit |
| SEQ ID NO: 5481 | Nga05058.01 | 5137.54 | 3468.91 | ferredoxin-dependent bilin reductase |
| SEQ ID NO: 5482 | Nga05061.01 | 1195.18 | 788.67 | phosphoinositol transporter |
| SEQ ID NO: 5483 | Nga05065 | 189.25 | 230.33 | zinc iron permease |
| SEQ ID NO: 5484 | Nga05069 | 255.56 | 284.85 | vacuolar protein sorting protein |
| SEQ ID NO: 5485 | Nga04461.02 | 698.16 | 611.27 | deah (asp-glu-ala-his) box polypeptide 35 |
| SEQ ID NO: 5486 | Nga05064 | 1600.10 | 1420.39 | phytoene desaturase |
| SEQ ID NO: 5487 | Nga05630.01 | 2018.06 | 2342.56 | apolipoprotein a-i-binding protein precursor |
| SEQ ID NO: 5488 | Nga05626 | 1207.51 | 1206.68 | exportin 1 (crm1 yeast) |
| SEQ ID NO: 5489 | Nga21020 | 105.56 | 126.38 | dna excision repair protein rad2 |
| SEQ ID NO: 5490 | Nga05628 | 584.34 | 591.89 | protein |
| SEQ ID NO: 5491 | Nga20889 | 70.42 | 61.03 | protein |
| SEQ ID NO: 5492 | Nga20711 | 160.92 | 173.07 | protein |
| SEQ ID NO: 5493 | Nga05625 | 983.51 | 1005.66 | thioredoxin o |
| SEQ ID NO: 5494 | Nga05632 | 70.55 | 51.58 | peptide-n -(n-acetyl-beta-glucosaminyl)asparagine amidase |
| SEQ ID NO: 5495 | Nga05627 | 600.97 | 625.35 | b-keto acyl reductase |
| SEQ ID NO: 5496 | Nga05629 | 1184.75 | 1269.37 | ---NA--- |
| SEQ ID NO: 5497 | Nga05631 | 363.77 | 304.38 | ---NA--- |
| SEQ ID NO: 5498 | Nga05633 | 766.80 | 672.20 | ---NA--- |
| SEQ ID NO: 5499 | Nga04452.02 | 3876.38 | 5172.26 | ---NA--- |
| SEQ ID NO: 5500 | Nga20212 | 210.79 | 209.31 | dual specificity phosphatase 3 |

FIGURE 24 CI

| # | Nga model | +N rpkb | -N rpkb | GO |
|---|---|---|---|---|
| SEQ ID NO: 5501 | Nga06102 | 234.89 | 252.48 | arginyl-trna synthetase |
| SEQ ID NO: 5502 | Nga06101 | 337.35 | 242.38 | protein |
| SEQ ID NO: 5503 | Nga06100 | 325.73 | 315.78 | mitochondrial carrier protein |
| SEQ ID NO: 5504 | Nga06107 | 895.28 | 570.91 | ---NA--- |
| SEQ ID NO: 5505 | Nga06104 | 359.18 | 502.03 | major intrinsic protein |
| SEQ ID NO: 5506 | Nga06108 | 716.83 | 689.10 | protein |
| SEQ ID NO: 5507 | Nga06103 | 1903.11 | 2124.96 | histidinol-phosphate aminotransferase |
| SEQ ID NO: 5508 | Nga06106 | 159.16 | 194.47 | rna polymerase iii subunit |
| SEQ ID NO: 5509 | Nga06208 | 184.80 | 184.56 | rad1 homolog ( pombe) |
| SEQ ID NO: 5510 | Nga21151 | 162.87 | 190.54 | cirhin |
| SEQ ID NO: 5511 | Nga06210 | 205.35 | 204.85 | homodimeric type |
| SEQ ID NO: 5512 | Nga20518 | 113.35 | 190.09 | protein |
| SEQ ID NO: 5513 | Nga20616 | 54.14 | 82.79 | ---NA--- |
| SEQ ID NO: 5514 | Nga06207 | 627.82 | 582.27 | replication protein a 70 kda dna-binding subunit |
| SEQ ID NO: 5515 | Nga06206 | 537.65 | 497.23 | conserved unknown protein [Ectocarpus siliculosus] |
| SEQ ID NO: 5516 | Nga06211 | 307.38 | 421.75 | ---NA--- |
| SEQ ID NO: 5517 | Nga06209 | 735.09 | 639.56 | 4 -phosphopantetheinyl transferase |
| SEQ ID NO: 5518 | Nga06205 | 20225.50 | 18271.71 | cyclophilin |
| SEQ ID NO: 5519 | Nga21307 | 202.13 | 224.71 | conserved unknown protein [Ectocarpus siliculosus] |
| SEQ ID NO: 5520 | Nga06695 | 359.09 | 275.67 | serine threonine protein kinase |
| SEQ ID NO: 5521 | Nga06692 | 671.77 | 618.23 | riboflavin biosynthesis protein |
| SEQ ID NO: 5522 | Nga04204.02 | 12867.52 | 15623.75 | acyl- dehydrogenase |
| SEQ ID NO: 5523 | Nga06693 | 1438.04 | 1522.31 | membrane protein |
| SEQ ID NO: 5524 | Nga20303 | 571.43 | 549.54 | nuclear autoantigenic sperm protein |
| SEQ ID NO: 5525 | Nga20760.1 | 1417.03 | 1398.98 | uncharacterized protein |
| SEQ ID NO: 5526 | Nga04205.02 | 1129.97 | 1359.07 | ---NA--- |
| SEQ ID NO: 5527 | Nga06690 | 5409.46 | 5190.74 | conserved unknown protein [Ectocarpus siliculosus] |
| SEQ ID NO: 5528 | Nga06382 | 1264.24 | 1184.40 | ---NA--- |
| SEQ ID NO: 5529 | Nga02348.02 | 345.29 | 397.21 | sam-dependent methyltransferase |
| SEQ ID NO: 5530 | Nga06383 | 206.60 | 236.02 | arsenite inducible rna associated protein aip- |
| SEQ ID NO: 5531 | Nga06379 | 638.72 | 786.71 | dead-box atp-dependent rna helicase 42 |
| SEQ ID NO: 5532 | Nga06384 | 100.59 | 123.92 | ---NA--- |
| SEQ ID NO: 5533 | Nga05685 | 243.00 | 284.75 | wd repeat-containing protein 82 |
| SEQ ID NO: 5534 | Nga05678 | 9966.85 | 22234.88 | glutamine synthetase |
| SEQ ID NO: 5535 | Nga05686 | 2698.50 | 2620.86 | conserved unknown protein [Ectocarpus siliculosus] |
| SEQ ID NO: 5536 | Nga05684 | 657.37 | 455.20 | drug metabolite transporter superfamily |
| SEQ ID NO: 5537 | Nga01534.2 | 3648.79 | 2991.10 | zeaxanthin epoxidase |
| SEQ ID NO: 5538 | Nga05683 | 39.04 | 26.02 | ---NA--- |
| SEQ ID NO: 5539 | Nga05680 | 333.33 | 201.17 | pfkb-like carbohydrate kinase family protein |
| SEQ ID NO: 5540 | Nga05681 | 522.48 | 451.54 | rip metalloprotease |
| SEQ ID NO: 5541 | Nga20562.1 | 152.05 | 190.04 | ---NA--- |
| SEQ ID NO: 5542 | Nga05682 | 221.60 | 242.07 | phosphatidate cytidylyltransferase |
| SEQ ID NO: 5543 | Nga02819.01 | 385.71 | 330.13 | ---NA--- |
| SEQ ID NO: 5544 | Nga02820.1 | 871.08 | 761.16 | ---NA--- |
| SEQ ID NO: 5545 | Nga02817.01 | 1953.22 | 1704.03 | polymerase ii (dna directed) polypeptide e |
| SEQ ID NO: 5546 | Nga02821 | 857.14 | 960.07 | dehydroascorbate reductase |
| SEQ ID NO: 5547 | Nga02815 | 3479.95 | 3712.93 | succinate dehydrogenase flavoprotein subunit |
| SEQ ID NO: 5548 | Nga02814 | 1072.66 | 898.90 | protein |
| SEQ ID NO: 5549 | Nga02816 | 294.12 | 351.08 | myotubularin |
| SEQ ID NO: 5550 | Nga20252.1 | 224.86 | 176.95 | inactive receptor kinase |
| SEQ ID NO: 5551 | Nga02812 | 3833.67 | 4187.86 | atp-citrate synthase |
| SEQ ID NO: 5552 | Nga02813.01 | 226.29 | 307.50 | protein |
| SEQ ID NO: 5553 | Nga20606 | 242.06 | 214.93 | short chain dehydrogenase reductase family protein |
| SEQ ID NO: 5554 | Nga02811 | 743.52 | 736.72 | ---NA--- |
| SEQ ID NO: 5555 | Nga02818.1 | 566.34 | 582.59 | threonine synthase |
| SEQ ID NO: 5556 | Nga20030 | 3646.05 | 2345.15 | predicted protein [Phaeodactylum tricornutum CCAP 1055/1] |
| SEQ ID NO: 5557 | Nga20983 | 371.79 | 481.02 | ran protein binding protein |
| SEQ ID NO: 5558 | Nga20349 | 106.82 | 83.65 | gnat family |
| SEQ ID NO: 5559 | Nga20656 | 491.97 | 520.27 | uba thif-type nad fad binding protein |
| SEQ ID NO: 5560 | Nga20355 | 492.06 | 552.12 | molybdopterin biosynthesis protein |
| SEQ ID NO: 5561 | Nga20775 | 372.45 | 421.38 | ubiquitin specific peptidase 54 |
| SEQ ID NO: 5562 | Nga21109 | 788.85 | 672.61 | repb family protein |
| SEQ ID NO: 5563 | Nga21142 | 2363.17 | 2449.78 | trans-2-enoyl- reductase |
| SEQ ID NO: 5564 | Nga20035 | 3342.15 | 2333.70 | protein |

FIGURE 24 CJ

| # | Nga model | +N rpkb | -N rpkb | GO |
|---|---|---|---|---|
| SEQ ID NO: 5565 | Nga20816 | 419.64 | 383.03 | octopine dehydrogenase |
| SEQ ID NO: 5566 | Nga21030 | 1389.45 | 1211.50 | protein |
| SEQ ID NO: 5567 | Nga20763 | 670.37 | 812.72 | vacuolar sorting protein 35 |
| SEQ ID NO: 5568 | Nga20045 | 11066.08 | 8994.01 | calreticulin precursor |
| SEQ ID NO: 5569 | Nga21269 | 106.84 | 97.21 | accelerated cell death 1 |
| SEQ ID NO: 5570 | Nga20970 | 10396.14 | 10596.85 | protein |
| SEQ ID NO: 5571 | Nga05831.01 | 1936.49 | 1515.83 | pentapeptide repeat protein |
| SEQ ID NO: 5572 | Nga05836 | 803.98 | 1238.73 | ---NA--- |
| SEQ ID NO: 5573 | Nga05833 | 1376.64 | 1269.77 | protein |
| SEQ ID NO: 5574 | Nga05832 | 114.17 | 102.00 | anthranilate phosphoribosyltransferase |
| SEQ ID NO: 5575 | Nga04855.02 | 0.00 | 66.87 | ---NA--- |
| SEQ ID NO: 5576 | Nga05834 | 440.46 | 490.76 | protein |
| SEQ ID NO: 5577 | Nga05835.1 | 267.36 | 292.12 | ring zinc finger-containing protein |
| SEQ ID NO: 5578 | Nga05830 | 338.03 | 356.77 | ubiquitin specific peptidase 5 (isopeptidase t) |
| SEQ ID NO: 5579 | Nga06407 | 505.82 | 578.33 | alpha- -mannosyltransferase alg9 |
| SEQ ID NO: 5580 | Nga01883.02 | 88.71 | 270.81 | ---NA--- |
| SEQ ID NO: 5581 | Nga06408 | 1988.98 | 1908.13 | d-lactate dehydrogenase |
| SEQ ID NO: 5582 | Nga03337 | 357.87 | 423.10 | coiled-coil domain-containing protein 12 |
| SEQ ID NO: 5583 | Nga03333 | 497.86 | 450.28 | atpase family aaa domain-containing protein 3 |
| SEQ ID NO: 5584 | Nga00838.2 | 940.72 | 973.95 | uv excision repair protein rad23 |
| SEQ ID NO: 5585 | Nga00840.02 | 285.71 | 424.31 | ---NA--- |
| SEQ ID NO: 5586 | Nga03350 | 683.59 | 647.40 | acid phosphatase |
| SEQ ID NO: 5587 | Nga03339 | 646.01 | 828.28 | rrna (guanine-n -)-methyltransferase |
| SEQ ID NO: 5588 | Nga03331 | 1273.33 | 1108.51 | ---NA--- |
| SEQ ID NO: 5589 | Nga03346 | 572.77 | 457.70 | ubiquitin-like protein 5 |
| SEQ ID NO: 5590 | Nga03336 | 1483.00 | 2022.38 | glycoside hydrolase family 8 |
| SEQ ID NO: 5591 | Nga03338 | 977.62 | 911.26 | beta-adaptin-like protein c |
| SEQ ID NO: 5592 | Nga03343 | 305.21 | 374.99 | n-acetyltransferase 10 |
| SEQ ID NO: 5593 | Nga03340.01 | 605.67 | 647.71 | mitotic checkpoint protein |
| SEQ ID NO: 5594 | Nga03335 | 570.47 | 561.25 | chaperone -domain containing protein |
| SEQ ID NO: 5595 | Nga03345 | 354.96 | 397.73 | conserved unknown protein (Partial) [Ectocarpus siliculosus] |
| SEQ ID NO: 5596 | Nga03349 | 442.03 | 472.28 | ferredoxin |
| SEQ ID NO: 5597 | Nga03334.1 | 481.17 | 513.48 | protein of hypothetical function duf482 |
| SEQ ID NO: 5598 | Nga03348 | 89.66 | 117.87 | protein |
| SEQ ID NO: 5599 | Nga03341 | 872.08 | 819.21 | methyltransferase type 11 |
| SEQ ID NO: 5600 | Nga03332 | 1664.02 | 1835.48 | n-acetyl-gamma-glutamyl-phosphate reductase |
| SEQ ID NO: 5601 | Nga03344 | 180.21 | 148.23 | component of oligomeric golgi complex 4 |
| SEQ ID NO: 5602 | Nga03342 | 62.63 | 71.30 | protein |
| SEQ ID NO: 5603 | Nga20192 | 456.67 | 457.43 | protein |
| SEQ ID NO: 5604 | Nga05183.1 | 314.78 | 411.62 | protein |
| SEQ ID NO: 5605 | Nga06884.2 | 304.21 | 253.28 | soluble pyridine nucleotide transhydrogenase |
| SEQ ID NO: 5606 | Nga05189 | 193.65 | 127.24 | hypothetical protein BATDEDRAFT_34916 [Batrachochytrium dendrobatidis JAM81] |
| SEQ ID NO: 5607 | Nga20326 | 141.81 | 95.35 | na+ solute symporter |
| SEQ ID NO: 5608 | Nga05188 | 123.81 | 134.11 | ---NA--- |
| SEQ ID NO: 5609 | Nga05182 | 726.76 | 931.13 | protein |
| SEQ ID NO: 5610 | Nga21073 | 173.91 | 220.99 | protein arginine n-methyltransferase |
| SEQ ID NO: 5611 | Nga05185 | 577.66 | 831.80 | ---NA--- |
| SEQ ID NO: 5612 | Nga05187 | 362.77 | 470.52 | cysteine proteinase |
| SEQ ID NO: 5613 | Nga05184 | 682.56 | 687.73 | 2-hydroxy-3-oxopropionate reductase |
| SEQ ID NO: 5614 | Nga00652 | 650.66 | 747.38 | ---NA--- |
| SEQ ID NO: 5615 | Nga00633 | 1318.75 | 1093.77 | threonine synthase |
| SEQ ID NO: 5616 | Nga00649 | 1384.92 | 1207.89 | photosystem ii oxygen evolving complex protein in synechococcus |
| SEQ ID NO: 5617 | Nga00618.2 | 305.63 | 288.66 | hypothetical protein Esi_0183_0025 [Ectocarpus siliculosus] |
| SEQ ID NO: 5618 | Nga00638 | 875.75 | 948.34 | protein transporter |
| SEQ ID NO: 5619 | Nga00645 | 16154.72 | 16510.60 | adp atp |
| SEQ ID NO: 5620 | Nga00644 | 611.77 | 648.82 | anthranilate synthase |
| SEQ ID NO: 5621 | Nga00637 | 3119.95 | 4231.30 | papain family cysteine protease containing protein |
| SEQ ID NO: 5622 | Nga00642 | 212.12 | 144.75 | transmembrane protein |
| SEQ ID NO: 5623 | Nga00631 | 8587.86 | 6551.19 | photosystem ii 11 kd protein |
| SEQ ID NO: 5624 | Nga00650 | 521.32 | 587.80 | ccaat-binding factor complex subunit |
| SEQ ID NO: 5625 | Nga00639 | 4270.83 | 3776.27 | glycoprotein fp21 |
| SEQ ID NO: 5626 | Nga03580.2 | 576.81 | 436.97 | wd-40 repeat protein |
| SEQ ID NO: 5627 | Nga00636 | 2517.46 | 2402.56 | cytochrome p450 cyp102a3 |

FIGURE 24 CK

| # | Nga model | +N rpkb | -N rpkb | GO |
|---|---|---|---|---|
| SEQ ID NO: 5628 | Nga20822 | 1126.23 | 1121.38 | t-complex 11 like isoform cra_b |
| SEQ ID NO: 5629 | Nga20821 | 1169.42 | 969.55 | conserved hypothetical protein [Phytophthora infestans T30-4] |
| SEQ ID NO: 5630 | Nga00632 | 1568.58 | 1303.44 | expressed unknown protein [Ectocarpus siliculosus] |
| SEQ ID NO: 5631 | Nga00640 | 1368.59 | 1126.62 | lycopene beta cyclase |
| SEQ ID NO: 5632 | Nga00630 | 694.51 | 763.74 | pantothenate kinase 3 |
| SEQ ID NO: 5633 | Nga00641.1 | 534.21 | 412.23 | ---NA--- |
| SEQ ID NO: 5634 | Nga00647 | 1345.11 | 1150.80 | coiled-coil domain-containing |
| SEQ ID NO: 5635 | Nga00634 | 228.81 | 220.32 | histone h2b |
| SEQ ID NO: 5636 | Nga00651 | 487.46 | 561.03 | ankyrin unc44 |
| SEQ ID NO: 5637 | Nga00635 | 1621.84 | 1445.99 | protein |
| SEQ ID NO: 5638 | Nga04787.2 | 439.31 | 584.79 | protein |
| SEQ ID NO: 5639 | Nga00628 | 1188.81 | 1328.16 | cathepsin z |
| SEQ ID NO: 5640 | Nga00648 | 473.60 | 519.56 | n-6 adenine-specific dna methyltransferase 2 |
| SEQ ID NO: 5641 | Nga05934 | 133.20 | 195.67 | ---NA--- |
| SEQ ID NO: 5642 | Nga20847 | 455.51 | 469.32 | histone deacetylase superfamily protein |
| SEQ ID NO: 5643 | Nga05933 | 760.81 | 709.29 | reticulon 4 interacting protein 1 |
| SEQ ID NO: 5644 | Nga21278 | 469.31 | 465.36 | peptidase |
| SEQ ID NO: 5645 | Nga05931 | 215.22 | 195.23 | ---NA--- |
| SEQ ID NO: 5646 | Nga05932 | 448.89 | 478.44 | trehalose-6-phosphate synthase |
| SEQ ID NO: 5647 | Nga06001 | 2151.43 | 2749.81 | protein kinase |
| SEQ ID NO: 5648 | Nga06003 | 4972.91 | 5093.40 | ribomal-ubiquitin fusion protein ubi5 |
| SEQ ID NO: 5649 | Nga20862.1 | 6250.00 | 6514.88 | ---NA--- |
| SEQ ID NO: 5650 | Nga21008.1 | 5611.11 | 5267.73 | hypothetical protein SNOG_05870 [Phaeosphaeria nodorum SN15] |
| SEQ ID NO: 5651 | Nga20911.1 | 30.46 | 5.50 | myo-inositol-1-phosphate synthase |
| SEQ ID NO: 5652 | Nga20412 | 78.95 | 46.05 | ---NA--- |
| SEQ ID NO: 5653 | Nga01445.2 | 3746.55 | 4432.15 | succinate dehydrogenase |
| SEQ ID NO: 5654 | Nga06002 | 284.88 | 313.32 | prolyl-trna synthetase |
| SEQ ID NO: 5655 | Nga05978 | 1454.79 | 1913.22 | protein |
| SEQ ID NO: 5656 | Nga05974 | 777.44 | 842.62 | protein |
| SEQ ID NO: 5657 | Nga05976 | 1060.19 | 1140.91 | protein |
| SEQ ID NO: 5658 | Nga05975 | 514.26 | 442.79 | protein |
| SEQ ID NO: 5659 | Nga21308 | 374.15 | 390.55 | cathepsin a |
| SEQ ID NO: 5660 | Nga05977 | 326.77 | 413.68 | ---NA--- |
| SEQ ID NO: 5661 | Nga05852 | 1304.64 | 1214.87 | conserved unknown protein [Ectocarpus siliculosus] |
| SEQ ID NO: 5662 | Nga20712 | 525.66 | 427.06 | isochorismatase hydrolase |
| SEQ ID NO: 5663 | Nga05853 | 891.89 | 935.77 | surface protein sur1 |
| SEQ ID NO: 5664 | Nga05851 | 3444.44 | 3500.60 | alpha beta hydrolase fold-3 domain protein |
| SEQ ID NO: 5665 | Nga05854 | 194.00 | 244.54 | protein |
| SEQ ID NO: 5666 | Nga05850 | 1407.35 | 1128.90 | photosystem ii stability assembly factor hcf136 |
| SEQ ID NO: 5667 | Nga05849 | 538.46 | 592.03 | nlr card domain containing 3 |
| SEQ ID NO: 5668 | Nga05848 | 1425.30 | 1103.05 | cytochrome c peroxidase |
| SEQ ID NO: 5669 | Nga05995.2 | 1085.29 | 843.36 | peptidyl-prolyl cis-trans isomerase |
| SEQ ID NO: 5670 | Nga05226 | 1034.87 | 1275.41 | glycerol-3-phosphate dehydrogenase 1-like protein |
| SEQ ID NO: 5671 | Nga04505.02 | 1002.05 | 1358.48 | ankyrin |
| SEQ ID NO: 5672 | Nga05222 | 2130.43 | 1774.55 | ---NA--- |
| SEQ ID NO: 5673 | Nga05229.1 | 755.84 | 843.22 | glycosyl hydrolase family 81 protein |
| SEQ ID NO: 5674 | Nga05227 | 1093.39 | 1193.74 | trna (5-methylaminomethyl-2-thiouridylate)-methyltransferase |
| SEQ ID NO: 5675 | Nga05225 | 1654.49 | 1451.92 | cation diffusion facilitator family transporter |
| SEQ ID NO: 5676 | Nga05228 | 466.62 | 446.24 | ion channel |
| SEQ ID NO: 5677 | Nga05231 | 393.44 | 579.35 | conserved hypothetical protein [Perkinsus marinus ATCC 50983] |
| SEQ ID NO: 5678 | Nga04504.02 | 4897.14 | 5041.69 | 3-ketoacyl- mitochondrial |
| SEQ ID NO: 5679 | Nga02759 | 1340.03 | 1462.02 | fe-s protein assembly co-chaperone |
| SEQ ID NO: 5680 | Nga02761 | 225.87 | 316.21 | phosphatidylinositol-4-phosphate 5- 11335-7537 |
| SEQ ID NO: 5681 | Nga02756 | 728.16 | 835.43 | homoserine o-acetyltransferase |
| SEQ ID NO: 5682 | Nga20333 | 321.43 | 368.54 | l-seryl-trna kinase-like |
| SEQ ID NO: 5683 | Nga20868 | 557.84 | 647.90 | predicted protein [Phaeodactylum tricornutum CCAP 1055/1] |
| SEQ ID NO: 5684 | Nga21145 | 5579.09 | 5538.14 | ubiquitin |
| SEQ ID NO: 5685 | Nga02757 | 1947.41 | 1628.07 | vesicle transport protein sft2a-like |
| SEQ ID NO: 5686 | Nga02758 | 6362.60 | 7305.63 | ribosomal protein l23 |
| SEQ ID NO: 5687 | Nga20641 | 152.78 | 140.42 | protein |
| SEQ ID NO: 5688 | Nga02762 | 1942.33 | 2029.74 | amp-binding domain protein |
| SEQ ID NO: 5689 | Nga21015 | 132.63 | 206.88 | protein kinase |
| SEQ ID NO: 5690 | Nga02765 | 31.86 | 45.13 | spo11 meiotic protein covalently bound to dsb homolog ( cerevisiae) |
| SEQ ID NO: 5691 | Nga02760 | 1626.94 | 1777.05 | wd repeat-containing protein 5 |

FIGURE 24 CL

| # | Nga model | +N rpkb | -N rpkb | GO |
|---|---|---|---|---|
| SEQ ID NO: 5692 | Nga01024 | 791.48 | 767.77 | apoptosis-inducing factor mitochondrial isoform 1 |
| SEQ ID NO: 5693 | Nga01022 | 246.01 | 324.46 | xpa-binding protein 1 |
| SEQ ID NO: 5694 | Nga01026 | 1929.97 | 1600.60 | protein |
| SEQ ID NO: 5695 | Nga20415 | 103.26 | 133.44 | rna exonuclease 4 |
| SEQ ID NO: 5696 | Nga01025 | 10.64 | 26.89 | ---NA--- |
| SEQ ID NO: 5697 | Nga20403 | 238.05 | 265.26 | transcription initiation factor tfiid subunit |
| SEQ ID NO: 5698 | Nga01027 | 120.50 | 128.53 | ---NA--- |
| SEQ ID NO: 5699 | Nga01023 | 3581.90 | 2352.81 | hpp family protein |
| SEQ ID NO: 5700 | Nga06244 | 2219.75 | 2424.05 | short-chain dehydrogenase reductase sdr |
| SEQ ID NO: 5701 | Nga06243 | 3204.49 | 2721.28 | ---NA--- |
| SEQ ID NO: 5702 | Nga06240.01 | 938.43 | 1181.71 | glucose-methanol-choline oxidoreductase |
| SEQ ID NO: 5703 | Nga06241 | 1898.33 | 1643.67 | ---NA--- |
| SEQ ID NO: 5704 | Nga06239 | 308.53 | 357.15 | protein |
| SEQ ID NO: 5705 | Nga06238 | 1998.35 | 1566.85 | ---NA--- |
| SEQ ID NO: 5706 | Nga06242 | 698.73 | 710.75 | magnesium h subunit |
| SEQ ID NO: 5707 | Nga20052 | 406.36 | 467.23 | magnesium h subunit |
| SEQ ID NO: 5708 | Nga20741 | 72.58 | 165.98 | fbox protein |
| SEQ ID NO: 5709 | Nga06627.1 | 80.98 | 152.85 | transducin -like 3 |
| SEQ ID NO: 5710 | Nga02359.02 | 579.34 | 642.88 | u2 small nuclear ribonucleoprotein a |
| SEQ ID NO: 5711 | Nga06628 | 162.42 | 185.97 | tripartite motif-containing 26 |
| SEQ ID NO: 5712 | Nga06626.1 | 314.79 | 310.38 | atp-dependent rna helicase ddx1 |
| SEQ ID NO: 5713 | Nga05984.01 | 206.52 | 263.87 | protein |
| SEQ ID NO: 5714 | Nga05981.01 | 2019.73 | 2874.37 | ---NA--- |
| SEQ ID NO: 5715 | Nga05985.01 | 469.14 | 493.32 | protein |
| SEQ ID NO: 5716 | Nga05982.01 | 456.31 | 493.09 | triacylglycerol lipase |
| SEQ ID NO: 5717 | Nga20665.1 | 63.68 | 37.90 | protein |
| SEQ ID NO: 5718 | Nga05987.01 | 489.49 | 465.27 | ---NA--- |
| SEQ ID NO: 5719 | Nga05983.01 | 3140.04 | 2439.95 | ---NA--- |
| SEQ ID NO: 5720 | Nga05986.01 | 458.72 | 510.52 | alanine-glyoxylate aminotransferase 2-like 2 |
| SEQ ID NO: 5721 | Nga01177 | 965.36 | 1074.61 | probable inactive purple acid phosphatase 27-like |
| SEQ ID NO: 5722 | Nga01178 | 123.71 | 89.34 | ---NA--- |
| SEQ ID NO: 5723 | Nga01176 | 638.74 | 790.56 | ---NA--- |
| SEQ ID NO: 5724 | Nga02662 | 1355.97 | 1684.12 | rna polymerase sigma factor |
| SEQ ID NO: 5725 | Nga02668 | 1294.01 | 1438.62 | cytochrome p450 |
| SEQ ID NO: 5726 | Nga02667 | 274.65 | 231.40 | cell cycle checkpoint protein rad17 |
| SEQ ID NO: 5727 | Nga02660 | 513.18 | 461.97 | cellulase 2 |
| SEQ ID NO: 5728 | Nga02669 | 352.36 | 331.44 | folate-binding protein |
| SEQ ID NO: 5729 | Nga20111 | 617.85 | 665.27 | la ribonucleoprotein domain member 1 |
| SEQ ID NO: 5730 | Nga02666 | 236.90 | 280.47 | thiamine triphosphatase |
| SEQ ID NO: 5731 | Nga02663 | 3778.00 | 3550.48 | protein |
| SEQ ID NO: 5732 | Nga02665.01 | 6477.17 | 6628.01 | conserved hypothetical protein [Phytophthora infestans T30-4] |
| SEQ ID NO: 5733 | Nga02661 | 933.16 | 866.96 | tricarboxylate transport mitochondrial-like |
| SEQ ID NO: 5734 | Nga02670 | 3615.84 | 3311.65 | ---NA--- |
| SEQ ID NO: 5735 | Nga20026 | 1041.43 | 849.56 | ---NA--- |
| SEQ ID NO: 5736 | Nga02664 | 2054.59 | 1716.24 | protein |
| SEQ ID NO: 5737 | Nga04292.02 | 3421.42 | 3302.43 | conserved unknown protein [Ectocarpus siliculosus] |
| SEQ ID NO: 5738 | Nga05585 | 677.98 | 744.50 | cyclin-y-like protein |
| SEQ ID NO: 5739 | Nga02277.02 | 1101.16 | 1216.17 | hypothetical protein AURANDRAFT_70731 [Aureococcus anophagefferens] |
| SEQ ID NO: 5740 | Nga05591 | 205.72 | 193.05 | ---NA--- |
| SEQ ID NO: 5741 | Nga20053.1 | 1379.41 | 1452.21 | hypothetical protein AURANDRAFT_70731 [Aureococcus anophagefferens] |
| SEQ ID NO: 5742 | Nga05584 | 138.63 | 155.23 | phosphatidylinositol-4-phosphate 5- |
| SEQ ID NO: 5743 | Nga02276.02 | 390.35 | 299.31 | phosphatidylinositol-4-phosphate 5- |
| SEQ ID NO: 5744 | Nga05589 | 245.36 | 263.55 | ---NA--- |
| SEQ ID NO: 5745 | Nga05593 | 122.81 | 133.03 | ---NA--- |
| SEQ ID NO: 5746 | Nga05592 | 75.47 | 61.32 | ---NA--- |
| SEQ ID NO: 5747 | Nga21149.1 | 1114.05 | 1007.81 | transcriptional coactivator pterin dehydratase |
| SEQ ID NO: 5748 | Nga05586.1 | 296.20 | 249.87 | diacylglycerol kinase |
| SEQ ID NO: 5749 | Nga02026.02 | 127.45 | 159.29 | ---NA--- |
| SEQ ID NO: 5750 | Nga21155 | 142.86 | 198.27 | e1a-binding protein p400-like |
| SEQ ID NO: 5751 | Nga05384 | 129.03 | 192.19 | ---NA--- |
| SEQ ID NO: 5752 | Nga05381 | 818.79 | 534.35 | ---NA--- |
| SEQ ID NO: 5753 | Nga04229.02 | 1672.54 | 1881.51 | ---NA--- |

FIGURE 24 CM

| # | Nga model | +N rpkb | -N rpkb | GO |
|---|---|---|---|---|
| SEQ ID NO: 5754 | Nga05382 | 353.23 | 455.39 | gtp cyclohydrolase ii |
| SEQ ID NO: 5755 | Nga05383 | 442.93 | 472.43 | Aardvark [Ectocarpus siliculosus] |
| SEQ ID NO: 5756 | Nga05378 | 758.35 | 696.75 | protein |
| SEQ ID NO: 5757 | Nga05380 | 258.72 | 295.37 | protein |
| SEQ ID NO: 5758 | Nga00958.02 | 980.74 | 1281.43 | ribosome biogenesis regulatory protein |
| SEQ ID NO: 5759 | Nga05379 | 1055.25 | 1268.76 | thiamin pyrophosphokinase1 |
| SEQ ID NO: 5760 | Nga01072 | 613.49 | 542.32 | transforming growth beta- 68kda |
| SEQ ID NO: 5761 | Nga01069 | 1681.90 | 1620.18 | enoyl- hydratase domain-containing protein 1-like |
| SEQ ID NO: 5762 | Nga01067 | 584.19 | 430.27 | uracil phosphoribosyltransferase |
| SEQ ID NO: 5763 | Nga01073 | 218.79 | 241.18 | ---NA--- |
| SEQ ID NO: 5764 | Nga01068 | 2381.33 | 2115.44 | nifu like protein |
| SEQ ID NO: 5765 | Nga00400.2 | 317.66 | 342.25 | chaperone protein |
| SEQ ID NO: 5766 | Nga01074 | 134.69 | 127.15 | brca1 brca2-containing complex subunit 3 |
| SEQ ID NO: 5767 | Nga01070 | 647.77 | 700.23 | protein |
| SEQ ID NO: 5768 | Nga01071 | 2312.47 | 2426.40 | cre-cul-1 protein |
| SEQ ID NO: 5769 | Nga20873 | 1197.26 | 1530.36 | cul2 protein |
| SEQ ID NO: 5770 | Nga20106 | 407.30 | 390.24 | uncharacterized protein family upf0310 |
| SEQ ID NO: 5771 | Nga00954 | 995.84 | 850.86 | natural resistance-associated macrophage |
| SEQ ID NO: 5772 | Nga00955 | 7.34 | 6.36 | dynein heavy chain |
| SEQ ID NO: 5773 | Nga00956 | 0.36 | 3.51 | dynein heavy chain |
| SEQ ID NO: 5774 | Nga06161.1 | 196.22 | 248.37 | pescadillo-like protein |
| SEQ ID NO: 5775 | Nga06158 | 5530.41 | 4944.40 | histone h3 |
| SEQ ID NO: 5776 | Nga02516.02 | 24.04 | 35.23 | t-complex 11 like isoform cra_b |
| SEQ ID NO: 5777 | Nga02514.02 | 802.06 | 599.69 |tropinone reductase |
| SEQ ID NO: 5778 | Nga06167 | 251.43 | 237.28 | pyrimidine 5 -nucleotidase |
| SEQ ID NO: 5779 | Nga06162 | 2176.55 | 2330.59 | expressed unknown protein [Ectocarpus siliculosus] |
| SEQ ID NO: 5780 | Nga20008 | 457.91 | 593.59 | ---NA--- |
| SEQ ID NO: 5781 | Nga02511.02 | 2391.62 | 2702.49 | sporangia induced sperm flagellar protein |
| SEQ ID NO: 5782 | Nga06163 | 418.44 | 446.44 | 3-dehydroquinate synthase |
| SEQ ID NO: 5783 | Nga06159 | 240.49 | 184.66 | protein mis18-alpha |
| SEQ ID NO: 5784 | Nga02519.02 | 463.46 | 438.55 | phosphoglycerate mutase 1 family |
| SEQ ID NO: 5785 | Nga02520.02 | 902.96 | 384.44 | phytochelatin synthase |
| SEQ ID NO: 5786 | Nga02518.02 | 181.02 | 126.74 | histone h1 |
| SEQ ID NO: 5787 | Nga06571 | 559.36 | 502.05 | protein |
| SEQ ID NO: 5788 | Nga06569.1 | 706.09 | 732.70 | tripeptidyl peptidase ii |
| SEQ ID NO: 5789 | Nga06572 | 515.82 | 611.46 | protein |
| SEQ ID NO: 5790 | Nga06573 | 149.59 | 172.61 | ---NA--- |
| SEQ ID NO: 5791 | Nga06570 | 532.48 | 541.04 | phenylalanyl-trna synthetase beta chain |
| SEQ ID NO: 5792 | Nga06577 | 128.69 | 109.69 | and ph domain containing 5 |
| SEQ ID NO: 5793 | Nga06568 | 808.06 | 1054.67 | gtp cyclohydrolase i |
| SEQ ID NO: 5794 | Nga01522.2 | 173.10 | 192.32 | brefeldin a-inhibited guanine nucleotide-exchange |
| SEQ ID NO: 5795 | Nga06576.1 | 178.23 | 170.10 | brefeldin a-inhibited guanine nucleotide-exchange |
| SEQ ID NO: 5796 | Nga20595.1 | 14.81 | 56.17 | ---NA--- |
| SEQ ID NO: 5797 | Nga20615.1 | 117.49 | 141.41 | c-myc promoter-binding protein irlb |
| SEQ ID NO: 5798 | Nga01525.02 | 170.52 | 169.06 | ---NA--- |
| SEQ ID NO: 5799 | Nga20130 | 104.50 | 129.67 | atp binding protein |
| SEQ ID NO: 5800 | Nga03766.02 | 3999.10 | 3999.26 | nadh dehydrogenase |
| SEQ ID NO: 5801 | Nga05614 | 274.43 | 290.26 | trimethylguanosine synthase homolog |
| SEQ ID NO: 5802 | Nga05617 | 62.47 | 62.68 | chromatin remodeling complex subunit |
| SEQ ID NO: 5803 | Nga03764.02 | 455.84 | 534.93 | 24-dehydrocholesterol reductase |
| SEQ ID NO: 5804 | Nga05619 | 33.74 | 26.58 | snf2 family dna-dependent atpase |
| SEQ ID NO: 5805 | Nga05615.1 | 654.91 | 1315.06 | phosphoribosylformylglycinamidine synthase |
| SEQ ID NO: 5806 | Nga05618 | 5018.97 | 3974.79 | conserved hypothetical protein [Phytophthora infestans T30-4] |
| SEQ ID NO: 5807 | Nga05616 | 1550.69 | 1688.13 | vacuolar sorting protein 9 domain-containing protein |
| SEQ ID NO: 5808 | Nga04756.02 | 1614.47 | 1104.61 | conserved unknown protein [Ectocarpus siliculosus] |
| SEQ ID NO: 5809 | Nga21205 | 463.34 | 536.85 | ---NA--- |
| SEQ ID NO: 5810 | Nga20475.1 | 201.51 | 226.47 | trna pseudouridine synthase a |
| SEQ ID NO: 5811 | Nga05411 | 456.90 | 445.12 | rnf111 partial |
| SEQ ID NO: 5812 | Nga20214 | 645.42 | 644.28 | ---NA--- |
| SEQ ID NO: 5813 | Nga05410 | 528.96 | 512.34 | hypothetical protein BATDEDRAFT_22755 [Batrachochytrium dendrobatidis JAM81] |
| SEQ ID NO: 5814 | Nga05413 | 608.47 | 553.80 | serine hydroxymethyltransferase |
| SEQ ID NO: 5815 | Nga20572 | 335.60 | 328.86 | methyltransferase family protein |
| SEQ ID NO: 5816 | Nga05408 | 1963.20 | 1947.77 | proteasome ( macropain) activator subunit 1 (pa28 alpha) |

FIGURE 24 CN

| # | Nga model | +N rpkb | -N rpkb | GO |
|---|---|---|---|---|
| SEQ ID NO: 5817 | Nga05404 | 854.79 | 866.86 | protein |
| SEQ ID NO: 5818 | Nga05412 | 806.17 | 854.18 | ---NA--- |
| SEQ ID NO: 5819 | Nga04776.02 | 2722.74 | 2796.39 | aquaporin sip1-2 |
| SEQ ID NO: 5820 | Nga05405 | 1103.86 | 807.87 | photosystem ii oxygen-evolving complex 23k protein |
| SEQ ID NO: 5821 | Nga05406 | 740.27 | 820.50 | uncharacterized glycosyltransferase aer61 |
| SEQ ID NO: 5822 | Nga04777.2 | 1441.20 | 1045.24 | protein |
| SEQ ID NO: 5823 | Nga05450 | 670.89 | 761.89 | zinc metalloproteinase |
| SEQ ID NO: 5824 | Nga05448 | 157.02 | 147.71 | ---NA--- |
| SEQ ID NO: 5825 | Nga05451 | 100.67 | 116.66 | ---NA--- |
| SEQ ID NO: 5826 | Nga05447 | 401.48 | 384.08 | protein |
| SEQ ID NO: 5827 | Nga05449 | 620.77 | 744.44 | histone acetyltransferase |
| SEQ ID NO: 5828 | Nga20241 | 436.33 | 426.67 | nucleoredoxin-like protein 2 |
| SEQ ID NO: 5829 | Nga06045 | 234.65 | 216.96 | cdc14 cell division cycle 14 homolog a ( cerevisiae) |
| SEQ ID NO: 5830 | Nga06041 | 680.50 | 743.43 | sh3 domain-containing protein |
| SEQ ID NO: 5831 | Nga20128 | 511.31 | 505.35 | predicted protein [Thalassiosira pseudonana CCMP1335] |
| SEQ ID NO: 5832 | Nga06046 | 384.62 | 392.12 | ---NA--- |
| SEQ ID NO: 5833 | Nga21089 | 2128.23 | 2050.87 | hypothetical protein |
| SEQ ID NO: 5834 | Nga06044 | 1126.30 | 1139.71 | t-complex protein 1 subunit zeta |
| SEQ ID NO: 5835 | Nga06043 | 408.48 | 379.46 | protein |
| SEQ ID NO: 5836 | Nga06040 | 602.43 | 500.74 | expressed unknown protein [Ectocarpus siliculosus] |
| SEQ ID NO: 5837 | Nga06042 | 9608.51 | 8659.21 | catalase |
| SEQ ID NO: 5838 | Nga06039 | 2452.44 | 1745.06 | delta-6 fatty acid desaturase |
| SEQ ID NO: 5839 | Nga01547 | 403.19 | 377.01 | protein |
| SEQ ID NO: 5840 | Nga01549.1 | 559.90 | 716.86 | protein |
| SEQ ID NO: 5841 | Nga01550 | 571.14 | 726.56 | ---NA--- |
| SEQ ID NO: 5842 | Nga01548 | 2441.91 | 2081.07 | pre-mrna branch site protein |
| SEQ ID NO: 5843 | Nga01383 | 142.86 | 77.37 | ---NA--- |
| SEQ ID NO: 5844 | Nga21243 | 107.84 | 138.06 | intraflagellar transport protein 46 homolog isoform 2 |
| SEQ ID NO: 5845 | Nga01382 | 41.03 | 16.67 | flagellar associated protein |
| SEQ ID NO: 5846 | Nga01380.01 | 473.02 | 387.44 | conserved unknown protein [Ectocarpus siliculosus] |
| SEQ ID NO: 5847 | Nga01381 | 448.33 | 443.10 | naphthoate synthase |
| SEQ ID NO: 5848 | Nga00781 | 49.69 | 47.10 | ---NA--- |
| SEQ ID NO: 5849 | Nga00783 | 145.39 | 126.76 | ---NA--- |
| SEQ ID NO: 5850 | Nga00782 | 116.02 | 125.68 | thioredoxin |
| SEQ ID NO: 5851 | Nga00779.01 | 5335.74 | 3704.86 | ribulose-phosphate 3-epimerase |
| SEQ ID NO: 5852 | Nga20826.1 | 592.84 | 339.05 | dna ligase |
| SEQ ID NO: 5853 | Nga00780 | 81.78 | 57.37 | dna ligase 1 |
| SEQ ID NO: 5854 | Nga05497.02 | 1666.92 | 1441.52 | dolichyl-diphosphooligosaccharide--protein glycosyltransferase subunit dad1 |
| SEQ ID NO: 5855 | Nga20937 | 7508.09 | 6591.72 | mapeg family protein |
| SEQ ID NO: 5856 | Nga05909 | 435.90 | 333.30 | ---NA--- |
| SEQ ID NO: 5857 | Nga05498.02 | 3419.10 | 2738.25 | ---NA--- |
| SEQ ID NO: 5858 | Nga05903 | 725.81 | 640.62 | gpn-loop gtpase 3 |
| SEQ ID NO: 5859 | Nga05902.1 | 2056.91 | 1804.99 | predicted protein [Thalassiosira pseudonana CCMP1335] |
| SEQ ID NO: 5860 | Nga05494.02 | 967.68 | 874.50 | topoisomerase 6 subunit b |
| SEQ ID NO: 5861 | Nga05897.1 | 895.27 | 834.38 | ---NA--- |
| SEQ ID NO: 5862 | Nga05899 | 255.68 | 228.55 | protein |
| SEQ ID NO: 5863 | Nga05908 | 168.87 | 129.13 | ---NA--- |
| SEQ ID NO: 5864 | Nga05900 | 1069.06 | 809.93 | phenylalanyl-trna synthetase |
| SEQ ID NO: 5865 | Nga05905 | 1115.94 | 1287.32 | ---NA--- |
| SEQ ID NO: 5866 | Nga05911 | 492.42 | 625.73 | trna (guanine-n -)-methyltransferase |
| SEQ ID NO: 5867 | Nga20804.1 | 2625.50 | 2593.72 | mitochondrial carrier domain-containing protein |
| SEQ ID NO: 5868 | Nga05910 | 521.05 | 530.21 | ---NA--- |
| SEQ ID NO: 5869 | Nga05898 | 19.48 | 16.08 | g-protein complex alpha subunit |
| SEQ ID NO: 5870 | Nga20055.1 | 2043.29 | 1900.23 | conserved unknown protein [Ectocarpus siliculosus] |
| SEQ ID NO: 5871 | Nga05901 | 231.58 | 219.97 | unc45 family protein |
| SEQ ID NO: 5872 | Nga01355.01 | 490.10 | 633.19 | chaperone protein |
| SEQ ID NO: 5873 | Nga20420 | 199.58 | 197.79 | low quality protein: l-fucose kinase-like |
| SEQ ID NO: 5874 | Nga20342 | 186.36 | 177.26 | l-fucose kinase |
| SEQ ID NO: 5875 | Nga02831.01 | 751.54 | 685.38 | solute carrier family 25 (mitochondrial carrier citrate transporter) member 1 |
| SEQ ID NO: 5876 | Nga02833 | 5136.12 | 4585.13 | beta- -mannosyltransferase egh |
| SEQ ID NO: 5877 | Nga02830.01 | 727.36 | 711.81 | potential ankyrin repeat protein |
| SEQ ID NO: 5878 | Nga02839.01 | 1754.74 | 1803.40 | dihydrolipoamide dehydrogenase |

FIGURE 24 CO

| # | Nga model | +N rpkb | -N rpkb | GO |
|---|---|---|---|---|
| SEQ ID NO: 5879 | Nga21237.1 | 153.06 | 118.82 | protein |
| SEQ ID NO: 5880 | Nga02842.01 | 2105.04 | 2116.40 | ---NA--- |
| SEQ ID NO: 5881 | Nga02829 | 1823.71 | 1901.20 | pbs lyase heat-like repeat domain protein |
| SEQ ID NO: 5882 | Nga02834 | 741.71 | 806.44 | glutamyl-trna synthetase |
| SEQ ID NO: 5883 | Nga02832 | 2218.77 | 1834.55 | glycine decarboxylase t-protein |
| SEQ ID NO: 5884 | Nga02835 | 1163.55 | 1421.41 | protein |
| SEQ ID NO: 5885 | Nga02837 | 364.53 | 275.98 | protein kinase family protein |
| SEQ ID NO: 5886 | Nga02836 | 950.24 | 900.10 | aminophospholipid transporter- class type member 2 |
| SEQ ID NO: 5887 | Nga02843 | 1048.99 | 1101.69 | protein myg1 |
| SEQ ID NO: 5888 | Nga02838 | 712.33 | 786.46 | fk506 binding-like protein |
| SEQ ID NO: 5889 | Nga02841 | 544.22 | 704.96 | protein archease-like |
| SEQ ID NO: 5890 | Nga02840 | 566.41 | 549.06 | n-terminal acetyltransferase complex ard1 subunit |
| SEQ ID NO: 5891 | Nga03109 | 679.86 | 549.38 | solute carrier family 35 member b1 |
| SEQ ID NO: 5892 | Nga03106 | 737.73 | 634.00 | proteasome ( macropain) 26s non- 3 |
| SEQ ID NO: 5893 | Nga03102 | 588.07 | 574.58 | asparaginyl-trna synthetase |
| SEQ ID NO: 5894 | Nga03111 | 4980.48 | 5818.63 | succinate- ligase |
| SEQ ID NO: 5895 | Nga03103 | 2239.08 | 2012.46 | protein |
| SEQ ID NO: 5896 | Nga03113 | 1667.10 | 2035.47 | amp-dependent synthetase and ligase |
| SEQ ID NO: 5897 | Nga03110 | 413.18 | 531.32 | hypoxanthine phosphoribosyltransferase 1 |
| SEQ ID NO: 5898 | Nga03114 | 104.07 | 117.64 | ---NA--- |
| SEQ ID NO: 5899 | Nga03105.01 | 948.53 | 915.97 | conserved unknown protein [Ectocarpus siliculosus] |
| SEQ ID NO: 5900 | Nga03108 | 667.69 | 733.57 | atp-dependent dna helicase |
| SEQ ID NO: 5901 | Nga03115 | 525.94 | 455.11 | expressed unknown protein [Ectocarpus siliculosus] |
| SEQ ID NO: 5902 | Nga03107 | 517.01 | 526.14 | udp-n-acetylglucosamine transferase subunit alg14 homolog |
| SEQ ID NO: 5903 | Nga03112 | 16980.97 | 17325.40 | ribosomal protein s25 |
| SEQ ID NO: 5904 | Nga03104 | 387.98 | 547.30 | protein |
| SEQ ID NO: 5905 | Nga03101 | 1905.63 | 1692.08 | xenotropic and polytropic murine leukemia virus receptor xpr1 |
| SEQ ID NO: 5906 | Nga20360 | 416.96 | 458.23 | conserved unknown protein [Ectocarpus siliculosus] |
| SEQ ID NO: 5907 | Nga05309 | 1512.68 | 1590.09 | cysteine synthase |
| SEQ ID NO: 5908 | Nga05310 | 804.46 | 835.01 | adenine guanine permease azg1 |
| SEQ ID NO: 5909 | Nga05308 | 4440.73 | 4333.69 | 4-hydroxy-3-methylbut-2-enyl diphosphate reductase |
| SEQ ID NO: 5910 | Nga05306 | 1451.65 | 1402.41 | protein |
| SEQ ID NO: 5911 | Nga05307 | 362.23 | 411.50 | lon protease-like mitochondrial |
| SEQ ID NO: 5912 | Nga01235 | 512.91 | 432.55 | ribokinase |
| SEQ ID NO: 5913 | Nga01236 | 101.45 | 146.52 | solute carrier family member 35-like |
| SEQ ID NO: 5914 | Nga00985.2 | 231.15 | 248.73 | cation transporting atpase |
| SEQ ID NO: 5915 | Nga20143 | 560.12 | 507.24 | s-adenosylmethionine mitochondrial carrier protein |
| SEQ ID NO: 5916 | Nga01230 | 585.08 | 723.67 | gtp-binding proten |
| SEQ ID NO: 5917 | Nga01231 | 178.52 | 145.40 | diacylglycerol cholinephosphotransferase |
| SEQ ID NO: 5918 | Nga01233 | 408.33 | 456.51 | protein |
| SEQ ID NO: 5919 | Nga01232 | 453.33 | 418.13 | aminopeptidase-like 1 |
| SEQ ID NO: 5920 | Nga20099 | 1342.18 | 1592.32 | ring finger protein 126 |
| SEQ ID NO: 5921 | Nga01422 | 2443.47 | 1967.98 | ---NA--- |
| SEQ ID NO: 5922 | Nga01421 | 56.66 | 52.89 | protein |
| SEQ ID NO: 5923 | Nga01423 | 1731.93 | 1801.60 | atp-dependent clp protease adaptor protein |
| SEQ ID NO: 5924 | Nga01424 | 104.05 | 250.46 | ---NA--- |
| SEQ ID NO: 5925 | Nga05993 | 1155.89 | 1171.10 | protein |
| SEQ ID NO: 5926 | Nga04312.02 | 962.73 | 1403.02 | galactosamine (n-acetyl)-6-sulfate sulfatase-like |
| SEQ ID NO: 5927 | Nga05991 | 2536.14 | 3505.07 | p-type h+-atpase |
| SEQ ID NO: 5928 | Nga05870 | 112.90 | 64.06 | phosphoinositol transporter |
| SEQ ID NO: 5929 | Nga07312.2 | 1237.00 | 1185.74 | phosphatidylinositol n-acetylglucosaminyltransferase subunit |
| SEQ ID NO: 5930 | Nga05867 | 1168.20 | 1075.77 | phosphatidate cytidylyltransferase |
| SEQ ID NO: 5931 | Nga05865 | 1085.06 | 1194.08 | protein |
| SEQ ID NO: 5932 | Nga20808 | 301.47 | 298.69 | ---NA--- |
| SEQ ID NO: 5933 | Nga20879 | 1019.81 | 1100.18 | methyltransferase type 11 |
| SEQ ID NO: 5934 | Nga05868 | 125.65 | 129.84 | chloride channel protein |
| SEQ ID NO: 5935 | Nga05864 | 301.47 | 321.25 | hippocampus abundant transcript 1 |
| SEQ ID NO: 5936 | Nga05866 | 6452.44 | 7184.28 | 40s ribosomal protein s19 |
| SEQ ID NO: 5937 | Nga20935 | 841.34 | 774.90 | atp-binding cassette sub-family g member 2 |
| SEQ ID NO: 5938 | Nga20215 | 294.90 | 361.83 | probable atp-dependent rna helicase ddx31 |
| SEQ ID NO: 5939 | Nga21103 | 194.82 | 245.83 | dead box atp-dependent rna |
| SEQ ID NO: 5940 | Nga01031 | 768.42 | 722.50 | protein |
| SEQ ID NO: 5941 | Nga01033 | 222.77 | 267.86 | ---NA--- |
| SEQ ID NO: 5942 | Nga01030.01 | 2352.40 | 2701.89 | ---NA--- |

FIGURE 24 CP

| # | Nga model | +N rpkb | -N rpkb | GO |
|---|---|---|---|---|
| SEQ ID NO: 5943 | Nga01034 | 441.86 | 541.62 | splicing arginine serine-rich 9 |
| SEQ ID NO: 5944 | Nga01032 | 211.16 | 467.28 | notch-regulated ankyrin repeat-containing protein b |
| SEQ ID NO: 5945 | Nga21215.1 | 599.19 | 469.26 | uncharacterized protein |
| SEQ ID NO: 5946 | Nga06181 | 2250.00 | 2302.78 | conserved plasmodium protein |
| SEQ ID NO: 5947 | Nga06183 | 516.93 | 546.08 | ---NA--- |
| SEQ ID NO: 5948 | Nga21280 | 104.90 | 98.48 | ---NA--- |
| SEQ ID NO: 5949 | Nga06184 | 114.09 | 72.70 | ---NA--- |
| SEQ ID NO: 5950 | Nga02092.02 | 1547.45 | 2155.74 | alternative nadh-dehydrogenase |
| SEQ ID NO: 5951 | Nga06534 | 156.86 | 148.68 | hypothetical protein CHLNCDRAFT_138430 [Chlorella variabilis] |
| SEQ ID NO: 5952 | Nga20651 | 666.67 | 644.68 | tp53 regulating kinase |
| SEQ ID NO: 5953 | Nga06535 | 3016.23 | 2719.65 | bacterioferritin comigratory protein |
| SEQ ID NO: 5954 | Nga06536 | 2909.77 | 3307.62 | trehalose-6-phosphate phosphatase |
| SEQ ID NO: 5955 | Nga06537.01 | 6065.22 | 6723.12 | ribosomal protein l22 |
| SEQ ID NO: 5956 | Nga20503 | 245.76 | 309.06 | gpi-anchored wall transfer protein 1 |
| SEQ ID NO: 5957 | Nga06364 | 281.21 | 283.07 | ---NA--- |
| SEQ ID NO: 5958 | Nga20743 | 145.60 | 145.82 | gpi-anchored wall transfer protein 1 |
| SEQ ID NO: 5959 | Nga06369 | 3536.93 | 2667.00 | secreted salivary gland |
| SEQ ID NO: 5960 | Nga06367 | 935.90 | 805.48 | phospholipid n-methyltransferase |
| SEQ ID NO: 5961 | Nga06365 | 151.41 | 248.47 | conserved hypothetical protein [Phytophthora infestans T30-4] |
| SEQ ID NO: 5962 | Nga06368 | 106.23 | 107.79 | trpc4apa protein |
| SEQ ID NO: 5963 | Nga21257 | 82.80 | 172.49 | ---NA--- |
| SEQ ID NO: 5964 | Nga06366 | 125.27 | 85.71 | ---NA--- |
| SEQ ID NO: 5965 | Nga06370 | 792.34 | 761.89 | amidase family protein |
| SEQ ID NO: 5966 | Nga06636 | 2072.50 | 2410.60 | uncharacterized protein |
| SEQ ID NO: 5967 | Nga04941.02 | 5066.50 | 7316.46 | wd sam and u-box domain-containing protein 1 |
| SEQ ID NO: 5968 | Nga04942.02 | 2777.10 | 2549.14 | phosphoglucomutase |
| SEQ ID NO: 5969 | Nga04943.02 | 365.54 | 394.22 | aintegumenta-like protein |
| SEQ ID NO: 5970 | Nga02317.02 | 2491.88 | 2067.26 | expressed unknown protein [Ectocarpus siliculosus] |
| SEQ ID NO: 5971 | Nga06638 | 707.18 | 716.12 | sulphate transporter |
| SEQ ID NO: 5972 | Nga06640 | 116.57 | 168.54 | gtp binding protein |
| SEQ ID NO: 5973 | Nga21112 | 1048.96 | 874.49 | short-chain dehydrogenase reductase sdr |
| SEQ ID NO: 5974 | Nga06635 | 614.58 | 508.71 | predicted protein [Thalassiosira pseudonana CCMP1335] |
| SEQ ID NO: 5975 | Nga00331 | 2033.25 | 2377.17 | ---NA--- |
| SEQ ID NO: 5976 | Nga00340 | 135.77 | 234.83 | ---NA--- |
| SEQ ID NO: 5977 | Nga00342 | 936.51 | 1053.76 | ribosome biogenesis gtpase |
| SEQ ID NO: 5978 | Nga00338 | 925.57 | 1205.93 | mitochondrial carrier protein |
| SEQ ID NO: 5979 | Nga00348 | 572.78 | 625.29 | protein |
| SEQ ID NO: 5980 | Nga00343 | 651.43 | 598.36 | dna replication complex gins protein psf1 |
| SEQ ID NO: 5981 | Nga00349 | 250.00 | 346.82 | predicted protein [Thalassiosira pseudonana CCMP1335] |
| SEQ ID NO: 5982 | Nga00344 | 1025.04 | 1085.95 | conserved hypothetical protein [Albugo laibachii Nc14] |
| SEQ ID NO: 5983 | Nga00330 | 1951.10 | 2021.27 | clathrin heavy chain |
| SEQ ID NO: 5984 | Nga00337 | 451.13 | 336.39 | methylenetetrahydrofolate reductase |
| SEQ ID NO: 5985 | Nga00328 | 900.22 | 810.90 | nucleotide sugar transporter family protein |
| SEQ ID NO: 5986 | Nga20149 | 951.28 | 784.65 | transmembrane emp24 domain trafficking protein 2 |
| SEQ ID NO: 5987 | Nga00327 | 8169.65 | 8650.17 | rubisco expression protein |
| SEQ ID NO: 5988 | Nga00329 | 276.36 | 288.01 | peptidyl-prolyl cis-trans isomerase-like protein |
| SEQ ID NO: 5989 | Nga00336 | 397.11 | 401.02 | major facilitator superfamily mfs_1 |
| SEQ ID NO: 5990 | Nga00334 | 638.40 | 712.65 | ---NA--- |
| SEQ ID NO: 5991 | Nga00332 | 1290.44 | 1379.26 | protein kinase c inhibitor |
| SEQ ID NO: 5992 | Nga00335 | 3111.78 | 3765.06 | polyketide synthase |
| SEQ ID NO: 5993 | Nga00333 | 458.61 | 527.08 | phosphatidylinositol phosphate kinase pipk5 |
| SEQ ID NO: 5994 | Nga00341 | 41.67 | 112.84 | ---NA--- |
| SEQ ID NO: 5995 | Nga00345 | 100.92 | 99.38 | ---NA--- |
| SEQ ID NO: 5996 | Nga00339 | 3222.22 | 3278.02 | protein |
| SEQ ID NO: 5997 | Nga04200.01 | 2435.26 | 2111.26 | glycine cleavage system h protein |
| SEQ ID NO: 5998 | Nga04199.01 | 844.11 | 731.14 | protein |
| SEQ ID NO: 5999 | Nga20123.1 | 500.47 | 556.51 | predicted protein [Thalassiosira pseudonana CCMP1335] |
| SEQ ID NO: 6000 | Nga02061.02 | 3210.62 | 3488.59 | peptidase s1 and chymotrypsin hap |
| SEQ ID NO: 6001 | Nga20785 | 605.52 | 862.54 | protein |
| SEQ ID NO: 6002 | Nga02954 | 3985.99 | 3621.40 | protein disulfide isomerase |
| SEQ ID NO: 6003 | Nga02960 | 921.97 | 1162.55 | polysaccharide deacetylase family protein |
| SEQ ID NO: 6004 | Nga02962 | 9144.93 | 9393.26 | ribosomal protein l32 |
| SEQ ID NO: 6005 | Nga20633 | 280.13 | 310.50 | protein arginine n-methyltransferase 7 |
| SEQ ID NO: 6006 | Nga02955 | 359.95 | 407.92 | protein |

FIGURE 24 CQ

| # | Nga model | +N rpkb | -N rpkb | GO |
|---|---|---|---|---|
| SEQ ID NO: 6007 | Nga02961 | 329.42 | 322.09 | protein |
| SEQ ID NO: 6008 | Nga02965 | 887.32 | 929.39 | ---NA--- |
| SEQ ID NO: 6009 | Nga02953 | 895.42 | 818.90 | protein |
| SEQ ID NO: 6010 | Nga02956 | 1779.14 | 2084.51 | plasma membrane intrinsic protein |
| SEQ ID NO: 6011 | Nga02958 | 548.88 | 517.58 | protein kinase-like |
| SEQ ID NO: 6012 | Nga02963 | 501.20 | 688.39 | fe-s-cluster oxidoreductase-like |
| SEQ ID NO: 6013 | Nga02946.2 | 2234.01 | 1934.71 | ---NA--- |
| SEQ ID NO: 6014 | Nga02957 | 2336.83 | 2590.37 | phytoene synthase |
| SEQ ID NO: 6015 | Nga02959 | 664.86 | 647.85 | adiponutrin and related vesicular transport proteins alpha beta hydrolase |
| SEQ ID NO: 6016 | Nga02964 | 416.48 | 425.64 | ---NA--- |
| SEQ ID NO: 6017 | Nga06747 | 315.33 | 314.68 | dynamin family protein |
| SEQ ID NO: 6018 | Nga06745 | 861.87 | 943.50 | assembly protein |
| SEQ ID NO: 6019 | Nga06746 | 151.76 | 106.66 | protein |
| SEQ ID NO: 6020 | Nga02693 | 268.10 | 326.15 | protein mon2 homolog |
| SEQ ID NO: 6021 | Nga02691 | 239.11 | 216.65 | transmembrane protein |
| SEQ ID NO: 6022 | Nga02689 | 551.55 | 528.06 | protein |
| SEQ ID NO: 6023 | Nga02690 | 574.31 | 561.29 | gcn5-related n-acetyltransferase |
| SEQ ID NO: 6024 | Nga02688 | 1167.21 | 1010.43 | ribosomal protein l17 |
| SEQ ID NO: 6025 | Nga02685 | 296.86 | 323.63 | AlNc14C116G6546 [Albugo laibachii Nc14] |
| SEQ ID NO: 6026 | Nga02684 | 338.70 | 361.34 | actin-like protein 6a |
| SEQ ID NO: 6027 | Nga02686 | 1598.07 | 1329.45 | udp-sulfoquinovose synthase |
| SEQ ID NO: 6028 | Nga02683 | 311.62 | 351.19 | protein |
| SEQ ID NO: 6029 | Nga20909 | 162.07 | 179.29 | glutathione synthetase |
| SEQ ID NO: 6030 | Nga20438 | 125.44 | 67.94 | glutathione synthetase |
| SEQ ID NO: 6031 | Nga02687 | 246.89 | 272.49 | abc transporter |
| SEQ ID NO: 6032 | Nga02692 | 97.39 | 120.36 | glutathione synthetase |
| SEQ ID NO: 6033 | Nga06352 | 517.45 | 499.08 | ---NA--- |
| SEQ ID NO: 6034 | Nga03958.02 | 971.34 | 986.64 | ---NA--- |
| SEQ ID NO: 6035 | Nga06349 | 1677.11 | 1777.57 | sulfate transporter |
| SEQ ID NO: 6036 | Nga06350 | 541.64 | 490.83 | fructose-bisphosphate aldolase |
| SEQ ID NO: 6037 | Nga06353 | 387.81 | 517.73 | ---NA--- |
| SEQ ID NO: 6038 | Nga01360.01 | 2706.83 | 2504.43 | transport protein sec61 alpha subunit |
| SEQ ID NO: 6039 | Nga01092.02 | 455.84 | 478.35 | rpa-interacting protein a |
| SEQ ID NO: 6040 | Nga01090.02 | 3969.61 | 4630.68 | transketolase |
| SEQ ID NO: 6041 | Nga01367 | 237.00 | 295.24 | lipase class 3 family protein |
| SEQ ID NO: 6042 | Nga20327 | 134.73 | 272.43 | zinc finger fyve domain-containing protein |
| SEQ ID NO: 6043 | Nga01368 | 139.57 | 176.11 | ---NA--- |
| SEQ ID NO: 6044 | Nga01363 | 508.73 | 459.23 | mpn pad-1 domain-containing protein |
| SEQ ID NO: 6045 | Nga01365 | 2289.17 | 2818.00 | lipase class 2 |
| SEQ ID NO: 6046 | Nga01362 | 653.23 | 528.51 | peptidase c13-like protein |
| SEQ ID NO: 6047 | Nga01361 | 6650.02 | 6478.26 | protein |
| SEQ ID NO: 6048 | Nga21165.1 | 101.93 | 80.57 | cupin 4 family protein |
| SEQ ID NO: 6049 | Nga02453.02 | 857.36 | 952.91 | protein |
| SEQ ID NO: 6050 | Nga02459.02 | 69.38 | 76.02 | metallo-beta-lactamase superfamily protein |
| SEQ ID NO: 6051 | Nga02451.02 | 757.24 | 824.83 | zinc transporter |
| SEQ ID NO: 6052 | Nga20718.1 | 229.86 | 261.82 | conserved unknown protein [Ectocarpus siliculosus] |
| SEQ ID NO: 6053 | Nga06303 | 2276.20 | 2171.49 | sideroflexin 3 |
| SEQ ID NO: 6054 | Nga06300 | 351.08 | 353.53 | protein |
| SEQ ID NO: 6055 | Nga06301 | 112.79 | 154.10 | protein |
| SEQ ID NO: 6056 | Nga06304 | 110.65 | 78.20 | glycoside hydrolase family 3 domain protein |
| SEQ ID NO: 6057 | Nga04154 | 480.66 | 450.42 | insulin-degrading enzyme |
| SEQ ID NO: 6058 | Nga04153 | 230.48 | 211.12 | chromosome 3 open reading frame 23 |
| SEQ ID NO: 6059 | Nga04155 | 19464.65 | 15657.65 | ---NA--- |
| SEQ ID NO: 6060 | Nga03824 | 459.05 | 518.27 | zinc finger ccch type domain containing protein expressed |
| SEQ ID NO: 6061 | Nga20409.1 | 85.06 | 53.94 | elegans protein confirmed by transcript evidence |
| SEQ ID NO: 6062 | Nga20453.1 | 37.63 | 34.94 | wd repeat domain 19 |
| SEQ ID NO: 6063 | Nga03825 | 16.67 | 27.08 | ---NA--- |
| SEQ ID NO: 6064 | Nga06670.2 | 496.12 | 501.27 | mitochondrial phosphate carrier protein |
| SEQ ID NO: 6065 | Nga03034 | 267.68 | 279.70 | glutamyl-trna a subunit |
| SEQ ID NO: 6066 | Nga03036 | 325.30 | 395.88 | ---NA--- |
| SEQ ID NO: 6067 | Nga03033.01 | 251.53 | 367.69 | biotin lipoate protein ligase-like protein |
| SEQ ID NO: 6068 | Nga03042.01 | 75.30 | 123.56 | protein |
| SEQ ID NO: 6069 | Nga03030.01 | 609.79 | 759.79 | peptidase u34 dipeptidase |

FIGURE 24 CR

| # | Nga model | +N rpkb | -N rpkb | GO |
|---|---|---|---|---|
| SEQ ID NO: 6070 | Nga03032 | 734.19 | 606.05 | ---NA--- |
| SEQ ID NO: 6071 | Nga03039 | 690.05 | 698.47 | ---NA--- |
| SEQ ID NO: 6072 | Nga03035 | 507.88 | 646.52 | Aardvark [Ectocarpus siliculosus] |
| SEQ ID NO: 6073 | Nga03037.01 | 415.64 | 402.61 | protein |
| SEQ ID NO: 6074 | Nga03031 | 479.89 | 486.21 | protein |
| SEQ ID NO: 6075 | Nga03041.01 | 422.87 | 487.28 | calcium calmodulin-dependent protein kinase type 1 |
| SEQ ID NO: 6076 | Nga03040.01 | 193.55 | 227.13 | ---NA--- |
| SEQ ID NO: 6077 | Nga03038.01 | 1745.28 | 1917.36 | conserved unknown protein [Ectocarpus siliculosus] |
| SEQ ID NO: 6078 | Nga06129 | 157.67 | 137.22 | dna topoisomerase 3-beta-1 |
| SEQ ID NO: 6079 | Nga06131 | 2535.79 | 2315.44 | ---NA--- |
| SEQ ID NO: 6080 | Nga06132 | 234.29 | 174.86 | ---NA--- |
| SEQ ID NO: 6081 | Nga06130 | 1083.33 | 1018.56 | chaperone protein |
| SEQ ID NO: 6082 | Nga06128 | 1112.69 | 833.60 | peroxisomal trans-2-enoyl- reductase |
| SEQ ID NO: 6083 | Nga20501 | 278.63 | 270.81 | ---NA--- |
| SEQ ID NO: 6084 | Nga20653 | 168.46 | 190.25 | ---NA--- |
| SEQ ID NO: 6085 | Nga06601.1 | 394.31 | 433.70 | ribonucleoside triphosphate reductase |
| SEQ ID NO: 6086 | Nga06602 | 347.14 | 443.35 | ufd1 like protein |
| SEQ ID NO: 6087 | Nga20848.1 | 284.96 | 214.36 | ---NA--- |
| SEQ ID NO: 6088 | Nga21244 | 151.32 | 149.66 | adp-ribosylation factor-like protein 2 |
| SEQ ID NO: 6089 | Nga06605 | 556.95 | 561.58 | arginine methyltransferase 4 |
| SEQ ID NO: 6090 | Nga06604 | 147.92 | 206.58 | atp-dependent rna helicase dbp4 |
| SEQ ID NO: 6091 | Nga20532 | 270.49 | 261.93 | serine threonine protein kinase cki3 |
| SEQ ID NO: 6092 | Nga21012 | 236.67 | 187.76 | cellular apoptosis susceptibility protein |
| SEQ ID NO: 6093 | Nga06603 | 267.67 | 217.34 | exportin-2-like protein |
| SEQ ID NO: 6094 | Nga20047 | 278.86 | 314.34 | pentatricopeptide repeat-containing protein |
| SEQ ID NO: 6095 | Nga20800 | 742.07 | 800.67 | aldo keto reductase family protein |
| SEQ ID NO: 6096 | Nga03247 | 2238.76 | 1592.10 | nudc domain-containing protein 2 |
| SEQ ID NO: 6097 | Nga03251 | 922.80 | 1038.64 | protein |
| SEQ ID NO: 6098 | Nga20831 | 536.52 | 582.62 | conserved unknown protein [Ectocarpus siliculosus] |
| SEQ ID NO: 6099 | Nga20839 | 515.54 | 603.46 | conserved unknown protein [Ectocarpus siliculosus] |
| SEQ ID NO: 6100 | Nga03252 | 4215.18 | 4347.34 | mpv17 protein |
| SEQ ID NO: 6101 | Nga03250 | 400.25 | 405.30 | ubiquitin-conjugating enzyme catalytic domain |
| SEQ ID NO: 6102 | Nga03249 | 1108.16 | 1129.33 | p21-activated protein kinase |
| SEQ ID NO: 6103 | Nga03248 | 3231.71 | 2687.33 | porphobilinogen deaminase |
| SEQ ID NO: 6104 | Nga21100 | 1144.02 | 1117.18 | ribophorin ii family protein |
| SEQ ID NO: 6105 | Nga03246 | 1849.38 | 1665.81 | high mobility group protein |
| SEQ ID NO: 6106 | Nga03253 | 453.70 | 702.10 | ---NA--- |
| SEQ ID NO: 6107 | Nga21042 | 439.10 | 427.42 | conserved unknown protein [Ectocarpus siliculosus] |
| SEQ ID NO: 6108 | Nga05503.1 | 1697.92 | 1685.03 | glycoprotease m22 family protein |
| SEQ ID NO: 6109 | Nga20781.1 | 866.36 | 771.81 | protein |
| SEQ ID NO: 6110 | Nga20471.1 | 391.08 | 343.74 | wd repeat and hmg-box dna-binding protein 1 |
| SEQ ID NO: 6111 | Nga21122.1 | 467.19 | 504.38 | lysocardiolipin acyltransferase 1 |
| SEQ ID NO: 6112 | Nga05507 | 180.09 | 168.12 | chromosome segregation protein |
| SEQ ID NO: 6113 | Nga05504 | 726.43 | 648.30 | protein |
| SEQ ID NO: 6114 | Nga05500.01 | 1186.11 | 978.92 | rna (guanine-9-)-methyltransferase domain-containing |
| SEQ ID NO: 6115 | Nga05499.01 | 1387.17 | 1469.01 | peptidase dimerization domain-containing protein |
| SEQ ID NO: 6116 | Nga21050 | 1748.68 | 1679.30 | erg28 like protein |
| SEQ ID NO: 6117 | Nga05501 | 4994.52 | 4540.79 | ---NA--- |
| SEQ ID NO: 6118 | Nga05895.2 | 422.28 | 434.61 | ---NA--- |
| SEQ ID NO: 6119 | Nga05502.01 | 1425.93 | 1289.85 | peroxisomal -dienoyl- reductase |
| SEQ ID NO: 6120 | Nga21071 | 95.59 | 143.37 | conserved unknown protein [Ectocarpus siliculosus] |
| SEQ ID NO: 6121 | Nga20875.1 | 1243.39 | 985.48 | protein |
| SEQ ID NO: 6122 | Nga04134.01 | 716.06 | 560.23 | activating transcription factor 1 |
| SEQ ID NO: 6123 | Nga04136.01 | 176.74 | 235.40 | protein |
| SEQ ID NO: 6124 | Nga05539.2 | 400.87 | 348.10 | isoform cra_a |
| SEQ ID NO: 6125 | Nga04137 | 429.43 | 645.17 | nucleolar protein 10 |
| SEQ ID NO: 6126 | Nga03613.01 | 3916.28 | 4065.88 | calcium-dependent protein |
| SEQ ID NO: 6127 | Nga03614.01 | 8410.89 | 7259.10 | protein |
| SEQ ID NO: 6128 | Nga20926 | 2883.01 | 2567.18 | protein |
| SEQ ID NO: 6129 | Nga03612 | 532.95 | 670.72 | protein |
| SEQ ID NO: 6130 | Nga03615 | 280.08 | 322.50 | twy3 methyltransferase |
| SEQ ID NO: 6131 | Nga02521 | 28.84 | 52.48 | ---NA--- |
| SEQ ID NO: 6132 | Nga02520.01 | 902.96 | 384.44 | phytochelatin synthase |
| SEQ ID NO: 6133 | Nga02512.02 | 644.84 | 653.19 | prolyl-trna |

FIGURE 24 CS

| # | Nga model | +N rpkb | -N rpkb | GO |
|---|---|---|---|---|
| SEQ ID NO: 6134 | Nga02518.01 | 181.02 | 126.74 | histone h1 |
| SEQ ID NO: 6135 | Nga02513 | 273.58 | 233.68 | xylosyltransferase i |
| SEQ ID NO: 6136 | Nga02509 | 4202.99 | 3776.77 | 40s ribosomal protein s21 |
| SEQ ID NO: 6137 | Nga02516.01 | 24.04 | 35.23 | t-complex 11 like isoform cra_b |
| SEQ ID NO: 6138 | Nga02512.01 | 644.84 | 653.19 | prolyl-trna |
| SEQ ID NO: 6139 | Nga02514.01 | 802.06 | 599.69 | tropinone reductase |
| SEQ ID NO: 6140 | Nga02508 | 4665.88 | 4659.18 | nadh-ubiquinone oxidoreductase b18 subunit family protein |
| SEQ ID NO: 6141 | Nga02511.01 | 2391.62 | 2702.49 | sporangia induced sperm flagellar protein |
| SEQ ID NO: 6142 | Nga02510 | 226.67 | 250.89 | protein |
| SEQ ID NO: 6143 | Nga02517 | 1349.68 | 1276.22 | protein |
| SEQ ID NO: 6144 | Nga02519.01 | 463.46 | 438.55 | phosphoglycerate mutase 1 family |
| SEQ ID NO: 6145 | Nga01612 | 1181.36 | 1299.88 | dna-directed rna polymerases i and iii subunit rpac2 |
| SEQ ID NO: 6146 | Nga01611 | 1717.82 | 1751.83 | glycerol kinase |
| SEQ ID NO: 6147 | Nga01613 | 1026.92 | 783.26 | proliferating cell nuclear antigen |
| SEQ ID NO: 6148 | Nga01614 | 393.84 | 368.97 | tyrosine aminotransferase |
| SEQ ID NO: 6149 | Nga01615 | 182.27 | 159.03 | alkylated dna repair protein alkb-like protein |
| SEQ ID NO: 6150 | Nga21025 | 963.21 | 778.91 | family with sequence similarity member a |
| SEQ ID NO: 6151 | Nga20876 | 1048.52 | 957.54 | protein |
| SEQ ID NO: 6152 | Nga06705 | 1078.84 | 1015.19 | protein |
| SEQ ID NO: 6153 | Nga04379.02 | 1007.44 | 1088.61 | ---NA--- |
| SEQ ID NO: 6154 | Nga04378.02 | 10024.63 | 8667.28 | like protein |
| SEQ ID NO: 6155 | Nga06704 | 1002.82 | 1049.67 | hydroxyacylglutathione hydrolase |
| SEQ ID NO: 6156 | Nga06710 | 184.24 | 259.24 | ---NA--- |
| SEQ ID NO: 6157 | Nga06707 | 1142.86 | 1049.97 | conserved unknown protein [Ectocarpus siliculosus] |
| SEQ ID NO: 6158 | Nga06711 | 83.77 | 124.77 | ---NA--- |
| SEQ ID NO: 6159 | Nga06706 | 677.48 | 737.77 | 1-aminocyclopropane-1-carboxylate deaminase |
| SEQ ID NO: 6160 | Nga21230 | 100.78 | 75.57 | ---NA--- |
| SEQ ID NO: 6161 | Nga03839 | 461.47 | 409.36 | prolyl endopeptidase |
| SEQ ID NO: 6162 | Nga03840 | 873.86 | 858.34 | protein serine threonine kinase |
| SEQ ID NO: 6163 | Nga03841 | 568.14 | 612.25 | beta-ketoacyl synthase |
| SEQ ID NO: 6164 | Nga20632 | 160.51 | 259.07 | polyketide synthase |
| SEQ ID NO: 6165 | Nga20637 | 139.30 | 169.76 | polyketide synthase |
| SEQ ID NO: 6166 | Nga20733 | 181.47 | 156.84 | polyketide synthase |
| SEQ ID NO: 6167 | Nga20163 | 139.19 | 174.20 | beta-ketoacyl synthase |
| SEQ ID NO: 6168 | Nga01202.01 | 701.79 | 658.97 | magnesium-dependent phosphatase 1 |
| SEQ ID NO: 6169 | Nga01205 | 853.93 | 709.98 | ---NA--- |
| SEQ ID NO: 6170 | Nga01203 | 452.20 | 538.47 | sulfotransferase |
| SEQ ID NO: 6171 | Nga01207 | 374.28 | 272.37 | trna splicing endonuclease 54 homolog |
| SEQ ID NO: 6172 | Nga01206 | 1929.29 | 2415.61 | glycoside hydrolase family 8 |
| SEQ ID NO: 6173 | Nga01204.01 | 11063.86 | 12214.44 | hypothetical protein THAPSDRAFT_268059 [Thalassiosira pseudonana CCMP1335] |
| SEQ ID NO: 6174 | Nga01201.01 | 567.13 | 655.45 | l-allo-threonine aldolase |
| SEQ ID NO: 6175 | Nga20807.1 | 2369.09 | 2461.90 | conserved unknown protein [Ectocarpus siliculosus] |
| SEQ ID NO: 6176 | Nga01508.1 | 2612.36 | 3093.51 | threonine aldolase |
| SEQ ID NO: 6177 | Nga01504 | 455.49 | 703.47 | uncharacterized protein |
| SEQ ID NO: 6178 | Nga04086.2 | 245.95 | 279.00 | atpase-like protein |
| SEQ ID NO: 6179 | Nga01506 | 361.54 | 351.63 | ---NA--- |
| SEQ ID NO: 6180 | Nga01503 | 623.17 | 654.33 | escrt-ii complex subunit vps22 |
| SEQ ID NO: 6181 | Nga04083.2 | 948.01 | 1692.75 | sec14p-like phosphatidylinositol transfer family protein |
| SEQ ID NO: 6182 | Nga05546.1 | 360.44 | 368.05 | ---NA--- |
| SEQ ID NO: 6183 | Nga04129.02 | 2357.42 | 2462.01 | ---NA--- |
| SEQ ID NO: 6184 | Nga20544 | 198.16 | 304.50 | rdd domain containing protein |
| SEQ ID NO: 6185 | Nga05548 | 467.30 | 419.98 | citrate synthase |
| SEQ ID NO: 6186 | Nga04128.02 | 25708.25 | 33515.41 | fructose-bisphosphate aldolase |
| SEQ ID NO: 6187 | Nga20625 | 305.56 | 259.11 | protein |
| SEQ ID NO: 6188 | Nga05552 | 252.33 | 232.95 | protein pelota homolog |
| SEQ ID NO: 6189 | Nga20680 | 29.20 | 94.88 | ---NA--- |
| SEQ ID NO: 6190 | Nga04228.02 | 902.97 | 885.89 | expressed unknown protein [Ectocarpus siliculosus] |
| SEQ ID NO: 6191 | Nga20805 | 503.09 | 579.23 | protein |
| SEQ ID NO: 6192 | Nga04227.02 | 1197.11 | 1442.35 | aaa-type atpase family protein |
| SEQ ID NO: 6193 | Nga05554 | 441.75 | 476.65 | acid phosphatase-1 |
| SEQ ID NO: 6194 | Nga04226.02 | 2703.62 | 3063.23 | peroxisomal biogenesis factor 11 domain-containing protein |
| SEQ ID NO: 6195 | Nga20348 | 490.09 | 460.49 | conserved unknown protein [Ectocarpus siliculosus] |
| SEQ ID NO: 6196 | Nga01224 | 529.65 | 748.31 | ---NA--- |

FIGURE 24 CT

| # | Nga model | +N rpkb | -N rpkb | GO |
|---|---|---|---|---|
| SEQ ID NO: 6197 | Nga01222.01 | 694.92 | 575.64 | uv excision repair protein |
| SEQ ID NO: 6198 | Nga06844.2 | 3618.52 | 7053.06 | ferredoxin (2fe-2s) |
| SEQ ID NO: 6199 | Nga06144.1 | 861.43 | 810.33 | hydroxyacyl-coenzyme a mitochondrial precursor |
| SEQ ID NO: 6200 | Nga06148 | 287.08 | 417.23 | major facilitator superfamily mfs_1 |
| SEQ ID NO: 6201 | Nga06145 | 2327.49 | 2308.50 | vacuolar atpase subunit dva41 |
| SEQ ID NO: 6202 | Nga06147 | 138.18 | 182.08 | ---NA--- |
| SEQ ID NO: 6203 | Nga06143 | 3092.62 | 2830.61 | high mobility group b3 protein |
| SEQ ID NO: 6204 | Nga06146.1 | 1602.18 | 1863.63 | pyrophosphate-dependent phosphofructose kinase |
| SEQ ID NO: 6205 | Nga06788 | 228.59 | 183.95 | cellulase 2 |
| SEQ ID NO: 6206 | Nga06786 | 239.09 | 287.81 | protein phosphatase |
| SEQ ID NO: 6207 | Nga06784 | 148.15 | 100.30 | ---NA--- |
| SEQ ID NO: 6208 | Nga06785 | 2124.70 | 2027.01 | ubiquitin-like domain-containing ctd phosphatase 1 |
| SEQ ID NO: 6209 | Nga06787 | 645.16 | 570.17 | ---NA--- |
| SEQ ID NO: 6210 | Nga21268 | 33.33 | 36.11 | transmembrane protein 97 |
| SEQ ID NO: 6211 | Nga03628 | 33.24 | 22.24 | ---NA--- |
| SEQ ID NO: 6212 | Nga03627 | 83.95 | 56.17 | ---NA--- |
| SEQ ID NO: 6213 | Nga20636 | 185.04 | 213.24 | ---NA--- |
| SEQ ID NO: 6214 | Nga00885 | 177.26 | 142.63 | condensin complex components subunit |
| SEQ ID NO: 6215 | Nga20506.1 | 354.17 | 324.97 | conserved unknown protein [Ectocarpus siliculosus] |
| SEQ ID NO: 6216 | Nga20275.1 | 178.53 | 155.39 | upf0533 protein c5orf44 homolog |
| SEQ ID NO: 6217 | Nga00886.01 | 6284.26 | 7991.04 | isocitrate lyase |
| SEQ ID NO: 6218 | Nga01406 | 1488.32 | 1530.94 | conserved unknown protein [Ectocarpus siliculosus] |
| SEQ ID NO: 6219 | Nga01407 | 1385.96 | 1435.54 | ribonuclease h |
| SEQ ID NO: 6220 | Nga01405 | 610.77 | 734.76 | mitochondrial dna replication protein yhm2 |
| SEQ ID NO: 6221 | Nga01408 | 57.68 | 42.55 | zinc ran-binding domain containing 3 |
| SEQ ID NO: 6222 | Nga20732 | 181.82 | 166.18 | ---NA--- |
| SEQ ID NO: 6223 | Nga20452 | 215.74 | 208.44 | protein |
| SEQ ID NO: 6224 | Nga20753 | 265.63 | 225.67 | ---NA--- |
| SEQ ID NO: 6225 | Nga20515 | 162.71 | 168.91 | ---NA--- |
| SEQ ID NO: 6226 | Nga20054 | 348.19 | 417.40 | protein |
| SEQ ID NO: 6227 | Nga01243.2 | 837.84 | 803.64 | mitogen-activated protein |
| SEQ ID NO: 6228 | Nga20542 | 164.35 | 203.11 | ---NA--- |
| SEQ ID NO: 6229 | Nga01240 | 920.97 | 1304.03 | carbonic anhydrase |
| SEQ ID NO: 6230 | Nga01246 | 492.46 | 480.83 | protein |
| SEQ ID NO: 6231 | Nga01242 | 403.05 | 462.51 | protein kinase-like |
| SEQ ID NO: 6232 | Nga01241 | 2189.13 | 2124.59 | ycii-related domain protein |
| SEQ ID NO: 6233 | Nga01244 | 236.29 | 202.63 | protein |
| SEQ ID NO: 6234 | Nga01243.1 | 837.84 | 803.64 | protein |
| SEQ ID NO: 6235 | Nga03809 | 290.85 | 306.16 | mn2+ fe2+ nramp family |
| SEQ ID NO: 6236 | Nga03811 | 2050.19 | 2062.61 | ---NA--- |
| SEQ ID NO: 6237 | Nga03810 | 200.60 | 210.81 | protein |
| SEQ ID NO: 6238 | Nga06329 | 387.03 | 555.34 | atp-dependent clp atp-binding subunit |
| SEQ ID NO: 6239 | Nga06325 | 610.17 | 411.57 | protein |
| SEQ ID NO: 6240 | Nga06322 | 1308.41 | 1356.57 | molybdenum cofactor synthesis isoform cra_a |
| SEQ ID NO: 6241 | Nga06328 | 1832.45 | 1846.68 | cell division protein |
| SEQ ID NO: 6242 | Nga06327 | 937.98 | 1016.06 | protein |
| SEQ ID NO: 6243 | Nga20605 | 825.08 | 799.02 | predicted protein [Phaeodactylum tricornutum CCAP 1055/1] |
| SEQ ID NO: 6244 | Nga06323 | 387.08 | 327.63 | mitogen-activated protein kinase |
| SEQ ID NO: 6245 | Nga06324.01 | 2670.06 | 2608.04 | dna repair protein nse1 |
| SEQ ID NO: 6246 | Nga06330 | 309.48 | 291.99 | fg-gap repeat family protein |
| SEQ ID NO: 6247 | Nga06321 | 12408.16 | 9381.89 | extrinsic protein in photosystem ii |
| SEQ ID NO: 6248 | Nga06326 | 1569.87 | 1313.92 | 26s proteasome non-atpase regulatory subunit 14 |
| SEQ ID NO: 6249 | Nga01322 | 138.00 | 133.39 | intraflagellar transport protein ift88 |
| SEQ ID NO: 6250 | Nga20569 | 115.89 | 114.78 | ---NA--- |
| SEQ ID NO: 6251 | Nga01321 | 131.00 | 66.22 | intraflagellar transport protein 88 homolog |
| SEQ ID NO: 6252 | Nga20597 | 122.56 | 120.69 | intraflagellar transport protein 88 homolog |
| SEQ ID NO: 6253 | Nga01319 | 339.57 | 423.71 | 60s ribosomal export protein |
| SEQ ID NO: 6254 | Nga01318 | 4676.56 | 5307.80 | chaperonin |
| SEQ ID NO: 6255 | Nga20071 | 1048.85 | 1212.72 | hit zinc finger family protein |
| SEQ ID NO: 6256 | Nga01320 | 1176.86 | 1267.71 | eukaryotic translation initiation factor iso4e |
| SEQ ID NO: 6257 | Nga01785.02 | 1113.07 | 1258.03 | protein |
| SEQ ID NO: 6258 | Nga06051 | 1828.77 | 1937.09 | peptidase c26 family protein |
| SEQ ID NO: 6259 | Nga06054 | 389.91 | 427.62 | ---NA--- |
| SEQ ID NO: 6260 | Nga06052 | 653.74 | 435.78 | ---NA--- |

FIGURE 24 CU

| # | Nga model | +N rpkb | -N rpkb | GO |
|---|---|---|---|---|
| SEQ ID NO: 6261 | Nga06055 | 2352.14 | 2984.16 | ---NA--- |
| SEQ ID NO: 6262 | Nga06050 | 430.08 | 367.71 | high density lipoprotien binding protein vigilin |
| SEQ ID NO: 6263 | Nga02741 | 1096.55 | 1111.46 | pyruvate dehydrogenase component x |
| SEQ ID NO: 6264 | Nga02742 | 291.67 | 248.24 | chaperone protein dnak |
| SEQ ID NO: 6265 | Nga02737 | 830.75 | 964.31 | phospholipid:diacylglycerol acyltransferase |
| SEQ ID NO: 6266 | Nga04982.2 | 877.34 | 673.70 | isoform a |
| SEQ ID NO: 6267 | Nga02736.01 | 3124.70 | 3021.11 | conserved unknown protein [Ectocarpus siliculosus] |
| SEQ ID NO: 6268 | Nga02739 | 1093.14 | 1109.78 | thymidylate kinase |
| SEQ ID NO: 6269 | Nga02744 | 434.78 | 399.45 | selw selh selenoprotein |
| SEQ ID NO: 6270 | Nga02740 | 100.60 | 156.14 | root hairless 1 |
| SEQ ID NO: 6271 | Nga01469 | 649.82 | 600.09 | caib baif -transferase family protein c7orf10-like isoform 1 |
| SEQ ID NO: 6272 | Nga01468 | 1832.78 | 1706.48 | abortive infection protein |
| SEQ ID NO: 6273 | Nga20537 | 327.82 | 371.32 | indole-3-glycerol-phosphate synthase |
| SEQ ID NO: 6274 | Nga01471 | 346.83 | 391.78 | u4 tri-snrnp-associated |
| SEQ ID NO: 6275 | Nga01470 | 302.22 | 334.96 | u4 tri-snrnp-associated protein 2 |
| SEQ ID NO: 6276 | Nga04009 | 356.12 | 429.49 | aarf domain containing kinase 2 |
| SEQ ID NO: 6277 | Nga04010.1 | 968.23 | 1108.62 | protein |
| SEQ ID NO: 6278 | Nga04011.01 | 136.51 | 204.59 | atp synthetase alpha chain -like |
| SEQ ID NO: 6279 | Nga04008.01 | 768.78 | 714.71 | emp24 gp25l p24 family protein |
| SEQ ID NO: 6280 | Nga03649 | 1523.72 | 1529.97 | protein |
| SEQ ID NO: 6281 | Nga03647 | 512.20 | 497.36 | argininosuccinate lyase |
| SEQ ID NO: 6282 | Nga03648 | 351.05 | 362.09 | ---NA--- |
| SEQ ID NO: 6283 | Nga20299 | 578.85 | 543.15 | amine oxidase |
| SEQ ID NO: 6284 | Nga03646 | 169.83 | 195.08 | general transcription factor polypeptide 3 |
| SEQ ID NO: 6285 | Nga00815 | 31086.73 | 24649.10 | expressed unknown protein [Ectocarpus siliculosus] |
| SEQ ID NO: 6286 | Nga00813 | 242.94 | 134.64 | conserved unknown protein [Ectocarpus siliculosus] |
| SEQ ID NO: 6287 | Nga00816 | 95.91 | 72.22 | hypothetical protein Esi_0189_0054 [Ectocarpus siliculosus] |
| SEQ ID NO: 6288 | Nga00808 | 372.03 | 407.68 | histone acetylase complex subunit mrg15-2 |
| SEQ ID NO: 6289 | Nga00809 | 8606.19 | 6021.06 | expressed unknown protein [Ectocarpus siliculosus] |
| SEQ ID NO: 6290 | Nga00810 | 1986.52 | 2210.28 | betacateninlike protein |
| SEQ ID NO: 6291 | Nga00812 | 1461.19 | 1501.69 | clusterin associated protein 1 |
| SEQ ID NO: 6292 | Nga00814 | 1292.50 | 1369.72 | protein |
| SEQ ID NO: 6293 | Nga00811 | 10958.01 | 11253.50 | predicted protein [Thalassiosira pseudonana CCMP1335] |
| SEQ ID NO: 6294 | Nga04126.01 | 3030.08 | 2953.05 | ---NA--- |
| SEQ ID NO: 6295 | Nga04127.01 | 203.45 | 291.35 | growth arrest-specific 7 |
| SEQ ID NO: 6296 | Nga20183 | 690.06 | 753.43 | kynurenine alpha-aminoadipate mitochondrial-like |
| SEQ ID NO: 6297 | Nga21057 | 517.29 | 582.20 | aromatic aminotransferase |
| SEQ ID NO: 6298 | Nga21219.1 | 230.33 | 228.50 | augmenter of liver regeneration |
| SEQ ID NO: 6299 | Nga02583 | 2572.73 | 2578.84 | ---NA--- |
| SEQ ID NO: 6300 | Nga02111.02 | 525.58 | 463.05 | carbohydratebinding protein |
| SEQ ID NO: 6301 | Nga20179 | 210.32 | 223.48 | protein |
| SEQ ID NO: 6302 | Nga02588 | 178.67 | 194.98 | sterol desaturase family protein |
| SEQ ID NO: 6303 | Nga20126 | 376.51 | 268.63 | dna repair and transcription protein |
| SEQ ID NO: 6304 | Nga02591 | 151.99 | 132.14 | mms19 nucleotide excision repair protein |
| SEQ ID NO: 6305 | Nga02586 | 423.84 | 498.22 | ppgpp synthetase |
| SEQ ID NO: 6306 | Nga02587 | 934.37 | 925.42 | 6-phosphogluconate dehydrogenase |
| SEQ ID NO: 6307 | Nga02582 | 2173.54 | 2373.53 | ---NA--- |
| SEQ ID NO: 6308 | Nga02590 | 146.55 | 150.66 | abc subfamily abcg |
| SEQ ID NO: 6309 | Nga02585 | 1421.11 | 1459.82 | protein |
| SEQ ID NO: 6310 | Nga02589 | 75.84 | 91.70 | abc transporter g family protein |
| SEQ ID NO: 6311 | Nga03685 | 883.37 | 901.24 | ccr4-associated factor |
| SEQ ID NO: 6312 | Nga03419 | 1677.78 | 1368.49 | mitochondrial carrier |
| SEQ ID NO: 6313 | Nga03418 | 527.71 | 608.84 | activating signal cointegrator 1 complex subunit 2 |
| SEQ ID NO: 6314 | Nga03422 | 406.24 | 516.38 | non-ribosomal peptide synthetase |
| SEQ ID NO: 6315 | Nga03411 | 554.52 | 600.67 | pseudouridine family |
| SEQ ID NO: 6316 | Nga03420 | 136.36 | 140.42 | ---NA--- |
| SEQ ID NO: 6317 | Nga03417 | 453.67 | 498.36 | ---NA--- |
| SEQ ID NO: 6318 | Nga03413 | 738.11 | 812.23 | cytoplasm protein |
| SEQ ID NO: 6319 | Nga03410 | 369.19 | 437.12 | protein |
| SEQ ID NO: 6320 | Nga03421 | 200.00 | 171.51 | ---NA--- |
| SEQ ID NO: 6321 | Nga03409 | 5319.15 | 5066.94 | translation elongation factor g |
| SEQ ID NO: 6322 | Nga02839.02 | 1754.74 | 1803.40 | dihydrolipoamide dehydrogenase |
| SEQ ID NO: 6323 | Nga03423 | 2415.07 | 2341.26 | uncharacterized protein |
| SEQ ID NO: 6324 | Nga03414 | 1062.63 | 992.39 | ---NA--- |

FIGURE 24 CV

| # | Nga model | +N rpkb | -N rpkb | GO |
|---|---|---|---|---|
| SEQ ID NO: 6325 | Nga02842.02 | 2105.04 | 2116.40 | ---NA--- |
| SEQ ID NO: 6326 | Nga03415 | 849.81 | 760.89 | uncharacterized protein |
| SEQ ID NO: 6327 | Nga03412 | 1441.04 | 1358.46 | protein sco1 mitochondrial-like |
| SEQ ID NO: 6328 | Nga20825 | 237.61 | 261.06 | karyopherin beta 2b isoform 2 |
| SEQ ID NO: 6329 | Nga06487.1 | 139.53 | 178.14 | transportin 1 |
| SEQ ID NO: 6330 | Nga02592.02 | 324.43 | 366.06 | thiamine monophosphate synthase |
| SEQ ID NO: 6331 | Nga02563.02 | 1646.55 | 1120.59 | ---NA--- |
| SEQ ID NO: 6332 | Nga02597.2 | 555.13 | 626.05 | u2 small nuclear ribonucleoprotein auxiliary factor u2af |
| SEQ ID NO: 6333 | Nga06485 | 857.93 | 1099.22 | serine threonine-protein phosphatase 1 regulatory subunit 10 |
| SEQ ID NO: 6334 | Nga06486 | 3845.15 | 4297.50 | glucan -beta-glucosidase precursor |
| SEQ ID NO: 6335 | Nga06665.2 | 558.54 | 566.24 | protein |
| SEQ ID NO: 6336 | Nga06662 | 144.48 | 159.86 | mitochondrial carrier protein |
| SEQ ID NO: 6337 | Nga20262.1 | 647.28 | 605.12 | myosin-like protein |
| SEQ ID NO: 6338 | Nga06666 | 290.63 | 282.22 | protein kinase domain containing protein |
| SEQ ID NO: 6339 | Nga20744 | 170.10 | 217.76 | myosin 29 |
| SEQ ID NO: 6340 | Nga06667 | 140.61 | 157.64 | class v myosin |
| SEQ ID NO: 6341 | Nga06663 | 6510.15 | 5646.23 | ---NA--- |
| SEQ ID NO: 6342 | Nga21009 | 291.67 | 376.70 | rna binding identical |
| SEQ ID NO: 6343 | Nga06665.1 | 558.54 | 566.24 | protein |
| SEQ ID NO: 6344 | Nga06661 | 208.20 | 156.89 | protein |
| SEQ ID NO: 6345 | Nga00060 | 421.44 | 364.03 | l-asparaginase i |
| SEQ ID NO: 6346 | Nga00053.01 | 6413.41 | 6296.68 | expressed unknown protein [Ectocarpus siliculosus] |
| SEQ ID NO: 6347 | Nga00055 | 207.07 | 280.84 | deah (asp-glu-ala-his) box polypeptide 35 |
| SEQ ID NO: 6348 | Nga00056 | 1521.01 | 1609.98 | protein high chlorophyll fluorescent 107 |
| SEQ ID NO: 6349 | Nga00054.01 | 1480.13 | 1451.60 | gamma tubulin |
| SEQ ID NO: 6350 | Nga00065 | 6234.67 | 5507.78 | transport protein sec61 subunit gamma |
| SEQ ID NO: 6351 | Nga00068 | 6583.39 | 6152.26 | rna binding s1 domain protein |
| SEQ ID NO: 6352 | Nga00058 | 704.45 | 750.35 | diaminopimelate decarboxylase |
| SEQ ID NO: 6353 | Nga00052.01 | 725.04 | 763.11 | isoleucyl-trna synthetase |
| SEQ ID NO: 6354 | Nga00064 | 1084.32 | 1043.27 | uncharacterized protein |
| SEQ ID NO: 6355 | Nga00061.01 | 734.20 | 684.80 | ---NA--- |
| SEQ ID NO: 6356 | Nga00057.01 | 412.66 | 515.55 | conserved hypothetical protein [Phytophthora infestans T30-4] |
| SEQ ID NO: 6357 | Nga00051 | 836.72 | 833.62 | beta glucosidase |
| SEQ ID NO: 6358 | Nga00070.01 | 910.24 | 770.27 | ---NA--- |
| SEQ ID NO: 6359 | Nga00067 | 625.30 | 535.03 | ---NA--- |
| SEQ ID NO: 6360 | Nga00063.1 | 543.50 | 530.89 | methylmalonic aciduria type a mitochondrial |
| SEQ ID NO: 6361 | Nga00069 | 1767.30 | 1941.65 | ---NA--- |
| SEQ ID NO: 6362 | Nga00059 | 1511.53 | 1363.96 | 1-acyl-sn-glycerol-3-phosphate acyltransferase |
| SEQ ID NO: 6363 | Nga01540 | 375.39 | 457.27 | tetratricopeptide repeat |
| SEQ ID NO: 6364 | Nga01536 | 994.48 | 830.38 | 30s ribosomal protein s17 |
| SEQ ID NO: 6365 | Nga21106 | 243.78 | 264.07 | tetrapyrrole methylase family protein |
| SEQ ID NO: 6366 | Nga21220 | 251.57 | 200.68 | uncharacterized protein |
| SEQ ID NO: 6367 | Nga01538 | 300.21 | 352.11 | ---NA--- |
| SEQ ID NO: 6368 | Nga01539.1 | 338.33 | 507.74 | hypothetical protein GLRG_11977 [Glomerella graminicola M1.001] |
| SEQ ID NO: 6369 | Nga05666.2 | 1267.76 | 1299.29 | protein |
| SEQ ID NO: 6370 | Nga01541.1 | 738.35 | 652.27 | ---NA--- |
| SEQ ID NO: 6371 | Nga04044 | 221.40 | 279.80 | atp-citrate synthase |
| SEQ ID NO: 6372 | Nga20541 | 271.13 | 226.31 | predicted protein [Thalassiosira pseudonana CCMP1335] |
| SEQ ID NO: 6373 | Nga20463 | 149.35 | 189.92 | ---NA--- |
| SEQ ID NO: 6374 | Nga21144 | 220.53 | 240.38 | all-trans-retinol -reductase-like |
| SEQ ID NO: 6375 | Nga06648 | 1432.49 | 1654.41 | aara_dicdi ame: full=protein aardvark ame: full=suppressor of amib protein 16 |
| SEQ ID NO: 6376 | Nga21240 | 231.40 | 153.98 | wd repeat-containing protein 59 |
| SEQ ID NO: 6377 | Nga06652 | 242.35 | 204.49 | protein |
| SEQ ID NO: 6378 | Nga01591.02 | 93.20 | 98.23 | vacuolar membrane protein |
| SEQ ID NO: 6379 | Nga21123 | 194.56 | 166.56 | protein |
| SEQ ID NO: 6380 | Nga06650 | 814.72 | 820.07 | ras-related protein rab-22a |
| SEQ ID NO: 6381 | Nga06651 | 1937.24 | 2038.05 | predicted protein [Thalassiosira pseudonana CCMP1335] |
| SEQ ID NO: 6382 | Nga06649 | 757.74 | 643.49 | integral membrane protein gpr180-like |
| SEQ ID NO: 6383 | Nga00719 | 1790.17 | 1911.41 | aspartate-semialdehyde dehydrogenase |
| SEQ ID NO: 6384 | Nga20795 | 566.49 | 620.66 | endothelin-converting enzyme 2 |
| SEQ ID NO: 6385 | Nga00730 | 956.35 | 1017.04 | elongation factor |
| SEQ ID NO: 6386 | Nga00727 | 402.50 | 321.46 | mitochondrial carrier family |
| SEQ ID NO: 6387 | Nga00726 | 520.54 | 579.21 | elongation factor 2 |

FIGURE 24 CW

| # | Nga model | +N rpkb | -N rpkb | GO |
|---|---|---|---|---|
| SEQ ID NO: 6388 | Nga00720 | 1057.08 | 906.89 | hypothetical protein PITG_19672 [Albugo laibachii Nc14] |
| SEQ ID NO: 6389 | Nga20017 | 676.21 | 696.71 | conserved unknown protein [Ectocarpus siliculosus] |
| SEQ ID NO: 6390 | Nga00722 | 931.69 | 889.71 | protein |
| SEQ ID NO: 6391 | Nga21249 | 334.15 | 417.86 | conserved unknown protein (Partial) [Ectocarpus siliculosus] |
| SEQ ID NO: 6392 | Nga00725 | 158.83 | 219.15 | conserved hypothetical protein [Phytophthora infestans T30-4] |
| SEQ ID NO: 6393 | Nga00715 | 6589.02 | 6689.63 | snf7 family protein |
| SEQ ID NO: 6394 | Nga00713 | 1355.48 | 2633.31 | guanine deaminase |
| SEQ ID NO: 6395 | Nga00712.01 | 1387.79 | 1547.99 | ---NA--- |
| SEQ ID NO: 6396 | Nga00718 | 3675.62 | 3501.73 | nuclear cap-binding protein subunit 2 |
| SEQ ID NO: 6397 | Nga00721 | 500.00 | 422.91 | ---NA--- |
| SEQ ID NO: 6398 | Nga00714 | 10613.76 | 10849.80 | isocitrate dehydrogenase |
| SEQ ID NO: 6399 | Nga00717 | 164.81 | 132.69 | cytohesin-1 isoform 2 |
| SEQ ID NO: 6400 | Nga20430 | 126.87 | 113.17 | ---NA--- |
| SEQ ID NO: 6401 | Nga00729 | 1094.19 | 1099.84 | 50s ribosomal protein l34 |
| SEQ ID NO: 6402 | Nga00723 | 585.90 | 710.29 | mediator of rna polymerase ii transcription subunit 14 |
| SEQ ID NO: 6403 | Nga00724 | 306.56 | 389.08 | ---NA--- |
| SEQ ID NO: 6404 | Nga00716 | 2835.95 | 2836.94 | ---NA--- |
| SEQ ID NO: 6405 | Nga00939.1 | 1862.83 | 2384.66 | protein |
| SEQ ID NO: 6406 | Nga00941 | 786.93 | 706.58 | trna rrna methyltransferase |
| SEQ ID NO: 6407 | Nga00942 | 2361.64 | 2083.58 | haloacid dehalogenase-like hydrolase domain-containing protein |
| SEQ ID NO: 6408 | Nga00940 | 401.71 | 300.24 | unc-50 family protein |
| SEQ ID NO: 6409 | Nga01651 | 1432.46 | 1310.09 | proteasome subunit alpha |
| SEQ ID NO: 6410 | Nga01650 | 98.90 | 92.53 | rad54-like protein |
| SEQ ID NO: 6411 | Nga20810 | 143.76 | 176.34 | dna helicase aaa atpase |
| SEQ ID NO: 6412 | Nga03967 | 97.83 | 113.82 | ---NA--- |
| SEQ ID NO: 6413 | Nga03968 | 214.29 | 165.80 | ---NA--- |
| SEQ ID NO: 6414 | Nga01057.01 | 382.95 | 325.41 | protein |
| SEQ ID NO: 6415 | Nga01058 | 510.97 | 495.55 | notchless protein homolog 1 |
| SEQ ID NO: 6416 | Nga01060 | 169.96 | 184.11 | beta-lactamase-like protein |
| SEQ ID NO: 6417 | Nga05713 | 431.57 | 502.01 | predicted protein [Phaeodactylum tricornutum CCAP 1055/1] |
| SEQ ID NO: 6418 | Nga05720 | 1510.74 | 1313.32 | nucleotide-sensitive chloride conductance regulator family protein |
| SEQ ID NO: 6419 | Nga05712.1 | 588.89 | 489.93 | transmembrane protein 30a |
| SEQ ID NO: 6420 | Nga05715 | 865.64 | 808.88 | zinc matrin type 2 |
| SEQ ID NO: 6421 | Nga05719 | 131.08 | 155.48 | set and mynd domain containing 3 |
| SEQ ID NO: 6422 | Nga05710 | 669.16 | 546.35 | hypothetical protein AURANDRAFT_70357 [Aureococcus anophagefferens] |
| SEQ ID NO: 6423 | Nga05711 | 1342.40 | 1381.25 | serine threonine protein phosphatase |
| SEQ ID NO: 6424 | Nga05714 | 684.50 | 754.85 | ---NA--- |
| SEQ ID NO: 6425 | Nga00800.02 | 375.00 | 371.91 | metal ion transporter family |
| SEQ ID NO: 6426 | Nga05718 | 146.84 | 159.93 | protein ilityhia |
| SEQ ID NO: 6427 | Nga05709 | 512.78 | 391.22 | ---NA--- |
| SEQ ID NO: 6428 | Nga05716 | 426.14 | 457.50 | ankyrin unc44 |
| SEQ ID NO: 6429 | Nga02465.01 | 2351.72 | 2235.21 | ---NA--- |
| SEQ ID NO: 6430 | Nga02473 | 355.34 | 362.33 | general transcription factor 3c polypeptide 5 |
| SEQ ID NO: 6431 | Nga02476.01 | 1954.21 | 1454.23 | response regulator receiver domain-containing protein |
| SEQ ID NO: 6432 | Nga02471 | 312.15 | 201.96 | protein |
| SEQ ID NO: 6433 | Nga20591 | 108.28 | 151.79 | glutathione s-transferase |
| SEQ ID NO: 6434 | Nga21283.1 | 1526.01 | 1092.63 | response regulator receiver domain-containing protein |
| SEQ ID NO: 6435 | Nga02475 | 44.12 | 55.75 | ---NA--- |
| SEQ ID NO: 6436 | Nga04047.2 | 2199.20 | 1649.65 | anion:sodium symporter |
| SEQ ID NO: 6437 | Nga02464 | 5103.83 | 4208.76 | heat shock protein 90 |
| SEQ ID NO: 6438 | Nga02467.01 | 721.70 | 742.59 | 50s ribosomal protein l25 general stress protein ctc |
| SEQ ID NO: 6439 | Nga02469 | 998.18 | 941.56 | protein |
| SEQ ID NO: 6440 | Nga02472 | 55.94 | 39.84 | kinesin-like protein |
| SEQ ID NO: 6441 | Nga20500 | 197.18 | 208.51 | anaphase promoting complex subunit 4 |
| SEQ ID NO: 6442 | Nga02470 | 942.47 | 1041.08 | predicted protein [Thalassiosira pseudonana CCMP1335] |
| SEQ ID NO: 6443 | Nga02478 | 1076.61 | 1313.28 | novel protein vertebrate fuse-binding protein-interacting repressor |
| SEQ ID NO: 6444 | Nga02466 | 1740.09 | 2158.98 | nadh-dependent fumarate reductase |
| SEQ ID NO: 6445 | Nga02474 | 9615.69 | 10326.79 | ---NA--- |
| SEQ ID NO: 6446 | Nga01624 | 1559.28 | 1289.22 | glutaredoxin-like protein |
| SEQ ID NO: 6447 | Nga20885 | 1682.57 | 1421.12 | grx5 |
| SEQ ID NO: 6448 | Nga01626 | 267.91 | 319.69 | ---NA--- |
| SEQ ID NO: 6449 | Nga01623 | 899.33 | 703.38 | hypothetical protein AURANDRAFT_61437 [Aureococcus anophagefferens] |

FIGURE 24 CX

| # | Nga model | +N rpkb | -N rpkb | GO |
|---|---|---|---|---|
| SEQ ID NO: 6450 | Nga01625 | 96.59 | 117.71 | transmembrane protein |
| SEQ ID NO: 6451 | Nga01627 | 663.38 | 741.48 | ---NA--- |
| SEQ ID NO: 6452 | Nga01628 | 484.08 | 499.84 | histone methylation dot1 family protein |
| SEQ ID NO: 6453 | Nga06231 | 781.30 | 787.51 | stress-inducible protein |
| SEQ ID NO: 6454 | Nga06230 | 282.95 | 197.57 | protein |
| SEQ ID NO: 6455 | Nga01122 | 389.79 | 365.19 | hsp90 chloroplast targeted |
| SEQ ID NO: 6456 | Nga01123 | 272.47 | 213.00 | ---NA--- |
| SEQ ID NO: 6457 | Nga03777 | 366.67 | 482.60 | protein |
| SEQ ID NO: 6458 | Nga03779 | 50.40 | 70.73 | gcn5-related n-acetyltransferase |
| SEQ ID NO: 6459 | Nga03782 | 822.82 | 847.69 | ---NA--- |
| SEQ ID NO: 6460 | Nga03778 | 1017.69 | 1157.82 | rrm-containing rna-binding |
| SEQ ID NO: 6461 | Nga07071.2 | 398.76 | 385.02 | tpr domain-containing protein |
| SEQ ID NO: 6462 | Nga00532.02 | 423.08 | 522.87 | sdhfb_dicdi ame: full=succinate dehydrogenase assembly factor 1 homolog mitochondrial short=sdh assembly factor 1b |
| SEQ ID NO: 6463 | Nga01006 | 569.73 | 632.31 | protein |
| SEQ ID NO: 6464 | Nga01005 | 702.11 | 782.49 | homeodomain transcription factor 2 |
| SEQ ID NO: 6465 | Nga01003 | 1626.04 | 2396.14 | conserved unknown protein [Ectocarpus siliculosus] |
| SEQ ID NO: 6466 | Nga01004 | 6757.16 | 7228.41 | atpase |
| SEQ ID NO: 6467 | Nga01008 | 323.02 | 279.18 | abhydrolase domain-containing protein |
| SEQ ID NO: 6468 | Nga01002 | 29606.59 | 24538.77 | rieske (2fe-2s) region protein |
| SEQ ID NO: 6469 | Nga01007 | 183.29 | 227.74 | ---NA--- |
| SEQ ID NO: 6470 | Nga21214 | 311.59 | 300.97 | t-complex protein 10a-like |
| SEQ ID NO: 6471 | Nga01100.1 | 489.92 | 115.80 | poly -binding protein 3 isoform 2 |
| SEQ ID NO: 6472 | Nga01103.1 | 1040.00 | 1014.42 | endoribonuclease l-psp |
| SEQ ID NO: 6473 | Nga21211 | 469.91 | 451.35 | tubulin binding cofactor c domain-containing protein |
| SEQ ID NO: 6474 | Nga01104.01 | 171.35 | 145.49 | exocyst complex component 7 |
| SEQ ID NO: 6475 | Nga01101 | 3065.34 | 3258.10 | conserved unknown protein [Ectocarpus siliculosus] |
| SEQ ID NO: 6476 | Nga01102 | 1322.10 | 1161.77 | protein |
| SEQ ID NO: 6477 | Nga01105 | 0.00 | 7.33 | adenylate and guanylate cyclase catalytic domain protein |
| SEQ ID NO: 6478 | Nga05819.1 | 1067.43 | 958.50 | cdp-diacylglycerol--glycerol-3-phosphate 3-phosphatidyltransferase |
| SEQ ID NO: 6479 | Nga04657.02 | 553.42 | 557.82 | vesicle transport v- |
| SEQ ID NO: 6480 | Nga20292 | 509.57 | 578.44 | wd40 repeat-containing protein |
| SEQ ID NO: 6481 | Nga05820 | 2970.95 | 4120.54 | protein |
| SEQ ID NO: 6482 | Nga05824 | 491.28 | 669.94 | aminoglycoside phosphotransferase |
| SEQ ID NO: 6483 | Nga20659 | 405.09 | 549.04 | ---NA--- |
| SEQ ID NO: 6484 | Nga05821 | 10989.89 | 10063.12 | calmodulin |
| SEQ ID NO: 6485 | Nga05822 | 281.52 | 300.19 | conserved c2h2 zinc finger protein |
| SEQ ID NO: 6486 | Nga05817 | 377.84 | 322.71 | microcystin synthetase-associated thioesterase |
| SEQ ID NO: 6487 | Nga05818.1 | 586.84 | 778.60 | trehalose-phosphate synthase |
| SEQ ID NO: 6488 | Nga00915 | 767.68 | 827.93 | replication protein a 32 kda |
| SEQ ID NO: 6489 | Nga00917 | 820.48 | 973.68 | gtp-binding protein 1 |
| SEQ ID NO: 6490 | Nga20393 | 128.10 | 89.52 | helicase-like protein |
| SEQ ID NO: 6491 | Nga00916 | 822.41 | 926.09 | vacuolar protein sorting-associated protein 13 family protein |
| SEQ ID NO: 6492 | Nga20041 | 411.35 | 515.69 | tectonin beta-propeller repeat-containing protein 1-like |
| SEQ ID NO: 6493 | Nga20770 | 183.06 | 268.19 | conserved unknown protein [Ectocarpus siliculosus] |
| SEQ ID NO: 6494 | Nga20394 | 152.94 | 223.02 | protein |
| SEQ ID NO: 6495 | Nga20268 | 198.99 | 223.79 | vacuolar protein sorting-associated protein vps13 |
| SEQ ID NO: 6496 | Nga00913 | 1169.71 | 1219.71 | conserved hypothetical protein |
| SEQ ID NO: 6497 | Nga00914 | 94.71 | 111.01 | dead deah box rna |
| SEQ ID NO: 6498 | Nga01330 | 107.20 | 148.64 | protein |
| SEQ ID NO: 6499 | Nga01331.1 | 956.06 | 908.09 | nad-dependent epimerase dehydratase |
| SEQ ID NO: 6500 | Nga01332 | 172.26 | 179.02 | ---NA--- |
| SEQ ID NO: 6501 | Nga20592 | 138.76 | 347.26 | alpha-galactosidase |
| SEQ ID NO: 6502 | Nga21156 | 211.45 | 238.60 | alpha-galactosidase |
| SEQ ID NO: 6503 | Nga05245 | 710.47 | 861.55 | expressed unknown protein [Ectocarpus siliculosus] |
| SEQ ID NO: 6504 | Nga05247 | 742.08 | 649.45 | protein |
| SEQ ID NO: 6505 | Nga05248 | 367.87 | 485.33 | phosphatidylinositide phosphatase sac1 |
| SEQ ID NO: 6506 | Nga05246 | 1599.20 | 1774.27 | protein |
| SEQ ID NO: 6507 | Nga05249 | 894.61 | 1123.06 | ---NA--- |
| SEQ ID NO: 6508 | Nga05244 | 618.28 | 650.33 | uncharacterized protein c7orf50-like |
| SEQ ID NO: 6509 | Nga00968.02 | 54.57 | 59.11 | hypothetical protein PTSG_07517 [Salpingoeca sp. ATCC 50818] |
| SEQ ID NO: 6510 | Nga06291 | 1186.34 | 1368.81 | radical sam domain protein |
| SEQ ID NO: 6511 | Nga00967.02 | 484.45 | 507.08 | dna polymerase beta |
| SEQ ID NO: 6512 | Nga02278.2 | 881.63 | 1017.11 | fe-only |

FIGURE 24 CY

| # | Nga model | +N rpkb | -N rpkb | GO |
|---|---|---|---|---|
| SEQ ID NO: 6513 | Nga00985.1 | 231.15 | 248.73 | atpase type 13a1 |
| SEQ ID NO: 6514 | Nga00982.01 | 2877.19 | 2455.92 | ---NA--- |
| SEQ ID NO: 6515 | Nga20397 | 343.09 | 334.04 | duf89 fructose- -bisphosphatase |
| SEQ ID NO: 6516 | Nga00984 | 1098.97 | 1337.96 | protein |
| SEQ ID NO: 6517 | Nga00983.01 | 1637.10 | 1510.56 | peptidyl-prolyl cis-trans isomerase |
| SEQ ID NO: 6518 | Nga00981 | 331.99 | 549.75 | ---NA--- |
| SEQ ID NO: 6519 | Nga01117.02 | 2200.70 | 2327.30 | dual specificity protein phosphatase 10 |
| SEQ ID NO: 6520 | Nga01282 | 72.46 | 23.55 | ---NA--- |
| SEQ ID NO: 6521 | Nga01276 | 900.56 | 563.62 | ---NA--- |
| SEQ ID NO: 6522 | Nga01281 | 143.13 | 108.12 | ---NA--- |
| SEQ ID NO: 6523 | Nga01277 | 125.64 | 180.23 | protein |
| SEQ ID NO: 6524 | Nga21014 | 229.21 | 241.70 | peroxisome biogenesis factor 10 |
| SEQ ID NO: 6525 | Nga01279 | 175.36 | 220.75 | ring-1 like protein |
| SEQ ID NO: 6526 | Nga01280 | 153.69 | 169.85 | predicted protein [Thalassiosira pseudonana CCMP1335] |
| SEQ ID NO: 6527 | Nga20419.1 | 187.56 | 171.67 | protein |
| SEQ ID NO: 6528 | Nga20486.1 | 153.35 | 110.75 | ---NA--- |
| SEQ ID NO: 6529 | Nga03710 | 214.17 | 228.77 | protein |
| SEQ ID NO: 6530 | Nga20907 | 112.78 | 138.46 | ---NA--- |
| SEQ ID NO: 6531 | Nga02439.02 | 217.65 | 364.79 | ---NA--- |
| SEQ ID NO: 6532 | Nga00900 | 193.20 | 284.44 | protein |
| SEQ ID NO: 6533 | Nga00902 | 567.90 | 511.53 | predicted protein [Thalassiosira pseudonana CCMP1335] |
| SEQ ID NO: 6534 | Nga00899 | 1393.10 | 1060.82 | malonyl- :acp transacylase |
| SEQ ID NO: 6535 | Nga00894 | 520.00 | 416.27 | protein |
| SEQ ID NO: 6536 | Nga00897 | 763.53 | 736.89 | nitrite transporter nar1 |
| SEQ ID NO: 6537 | Nga00896 | 336.11 | 286.62 | mitochondrial matrix protein frataxin |
| SEQ ID NO: 6538 | Nga00903 | 944.14 | 804.13 | unknown [Picea sitchensis] |
| SEQ ID NO: 6539 | Nga00895 | 535.47 | 674.51 | abc transporter atp-binding protein |
| SEQ ID NO: 6540 | Nga00901 | 617.30 | 685.62 | hypothetical protein AURANDRAFT_70357 [Aureococcus anophagefferens] |
| SEQ ID NO: 6541 | Nga00898 | 327.00 | 267.38 | upf0551 protein mitochondrial-like |
| SEQ ID NO: 6542 | Nga21016 | 361.43 | 331.47 | nad-dependent epimerase dehydratase |
| SEQ ID NO: 6543 | Nga02272 | 93.66 | 74.60 | PREDICTED: hypothetical protein, partial [Strongylocentrotus purpuratus] |
| SEQ ID NO: 6544 | Nga02271 | 76.92 | 87.95 | ---NA--- |
| SEQ ID NO: 6545 | Nga01748 | 333.74 | 251.28 | potential abc transporter |
| SEQ ID NO: 6546 | Nga01747 | 4701.88 | 5746.79 | thiamine biosynthesis protein |
| SEQ ID NO: 6547 | Nga21175 | 238.37 | 233.02 | dual specificity protein |
| SEQ ID NO: 6548 | Nga01750 | 213.74 | 140.57 | ---NA--- |
| SEQ ID NO: 6549 | Nga01749 | 689.83 | 682.73 | ---NA--- |
| SEQ ID NO: 6550 | Nga02129 | 16.97 | 19.57 | outer dynein arm heavy chain beta |
| SEQ ID NO: 6551 | Nga02130 | 7.75 | 2.80 | flagellar outer dynein arm heavy chain beta |
| SEQ ID NO: 6552 | Nga04665.2 | 487.34 | 523.33 | dna-directed rna polymerases i and iii subunit rpac1 |
| SEQ ID NO: 6553 | Nga01918.01 | 520.47 | 576.46 | protein |
| SEQ ID NO: 6554 | Nga20936.1 | 4845.53 | 5109.62 | dynamin-like protein |
| SEQ ID NO: 6555 | Nga01916.01 | 4258.00 | 4114.80 | dynamin-like protein |
| SEQ ID NO: 6556 | Nga01917.01 | 1146.85 | 805.48 | dna-directed rna polymerases and iii subunit rpabc2 |
| SEQ ID NO: 6557 | Nga21018 | 107.87 | 143.62 | ---NA--- |
| SEQ ID NO: 6558 | Nga05804 | 201.75 | 214.98 | probable methyltransferase c20orf7 mitochondrial precursor |
| SEQ ID NO: 6559 | Nga05803 | 522.93 | 459.57 | protein |
| SEQ ID NO: 6560 | Nga20278 | 199.82 | 273.92 | trna pseudouridine synthase |
| SEQ ID NO: 6561 | Nga05805 | 1229.66 | 1724.36 | ---NA--- |
| SEQ ID NO: 6562 | Nga05807 | 959.24 | 1009.64 | ---NA--- |
| SEQ ID NO: 6563 | Nga05806 | 174.45 | 209.22 | ---NA--- |
| SEQ ID NO: 6564 | Nga00095 | 682.17 | 626.99 | tri-functional histidine biosynthesis protein |
| SEQ ID NO: 6565 | Nga00096 | 925.90 | 698.24 | udp-sugar transporter ust74c |
| SEQ ID NO: 6566 | Nga20768 | 875.11 | 885.58 | elongator complex protein 3 |
| SEQ ID NO: 6567 | Nga20938 | 569.32 | 517.92 | alpha beta hydrolase fold protein |
| SEQ ID NO: 6568 | Nga00113 | 185.68 | 166.65 | glutamine synthetase |
| SEQ ID NO: 6569 | Nga00103.01 | 2716.83 | 3062.52 | protein |
| SEQ ID NO: 6570 | Nga00091 | 1648.13 | 1942.21 | p-type atpase |
| SEQ ID NO: 6571 | Nga00110 | 626.43 | 663.55 | proteasome assembly chaperone 4-like |
| SEQ ID NO: 6572 | Nga00098 | 587.77 | 424.46 | dolichol-phosphate mannosyltransferase |
| SEQ ID NO: 6573 | Nga20373 | 495.11 | 455.38 | dna-directed rna polymerase iii subunit rpc2 |
| SEQ ID NO: 6574 | Nga00099.01 | 257.29 | 207.31 | protein |

FIGURE 24 CZ

| # | Nga model | +N rpkb | -N rpkb | GO |
|---|---|---|---|---|
| SEQ ID NO: 6575 | Nga00101 | 6070.18 | 6877.83 | elongation factor 2 |
| SEQ ID NO: 6576 | Nga00105 | 2736.60 | 3078.00 | mitochondrial processing peptidase |
| SEQ ID NO: 6577 | Nga00107 | 6547.31 | 4853.77 | ---NA--- |
| SEQ ID NO: 6578 | Nga00104 | 857.41 | 1046.65 | protein |
| SEQ ID NO: 6579 | Nga00094 | 517.51 | 378.09 | nicotinate phosphoribosyltransferase |
| SEQ ID NO: 6580 | Nga00112 | 308.14 | 233.02 | ---NA--- |
| SEQ ID NO: 6581 | Nga00111 | 3121.00 | 2480.56 | conserved hypothetical protein [Phytophthora infestans T30-4] |
| SEQ ID NO: 6582 | Nga00106 | 418.80 | 408.69 | small-conductance mechanosensitive channel |
| SEQ ID NO: 6583 | Nga00092 | 6991.55 | 7148.71 | heat shock protein 70 |
| SEQ ID NO: 6584 | Nga00100 | 1399.88 | 1333.52 | cytochrome p450 |
| SEQ ID NO: 6585 | Nga00109 | 381.47 | 426.43 | alpha-galactosidase |
| SEQ ID NO: 6586 | Nga00102 | 865.36 | 967.38 | protein |
| SEQ ID NO: 6587 | Nga00108 | 2652.13 | 2543.30 | ormdl family protein |
| SEQ ID NO: 6588 | Nga00097 | 1684.50 | 2533.38 | ngdn protein |
| SEQ ID NO: 6589 | Nga00093 | 805.18 | 738.63 | protein |
| SEQ ID NO: 6590 | Nga02035 | 342.83 | 292.52 | dolichyl-phosphate beta-glucosyltransferase isoform 1 |
| SEQ ID NO: 6591 | Nga01784.02 | 451.68 | 369.62 | dna-directed rna polymerase ii kda polypeptide |
| SEQ ID NO: 6592 | Nga01787.02 | 325.16 | 362.85 | charged multivesicular body protein 3 |
| SEQ ID NO: 6593 | Nga20075.1 | 420.11 | 497.58 | beta-lactamase domain protein |
| SEQ ID NO: 6594 | Nga01681.01 | 1100.15 | 1061.04 | rab18 -family small gtpase |
| SEQ ID NO: 6595 | Nga01682.01 | 481.50 | 549.59 | ---NA--- |
| SEQ ID NO: 6596 | Nga01684.01 | 424.39 | 547.78 | glucosamine-6-phosphate isomerase |
| SEQ ID NO: 6597 | Nga20571 | 131.34 | 229.63 | conserved unknown protein [Ectocarpus siliculosus] |
| SEQ ID NO: 6598 | Nga20202 | 214.87 | 256.32 | predicted protein [Thalassiosira pseudonana CCMP1335] |
| SEQ ID NO: 6599 | Nga01683 | 1010.46 | 1102.75 | urate oxidase |
| SEQ ID NO: 6600 | Nga06764 | 35.26 | 59.02 | protein |
| SEQ ID NO: 6601 | Nga06763 | 204.51 | 297.75 | ---NA--- |
| SEQ ID NO: 6602 | Nga06765 | 350.17 | 248.01 | ---NA--- |
| SEQ ID NO: 6603 | Nga06762 | 530.82 | 557.77 | mitogen-activated protein kinase kinase 2 |
| SEQ ID NO: 6604 | Nga06761 | 259.85 | 298.82 | protein |
| SEQ ID NO: 6605 | Nga01657 | 595.40 | 567.76 | protein |
| SEQ ID NO: 6606 | Nga20498.1 | 399.18 | 472.25 | ---NA--- |
| SEQ ID NO: 6607 | Nga06223 | 900.15 | 988.70 | periplasmic beta-glucosidase |
| SEQ ID NO: 6608 | Nga06221 | 525.33 | 651.36 | protein |
| SEQ ID NO: 6609 | Nga06220 | 1044.94 | 753.26 | protein |
| SEQ ID NO: 6610 | Nga06224 | 346.01 | 354.21 | tb2 dp1 hva22 family integral membrane protein that may be involved in membrane 3x transmembrane domains |
| SEQ ID NO: 6611 | Nga06219 | 786.09 | 735.67 | mitochondrial carrier |
| SEQ ID NO: 6612 | Nga06222 | 384.71 | 471.44 | tetratricopeptide repeat domain-containing protein |
| SEQ ID NO: 6613 | Nga20466 | 147.77 | 208.46 | g patch domain-containing protein 1 |
| SEQ ID NO: 6614 | Nga20317 | 133.48 | 163.24 | kif2a protein |
| SEQ ID NO: 6615 | Nga21061 | 144.58 | 172.27 | kinesin-like protein |
| SEQ ID NO: 6616 | Nga03575.01 | 352.24 | 224.19 | protein |
| SEQ ID NO: 6617 | Nga03574.01 | 344.22 | 390.16 | protein |
| SEQ ID NO: 6618 | Nga03570.2 | 262.11 | 255.67 | ---NA--- |
| SEQ ID NO: 6619 | Nga03576.01 | 333.33 | 350.46 | 60s ribosome subunit biogenesis protein nip7 homolog |
| SEQ ID NO: 6620 | Nga02317.01 | 2491.88 | 2067.26 | expressed unknown protein [Ectocarpus siliculosus] |
| SEQ ID NO: 6621 | Nga02319 | 299.29 | 237.68 | mitochondrial carrier family |
| SEQ ID NO: 6622 | Nga02318 | 22562.94 | 15306.00 | ---NA--- |
| SEQ ID NO: 6623 | Nga20788 | 326.72 | 291.52 | cs-domain containing conserved in apicomplexa |
| SEQ ID NO: 6624 | Nga06079.2 | 539.93 | 483.32 | mitochondrial carrier |
| SEQ ID NO: 6625 | Nga00877 | 1362.81 | 1463.10 | wd repeat protein |
| SEQ ID NO: 6626 | Nga00879 | 637.24 | 675.96 | polynucleotide adenylyltransferase region |
| SEQ ID NO: 6627 | Nga20100 | 1902.74 | 1691.56 | mitochondrial pyruvate dehydrogenase kinase |
| SEQ ID NO: 6628 | Nga00880 | 861.32 | 844.91 | mitochondrial import receptor subunit tom40 |
| SEQ ID NO: 6629 | Nga01848.01 | 817.03 | 538.20 | ---NA--- |
| SEQ ID NO: 6630 | Nga02393 | 568.78 | 670.50 | ---NA--- |
| SEQ ID NO: 6631 | Nga02023 | 9.17 | 11.74 | ---NA--- |
| SEQ ID NO: 6632 | Nga02083 | 304.88 | 332.46 | conserved unknown protein [Ectocarpus siliculosus] |
| SEQ ID NO: 6633 | Nga02086 | 193.35 | 186.08 | potassium channel modulatory factor 1 |
| SEQ ID NO: 6634 | Nga02084 | 862.30 | 784.01 | protein |
| SEQ ID NO: 6635 | Nga02085 | 111.57 | 131.37 | membrane-associated tyrosine- and threonine-specific cdc2-inhibitory kinase |

FIGURE 24 DA

| # | Nga model | +N rpkb | -N rpkb | GO |
|---|---|---|---|---|
| SEQ ID NO: 6636 | Nga20558.1 | 308.61 | 329.47 | b chain snapshots of the rna processing factor scaf8 bound to different phosphorylated forms of the carboxy-terminal domain of rna-polymerase ii |
| SEQ ID NO: 6637 | Nga04892.2 | 449.06 | 410.90 | protein |
| SEQ ID NO: 6638 | Nga01648 | 749.03 | 701.07 | saccharopine dehydrogenase |
| SEQ ID NO: 6639 | Nga05884 | 420.79 | 406.36 | inositol-3-phosphate synthase |
| SEQ ID NO: 6640 | Nga05882 | 287.44 | 354.97 | dead deah box rna |
| SEQ ID NO: 6641 | Nga05883 | 3646.90 | 3205.23 | ras-related protein rab-11b |
| SEQ ID NO: 6642 | Nga05885 | 670.23 | 587.17 | protein |
| SEQ ID NO: 6643 | Nga05881 | 247.02 | 184.02 | ---NA--- |
| SEQ ID NO: 6644 | Nga20188 | 265.60 | 266.04 | rna binding motif protein 19 |
| SEQ ID NO: 6645 | Nga20304 | 169.12 | 284.08 | probable rna-binding protein 19 |
| SEQ ID NO: 6646 | Nga20549 | 131.66 | 88.29 | trna rrna methyltransferase |
| SEQ ID NO: 6647 | Nga03930 | 1183.76 | 1185.08 | conserved unknown protein [Ectocarpus siliculosus] |
| SEQ ID NO: 6648 | Nga03929.01 | 1365.45 | 1483.05 | -dihydroxy-2-butanone 4-phosphate synthase |
| SEQ ID NO: 6649 | Nga03927 | 1448.96 | 1350.55 | atp-dependent clp protease proteolytic subunit |
| SEQ ID NO: 6650 | Nga03928 | 346.33 | 342.21 | tsa family domain-containing protein |
| SEQ ID NO: 6651 | Nga02254 | 420.36 | 336.67 | translation initiation factor if-3 |
| SEQ ID NO: 6652 | Nga02256 | 500.00 | 533.31 | cop9 constitutive photomorphogenic homolog subunit 8 |
| SEQ ID NO: 6653 | Nga02255 | 368.83 | 427.67 | protein |
| SEQ ID NO: 6654 | Nga20661 | 212.67 | 249.98 | aaa atpase domain-containing protein |
| SEQ ID NO: 6655 | Nga02250 | 133.33 | 101.10 | duf647 family protein |
| SEQ ID NO: 6656 | Nga02251 | 287.09 | 158.10 | protein |
| SEQ ID NO: 6657 | Nga03442 | 428.84 | 404.30 | 3 (2) -bisphosphate nucleotidase |
| SEQ ID NO: 6658 | Nga03450 | 4620.38 | 4566.75 | ---NA--- |
| SEQ ID NO: 6659 | Nga20991 | 647.06 | 477.90 | unidentified vitellogenin-linked transcript family member (uvt-5) |
| SEQ ID NO: 6660 | Nga03430.2 | 1044.76 | 980.40 | fkbp-type peptidyl-prolyl cis-trans isomerase |
| SEQ ID NO: 6661 | Nga03444 | 972.38 | 1006.83 | spx domain-containing membrane protein |
| SEQ ID NO: 6662 | Nga03439 | 21834.08 | 22200.65 | expressed unknown protein [Ectocarpus siliculosus] |
| SEQ ID NO: 6663 | Nga03448 | 636.79 | 601.23 | charged multivesicular body protein 2a |
| SEQ ID NO: 6664 | Nga03449 | 11.01 | 15.72 | mer3 meiotic cross-over helicase |
| SEQ ID NO: 6665 | Nga20869 | 614.26 | 567.07 | hypothetical protein DFA_11952 [Dictyostelium fasciculatum] |
| SEQ ID NO: 6666 | Nga03441 | 637.69 | 552.62 | stress-inducible protein |
| SEQ ID NO: 6667 | Nga03446 | 680.42 | 729.18 | conserved unknown protein [Ectocarpus siliculosus] |
| SEQ ID NO: 6668 | Nga03440 | 2636.40 | 3144.03 | kif1-binding protein homolog |
| SEQ ID NO: 6669 | Nga03447 | 341.43 | 469.45 | arginyl-trna synthetase |
| SEQ ID NO: 6670 | Nga03445 | 1548.15 | 1185.94 | fkbp-type peptidyl-prolyl cis-trans isomerase |
| SEQ ID NO: 6671 | Nga20159 | 558.38 | 601.62 | indoleamine -dioxygenase 2 |
| SEQ ID NO: 6672 | Nga20057 | 194.44 | 215.98 | rio kinase 1 |
| SEQ ID NO: 6673 | Nga20155 | 548.32 | 674.97 | hect e3 ubiquitin |
| SEQ ID NO: 6674 | Nga21054 | 193.66 | 282.25 | hect e3 ubiquitin |
| SEQ ID NO: 6675 | Nga21055 | 156.51 | 306.95 | hect e3 ubiquitin |
| SEQ ID NO: 6676 | Nga21128 | 76.51 | 98.30 | e3 ubiquitin-protein ligase mf123 |
| SEQ ID NO: 6677 | Nga02145 | 461.54 | 621.38 | dis3 mitotic control homolog |
| SEQ ID NO: 6678 | Nga02246 | 698.28 | 680.08 | protein |
| SEQ ID NO: 6679 | Nga02245 | 2954.23 | 3079.94 | heat shock protein hsp90 |
| SEQ ID NO: 6680 | Nga20259 | 121.18 | 139.22 | predicted protein [Phaeodactylum tricornutum CCAP 1055/1] |
| SEQ ID NO: 6681 | Nga04181 | 84.25 | 79.36 | ---NA--- |
| SEQ ID NO: 6682 | Nga04178 | 3021.12 | 2812.17 | ---NA--- |
| SEQ ID NO: 6683 | Nga04177 | 22890.19 | 11531.01 | light harvesting complex protein |
| SEQ ID NO: 6684 | Nga04180 | 181.97 | 185.14 | guanine nucleotide-binding protein subunit beta-like protein 1 |
| SEQ ID NO: 6685 | Nga04179 | 500.00 | 554.51 | ---NA--- |
| SEQ ID NO: 6686 | Nga07181.2 | 133.99 | 140.87 | glycosyl hydrolase |
| SEQ ID NO: 6687 | Nga00253.1 | 3745.67 | 1601.50 | ---NA--- |
| SEQ ID NO: 6688 | Nga00250 | 128.60 | 134.72 | myotubularin related protein 3 |
| SEQ ID NO: 6689 | Nga00251.01 | 8641.55 | 8947.81 | redoxin domain protein |
| SEQ ID NO: 6690 | Nga00255 | 263.31 | 251.84 | ---NA--- |
| SEQ ID NO: 6691 | Nga00258.01 | 3.62 | 27.47 | ---NA--- |
| SEQ ID NO: 6692 | Nga00254 | 435.24 | 517.47 | ubiquitin-like activating enzyme |
| SEQ ID NO: 6693 | Nga00256 | 753.44 | 1123.52 | ---NA--- |
| SEQ ID NO: 6694 | Nga20850 | 343.40 | 371.98 | ---NA--- |
| SEQ ID NO: 6695 | Nga00257.1 | 709.01 | 743.00 | ---NA--- |
| SEQ ID NO: 6696 | Nga00971.1 | 204.50 | 216.85 | glutamine-fructose-6-phosphate transaminase |
| SEQ ID NO: 6697 | Nga00970.01 | 3093.06 | 2547.48 | glutaredoxin type i |

FIGURE 24 DB

| # | Nga model | +N rpkb | -N rpkb | GO |
|---|---|---|---|---|
| SEQ ID NO: 6698 | Nga00974.1 | 69.99 | 107.07 | guanine deaminase |
| SEQ ID NO: 6699 | Nga00972 | 163.06 | 171.88 | dna mismatch repair protein |
| SEQ ID NO: 6700 | Nga00973 | 167.06 | 188.73 | ---NA--- |
| SEQ ID NO: 6701 | Nga06287.2 | 265.54 | 321.91 | ---NA--- |
| SEQ ID NO: 6702 | Nga04422 | 1722.66 | 1268.64 | ribonuclease p |
| SEQ ID NO: 6703 | Nga04425.01 | 316.04 | 226.10 | ---NA--- |
| SEQ ID NO: 6704 | Nga04423.1 | 220.40 | 345.89 | protein |
| SEQ ID NO: 6705 | Nga04426 | 298.67 | 381.30 | protein |
| SEQ ID NO: 6706 | Nga04424 | 133.62 | 122.95 | ---NA--- |
| SEQ ID NO: 6707 | Nga03065.02 | 525.64 | 552.61 | adenosine 3 -phospho 5 -phosphosulfate transporter 2 |
| SEQ ID NO: 6708 | Nga03066.02 | 1130.43 | 1118.00 | coiled-coil domain 6-like protein |
| SEQ ID NO: 6709 | Nga06389.1 | 645.23 | 635.62 | fact complex subunit |
| SEQ ID NO: 6710 | Nga06392 | 8319.44 | 8728.20 | 60s ribosomal protein l24 |
| SEQ ID NO: 6711 | Nga06393 | 864.46 | 888.30 | casein kinase ii beta subunit |
| SEQ ID NO: 6712 | Nga06391 | 742.29 | 654.48 | conserved unknown protein [Ectocarpus siliculosus] |
| SEQ ID NO: 6713 | Nga06388 | 2111.84 | 2020.37 | hig1 domain family member 2a |
| SEQ ID NO: 6714 | Nga20319 | 92.50 | 136.11 | protein |
| SEQ ID NO: 6715 | Nga05206 | 72.46 | 125.59 | protein |
| SEQ ID NO: 6716 | Nga05205 | 42.12 | 63.49 | protein |
| SEQ ID NO: 6717 | Nga05202 | 674.73 | 612.40 | ras-related gtp-binding protein |
| SEQ ID NO: 6718 | Nga05200 | 485.29 | 524.63 | dihydrolipoamide s-acetyltransferase |
| SEQ ID NO: 6719 | Nga05203 | 286.76 | 310.24 | kinesin heavy chain |
| SEQ ID NO: 6720 | Nga05201 | 44.17 | 67.09 | large subunit gtpase 1 |
| SEQ ID NO: 6721 | Nga05207 | 490.66 | 422.45 | protein |
| SEQ ID NO: 6722 | Nga00939.2 | 1862.83 | 2384.66 | protein |
| SEQ ID NO: 6723 | Nga21096 | 218.99 | 215.28 | protein |
| SEQ ID NO: 6724 | Nga02198.1 | 267.59 | 327.20 | inositol polyphosphate 5-phosphatase ocrl-1 |
| SEQ ID NO: 6725 | Nga04291 | 1502.38 | 1494.22 | choline dehydrogenase |
| SEQ ID NO: 6726 | Nga01807 | 632.52 | 903.10 | ribonuclease ii |
| SEQ ID NO: 6727 | Nga21216 | 473.56 | 580.36 | weakly cyanobacterial exoribonuclease ii |
| SEQ ID NO: 6728 | Nga01806 | 533.33 | 546.28 | protein |
| SEQ ID NO: 6729 | Nga04563 | 144.74 | 204.29 | protein |
| SEQ ID NO: 6730 | Nga04562 | 861.68 | 787.25 | ---NA--- |
| SEQ ID NO: 6731 | Nga04561 | 1605.70 | 1807.34 | hypothetical protein PHATRDRAFT_50624 [Phaeodactylum tricornutum CCAP 1055/1] |
| SEQ ID NO: 6732 | Nga04620 | 7112.40 | 10995.86 | ---NA--- |
| SEQ ID NO: 6733 | Nga04619 | 1618.76 | 1415.91 | enzyme of the cupin superfamily |
| SEQ ID NO: 6734 | Nga04621 | 622.93 | 593.09 | conserved unknown protein [Ectocarpus siliculosus] |
| SEQ ID NO: 6735 | Nga01795.1 | 993.21 | 1478.37 | protein |
| SEQ ID NO: 6736 | Nga21295 | 196.97 | 283.12 | ---NA--- |
| SEQ ID NO: 6737 | Nga01796 | 315.86 | 377.09 | l-serine ammonia-lyase |
| SEQ ID NO: 6738 | Nga20585 | 86.96 | 126.57 | protein |
| SEQ ID NO: 6739 | Nga04216 | 1101.55 | 1037.40 | ---NA--- |
| SEQ ID NO: 6740 | Nga04214 | 871.29 | 754.33 | trafficking protein particle complex 1 |
| SEQ ID NO: 6741 | Nga04215 | 772.77 | 785.90 | scavenger receptor class member 2 |
| SEQ ID NO: 6742 | Nga03748 | 339.25 | 320.48 | hypothetical protein CPC735_031960 [Coccidioides posadasii C735 delta SOWgp] |
| SEQ ID NO: 6743 | Nga03746 | 390.69 | 460.49 | patsas cg6618-pa |
| SEQ ID NO: 6744 | Nga03745 | 889.58 | 883.51 | heat shock protein |
| SEQ ID NO: 6745 | Nga03744 | 823.17 | 819.76 | udp-glucose pyrophosphorylase 2 |
| SEQ ID NO: 6746 | Nga03743 | 1469.72 | 1552.70 | cytochrome p450 |
| SEQ ID NO: 6747 | Nga03747 | 1753.83 | 1434.10 | ---NA--- |
| SEQ ID NO: 6748 | Nga03749 | 1667.88 | 1665.70 | c21orf57 isoform a protein |
| SEQ ID NO: 6749 | Nga20329 | 864.25 | 738.90 | scavenger receptor class member 2 |
| SEQ ID NO: 6750 | Nga03864 | 904.28 | 853.57 | ubiquitin-activating enzyme e1 |
| SEQ ID NO: 6751 | Nga03866 | 784.23 | 693.69 | ubiquitin activating enzyme |
| SEQ ID NO: 6752 | Nga03862 | 228.31 | 281.63 | cre-let-765 protein |
| SEQ ID NO: 6753 | Nga04754.2 | 1061.60 | 769.23 | protein |
| SEQ ID NO: 6754 | Nga04691 | 1391.49 | 1525.75 | 2-isopropylmalate synthase |
| SEQ ID NO: 6755 | Nga04690 | 500.98 | 510.94 | thioesterase superfamily member 2 |
| SEQ ID NO: 6756 | Nga04689 | 270.92 | 330.35 | alpha beta-hydrolase domain-containing protein |
| SEQ ID NO: 6757 | Nga04512 | 515.25 | 582.13 | beta-ketoacyl-coa synthase family protein |
| SEQ ID NO: 6758 | Nga21146 | 733.80 | 703.82 | protein containing a histone methylation dot1 motif |
| SEQ ID NO: 6759 | Nga04513.1 | 287.48 | 265.55 | tata-binding protein-associated-factor |

FIGURE 24 DC

| # | Nga model | +N rpkb | -N rpkb | GO |
|---|---|---|---|---|
| SEQ ID NO: 6760 | Nga02205 | 26.40 | 44.69 | heat repeat-containing protein 1 |
| SEQ ID NO: 6761 | Nga04431.2 | 381.55 | 374.70 | upf0598 protein c8orf82 homolog |
| SEQ ID NO: 6762 | Nga02203.01 | 2106.76 | 1790.83 | protein |
| SEQ ID NO: 6763 | Nga06339 | 1009.98 | 970.80 | ribosomal protein s15 |
| SEQ ID NO: 6764 | Nga06340 | 1070.96 | 922.39 | inorganic pyrophosphatase |
| SEQ ID NO: 6765 | Nga06341 | 352.49 | 284.99 | gscfa family protein |
| SEQ ID NO: 6766 | Nga06338 | 433.23 | 391.08 | protein |
| SEQ ID NO: 6767 | Nga06342 | 1996.83 | 2145.83 | ---NA--- |
| SEQ ID NO: 6768 | Nga01694.2 | 1476.45 | 1599.95 | g-rich sequence factor 1 |
| SEQ ID NO: 6769 | Nga05530 | 1671.26 | 2120.48 | cystathionine beta-synthase |
| SEQ ID NO: 6770 | Nga05535 | 238.19 | 218.75 | ---NA--- |
| SEQ ID NO: 6771 | Nga05533 | 841.87 | 932.27 | atlastin-like protein |
| SEQ ID NO: 6772 | Nga05528 | 1259.17 | 1061.78 | beta--endoglucanase |
| SEQ ID NO: 6773 | Nga20021 | 327.92 | 237.75 | o-succinylbenzoic acid synthetase |
| SEQ ID NO: 6774 | Nga20489 | 180.72 | 145.43 | 2-succinyl-6-hydroxy--cyclohexadiene-1-carboxylic acid synthase 2-oxoglutarate decarboxylase |
| SEQ ID NO: 6775 | Nga05531 | 7025.69 | 7907.54 | phosphoglycerate kinase |
| SEQ ID NO: 6776 | Nga20505 | 131.15 | 119.87 | ---NA--- |
| SEQ ID NO: 6777 | Nga20448 | 176.56 | 123.66 | 2-oxoglutarate decarboxylase hydro-lyase magnesium ion binding protein |
| SEQ ID NO: 6778 | Nga20232 | 99.33 | 139.51 | 2-succinyl-6-hydroxy--cyclohexadiene-1-carboxylic acid synthase 2-oxoglutarate decarboxylase |
| SEQ ID NO: 6779 | Nga05532 | 1137.97 | 1301.24 | transcription factor jmjc |
| SEQ ID NO: 6780 | Nga05534 | 5486.73 | 3721.82 | mesencephalic astrocyte-derived neurotrophic factor |
| SEQ ID NO: 6781 | Nga05536 | 306.83 | 249.14 | suppression of tumorigenicity 5 |
| SEQ ID NO: 6782 | Nga05529 | 337.96 | 401.69 | wd-40 repeat expressed |
| SEQ ID NO: 6783 | Nga02228.01 | 59.00 | 67.10 | protein unc-45 homolog a |
| SEQ ID NO: 6784 | Nga02078 | 10.29 | 11.14 | ---NA--- |
| SEQ ID NO: 6785 | Nga02077 | 6529.34 | 5202.50 | ---NA--- |
| SEQ ID NO: 6786 | Nga04614 | 174.04 | 207.70 | ---NA--- |
| SEQ ID NO: 6787 | Nga04615 | 329.60 | 262.31 | protein n-terminal glutamine amidohydrolase-like |
| SEQ ID NO: 6788 | Nga02858 | 1028.49 | 1001.99 | mitochondrial 3-hydroxyisobutyryl- hydrolase |
| SEQ ID NO: 6789 | Nga02866 | 818.99 | 703.08 | abc-1 domain protein |
| SEQ ID NO: 6790 | Nga02863 | 658.57 | 708.41 | aspartate kinase |
| SEQ ID NO: 6791 | Nga02861 | 727.76 | 688.49 | mgc152585 protein |
| SEQ ID NO: 6792 | Nga21164 | 621.69 | 491.59 | nad-dependent epimerase dehydratase |
| SEQ ID NO: 6793 | Nga02868 | 433.64 | 581.74 | protein |
| SEQ ID NO: 6794 | Nga02865 | 447.25 | 458.98 | polyprenyl synthetase |
| SEQ ID NO: 6795 | Nga02869 | 278.10 | 264.10 | ---NA--- |
| SEQ ID NO: 6796 | Nga02859 | 396.80 | 352.73 | ---NA--- |
| SEQ ID NO: 6797 | Nga02867 | 236.92 | 207.26 | mono-or diacylglycerol acyltransferase type 2 |
| SEQ ID NO: 6798 | Nga21132 | 155.89 | 146.22 | ---NA--- |
| SEQ ID NO: 6799 | Nga02864 | 5533.77 | 5630.93 | expressed unknown protein [Ectocarpus siliculosus] |
| SEQ ID NO: 6800 | Nga02860 | 1766.74 | 1475.12 | calmodulin binding |
| SEQ ID NO: 6801 | Nga02862 | 505.85 | 367.41 | predicted protein [Phaeodactylum tricornutum CCAP 1055/1] |
| SEQ ID NO: 6802 | Nga04243 | 552.99 | 563.60 | alpha beta hydrolase fold family |
| SEQ ID NO: 6803 | Nga04681 | 1918.44 | 1813.07 | ---NA--- |
| SEQ ID NO: 6804 | Nga04680 | 146.72 | 216.80 | ---NA--- |
| SEQ ID NO: 6805 | Nga21201.1 | 166.05 | 243.83 | ---NA--- |
| SEQ ID NO: 6806 | Nga20801.1 | 228.97 | 195.72 | pseudouridylate synthase 10 |
| SEQ ID NO: 6807 | Nga20834 | 2049.22 | 1340.01 | glycosyl transferase |
| SEQ ID NO: 6808 | Nga04076 | 1616.28 | 1728.24 | protein |
| SEQ ID NO: 6809 | Nga04078 | 300.00 | 286.28 | ---NA--- |
| SEQ ID NO: 6810 | Nga04077 | 2015.94 | 2421.91 | protein |
| SEQ ID NO: 6811 | Nga20146 | 717.64 | 725.54 | ---NA--- |
| SEQ ID NO: 6812 | Nga04121 | 226.97 | 243.80 | u6 snrna-associated sm-like protein lsm1 |
| SEQ ID NO: 6813 | Nga04119 | 1138.91 | 1101.42 | ring zinc finger-containing protein |
| SEQ ID NO: 6814 | Nga04122 | 196.81 | 197.31 | myosin-like protein |
| SEQ ID NO: 6815 | Nga04120 | 1022.57 | 809.37 | uroporphyrinogen decarboxylase |
| SEQ ID NO: 6816 | Nga20311 | 631.69 | 886.07 | homocysteine s-methyltransferase |
| SEQ ID NO: 6817 | Nga20815 | 594.96 | 457.80 | protein |
| SEQ ID NO: 6818 | Nga01945 | 45.75 | 58.06 | protein |
| SEQ ID NO: 6819 | Nga01946 | 357.27 | 391.00 | ---NA--- |
| SEQ ID NO: 6820 | Nga01944.1 | 114.12 | 138.29 | hect domain and rld 4 |

FIGURE 24 DD

| # | Nga model | +N rpkb | -N rpkb | GO |
|---|---|---|---|---|
| SEQ ID NO: 6821 | Nga01943.01 | 2224.59 | 2333.20 | bromodomain containing protein |
| SEQ ID NO: 6822 | Nga02012 | 1010.86 | 1142.80 | pheophorbide a oxygenase |
| SEQ ID NO: 6823 | Nga20925 | 4983.37 | 4587.03 | pyruvate kinase |
| SEQ ID NO: 6824 | Nga02011 | 439.11 | 618.38 | phosphoinositol transporter |
| SEQ ID NO: 6825 | Nga20982.1 | 177.24 | 154.07 | ---NA--- |
| SEQ ID NO: 6826 | Nga02013.01 | 121.38 | 210.93 | transducin -like 3 |
| SEQ ID NO: 6827 | Nga04940 | 46.80 | 46.99 | ---NA--- |
| SEQ ID NO: 6828 | Nga04939 | 630.43 | 562.55 | atp-dependent bile acid permease |
| SEQ ID NO: 6829 | Nga03590 | 336.31 | 251.47 | rad51-like 3 ( cerevisiae) |
| SEQ ID NO: 6830 | Nga06452 | 880.27 | 1048.81 | hypothetical protein Cpap_3608 [Clostridium papyrosolvens DSM 2782] |
| SEQ ID NO: 6831 | Nga04283.1 | 960.65 | 930.38 | protein |
| SEQ ID NO: 6832 | Nga00948 | 374.38 | 379.94 | cre-duo-3 protein |
| SEQ ID NO: 6833 | Nga00947 | 1311.11 | 1010.22 | phosphate transporter |
| SEQ ID NO: 6834 | Nga00949 | 776.00 | 515.62 | ---NA--- |
| SEQ ID NO: 6835 | Nga04919.2 | 1002.75 | 818.38 | protein nef1 |
| SEQ ID NO: 6836 | Nga02241 | 686.04 | 641.07 | autoinhibited calcium atpase |
| SEQ ID NO: 6837 | Nga01637.01 | 752.43 | 562.65 | meiotic nuclear division protein 1 homolog |
| SEQ ID NO: 6838 | Nga01638 | 263.16 | 215.38 | ---NA--- |
| SEQ ID NO: 6839 | Nga02047 | 359.89 | 449.36 | udp-n-acetylglucosamine pyrophosphorylase |
| SEQ ID NO: 6840 | Nga21300.1 | 473.47 | 530.56 | udp-n-acetylglucosamine pyrophosphorylase |
| SEQ ID NO: 6841 | Nga20745.1 | 496.50 | 545.40 | ---NA--- |
| SEQ ID NO: 6842 | Nga20221.1 | 202.55 | 164.21 | protein |
| SEQ ID NO: 6843 | Nga20167 | 187.24 | 260.26 | protein |
| SEQ ID NO: 6844 | Nga20020 | 1493.06 | 1436.79 | protein |
| SEQ ID NO: 6845 | Nga04992.01 | 200.00 | 256.04 | ---NA--- |
| SEQ ID NO: 6846 | Nga04991.1 | 177.95 | 180.89 | beta-catenin-like protein 1 |
| SEQ ID NO: 6847 | Nga01875 | 137.35 | 148.79 | dna mismatch repair protein |
| SEQ ID NO: 6848 | Nga01876 | 533.58 | 586.08 | conserved hypothetical protein [Neospora caninum Liverpool] |
| SEQ ID NO: 6849 | Nga02063 | 702.94 | 815.55 | 3-mercaptopyruvate sulfurtransferase |
| SEQ ID NO: 6850 | Nga21234 | 575.76 | 587.57 | ---NA--- |
| SEQ ID NO: 6851 | Nga02065 | 658.95 | 588.37 | conserved unknown protein [Ectocarpus siliculosus] |
| SEQ ID NO: 6852 | Nga02064 | 192.74 | 201.29 | regulator of chromosome condensation rcc1 |
| SEQ ID NO: 6853 | Nga20682 | 136.65 | 168.20 | ---NA--- |
| SEQ ID NO: 6854 | Nga05392 | 155.04 | 218.33 | ---NA--- |
| SEQ ID NO: 6855 | Nga05391 | 386.76 | 337.71 | ---NA--- |
| SEQ ID NO: 6856 | Nga05390 | 111.11 | 112.34 | ---NA--- |
| SEQ ID NO: 6857 | Nga00866 | 54.47 | 71.65 | ---NA--- |
| SEQ ID NO: 6858 | Nga00863.01 | 442.76 | 488.39 | deoxyhypusine hydroxylase monooxygenase |
| SEQ ID NO: 6859 | Nga00865.01 | 668.39 | 480.81 | expressed unknown protein [Ectocarpus siliculosus] |
| SEQ ID NO: 6860 | Nga00864.01 | 471.93 | 552.11 | ---NA--- |
| SEQ ID NO: 6861 | Nga00867 | 629.20 | 714.38 | telomerase activating protein est1 |
| SEQ ID NO: 6862 | Nga00868 | 1186.38 | 1207.48 | ---NA--- |
| SEQ ID NO: 6863 | Nga20079 | 318.18 | 388.14 | pre-mrna-splicing factor atp-dependent rna helicase prp16 |
| SEQ ID NO: 6864 | Nga01911 | 790.67 | 862.10 | u2 snrnp auxiliary small subunit |
| SEQ ID NO: 6865 | Nga01913 | 876.79 | 1138.85 | gelsolin precursor |
| SEQ ID NO: 6866 | Nga01912 | 423.12 | 409.97 | atp-binding sub-family c (cftr mrp) member partial |
| SEQ ID NO: 6867 | Nga01915 | 170.21 | 181.31 | atp-binding cassette protein c4-like |
| SEQ ID NO: 6868 | Nga01914 | 742.14 | 651.76 | protein |
| SEQ ID NO: 6869 | Nga03668 | 480.94 | 348.95 | mitochondrial substrate carrier family protein |
| SEQ ID NO: 6870 | Nga03667 | 553.96 | 243.53 | glutathione s-transferase |
| SEQ ID NO: 6871 | Nga20141 | 187.12 | 147.85 | tesmin tso1-like cxc domain-containing protein |
| SEQ ID NO: 6872 | Nga21134 | 209.55 | 281.58 | d111 g-patch domain-containing protein |
| SEQ ID NO: 6873 | Nga03549 | 448.95 | 519.39 | peptidylprolyl isomerase domain and wd repeat-containing protein 1 |
| SEQ ID NO: 6874 | Nga00996.2 | 483.73 | 464.08 | ---NA--- |
| SEQ ID NO: 6875 | Nga00996.1 | 483.73 | 464.08 | ---NA--- |
| SEQ ID NO: 6876 | Nga00997 | 346.72 | 388.12 | ethanolamine-phosphate cytidylyltransferase |
| SEQ ID NO: 6877 | Nga00995 | 301.39 | 241.52 | atp-binding cassette transporter |
| SEQ ID NO: 6878 | Nga20824 | 767.93 | 711.80 | 50s ribosomal protein l20 |
| SEQ ID NO: 6879 | Nga20601 | 374.60 | 130.68 | wd40 repeat-containing protein |
| SEQ ID NO: 6880 | Nga21023 | 169.81 | 143.07 | transducin wd domain-containing protein |
| SEQ ID NO: 6881 | Nga20903 | 242.99 | 172.10 | wd repeat protein pop3 |
| SEQ ID NO: 6882 | Nga20005 | 253.97 | 146.15 | likely wd40 component of tor1 and tor2 kinase complexes |
| SEQ ID NO: 6883 | Nga04245 | 173.61 | 173.02 | rrna-processing protein efg1 |
| SEQ ID NO: 6884 | Nga04628 | 946.08 | 899.66 | aspartyl-trna synthetase |

FIGURE 24 DE

| # | Nga model | +N rpkb | -N rpkb | GO |
|---|---|---|---|---|
| SEQ ID NO: 6885 | Nga04627 | 4467.55 | 3317.63 | iron-sulfur cluster assembly accessory protein |
| SEQ ID NO: 6886 | Nga01966 | 89.55 | 97.01 | ---NA--- |
| SEQ ID NO: 6887 | Nga04812 | 189.49 | 243.88 | et-dependent rrna methyltransferase spb1 |
| SEQ ID NO: 6888 | Nga04811 | 285.46 | 307.30 | choline ethanolamine kinase |
| SEQ ID NO: 6889 | Nga01864 | 655.67 | 613.88 | si:ch211- protein |
| SEQ ID NO: 6890 | Nga21183 | 655.46 | 568.93 | allantoicase |
| SEQ ID NO: 6891 | Nga21254 | 612.83 | 747.72 | allantoicase |
| SEQ ID NO: 6892 | Nga06579 | 163.96 | 130.77 | ubiquinone biosynthesis o-methyltransferase |
| SEQ ID NO: 6893 | Nga06580 | 437.92 | 449.92 | 3-demethylubiquinone-9 3-methyltransferase |
| SEQ ID NO: 6894 | Nga02403.01 | 9336.99 | 8769.55 | atp synthase subunit 5 |
| SEQ ID NO: 6895 | Nga02402 | 714.84 | 776.02 | conserved unknown protein [Ectocarpus siliculosus] |
| SEQ ID NO: 6896 | Nga02400 | 1060.31 | 965.26 | nmra-like family domain-containing protein 1-like |
| SEQ ID NO: 6897 | Nga02401 | 1437.99 | 1413.65 | protein phosphatase inhibitor |
| SEQ ID NO: 6898 | Nga04882 | 294.76 | 174.34 | protein |
| SEQ ID NO: 6899 | Nga04881 | 1811.64 | 2020.86 | 40s ribosomal protein s0 |
| SEQ ID NO: 6900 | Nga04414 | 206.06 | 196.95 | multidrug resistance-associated protein 4 |
| SEQ ID NO: 6901 | Nga04413 | 364.89 | 499.55 | multidrug resistance-associated protein |
| SEQ ID NO: 6902 | Nga04415 | 1576.27 | 1664.63 | multidrug resistance protein 1 (atp-binding cassette c1) |
| SEQ ID NO: 6903 | Nga06550 | 1993.72 | 2009.08 | protein |
| SEQ ID NO: 6904 | Nga06552 | 306.02 | 290.73 | protein |
| SEQ ID NO: 6905 | Nga06557 | 3885.71 | 3511.37 | ---NA--- |
| SEQ ID NO: 6906 | Nga06554 | 517.69 | 536.57 | ---NA--- |
| SEQ ID NO: 6907 | Nga05630.02 | 2018.06 | 2342.56 | apolipoprotein a-i-binding protein precursor |
| SEQ ID NO: 6908 | Nga06553 | 1701.12 | 1631.95 | ---NA--- |
| SEQ ID NO: 6909 | Nga21236 | 118.11 | 174.85 | signal transduction protein |
| SEQ ID NO: 6910 | Nga20280 | 193.62 | 197.40 | ---NA--- |
| SEQ ID NO: 6911 | Nga06551 | 2391.79 | 2542.64 | very long-chain acyl- synthetase isoform 1 |
| SEQ ID NO: 6912 | Nga06556 | 380.39 | 319.77 | sodium hydrogen exchanger |
| SEQ ID NO: 6913 | Nga01695 | 247.23 | 193.99 | ---NA--- |
| SEQ ID NO: 6914 | Nga01696 | 231.23 | 418.55 | mitogen-activated protein kinase kinase 2 |
| SEQ ID NO: 6915 | Nga01697 | 392.23 | 440.18 | hypothetical protein Esi_0538_0008 [Ectocarpus siliculosus] |
| SEQ ID NO: 6916 | Nga02096 | 293.14 | 234.28 | mitochondrial substrate carrier family protein |
| SEQ ID NO: 6917 | Nga02097 | 311.21 | 401.56 | ---NA--- |
| SEQ ID NO: 6918 | Nga05030 | 45.27 | 15.60 | ---NA--- |
| SEQ ID NO: 6919 | Nga05029 | 2119.12 | 2010.26 | hypothetical protein AURANDRAFT_60840 [Aureococcus anophagefferens] |
| SEQ ID NO: 6920 | Nga05699 | 112.61 | 146.38 | ---NA--- |
| SEQ ID NO: 6921 | Nga05695 | 518.38 | 567.50 | 17-beta-hydroxysteroid dehydrogenase type 6 |
| SEQ ID NO: 6922 | Nga05697 | 9107.71 | 3410.01 | light-harvesting protein |
| SEQ ID NO: 6923 | Nga05700 | 5207.57 | 4328.69 | AlNc14C52G4064 [Albugo laibachii Nc14] |
| SEQ ID NO: 6924 | Nga05698 | 189.63 | 247.14 | ---NA--- |
| SEQ ID NO: 6925 | Nga05694 | 1168.80 | 977.96 | protein |
| SEQ ID NO: 6926 | Nga05696 | 149.85 | 99.38 | dna cross-link repair protein snm1 |
| SEQ ID NO: 6927 | Nga05701 | 449.45 | 513.86 | ---NA--- |
| SEQ ID NO: 6928 | Nga03583 | 1066.84 | 1062.55 | gamma-tocopherol methyltransferase |
| SEQ ID NO: 6929 | Nga03581 | 17735.50 | 10534.34 | light harvesting complex protein |
| SEQ ID NO: 6930 | Nga00601.02 | 1153.05 | 973.71 | protein |
| SEQ ID NO: 6931 | Nga21227.1 | 293.56 | 255.08 | hexose-6-phosphate dehydrogenase (glucose 1-dehydrogenase) |
| SEQ ID NO: 6932 | Nga00617.02 | 240.08 | 208.48 | hexose-6-phosphate dehydrogenase (glucose 1-dehydrogenase) |
| SEQ ID NO: 6933 | Nga20007.1 | 373.20 | 415.19 | butyrylcholinesterase precursor |
| SEQ ID NO: 6934 | Nga02226.2 | 439.06 | 526.56 | far upstream binding protein |
| SEQ ID NO: 6935 | Nga21082 | 154.41 | 103.54 | rna helicase like protein |
| SEQ ID NO: 6936 | Nga06084 | 299.08 | 265.46 | ---NA--- |
| SEQ ID NO: 6937 | Nga06085.1 | 358.28 | 384.12 | ---NA--- |
| SEQ ID NO: 6938 | Nga02885.02 | 3260.95 | 3187.80 | small conserved protein |
| SEQ ID NO: 6939 | Nga06088.1 | 397.20 | 587.17 | glycerophosphoryl diester phosphodiesterase |
| SEQ ID NO: 6940 | Nga20442 | 220.62 | 171.45 | ---NA--- |
| SEQ ID NO: 6941 | Nga02227.02 | 599.18 | 542.06 | gluconolactonase |
| SEQ ID NO: 6942 | Nga07222 | 1234.02 | 1415.31 | protein |
| SEQ ID NO: 6943 | Nga02380 | 1231.35 | 1267.32 | major facilitator family transporter |
| SEQ ID NO: 6944 | Nga02381 | 3060.78 | 3375.23 | uncharacterized membrane permease |
| SEQ ID NO: 6945 | Nga04824 | 536.15 | 379.80 | expressed unknown protein [Ectocarpus siliculosus] |
| SEQ ID NO: 6946 | Nga04823 | 2258.29 | 1301.12 | rubredoxin-type fe 4 protein |
| SEQ ID NO: 6947 | Nga04825 | 630.24 | 530.76 | peptide methionine sulfoxide reductase |

FIGURE 24 DF

| # | Nga model | +N rpkb | -N rpkb | GO |
|---|---|---|---|---|
| SEQ ID NO: 6948 | Nga04578 | 279.91 | 305.91 | vacuolar protein sorting-associated protein 33-like protein |
| SEQ ID NO: 6949 | Nga04579 | 1266.41 | 1509.96 | magnesium transporter |
| SEQ ID NO: 6950 | Nga05047 | 98.81 | 166.98 | ---NA--- |
| SEQ ID NO: 6951 | Nga04841 | 361.26 | 407.83 | nucleolar protein 10 |
| SEQ ID NO: 6952 | Nga04842.01 | 173.78 | 173.92 | sulfate transporter |
| SEQ ID NO: 6953 | Nga01971.02 | 447.28 | 422.22 | nucleolar basal body binding protein bn46 S1 large subunit |
| SEQ ID NO: 6954 | Nga04900 | 133.33 | 154.59 | tubulin-specific chaperone d |
| SEQ ID NO: 6955 | Nga20914 | 108.70 | 102.04 | cobalamin 5 -phosphate synthase |
| SEQ ID NO: 6956 | Nga04898 | 309.76 | 296.34 | ---NA--- |
| SEQ ID NO: 6957 | Nga04962 | 148.58 | 80.48 | ---NA--- |
| SEQ ID NO: 6958 | Nga04359 | 656.88 | 664.52 | gtp-binding protein |
| SEQ ID NO: 6959 | Nga04360 | 9749.41 | 4888.64 | ---NA--- |
| SEQ ID NO: 6960 | Nga01675.02 | 238.79 | 327.29 | ---NA--- |
| SEQ ID NO: 6961 | Nga01962 | 51.28 | 66.66 | ---NA--- |
| SEQ ID NO: 6962 | Nga04911 | 291.73 | 345.17 | heavy metal p-type atpase |
| SEQ ID NO: 6963 | Nga04912 | 751.14 | 682.74 | heavy metal p-type atpase |
| SEQ ID NO: 6964 | Nga04507 | 440.82 | 474.52 | nucleoporin 205 |
| SEQ ID NO: 6965 | Nga04298 | 80.42 | 107.31 | protein |
| SEQ ID NO: 6966 | Nga00258.02 | 3.62 | 27.47 | ---NA--- |
| SEQ ID NO: 6967 | Nga20837 | 327.78 | 470.00 | major facilitator superfamily |
| SEQ ID NO: 6968 | Nga06426 | 785.69 | 829.60 | cockayne syndrome 1 |
| SEQ ID NO: 6969 | Nga06427 | 811.28 | 781.89 | calcium ion binding |
| SEQ ID NO: 6970 | Nga06425 | 423.31 | 474.02 | membrane protein |
| SEQ ID NO: 6971 | Nga06430 | 270.68 | 305.79 | loc495097 protein |
| SEQ ID NO: 6972 | Nga06428 | 3233.10 | 4170.07 | 2-oxoglutarate e1 component |
| SEQ ID NO: 6973 | Nga06429 | 297.36 | 285.84 | hypothetical protein [Monosiga brevicollis MX1] |
| SEQ ID NO: 6974 | Nga03516 | 186.05 | 162.35 | cop9 complex homolog subunit 3 |
| SEQ ID NO: 6975 | Nga03514 | 527.21 | 617.76 | protein |
| SEQ ID NO: 6976 | Nga03515 | 421.50 | 495.40 | ---NA--- |
| SEQ ID NO: 6977 | Nga02389 | 157.56 | 219.43 | ---NA--- |
| SEQ ID NO: 6978 | Nga04450 | 44.19 | 70.92 | ---NA--- |
| SEQ ID NO: 6979 | Nga21296 | 234.15 | 235.14 | srr1-like protein |
| SEQ ID NO: 6980 | Nga04449 | 910.11 | 1073.44 | scavenger receptor class member 2 |
| SEQ ID NO: 6981 | Nga06962 | 12705.60 | 13728.87 | ---NA--- |
| SEQ ID NO: 6982 | Nga06963 | 79.71 | 94.19 | ---NA--- |
| SEQ ID NO: 6983 | Nga06514 | 1606.74 | 1374.79 | cathepsin b |
| SEQ ID NO: 6984 | Nga20931 | 5968.00 | 7265.56 | transcript antisense to ribosomal rna protein |
| SEQ ID NO: 6985 | Nga06516 | 872.31 | 803.29 | ppgpp synthetase |
| SEQ ID NO: 6986 | Nga06515 | 1156.69 | 1156.37 | thioredoxin family trp26-like protein |
| SEQ ID NO: 6987 | Nga06517 | 1009.05 | 1019.04 | dead h (asp-glu-ala-asp his) box polypeptide 11 |
| SEQ ID NO: 6988 | Nga06518 | 525.53 | 627.82 | conserved hypothetical protein [Phytophthora infestans T30-4] |
| SEQ ID NO: 6989 | Nga02209.02 | 545.86 | 533.98 | mfs monosaccharide |
| SEQ ID NO: 6990 | Nga02311 | 521.34 | 781.19 | rna polymerase i-specific transcription initiation factor |
| SEQ ID NO: 6991 | Nga20395 | 168.94 | 259.74 | ---NA--- |
| SEQ ID NO: 6992 | Nga02310 | 329.41 | 327.52 | ---NA--- |
| SEQ ID NO: 6993 | Nga05664 | 276.04 | 406.21 | ---NA--- |
| SEQ ID NO: 6994 | Nga04608.02 | 2033.00 | 1573.72 | protein |
| SEQ ID NO: 6995 | Nga05661.01 | 362.80 | 297.24 | bacteriocin o-metyltransferase |
| SEQ ID NO: 6996 | Nga05661.02 | 362.80 | 297.24 | bacteriocin o-metyltransferase |
| SEQ ID NO: 6997 | Nga05663 | 169.47 | 230.99 | ---NA--- |
| SEQ ID NO: 6998 | Nga05660 | 337.37 | 413.49 | ---NA--- |
| SEQ ID NO: 6999 | Nga20547 | 129.87 | 344.67 | 3 -5 exoribonuclease rna-binding protein |
| SEQ ID NO: 7000 | Nga04609.2 | 635.63 | 716.60 | ---NA--- |
| SEQ ID NO: 7001 | Nga07059 | 278.96 | 333.73 | ---NA--- |
| SEQ ID NO: 7002 | Nga05487 | 268.75 | 294.50 | ---NA--- |
| SEQ ID NO: 7003 | Nga21091 | 1034.18 | 978.61 | family protein |
| SEQ ID NO: 7004 | Nga21058 | 245.33 | 250.56 | ---NA--- |
| SEQ ID NO: 7005 | Nga05484 | 562.07 | 453.95 | fanconi complementation group i |
| SEQ ID NO: 7006 | Nga05485 | 433.90 | 471.93 | had-superfamily hydrolase |
| SEQ ID NO: 7007 | Nga05482 | 256.19 | 214.44 | ---NA--- |
| SEQ ID NO: 7008 | Nga05488 | 177.30 | 176.70 | ---NA--- |
| SEQ ID NO: 7009 | Nga05483 | 147.37 | 184.07 | lysine-specific histone demethylase |
| SEQ ID NO: 7010 | Nga05486 | 646.99 | 407.47 | ---NA--- |
| SEQ ID NO: 7011 | Nga03878 | 129.30 | 129.78 | dna polymerase lambda |

FIGURE 24 DG

| # | Nga model | +N rpkb | -N rpkb | GO |
|---|---|---|---|---|
| SEQ ID NO: 7012 | Nga03877 | 615.48 | 487.80 | n -adenine-specific dna methyltransferase 1 |
| SEQ ID NO: 7013 | Nga20548 | 84.59 | 114.54 | ---NA--- |
| SEQ ID NO: 7014 | Nga06018 | 58.25 | 105.17 | ---NA--- |
| SEQ ID NO: 7015 | Nga06015 | 412.22 | 340.62 | chromosome 1 open reading frame 58 |
| SEQ ID NO: 7016 | Nga06016 | 325.98 | 424.80 | dipeptidyl peptidase 3 |
| SEQ ID NO: 7017 | Nga21282 | 217.39 | 329.68 | ---NA--- |
| SEQ ID NO: 7018 | Nga20579 | 258.33 | 126.38 | ---NA--- |
| SEQ ID NO: 7019 | Nga21087 | 7714.75 | 4637.71 | cytochrome b5 |
| SEQ ID NO: 7020 | Nga06014 | 351.18 | 344.16 | abc transporter g family member 29 |
| SEQ ID NO: 7021 | Nga06013 | 695.23 | 672.93 | hus1 checkpoint homolog ( pombe) |
| SEQ ID NO: 7022 | Nga06017 | 251.98 | 386.87 | predicted protein [Micromonas sp. RCC299] |
| SEQ ID NO: 7023 | Nga20462 | 71.91 | 119.28 | gtp-binding protein |
| SEQ ID NO: 7024 | Nga03212 | 2282.33 | 2369.57 | mucin-associated surface protein |
| SEQ ID NO: 7025 | Nga03213 | 922.08 | 984.76 | ---NA--- |
| SEQ ID NO: 7026 | Nga21157 | 674.99 | 765.43 | translocator of the inner chloroplast envelope membrane 110k |
| SEQ ID NO: 7027 | Nga00974.2 | 69.99 | 107.07 | guanine deaminase |
| SEQ ID NO: 7028 | Nga06416 | 210.42 | 198.59 | tyrosyl-dna phosphodiesterase 1 |
| SEQ ID NO: 7029 | Nga06417 | 1223.71 | 1751.00 | protein mitochondrial-like |
| SEQ ID NO: 7030 | Nga06415 | 858.97 | 847.14 | likely ras family gtp binding protein |
| SEQ ID NO: 7031 | Nga06418 | 200.80 | 169.66 | ---NA--- |
| SEQ ID NO: 7032 | Nga07136 | 5173.87 | 4039.95 | ---NA--- |
| SEQ ID NO: 7033 | Nga07137 | 580.09 | 722.16 | ---NA--- |
| SEQ ID NO: 7034 | Nga01968 | 880.29 | 747.92 | protein |
| SEQ ID NO: 7035 | Nga21065 | 124.09 | 181.86 | ribonuclease z |
| SEQ ID NO: 7036 | Nga21273 | 98.04 | 70.80 | ---NA--- |
| SEQ ID NO: 7037 | Nga04473.2 | 1877.24 | 2195.83 | protein |
| SEQ ID NO: 7038 | Nga20257 | 365.30 | 336.35 | conserved unknown protein [Ectocarpus siliculosus] |
| SEQ ID NO: 7039 | Nga04475 | 222.22 | 180.54 | ---NA--- |
| SEQ ID NO: 7040 | Nga04473.1 | 1877.24 | 2195.83 | loc398558 protein |
| SEQ ID NO: 7041 | Nga20693 | 153.37 | 148.42 | ---NA--- |
| SEQ ID NO: 7042 | Nga03951 | 127.80 | 160.30 | adenylate kinase |
| SEQ ID NO: 7043 | Nga20433 | 182.02 | 153.36 | conserved unknown protein [Ectocarpus siliculosus] |
| SEQ ID NO: 7044 | Nga03950 | 7941.40 | 5499.01 | lactoylglutathione lyase |
| SEQ ID NO: 7045 | Nga01170 | 524.43 | 418.66 | 3-like protein |
| SEQ ID NO: 7046 | Nga01168.1 | 652.21 | 843.10 | ---NA--- |
| SEQ ID NO: 7047 | Nga01169 | 468.11 | 575.47 | atp-binding sub-family b (mdr tap) member 10 |
| SEQ ID NO: 7048 | Nga01171 | 721.94 | 620.55 | integral membrane mpv17 pmp22 |
| SEQ ID NO: 7049 | Nga01167 | 1733.14 | 1888.73 | protein |
| SEQ ID NO: 7050 | Nga20752 | 107.78 | 188.11 | ---NA--- |
| SEQ ID NO: 7051 | Nga02419 | 169.26 | 228.25 | ---NA--- |
| SEQ ID NO: 7052 | Nga20153 | 234.14 | 186.16 | novel protein containing 10 heat domains |
| SEQ ID NO: 7053 | Nga02418 | 844.89 | 693.88 | 26s proteasome non-atpase regulatory subunit 12 |
| SEQ ID NO: 7054 | Nga02417 | 520.87 | 544.13 | ---NA--- |
| SEQ ID NO: 7055 | Nga06797 | 213.00 | 195.23 | signal peptide peptidase |
| SEQ ID NO: 7056 | Nga01605 | 517.35 | 696.36 | redoxin domain protein |
| SEQ ID NO: 7057 | Nga01603.01 | 228.78 | 321.85 | ---NA--- |
| SEQ ID NO: 7058 | Nga01604 | 153.10 | 145.90 | protein |
| SEQ ID NO: 7059 | Nga01602 | 754.29 | 762.05 | udp-glucuronic acid decarboxylase 1 |
| SEQ ID NO: 7060 | Nga07219 | 170.09 | 223.82 | ---NA--- |
| SEQ ID NO: 7061 | Nga07108 | 85.93 | 124.79 | heavy metal p-type atpase |
| SEQ ID NO: 7062 | Nga01703 | 233.81 | 220.75 | ---NA--- |
| SEQ ID NO: 7063 | Nga01702 | 244.90 | 317.39 | multidrug-resistance like protein isoform q |
| SEQ ID NO: 7064 | Nga20039 | 1908.56 | 2043.96 | conserved unknown protein [Ectocarpus siliculosus] |
| SEQ ID NO: 7065 | Nga01943.02 | 2224.59 | 2333.29 | bromodomain containing protein |
| SEQ ID NO: 7066 | Nga01944.2 | 114.12 | 138.24 | e3 isg15--protein ligase herc5 |
| SEQ ID NO: 7067 | Nga02235 | 365.63 | 270.31 | beta- -mannosyl-glycoprotein beta- -n-acetylglucosaminyltransferase |
| SEQ ID NO: 7068 | Nga21185 | 71.43 | 85.97 | ---NA--- |
| SEQ ID NO: 7069 | Nga21118 | 729.01 | 867.13 | ---NA--- |
| SEQ ID NO: 7070 | Nga20570 | 64.00 | 112.66 | like gtpase |
| SEQ ID NO: 7071 | Nga20576 | 103.66 | 102.38 | ---NA--- |
| SEQ ID NO: 7072 | Nga20251 | 651.45 | 572.98 | expressed unknown protein [Ectocarpus siliculosus] |
| SEQ ID NO: 7073 | Nga06873 | 1116.61 | 1268.09 | ---NA--- |
| SEQ ID NO: 7074 | Nga05598 | 2599.66 | 3970.65 | ---NA--- |
| SEQ ID NO: 7075 | Nga05601 | 399.35 | 313.01 | expressed unknown protein [Ectocarpus siliculosus] |

FIGURE 24 DH

| # | Nga model | +N rpkb | -N rpkb | GO |
|---|---|---|---|---|
| SEQ ID NO: 7076 | Nga05602 | 100.84 | 109.23 | ---NA--- |
| SEQ ID NO: 7077 | Nga05600 | 1307.28 | 1071.76 | expressed unknown protein [Ectocarpus siliculosus] |
| SEQ ID NO: 7078 | Nga05599 | 238.10 | 336.90 | hydrolase involved in interstrand cross-link repair |
| SEQ ID NO: 7079 | Nga04925.2 | 535.09 | 530.83 | ubiquitin conjugation factor e4 b |
| SEQ ID NO: 7080 | Nga04925.1 | 535.09 | 530.83 | ubiquitin conjugation factor e4 |
| SEQ ID NO: 7081 | Nga02016 | 79.23 | 97.67 | conserved hypothetical protein |
| SEQ ID NO: 7082 | Nga02015 | 177.09 | 150.13 | conserved hypothetical protein |
| SEQ ID NO: 7083 | Nga20406 | 89.64 | 142.42 | chaperone protein |
| SEQ ID NO: 7084 | Nga03701 | 795.24 | 717.00 | ---NA--- |
| SEQ ID NO: 7085 | Nga03702 | 850.65 | 661.19 | ---NA--- |
| SEQ ID NO: 7086 | Nga03697 | 180.19 | 170.08 | ---NA--- |
| SEQ ID NO: 7087 | Nga20135 | 338.51 | 341.61 | protein |
| SEQ ID NO: 7088 | Nga20015 | 193.72 | 229.69 | conserved unknown protein [Ectocarpus siliculosus] |
| SEQ ID NO: 7089 | Nga03698 | 639.76 | 716.51 | nt5c3l-b protein |
| SEQ ID NO: 7090 | Nga03703 | 337.00 | 301.56 | ---NA--- |
| SEQ ID NO: 7091 | Nga03700.01 | 801.22 | 1132.92 | n-acetyltransferase esco2 |
| SEQ ID NO: 7092 | Nga03699.1 | 613.38 | 865.78 | protein |
| SEQ ID NO: 7093 | Nga20449 | 322.03 | 415.72 | tho complex subunit |
| SEQ ID NO: 7094 | Nga20533 | 185.11 | 294.24 | tho complex subunit |
| SEQ ID NO: 7095 | Nga04513.2 | 287.48 | 265.55 | protein |
| SEQ ID NO: 7096 | Nga01446 | 709.15 | 674.96 | carboxyvinyl-carboxyphosphonate phosphorylmutase |
| SEQ ID NO: 7097 | Nga01447 | 196.34 | 217.16 | origin recognition complex subunit 4 |
| SEQ ID NO: 7098 | Nga01445.1 | 3746.55 | 4432.15 | succinate dehydrogenase |
| SEQ ID NO: 7099 | Nga04259 | 849.84 | 869.21 | dna mismatch repair protein msh2 |
| SEQ ID NO: 7100 | Nga05986.02 | 458.72 | 510.52 | alanine-glyoxylate aminotransferase 2-like 2 |
| SEQ ID NO: 7101 | Nga06776 | 299.48 | 256.70 | predicted protein [Thalassiosira pseudonana CCMP1335] |
| SEQ ID NO: 7102 | Nga06770 | 1753.96 | 2272.14 | protein |
| SEQ ID NO: 7103 | Nga05984.02 | 206.52 | 263.87 | protein |
| SEQ ID NO: 7104 | Nga05981.02 | 2019.73 | 2874.37 | ---NA--- |
| SEQ ID NO: 7105 | Nga05985.02 | 469.14 | 493.32 | tyrosine phosphatase |
| SEQ ID NO: 7106 | Nga05982.02 | 456.31 | 493.09 | triacylglycerol lipase |
| SEQ ID NO: 7107 | Nga05987.02 | 489.49 | 465.27 | ---NA--- |
| SEQ ID NO: 7108 | Nga05983.02 | 3140.04 | 2439.95 | ---NA--- |
| SEQ ID NO: 7109 | Nga06831 | 170.21 | 220.23 | ---NA--- |
| SEQ ID NO: 7110 | Nga06830 | 587.45 | 621.86 | uncharacterized protein |
| SEQ ID NO: 7111 | Nga01896.01 | 626.27 | 569.16 | arrestin domain protein |
| SEQ ID NO: 7112 | Nga01895 | 2246.12 | 2294.52 | branched-chain amino acid aminotransferase |
| SEQ ID NO: 7113 | Nga01894 | 1804.58 | 1667.85 | ---NA--- |
| SEQ ID NO: 7114 | Nga01893 | 2895.95 | 3301.91 | purple acid phosphatase |
| SEQ ID NO: 7115 | Nga07022 | 36.36 | 29.54 | ---NA--- |
| SEQ ID NO: 7116 | Nga02280 | 1232.01 | 1142.09 | tubulin-specific chaperone a |
| SEQ ID NO: 7117 | Nga06282.2 | 1803.52 | 2360.24 | biotin and thiamin synthesis associated |
| SEQ ID NO: 7118 | Nga02282 | 560.73 | 674.67 | small gtp-binding protein |
| SEQ ID NO: 7119 | Nga04071 | 271.86 | 236.34 | rab family gtpase |
| SEQ ID NO: 7120 | Nga04070 | 284.55 | 237.78 | conserved unknown protein [Ectocarpus siliculosus] |
| SEQ ID NO: 7121 | Nga06943 | 211.59 | 210.37 | ---NA--- |
| SEQ ID NO: 7122 | Nga05519 | 28.17 | 45.77 | ---NA--- |
| SEQ ID NO: 7123 | Nga05514 | 1130.03 | 1170.43 | glycoprotein fp21 |
| SEQ ID NO: 7124 | Nga05517 | 151.16 | 201.53 | ---NA--- |
| SEQ ID NO: 7125 | Nga05515 | 290.03 | 261.64 | ---NA--- |
| SEQ ID NO: 7126 | Nga05516 | 85.53 | 135.40 | ---NA--- |
| SEQ ID NO: 7127 | Nga02794 | 259.78 | 186.59 | kynureninase |
| SEQ ID NO: 7128 | Nga02790 | 20617.45 | 8748.27 | light-harvesting protein |
| SEQ ID NO: 7129 | Nga20467 | 340.77 | 357.76 | conserved unknown protein [Ectocarpus siliculosus] |
| SEQ ID NO: 7130 | Nga02791 | 309.34 | 302.27 | pseudouridine synthase |
| SEQ ID NO: 7131 | Nga02788 | 515.71 | 489.67 | phosphatidylinositol-4-phosphate 5-kinase |
| SEQ ID NO: 7132 | Nga02784 | 1812.98 | 1963.89 | protein phosphatase 2c containing protein |
| SEQ ID NO: 7133 | Nga02795 | 1475.53 | 1277.28 | protein |
| SEQ ID NO: 7134 | Nga02787 | 3976.80 | 3817.79 | p11915 nonspecific lipid-transfer protein |
| SEQ ID NO: 7135 | Nga02796 | 414.65 | 387.24 | diacylglycerol kinase |
| SEQ ID NO: 7136 | Nga02785 | 9248.51 | 2577.52 | light-harvesting protein |
| SEQ ID NO: 7137 | Nga20088 | 1037.09 | 883.92 | membrane protein |
| SEQ ID NO: 7138 | Nga02786 | 288.81 | 181.49 | bifunctional atp-dependent dihydroxyacetone kinase fad-amp lyase |
| SEQ ID NO: 7139 | Nga02797 | 354.57 | 362.36 | cdk5 and abl1 enzyme substrate 1 |

FIGURE 24 DI

| # | Nga model | +N rpkb | -N rpkb | GO |
|---|---|---|---|---|
| SEQ ID NO: 7140 | Nga02793 | 634.56 | 691.51 | expressed unknown protein [Ectocarpus siliculosus] |
| SEQ ID NO: 7141 | Nga02792 | 607.36 | 500.43 | tpr domain protein |
| SEQ ID NO: 7142 | Nga02789 | 1334.02 | 1385.69 | dnl-type zinc finger |
| SEQ ID NO: 7143 | Nga20858 | 644.32 | 657.61 | gualynate kinase-1 |
| SEQ ID NO: 7144 | Nga07012 | 7.30 | 31.63 | ---NA--- |
| SEQ ID NO: 7145 | Nga01303 | 82.47 | 122.84 | ---NA--- |
| SEQ ID NO: 7146 | Nga01301 | 286.68 | 277.66 | ---NA--- |
| SEQ ID NO: 7147 | Nga01299 | 169.54 | 206.06 | mitochondrial ornithine transporter 1 |
| SEQ ID NO: 7148 | Nga01300 | 248.69 | 202.28 | 16s ribosomal rna methyltransferase |
| SEQ ID NO: 7149 | Nga01302 | 394.62 | 355.82 | ncs1 nucleoside transporter family |
| SEQ ID NO: 7150 | Nga01298 | 1199.20 | 854.44 | nonclathrin coat protein zeta2-cop |
| SEQ ID NO: 7151 | Nga20376 | 146.74 | 188.39 | wd repeat protein 23 |
| SEQ ID NO: 7152 | Nga05950 | 542.25 | 608.70 | cation transporting |
| SEQ ID NO: 7153 | Nga05948 | 1820.49 | 1745.30 | predicted protein [Phaeodactylum tricornutum CCAP 1055/1] |
| SEQ ID NO: 7154 | Nga05949 | 1847.31 | 1520.54 | dolichyl-diphosphooligosaccharide-protein glycosyltransferase |
| SEQ ID NO: 7155 | Nga05952 | 201.45 | 211.50 | protein fra10ac1 homolog |
| SEQ ID NO: 7156 | Nga05951 | 341.33 | 410.18 | wd repeat domain isoform cra_c |
| SEQ ID NO: 7157 | Nga02222 | 347.88 | 474.00 | ---NA--- |
| SEQ ID NO: 7158 | Nga02220 | 807.39 | 913.51 | rossmann fold nucleotide-binding protein |
| SEQ ID NO: 7159 | Nga02221 | 156.44 | 191.06 | cg12909 |
| SEQ ID NO: 7160 | Nga20363 | 502.41 | 460.77 | lipase domain protein |
| SEQ ID NO: 7161 | Nga05921 | 1513.67 | 1833.01 | phosphoenolpyruvate carboxylase |
| SEQ ID NO: 7162 | Nga05919 | 677.42 | 641.90 | na+ h+ antiporter |
| SEQ ID NO: 7163 | Nga05922 | 11070.34 | 7973.53 | ---NA--- |
| SEQ ID NO: 7164 | Nga05923 | 451.17 | 441.86 | tudor-sn protein 1 |
| SEQ ID NO: 7165 | Nga05920 | 143.16 | 146.85 | dna mismatch repair protein msh6 |
| SEQ ID NO: 7166 | Nga03995 | 168.99 | 131.37 | ---NA--- |
| SEQ ID NO: 7167 | Nga03994 | 87.43 | 130.22 | ykl027w-like protein |
| SEQ ID NO: 7168 | Nga02211 | 258.93 | 220.52 | ---NA--- |
| SEQ ID NO: 7169 | Nga02210 | 1124.08 | 1303.79 | svop protein |
| SEQ ID NO: 7170 | Nga07158 | 3047.39 | 2388.50 | ---NA--- |
| SEQ ID NO: 7171 | Nga05256 | 4535.67 | 4791.75 | iojap-like protein |
| SEQ ID NO: 7172 | Nga05254 | 713.59 | 545.12 | vesicle transport protein |
| SEQ ID NO: 7173 | Nga05257 | 64.33 | 6.33 | ---NA--- |
| SEQ ID NO: 7174 | Nga05255 | 7482.23 | 4448.41 | phosphoglycerate kinase |
| SEQ ID NO: 7175 | Nga05253 | 6250.79 | 6086.80 | protein |
| SEQ ID NO: 7176 | Nga07270 | 704.18 | 588.11 | conserved unknown protein [Ectocarpus siliculosus] |
| SEQ ID NO: 7177 | Nga04834 | 351.94 | 345.96 | conserved hypothetical protein [Albugo laibachii Nc14] |
| SEQ ID NO: 7178 | Nga06921 | 1516.57 | 1304.08 | d-lactate dehydrogenase |
| SEQ ID NO: 7179 | Nga04483 | 290.13 | 254.62 | ---NA--- |
| SEQ ID NO: 7180 | Nga00857 | 6687.00 | 5909.04 | ---NA--- |
| SEQ ID NO: 7181 | Nga00859 | 622.81 | 516.28 | 26s proteasome non-atpase regulatory subunit |
| SEQ ID NO: 7182 | Nga00858 | 281.84 | 251.54 | rna-binding s4 |
| SEQ ID NO: 7183 | Nga00856 | 568.15 | 295.81 | ankyrin unc44 |
| SEQ ID NO: 7184 | Nga00855 | 996.32 | 1041.02 | chain structure of aminoadipate-semialdehyde dehydrogenase- phosphopantetheinyl transferase |
| SEQ ID NO: 7185 | Nga07267 | 1123.31 | 1059.75 | protein |
| SEQ ID NO: 7186 | Nga07314 | 372.70 | 361.08 | wd domain-containing |
| SEQ ID NO: 7187 | Nga06978 | 200.00 | 225.67 | ---NA--- |
| SEQ ID NO: 7188 | Nga06971 | 5321.50 | 4753.78 | cupin 2 barrel domain-containing protein |
| SEQ ID NO: 7189 | Nga21072 | 20.27 | 14.64 | snare associated golgi protein |
| SEQ ID NO: 7190 | Nga06523 | 6838.79 | 7207.12 | ribosomal protein srp1 |
| SEQ ID NO: 7191 | Nga06524 | 213.42 | 262.17 | la-related protein 4b |
| SEQ ID NO: 7192 | Nga06525 | 463.27 | 473.09 | ---NA--- |
| SEQ ID NO: 7193 | Nga02268 | 3284.76 | 1786.64 | nitrate reductase |
| SEQ ID NO: 7194 | Nga02267 | 6885.56 | 2084.81 | ferredoxin-nitrite reductase |
| SEQ ID NO: 7195 | Nga21027 | 404.49 | 430.86 | elicitin-like protein 6 precursor |
| SEQ ID NO: 7196 | Nga07259 | 8234.13 | 7070.05 | ---NA--- |
| SEQ ID NO: 7197 | Nga04437 | 109.59 | 115.00 | ---NA--- |
| SEQ ID NO: 7198 | Nga20844 | 366.58 | 289.06 | exosome component 5 |
| SEQ ID NO: 7199 | Nga02933 | 142.12 | 206.33 | sulfite reductase |
| SEQ ID NO: 7200 | Nga02928 | 1849.34 | 1844.81 | peptidyl-prolyl cis-trans isomerase ppi1 |
| SEQ ID NO: 7201 | Nga02935 | 256.15 | 270.27 | mucolipin-like protein |
| SEQ ID NO: 7202 | Nga02937 | 9.05 | 8.17 | type a von willebrand factor domain-containing protein |

FIGURE 24 DJ

| # | Nga model | +N rpkb | -N rpkb | GO |
|---|---|---|---|---|
| SEQ ID NO: 7203 | Nga02936 | 9.45 | 40.02 | midasin-like protein |
| SEQ ID NO: 7204 | Nga02927 | 469.05 | 344.41 | golgi snap receptor complex member 2 |
| SEQ ID NO: 7205 | Nga20218 | 19.05 | 59.32 | midasin-like protein |
| SEQ ID NO: 7206 | Nga20218 | 29.63 | 43.33 | midasin-like protein |
| SEQ ID NO: 7207 | Nga02931 | 1031.36 | 1179.12 | elongation factor tu |
| SEQ ID NO: 7208 | Nga21113 | 131.41 | 120.66 | protein |
| SEQ ID NO: 7209 | Nga02934 | 1224.90 | 1370.36 | elongation factor tu |
| SEQ ID NO: 7210 | Nga02930 | 328.07 | 384.15 | methionine synthase mitochondrial precursor-like protein |
| SEQ ID NO: 7211 | Nga02932 | 77.13 | 117.87 | protein |
| SEQ ID NO: 7212 | Nga02929 | 168.69 | 125.63 | programmed cell death protein 5 |
| SEQ ID NO: 7213 | Nga06840 | 83.33 | 40.12 | ---NA--- |
| SEQ ID NO: 7214 | Nga06839 | 116.33 | 92.09 | conserved unknown protein [Ectocarpus siliculosus] |
| SEQ ID NO: 7215 | Nga06829.1 | 48.85 | 54.47 | shq1 homolog ( cerevisiae) |
| SEQ ID NO: 7216 | Nga05819.2 | 1067.43 | 958.50 | cdp-diacylglycerol--glycerol-3-phosphate 3-phosphatidyltransferase |
| SEQ ID NO: 7217 | Nga04657.01 | 553.42 | 557.82 | vesicle transport v- |
| SEQ ID NO: 7218 | Nga21246 | 166.88 | 255.52 | cell division control protein |
| SEQ ID NO: 7219 | Nga20332 | 424.05 | 370.22 | protein |
| SEQ ID NO: 7220 | Nga02432 | 14878.71 | 9133.10 | mpv17-like protein |
| SEQ ID NO: 7221 | Nga02433 | 598.55 | 816.56 | ring finger protein 167 |
| SEQ ID NO: 7222 | Nga04067 | 164.10 | 249.98 | ---NA--- |
| SEQ ID NO: 7223 | Nga04066 | 323.53 | 427.30 | upf0652 protein |
| SEQ ID NO: 7224 | Nga06846 | 1647.89 | 1383.28 | secreted protein |
| SEQ ID NO: 7225 | Nga20676.1 | 24.19 | 87.36 | ---NA--- |
| SEQ ID NO: 7226 | Nga21261 | 37.31 | 56.59 | eukaryotic translation initiation factor 2-alpha kinase 4 |
| SEQ ID NO: 7227 | Nga20301 | 88.63 | 62.61 | protein kinase |
| SEQ ID NO: 7228 | Nga04724 | 158.33 | 81.24 | ---NA--- |
| SEQ ID NO: 7229 | Nga04723 | 140.22 | 107.92 | hypothetical protein PTSG_03639 [Salpingoeca sp. ATCC 50818] |
| SEQ ID NO: 7230 | Nga04805 | 991.48 | 935.60 | ---NA--- |
| SEQ ID NO: 7231 | Nga04815 | 172.99 | 187.39 | soluble nsf attachment protein gamma isoform |
| SEQ ID NO: 7232 | Nga04814.1 | 297.80 | 270.11 | ---NA--- |
| SEQ ID NO: 7233 | Nga06809 | 1013.28 | 1062.68 | conserved unknown protein [Ectocarpus siliculosus] |
| SEQ ID NO: 7234 | Nga07075 | 58.18 | 59.09 | ---NA--- |
| SEQ ID NO: 7235 | Nga07076 | 30.30 | 20.89 | ---NA--- |
| SEQ ID NO: 7236 | Nga20069 | 573.94 | 661.65 | trehalose synthase |
| SEQ ID NO: 7237 | Nga03635 | 348.02 | 652.39 | sodium hydrogen exchanger family protein |
| SEQ ID NO: 7238 | Nga03638 | 286.46 | 445.71 | ---NA--- |
| SEQ ID NO: 7239 | Nga03637 | 192.98 | 573.29 | monovalent cation:proton antiporter-1 family |
| SEQ ID NO: 7240 | Nga03636 | 210.67 | 181.98 | monovalent cation:proton antiporter-1 family |
| SEQ ID NO: 7241 | Nga06810 | 329.14 | 411.04 | aminophospholipid-transporting p-type atpase |
| SEQ ID NO: 7242 | Nga06899 | 83.87 | 74.06 | aminotransferase class-iii |
| SEQ ID NO: 7243 | Nga07284 | 868.87 | 659.27 | exported nucleotide-binding protein |
| SEQ ID NO: 7244 | Nga04959 | 2776.21 | 2415.86 | protein |
| SEQ ID NO: 7245 | Nga04960 | 172.00 | 137.49 | erythromycin esterase |
| SEQ ID NO: 7246 | Nga04185 | 380.95 | 443.61 | ---NA--- |
| SEQ ID NO: 7247 | Nga04184 | 626.21 | 557.39 | heme oxygenase |
| SEQ ID NO: 7248 | Nga21195 | 172.41 | 121.40 | ---NA--- |
| SEQ ID NO: 7249 | Nga06860 | 1743.39 | 1375.54 | ---NA--- |
| SEQ ID NO: 7250 | Nga05024 | 155.79 | 191.56 | ---NA--- |
| SEQ ID NO: 7251 | Nga03706.01 | 591.29 | 553.98 | protein |
| SEQ ID NO: 7252 | Nga07134 | 934.65 | 936.10 | ---NA--- |
| SEQ ID NO: 7253 | Nga07049 | 554.14 | 603.71 | histone h3 |
| SEQ ID NO: 7254 | Nga07039 | 50.30 | 102.44 | ---NA--- |
| SEQ ID NO: 7255 | Nga03298 | 32.26 | 0.00 | ---NA--- |
| SEQ ID NO: 7256 | Nga03302 | 1223.12 | 1278.33 | polyadenlyte binding protein |
| SEQ ID NO: 7257 | Nga03300 | 113.10 | 77.37 | rare lipoprotein a |
| SEQ ID NO: 7258 | Nga03296 | 1112.73 | 1486.33 | b chain crystal structure of the mile domain of poly -binding protein in complex with the binding region of paip2 |
| SEQ ID NO: 7259 | Nga03295 | 14.91 | 44.03 | ---NA--- |
| SEQ ID NO: 7260 | Nga20684 | 589.64 | 747.95 | disulfide isomerase |
| SEQ ID NO: 7261 | Nga03299 | 53.57 | 58.03 | ---NA--- |
| SEQ ID NO: 7262 | Nga03297 | 36.23 | 26.69 | p-loop containing nucleoside triphosphate hydrolase-like protein |
| SEQ ID NO: 7263 | Nga20443 | 122.30 | 124.69 | dna primase |
| SEQ ID NO: 7264 | Nga03301 | 67.71 | 43.25 | protein |
| SEQ ID NO: 7265 | Nga03294 | 193.28 | 200.87 | tfiih subunit |

FIGURE 24 DK

| # | Nga model | +N rpkb | -N rpkb | GO |
|---|---|---|---|---|
| SEQ ID NO: 7266 | Nga01499 | 712.75 | 890.77 | ankyrin repeat domain protein |
| SEQ ID NO: 7267 | Nga01498 | 902.96 | 893.45 | protein |
| SEQ ID NO: 7268 | Nga05017 | 729.37 | 818.68 | protein |
| SEQ ID NO: 7269 | Nga20266 | 504.30 | 425.09 | potential er nuclear membrane ubiquitin-protein ligase e3 |
| SEQ ID NO: 7270 | Nga01841 | 351.73 | 486.22 | glycosyl transferase family protein |
| SEQ ID NO: 7271 | Nga20611 | 348.80 | 390.03 | spindle pole body interacting protein |
| SEQ ID NO: 7272 | Nga20652 | 28.17 | 55.94 | wd repeat-containing protein 3 |
| SEQ ID NO: 7273 | Nga20960 | 741.41 | 561.31 | predicted protein [Thalassiosira pseudonana CCMP1335] |
| SEQ ID NO: 7274 | Nga01038 | 651.99 | 724.43 | 3-isopropylmalate dehydrogenase |
| SEQ ID NO: 7275 | Nga01039 | 156.72 | 288.32 | serine threonine protein |
| SEQ ID NO: 7276 | Nga03813 | 3.75 | 85.20 | protein |
| SEQ ID NO: 7277 | Nga03815 | 44.59 | 73.60 | potassium channel protein |
| SEQ ID NO: 7278 | Nga03812 | 111.11 | 114.89 | protein |
| SEQ ID NO: 7279 | Nga03816 | 66.67 | 55.22 | ---NA--- |
| SEQ ID NO: 7280 | Nga03814 | 169.31 | 126.09 | ---NA--- |
| SEQ ID NO: 7281 | Nga07002 | 112.09 | 126.69 | abc transporter atpase |
| SEQ ID NO: 7282 | Nga00234.02 | 163.78 | 204.54 | methyltransferase mett10d |
| SEQ ID NO: 7283 | Nga05367 | 283.38 | 336.48 | major facilitator superfamily domain-containing protein 9-like |
| SEQ ID NO: 7284 | Nga00232.02 | 3023.75 | 2957.22 | hypothetical protein tll0394 [Thermosynechococcus elongatus BP-1] |
| SEQ ID NO: 7285 | Nga00233.02 | 365.97 | 281.46 | ---NA--- |
| SEQ ID NO: 7286 | Nga00223.02 | 647.29 | 827.95 | serine acetyltransferase |
| SEQ ID NO: 7287 | Nga05366 | 1336.58 | 1265.25 | methylenetetrahydrofolate reductase |
| SEQ ID NO: 7288 | Nga00218.02 | 1682.69 | 1001.99 | protein |
| SEQ ID NO: 7289 | Nga00217.02 | 13677.11 | 13639.38 | myo-inositol 2-dehydrogenase |
| SEQ ID NO: 7290 | Nga00214.02 | 684.27 | 683.71 | pleckstrin domain-containing protein |
| SEQ ID NO: 7291 | Nga00227.02 | 631.30 | 781.54 | predicted protein [Thalassiosira pseudonana CCMP1335] |
| SEQ ID NO: 7292 | Nga07275 | 226.67 | 158.87 | ---NA--- |
| SEQ ID NO: 7293 | Nga20523 | 85.89 | 146.20 | translin-like protein |
| SEQ ID NO: 7294 | Nga20381 | 112.05 | 222.14 | ---NA--- |
| SEQ ID NO: 7295 | Nga03496 | 156.50 | 106.78 | necap-like protein cg9132 |
| SEQ ID NO: 7296 | Nga03493 | 231.43 | 192.70 | ---NA--- |
| SEQ ID NO: 7297 | Nga03497 | 1460.16 | 1210.05 | peptidyl-prolyl isomerase fkbp12 |
| SEQ ID NO: 7298 | Nga03494 | 920.19 | 969.32 | 3-dehydroquinate synthase |
| SEQ ID NO: 7299 | Nga20772.1 | 554.82 | 701.96 | protein |
| SEQ ID NO: 7300 | Nga03495 | 1976.30 | 1776.30 | proteasome subunit alpha type 5 |
| SEQ ID NO: 7301 | Nga03492 | 308.09 | 324.41 | alternative splicing type 3 |
| SEQ ID NO: 7302 | Nga03491.01 | 1636.64 | 1347.84 | ---NA--- |
| SEQ ID NO: 7303 | Nga07007 | 220.78 | 246.19 | er degradation-enhancing alpha-mannosidase-like protein |
| SEQ ID NO: 7304 | Nga06833 | 211.92 | 234.94 | ---NA--- |
| SEQ ID NO: 7305 | Nga06947 | 1502.85 | 1204.51 | predicted protein [Micromonas pusilla CCMP1545] |
| SEQ ID NO: 7306 | Nga20484 | 288.39 | 349.71 | protein |
| SEQ ID NO: 7307 | Nga04850 | 2687.19 | 2273.71 | glycerol-3-phosphate o-acyltransferase |
| SEQ ID NO: 7308 | Nga20220 | 1283.98 | 1338.11 | ornithine carbamoyltransferase |
| SEQ ID NO: 7309 | Nga04836 | 9682.24 | 8929.09 | ---NA--- |
| SEQ ID NO: 7310 | Nga06872 | 128.65 | 152.03 | ---NA--- |
| SEQ ID NO: 7311 | Nga04316 | 1219.93 | 1066.75 | ---NA--- |
| SEQ ID NO: 7312 | Nga04315 | 3148.30 | 2694.04 | ---NA--- |
| SEQ ID NO: 7313 | Nga20919 | 159.76 | 153.83 | ---NA--- |
| SEQ ID NO: 7314 | Nga06823 | 1837.16 | 1725.49 | conserved unknown protein [Ectocarpus siliculosus] |
| SEQ ID NO: 7315 | Nga06824 | 1374.69 | 1374.67 | ribosomal rna large subunit methyltransferase h |
| SEQ ID NO: 7316 | Nga04209 | 592.36 | 769.99 | conserved unknown protein [Ectocarpus siliculosus] |
| SEQ ID NO: 7317 | Nga04210 | 174.37 | 198.80 | ubiquitin-protein cullin 4 |
| SEQ ID NO: 7318 | Nga20345 | 192.07 | 137.95 | calcium calmodulin-dependent protein kinase kinase alpha |
| SEQ ID NO: 7319 | Nga20992 | 151.79 | 121.86 | protein kinase |
| SEQ ID NO: 7320 | Nga20552.1 | 125.33 | 178.18 | ---NA--- |
| SEQ ID NO: 7321 | Nga21140.1 | 134.71 | 151.07 | d-2-hydroxyglutarate mitochondrial precursor |
| SEQ ID NO: 7322 | Nga20751.1 | 250.64 | 261.76 | protein |
| SEQ ID NO: 7323 | Nga02446 | 1605.89 | 1315.05 | glycosyl hydrolase |
| SEQ ID NO: 7324 | Nga04018.2 | 2458.19 | 2300.51 | type iii effector protein |
| SEQ ID NO: 7325 | Nga06836 | 223.67 | 271.98 | ubiquinone menaquinone biosynthesis methyltransferase |
| SEQ ID NO: 7326 | Nga04160.02 | 2642.63 | 2382.10 | brain protein 44-like protein |
| SEQ ID NO: 7327 | Nga05788 | 282.92 | 442.43 | ---NA--- |
| SEQ ID NO: 7328 | Nga05791 | 167.74 | 172.39 | ---NA--- |
| SEQ ID NO: 7329 | Nga05790.1 | 953.02 | 993.35 | major facilitator superfamily mfs_1 |

FIGURE 24 DL

| # | Nga model | +N rpkb | -N rpkb | GO |
|---|---|---|---|---|
| SEQ ID NO: 7330 | Nga06895.2 | 912.42 | 1157.40 | ---NA--- |
| SEQ ID NO: 7331 | Nga05793 | 78.60 | 89.88 | emopamil binding |
| SEQ ID NO: 7332 | Nga06799 | 77.33 | 77.99 | 6-deoxyerythronolide-b synthase |
| SEQ ID NO: 7333 | Nga04398 | 1039.86 | 922.32 | conserved unknown protein [Ectocarpus siliculosus] |
| SEQ ID NO: 7334 | Nga04396 | 1985.88 | 1615.67 | ascorbate peroxidase |
| SEQ ID NO: 7335 | Nga04397 | 34.39 | 37.25 | ---NA--- |
| SEQ ID NO: 7336 | Nga04395 | 163.27 | 320.55 | ---NA--- |
| SEQ ID NO: 7337 | Nga20387 | 489.97 | 527.41 | zinc ion binding protein |
| SEQ ID NO: 7338 | Nga04889 | 175.70 | 126.29 | set translocation (myeloid leukemia-associated) a |
| SEQ ID NO: 7339 | Nga04365 | 828.33 | 947.99 | ---NA--- |
| SEQ ID NO: 7340 | Nga04364 | 174.48 | 189.00 | ---NA--- |
| SEQ ID NO: 7341 | Nga04501 | 428.36 | 371.53 | ---NA--- |
| SEQ ID NO: 7342 | Nga05288 | 287.79 | 261.36 | nad-dependent epimerase dehydratase |
| SEQ ID NO: 7343 | Nga05287 | 461.75 | 293.01 | charged multivesicular body protein |
| SEQ ID NO: 7344 | Nga05292 | 369.49 | 315.23 | transcription factor protein |
| SEQ ID NO: 7345 | Nga05291 | 931.40 | 643.66 | protein |
| SEQ ID NO: 7346 | Nga05294 | 826.53 | 751.63 | 24-dehydrocholesterol reductase |
| SEQ ID NO: 7347 | Nga05296 | 309.59 | 323.49 | ---NA--- |
| SEQ ID NO: 7348 | Nga05295 | 538.29 | 460.68 | udp-glucose ceramide glucosyltransferase-like 1 |
| SEQ ID NO: 7349 | Nga20131.1 | 392.55 | 476.35 | hypothetical protein AURANDRAFT_63258 [Aureococcus anophagefferens] |
| SEQ ID NO: 7350 | Nga05293 | 967.82 | 939.64 | 24-dehydrocholesterol reductase |
| SEQ ID NO: 7351 | Nga05289 | 67324.43 | 24008.93 | protein fucoxanthin chlorophyll a c protein |
| SEQ ID NO: 7352 | Nga05290 | 2588.24 | 2574.27 | protein |
| SEQ ID NO: 7353 | Nga01117.01 | 2200.70 | 2327.30 | dual specificity protein phosphatase 10 |
| SEQ ID NO: 7354 | Nga01118 | 1479.47 | 1562.05 | ---NA--- |
| SEQ ID NO: 7355 | Nga01116 | 912.61 | 1399.68 | dynactin 5 |
| SEQ ID NO: 7356 | Nga04739 | 579.30 | 576.28 | phosphatidylinositol kinase |
| SEQ ID NO: 7357 | Nga04741 | 2371.74 | 2793.78 | ---NA--- |
| SEQ ID NO: 7358 | Nga04740 | 3217.91 | 3286.30 | hyaluronan mrna binding family protein |
| SEQ ID NO: 7359 | Nga21062 | 329.87 | 301.05 | ---NA--- |
| SEQ ID NO: 7360 | Nga04738 | 690.22 | 715.14 | phosphatidylinositol kinase |
| SEQ ID NO: 7361 | Nga07060 | 128.74 | 129.49 | ---NA--- |
| SEQ ID NO: 7362 | Nga06614 | 5974.50 | 5232.48 | ---NA--- |
| SEQ ID NO: 7363 | Nga06615.1 | 346.69 | 382.52 | patched family protein |
| SEQ ID NO: 7364 | Nga06616 | 163.27 | 125.27 | ---NA--- |
| SEQ ID NO: 7365 | Nga01331.2 | 956.06 | 908.09 | nad-dependent epimerase dehydratase |
| SEQ ID NO: 7366 | Nga04533 | 151.80 | 180.23 | protein |
| SEQ ID NO: 7367 | Nga07095.1 | 625.00 | 780.99 | ---NA--- |
| SEQ ID NO: 7368 | Nga04430 | 80.00 | 139.62 | ---NA--- |
| SEQ ID NO: 7369 | Nga01822 | 2.49 | 10.78 | bacteriocin o-metyltransferase |
| SEQ ID NO: 7370 | Nga01823 | 145.48 | 131.58 | prematurely terminated mrna decay factor-like |
| SEQ ID NO: 7371 | Nga07019 | 936.87 | 839.78 | iduronate-2-sulfatase |
| SEQ ID NO: 7372 | Nga07018 | 2114.53 | 1719.62 | short-chain dehydrogenase reductase sdr |
| SEQ ID NO: 7373 | Nga01556 | 625.32 | 455.23 | methylenetetrahydrofolate dehydrogenase |
| SEQ ID NO: 7374 | Nga01555 | 94.07 | 170.57 | ---NA--- |
| SEQ ID NO: 7375 | Nga01045.02 | 3785.01 | 3574.55 | microcystin synthetase-associated thioesterase |
| SEQ ID NO: 7376 | Nga01042.02 | 765.33 | 615.28 | rae1-like protein |
| SEQ ID NO: 7377 | Nga01292 | 8888.07 | 9693.15 | 60s ribosomal protein l11 |
| SEQ ID NO: 7378 | Nga01296 | 1162.45 | 1165.50 | protein-s-isoprenylcysteine o-methyltransferase |
| SEQ ID NO: 7379 | Nga20734 | 946.67 | 772.71 | protein-s-isoprenylcysteine o-methyltransferase-like |
| SEQ ID NO: 7380 | Nga01290 | 6309.11 | 5550.10 | stress-inducible protein |
| SEQ ID NO: 7381 | Nga01291 | 295.02 | 351.12 | acyl- dehydrogenase domain protein |
| SEQ ID NO: 7382 | Nga01295 | 83.56 | 70.73 | ---NA--- |
| SEQ ID NO: 7383 | Nga02148 | 700.37 | 756.64 | ---NA--- |
| SEQ ID NO: 7384 | Nga20097.1 | 190.19 | 218.10 | type i inositol polyphosphate 5- |
| SEQ ID NO: 7385 | Nga06939 | 242.29 | 152.70 | ---NA--- |
| SEQ ID NO: 7386 | Nga07061 | 575.61 | 667.55 | atp-citrate synthase |
| SEQ ID NO: 7387 | Nga06907 | 432.60 | 522.05 | upf0082 protein pc1328 |
| SEQ ID NO: 7388 | Nga20389 | 352.83 | 273.28 | gpi mannosyltransferase 1 |
| SEQ ID NO: 7389 | Nga06908 | 296.86 | 258.89 | gpi mannosyltransferase 1 |
| SEQ ID NO: 7390 | Nga06273.02 | 77.78 | 96.29 | ---NA--- |
| SEQ ID NO: 7391 | Nga06271.02 | 2306.05 | 2335.27 | thiol-disulfide oxidoreductase dcc |
| SEQ ID NO: 7392 | Nga06269.02 | 1489.60 | 1356.36 | ---NA--- |

FIGURE 24 DM

| # | Nga model | +N rpkb | -N rpkb | GO |
|---|---|---|---|---|
| SEQ ID NO: 7393 | Nga01351.02 | 1830.59 | 2111.68 | eukaryotic translation initiation factor 3 subunit g |
| SEQ ID NO: 7394 | Nga05066.02 | 164.88 | 164.69 | ---NA--- |
| SEQ ID NO: 7395 | Nga05058.02 | 5137.54 | 3468.91 | ferredoxin-dependent bilin reductase |
| SEQ ID NO: 7396 | Nga05061.02 | 1195.18 | 788.67 | phosphoinositol transporter |
| SEQ ID NO: 7397 | Nga20921 | 110.41 | 157.19 | trna (adenine-n -)-methyltransferase catalytic |
| SEQ ID NO: 7398 | Nga21239 | 200.47 | 161.60 | protein |
| SEQ ID NO: 7399 | Nga21253 | 123.51 | 108.00 | diphthamide biosynthesis |
| SEQ ID NO: 7400 | Nga20386 | 143.28 | 140.80 | diphthamide biosynthesis protein |
| SEQ ID NO: 7401 | Nga21029 | 2030.73 | 1844.89 | hnh endonuclease |
| SEQ ID NO: 7402 | Nga07273 | 302.86 | 365.08 | protein |
| SEQ ID NO: 7403 | Nga04565 | 422.12 | 494.08 | protein |
| SEQ ID NO: 7404 | Nga03760 | 174.45 | 178.85 | ---NA--- |
| SEQ ID NO: 7405 | Nga20426 | 245.05 | 209.14 | ---NA--- |
| SEQ ID NO: 7406 | Nga03761 | 2288.22 | 3697.00 | bzip transcription factor |
| SEQ ID NO: 7407 | Nga20793 | 629.20 | 701.16 | protein |
| SEQ ID NO: 7408 | Nga20796 | 102.00 | 83.15 | related dnase |
| SEQ ID NO: 7409 | Nga07128 | 488.74 | 556.26 | histidine acid |
| SEQ ID NO: 7410 | Nga04776.01 | 2722.74 | 2796.39 | aquaporin sip1-2 |
| SEQ ID NO: 7411 | Nga04777.1 | 1441.20 | 1045.24 | protein |
| SEQ ID NO: 7412 | Nga01109.02 | 824.94 | 859.83 | ---NA--- |
| SEQ ID NO: 7413 | Nga01112.02 | 117.65 | 180.54 | ---NA--- |
| SEQ ID NO: 7414 | Nga01111.02 | 72.07 | 78.07 | ---NA--- |
| SEQ ID NO: 7415 | Nga05050 | 259.95 | 239.92 | integral membrane mpv17 pmp22 |
| SEQ ID NO: 7416 | Nga03571.2 | 1037.76 | 960.85 | protein |
| SEQ ID NO: 7417 | Nga04540 | 2153.59 | 2034.60 | protein |
| SEQ ID NO: 7418 | Nga04498.01 | 165.41 | 222.62 | conserved hypothetical protein [Phytophthora infestans T30-4] |
| SEQ ID NO: 7419 | Nga07231 | 496.82 | 492.17 | protein |
| SEQ ID NO: 7420 | Nga07062 | 446.88 | 398.31 | thioesterase superfamily member 4 |
| SEQ ID NO: 7421 | Nga02392.02 | 639.03 | 692.22 | cd4-specific ankyrin repeat protein |
| SEQ ID NO: 7422 | Nga02390.2 | 608.77 | 536.70 | ---NA--- |
| SEQ ID NO: 7423 | Nga04377 | 387.39 | 405.97 | protein |
| SEQ ID NO: 7424 | Nga04379.01 | 1007.44 | 1088.61 | ---NA--- |
| SEQ ID NO: 7425 | Nga04378.01 | 10024.63 | 8667.28 | like protein |
| SEQ ID NO: 7426 | Nga06275.02 | 1840.26 | 1797.89 | protein rer1a |
| SEQ ID NO: 7427 | Nga01375.02 | 437.80 | 290.24 | flap endonuclease 1 |
| SEQ ID NO: 7428 | Nga01377.02 | 421.05 | 445.24 | flap endonuclease-1 |
| SEQ ID NO: 7429 | Nga01376.02 | 265.65 | 284.10 | flap endonuclease-1 |
| SEQ ID NO: 7430 | Nga07056 | 5.49 | 59.52 | family transcriptional regulator |
| SEQ ID NO: 7431 | Nga03245.02 | 476.37 | 413.64 | e3 ubiquitin-protein ligase rnf14 |
| SEQ ID NO: 7432 | Nga03239.2 | 1841.42 | 2086.33 | protein |
| SEQ ID NO: 7433 | Nga03766.01 | 3999.10 | 3999.26 | nadh dehydrogenase |
| SEQ ID NO: 7434 | Nga03764.01 | 455.84 | 534.93 | 24-dehydrocholesterol reductase |
| SEQ ID NO: 7435 | Nga05615.2 | 654.91 | 1315.06 | phosphoribosylformylglycinamidine synthase |
| SEQ ID NO: 7436 | Nga02169 | 456.20 | 487.22 | aldose 1-epimerase |
| SEQ ID NO: 7437 | Nga02170 | 295.68 | 251.66 | transmembrane protein 184c |
| SEQ ID NO: 7438 | Nga02168 | 934.10 | 707.58 | signal recognition particle-docking protein |
| SEQ ID NO: 7439 | Nga20346 | 267.92 | 192.12 | ---NA--- |
| SEQ ID NO: 7440 | Nga20663 | 176.94 | 198.13 | carbohydrate fggy |
| SEQ ID NO: 7441 | Nga07006 | 505.65 | 544.68 | predicted protein [Phaeodactylum tricornutum CCAP 1055/1] |
| SEQ ID NO: 7442 | Nga04808.01 | 871.60 | 961.00 | mg-protoporphyrin ix methyl transferase |
| SEQ ID NO: 7443 | Nga04807.01 | 788.12 | 811.47 | uncharacterized protein |
| SEQ ID NO: 7444 | Nga04010.2 | 968.23 | 1108.62 | protein |
| SEQ ID NO: 7445 | Nga04011.02 | 136.51 | 204.59 | atp synthetase alpha chain -like |
| SEQ ID NO: 7446 | Nga04008.02 | 768.78 | 714.71 | emp24 gp25l p24 family protein |
| SEQ ID NO: 7447 | Nga04143 | 2615.97 | 3348.55 | tfiib zinc-binding family |
| SEQ ID NO: 7448 | Nga04938.2 | 648.41 | 700.47 | atp-dependent protease la |
| SEQ ID NO: 7449 | Nga03232 | 364.75 | 335.18 | ---NA--- |
| SEQ ID NO: 7450 | Nga05323.2 | 876.54 | 1084.57 | protein |
| SEQ ID NO: 7451 | Nga03225.01 | 843.56 | 1355.27 | nadph--cytochrome p450 reductase |
| SEQ ID NO: 7452 | Nga03235 | 158.46 | 166.04 | rrna methylase family |
| SEQ ID NO: 7453 | Nga03228.01 | 227.86 | 231.40 | calcium-dependent protein |
| SEQ ID NO: 7454 | Nga03237 | 69.98 | 51.35 | ---NA--- |
| SEQ ID NO: 7455 | Nga03234 | 974.27 | 902.40 | rho gtpase-activating protein 12 isoform 1 |
| SEQ ID NO: 7456 | Nga03230 | 1893.09 | 2076.53 | plastid atp adp translocase |

FIGURE 24 DN

| # | Nga model | +N rpkb | -N rpkb | GO |
|---|---|---|---|---|
| SEQ ID NO: 7457 | Nga03227 | 548.88 | 486.73 | septum site-determining protein |
| SEQ ID NO: 7458 | Nga05325.2 | 974.06 | 1018.31 | calpain 7 |
| SEQ ID NO: 7459 | Nga20719.1 | 255.14 | 341.29 | coiled-coil domain containing 76 |
| SEQ ID NO: 7460 | Nga03223.1 | 2371.74 | 2031.69 | hypothetical protein AURANDRAFT_64839 [Aureococcus anophageferens] |
| SEQ ID NO: 7461 | Nga03236.01 | 290.83 | 319.01 | ---NA--- |
| SEQ ID NO: 7462 | Nga03233.1 | 466.93 | 514.95 | blue cheese |
| SEQ ID NO: 7463 | Nga03226 | 2957.91 | 2251.74 | protein |
| SEQ ID NO: 7464 | Nga03224 | 521.59 | 512.51 | ---NA--- |
| SEQ ID NO: 7465 | Nga00175.02 | 273.43 | 269.47 | alpha beta hydrolase |
| SEQ ID NO: 7466 | Nga00183.2 | 199.22 | 194.04 | imidazoleglycerol phosphate cyclase subunit |
| SEQ ID NO: 7467 | Nga04642 | 964.13 | 850.10 | ---NA--- |
| SEQ ID NO: 7468 | Nga01813 | 109.52 | 101.45 | ---NA--- |
| SEQ ID NO: 7469 | Nga20696 | 245.54 | 261.59 | dnase domain containing 3 |
| SEQ ID NO: 7470 | Nga01814 | 69.65 | 61.98 | ---NA--- |
| SEQ ID NO: 7471 | Nga06865 | 713.25 | 788.32 | sam-dependent methyltransferase |
| SEQ ID NO: 7472 | Nga02827.2 | 233.58 | 222.41 | protein |
| SEQ ID NO: 7473 | Nga02826.2 | 58.44 | 112.54 | ---NA--- |
| SEQ ID NO: 7474 | Nga04868 | 500.00 | 314.98 | ---NA--- |
| SEQ ID NO: 7475 | Nga04867 | 814.13 | 909.16 | major facilitator superfamily mfs_1 |
| SEQ ID NO: 7476 | Nga04866 | 1381.73 | 1367.94 | protein |
| SEQ ID NO: 7477 | Nga07097.1 | 706.49 | 893.80 | gtp-binding protein |
| SEQ ID NO: 7478 | Nga07180 | 491.74 | 461.05 | ---NA--- |
| SEQ ID NO: 7479 | Nga00746.2 | 106.91 | 139.21 | kiaa1401 protein |
| SEQ ID NO: 7480 | Nga00747.02 | 1671.61 | 1771.89 | sugar transporter |
| SEQ ID NO: 7481 | Nga04733 | 72.80 | 94.63 | ribosome biogenesis protein |
| SEQ ID NO: 7482 | Nga20994 | 1113.80 | 949.18 | transport protein particle bet3 containing protein |
| SEQ ID NO: 7483 | Nga02173 | 233.99 | 205.44 | ---NA--- |
| SEQ ID NO: 7484 | Nga20714 | 21.74 | 64.76 | polyketide synthase |
| SEQ ID NO: 7485 | Nga01360.02 | 2706.83 | 2504.43 | transport protein sec61 alpha subunit |
| SEQ ID NO: 7486 | Nga01981.01 | 2059.33 | 2352.25 | ---NA--- |
| SEQ ID NO: 7487 | Nga01980.01 | 748.12 | 702.52 | alpha beta fold family protein |
| SEQ ID NO: 7488 | Nga20618.1 | 318.75 | 230.19 | ---NA--- |
| SEQ ID NO: 7489 | Nga01979 | 111.80 | 122.98 | sulphonylurea receptor 2b |
| SEQ ID NO: 7490 | Nga01978.01 | 1568.28 | 1993.29 | geranyl diphosphate synthase |
| SEQ ID NO: 7491 | Nga04049.1 | 808.42 | 789.84 | 5 -3 exoribonuclease 1 |
| SEQ ID NO: 7492 | Nga07241 | 581.03 | 773.39 | pseudouridine synthase |
| SEQ ID NO: 7493 | Nga04878 | 319.78 | 270.07 | ---NA--- |
| SEQ ID NO: 7494 | Nga04876 | 1055.59 | 1299.62 | predicted protein [Thalassiosira pseudonana CCMP1335] |
| SEQ ID NO: 7495 | Nga04877 | 1113.17 | 1850.57 | predicted protein [Thalassiosira pseudonana CCMP1335] |
| SEQ ID NO: 7496 | Nga20856 | 3621.17 | 3881.84 | conserved unknown protein [Ectocarpus siliculosus] |
| SEQ ID NO: 7497 | Nga07071.1 | 398.76 | 385.02 | tpr domain-containing protein |
| SEQ ID NO: 7498 | Nga02274 | 84.03 | 91.03 | ---NA--- |
| SEQ ID NO: 7499 | Nga02275 | 101.44 | 96.49 | predicted protein [Phaeodactylum tricornutum CCAP 1055/1] |
| SEQ ID NO: 7500 | Nga02273 | 306.35 | 300.19 | peptidase m50 |
| SEQ ID NO: 7501 | Nga06945 | 497.18 | 802.06 | peptidase u32 |
| SEQ ID NO: 7502 | Nga04704 | 515.90 | 534.60 | hypothetical protein VAS14_15709 [Vibrio angustum S14] |
| SEQ ID NO: 7503 | Nga04703 | 1522.45 | 1826.02 | diphthamide biosynthesis protein 1 |
| SEQ ID NO: 7504 | Nga01670.02 | 29.53 | 27.12 | ---NA--- |
| SEQ ID NO: 7505 | Nga01671.02 | 508.33 | 559.67 | ---NA--- |
| SEQ ID NO: 7506 | Nga04969 | 399.03 | 409.22 | protein |
| SEQ ID NO: 7507 | Nga04968 | 1894.64 | 2267.91 | ---NA--- |
| SEQ ID NO: 7508 | Nga04971 | 777.08 | 680.41 | protein |
| SEQ ID NO: 7509 | Nga04970 | 707.91 | 694.51 | protein |
| SEQ ID NO: 7510 | Nga00712.02 | 1387.79 | 1547.99 | ---NA--- |
| SEQ ID NO: 7511 | Nga04661 | 167.24 | 288.00 | conserved hypothetical protein [Phytophthora infestans T30-4] |
| SEQ ID NO: 7512 | Nga01681.02 | 1100.15 | 1061.04 | rab18 -family small gtpase |
| SEQ ID NO: 7513 | Nga01682.02 | 481.50 | 549.59 | ---NA--- |
| SEQ ID NO: 7514 | Nga01684.02 | 424.39 | 547.78 | glucosamine-6-phosphate isomerase |
| SEQ ID NO: 7515 | Nga20364 | 208.33 | 338.51 | like gtpase |
| SEQ ID NO: 7516 | Nga05768.2 | 229.01 | 219.40 | probable serca-type calcium atpase |
| SEQ ID NO: 7517 | Nga04326.01 | 428.11 | 438.60 | protein |
| SEQ ID NO: 7518 | Nga04327.01 | 178.06 | 211.06 | protein |
| SEQ ID NO: 7519 | Nga07088 | 586.21 | 728.38 | ---NA--- |

FIGURE 24 DO

| # | Nga model | +N rpkb | -N rpkb | GO |
|---|---|---|---|---|
| SEQ ID NO: 7520 | Nga20902 | 716.58 | 892.08 | 39s ribosomal protein mitochondrial-like |
| SEQ ID NO: 7521 | Nga21190 | 738.31 | 685.79 | protein |
| SEQ ID NO: 7522 | Nga02116 | 8090.45 | 8841.15 | 60s acidic ribosomal protein p0 |
| SEQ ID NO: 7523 | Nga02115.1 | 1490.61 | 1340.85 | d-galacturonic acid reductase |
| SEQ ID NO: 7524 | Nga04979 | 147.95 | 137.64 | peptidylprolyl isomerase-like 2 |
| SEQ ID NO: 7525 | Nga04978 | 525.46 | 677.17 | ---NA--- |
| SEQ ID NO: 7526 | Nga06903 | 546.64 | 676.35 | protein |
| SEQ ID NO: 7527 | Nga06904 | 768.71 | 636.19 | signal recognition particle protein |
| SEQ ID NO: 7528 | Nga00881.02 | 3447.70 | 3984.56 | succinate fumarate mitochondrial transporter |
| SEQ ID NO: 7529 | Nga00884.2 | 36.52 | 31.89 | dna replication atp-dependent helicase dna2 |
| SEQ ID NO: 7530 | Nga07163 | 458.11 | 496.24 | 6-4 photolyase |
| SEQ ID NO: 7531 | Nga04457.1 | 1102.61 | 1434.26 | protein |
| SEQ ID NO: 7532 | Nga03453.02 | 210.81 | 224.78 | structural maintenance of chromosomes protein 3 |
| SEQ ID NO: 7533 | Nga03458.02 | 2169.96 | 2504.33 | ---NA--- |
| SEQ ID NO: 7534 | Nga03946.1 | 7492.19 | 6006.61 | ---NA--- |
| SEQ ID NO: 7535 | Nga01204.02 | 11063.86 | 12214.44 | hypothetical protein THAPSDRAFT_268059 [Thalassiosira pseudonana CCMP1335] |
| SEQ ID NO: 7536 | Nga01201.02 | 567.13 | 655.45 | l-allo-threonine aldolase |
| SEQ ID NO: 7537 | Nga07193 | 446.67 | 500.09 | 4-hydroxyphenylpyruvate dioxygenase |
| SEQ ID NO: 7538 | Nga03681 | 1395.20 | 2017.21 | adhesin-like protein |
| SEQ ID NO: 7539 | Nga03679 | 1408.33 | 1211.87 | ---NA--- |
| SEQ ID NO: 7540 | Nga03680 | 2511.90 | 3301.28 | ---NA--- |
| SEQ ID NO: 7541 | Nga06852 | 285.17 | 356.00 | mitochondrial carnitine acylcarnitine carrier protein |
| SEQ ID NO: 7542 | Nga06853 | 17190.03 | 9384.65 | light-harvesting protein |
| SEQ ID NO: 7543 | Nga06854 | 660.98 | 576.49 | trna rrna methyltransferase |
| SEQ ID NO: 7544 | Nga03165.2 | 277.12 | 337.58 | glycoside hydrolase family 37 |
| SEQ ID NO: 7545 | Nga04712 | 76.99 | 74.03 | calcineurin-like phosphoesterase |
| SEQ ID NO: 7546 | Nga04845.01 | 295.92 | 316.77 | nadph dependent diflavin oxidoreductase 1 |
| SEQ ID NO: 7547 | Nga04844.01 | 224.19 | 218.08 | salicylate hydroxylase |
| SEQ ID NO: 7548 | Nga02139 | 555.16 | 613.02 | protein |
| SEQ ID NO: 7549 | Nga04370.1 | 676.10 | 700.21 | peroxisomal acyl-coenzyme a oxidase 1 |
| SEQ ID NO: 7550 | Nga01097.2 | 511.38 | 528.00 | conserved unknown protein [Ectocarpus siliculosus] |
| SEQ ID NO: 7551 | Nga04312.01 | 962.73 | 1403.02 | galactosamine (n-acetyl)-6-sulfate sulfatase-like |
| SEQ ID NO: 7552 | Nga04124.2 | 341.52 | 460.44 | transcription antitermination protein nusg |
| SEQ ID NO: 7553 | Nga04123.02 | 522.11 | 655.66 | ---NA--- |
| SEQ ID NO: 7554 | Nga00860.02 | 675.03 | 625.47 | ribosomal protein l22 |
| SEQ ID NO: 7555 | Nga06896 | 64.10 | 83.33 | ---NA--- |
| SEQ ID NO: 7556 | Nga05712.2 | 588.89 | 489.93 | cell cycle control protein 50a |
| SEQ ID NO: 7557 | Nga04753 | 471.82 | 507.60 | ---NA--- |
| SEQ ID NO: 7558 | Nga06973 | 1042.65 | 999.35 | protein |
| SEQ ID NO: 7559 | Nga04857.01 | 2722.67 | 2415.85 | signal peptidase complex catalytic subunit sec11a |
| SEQ ID NO: 7560 | Nga04858.1 | 142.86 | 152.42 | mgc83562 protein |
| SEQ ID NO: 7561 | Nga05826.2 | 245.43 | 257.05 | signal recognition particle receptor |
| SEQ ID NO: 7562 | Nga00667.2 | 895.95 | 1007.72 | lipoate-protein ligase b |
| SEQ ID NO: 7563 | Nga04269.02 | 42.42 | 52.52 | kinesin-like protein |
| SEQ ID NO: 7564 | Nga04238 | 1133.07 | 1016.76 | soluble nsf attachment protein receptor vesicle-associated membrane protein |
| SEQ ID NO: 7565 | Nga04239 | 239.51 | 263.90 | peptidase m28 family protein |
| SEQ ID NO: 7566 | Nga20577.1 | 202.70 | 146.38 | ---NA--- |
| SEQ ID NO: 7567 | Nga20401.1 | 232.88 | 204.03 | glutamate carboxypeptidase |
| SEQ ID NO: 7568 | Nga21068.1 | 156.10 | 195.51 | glutamate carboxypeptidase 2 |
| SEQ ID NO: 7569 | Nga04237 | 275.11 | 200.25 | chromosome 1 open reading frame 149 |
| SEQ ID NO: 7570 | Nga04757 | 644.40 | 598.01 | ---NA--- |
| SEQ ID NO: 7571 | Nga04756.01 | 1614.47 | 1104.61 | conserved unknown protein [Ectocarpus siliculosus] |
| SEQ ID NO: 7572 | Nga02181.1 | 494.41 | 529.25 | vesicle transport through interaction with t-snares homolog 1a |
| SEQ ID NO: 7573 | Nga02183 | 278.15 | 375.76 | protein |
| SEQ ID NO: 7574 | Nga02182 | 931.20 | 1190.30 | ---NA--- |
| SEQ ID NO: 7575 | Nga06880 | 916.31 | 754.42 | ---NA--- |
| SEQ ID NO: 7576 | Nga03072.02 | 1389.98 | 1476.54 | ---NA--- |
| SEQ ID NO: 7577 | Nga03063.02 | 1093.05 | 887.31 | ---NA--- |
| SEQ ID NO: 7578 | Nga04730.1 | 247.45 | 315.99 | ---NA--- |
| SEQ ID NO: 7579 | Nga04404.01 | 605.65 | 741.74 | alpha beta hydrolase fold-3 domain protein |
| SEQ ID NO: 7580 | Nga04403.01 | 6167.72 | 5668.70 | conserved unknown protein [Ectocarpus siliculosus] |
| SEQ ID NO: 7581 | Nga04950 | 69.48 | 66.69 | recombinase a |

FIGURE 24 DP

| # | Nga model | +N rpkb | -N rpkb | GO |
|---|---|---|---|---|
| SEQ ID NO: 7582 | Nga04949 | 2206.95 | 1947.00 | thioredoxin 1 |
| SEQ ID NO: 7583 | Nga01905 | 590.20 | 704.46 | hormone-sensitive lipase |
| SEQ ID NO: 7584 | Nga01907 | 833.33 | 844.29 | ---NA--- |
| SEQ ID NO: 7585 | Nga01908 | 592.43 | 513.87 | ---NA--- |
| SEQ ID NO: 7586 | Nga01906 | 405.11 | 383.48 | fatty acid hydroxylase-like protein |
| SEQ ID NO: 7587 | Nga04827 | 406.01 | 343.41 | trauco protein |
| SEQ ID NO: 7588 | Nga20213 | 430.46 | 392.90 | protein |
| SEQ ID NO: 7589 | Nga04500 | 34.55 | 79.01 | ---NA--- |
| SEQ ID NO: 7590 | Nga07081 | 191.49 | 212.55 | ---NA--- |
| SEQ ID NO: 7591 | Nga21120.1 | 134.62 | 160.24 | bromodomain phd finger transcription factor |
| SEQ ID NO: 7592 | Nga02104 | 446.70 | 428.89 | ---NA--- |
| SEQ ID NO: 7593 | Nga02101 | 12610.66 | 7352.70 | extrinsic protein in photosystem ii |
| SEQ ID NO: 7594 | Nga02103 | 233.33 | 238.87 | ---NA--- |
| SEQ ID NO: 7595 | Nga02102 | 728.66 | 643.32 | glutathione peroxidase |
| SEQ ID NO: 7596 | Nga07073 | 379.88 | 265.12 | ccd43_dicdi ame: full=coiled-coil domain-containing protein 43 homolog |
| SEQ ID NO: 7597 | Nga04816 | 212.45 | 271.80 | ---NA--- |
| SEQ ID NO: 7598 | Nga04273 | 1144.81 | 994.20 | protein |
| SEQ ID NO: 7599 | Nga02395 | 246.58 | 195.38 | ---NA--- |
| SEQ ID NO: 7600 | Nga06324.02 | 2670.06 | 2608.04 | dna repair protein nse1 |
| SEQ ID NO: 7601 | Nga07105 | 324.59 | 316.45 | transcription initiation protein spt5 |
| SEQ ID NO: 7602 | Nga04454 | 6146.40 | 6599.43 | protein |
| SEQ ID NO: 7603 | Nga06975 | 3611.11 | 3992.96 | ---NA--- |
| SEQ ID NO: 7604 | Nga07210 | 5.21 | 1.61 | beta tubulin |
| SEQ ID NO: 7605 | Nga07209 | 372.65 | 672.78 | protein |
| SEQ ID NO: 7606 | Nga20168.1 | 528.19 | 655.30 | protein |
| SEQ ID NO: 7607 | Nga20308.1 | 251.62 | 386.07 | protein |
| SEQ ID NO: 7608 | Nga20607.1 | 124.63 | 208.93 | e3 ubiquitin-protein ligase ubr4 |
| SEQ ID NO: 7609 | Nga01741.01 | 975.28 | 958.57 | pap fibrillin family protein |
| SEQ ID NO: 7610 | Nga01742 | 397.01 | 485.03 | ---NA--- |
| SEQ ID NO: 7611 | Nga07237 | 216.00 | 207.98 | ---NA--- |
| SEQ ID NO: 7612 | Nga05674.02 | 1894.78 | 1273.98 | light harvesting complex protein |
| SEQ ID NO: 7613 | Nga02363.1 | 196.23 | 182.86 | alpha- -glucosyltransferase alg10-a-like |
| SEQ ID NO: 7614 | Nga02362 | 194.84 | 257.96 | protein |
| SEQ ID NO: 7615 | Nga01160.02 | 45.20 | 57.53 | ---NA--- |
| SEQ ID NO: 7616 | Nga01157.02 | 962.03 | 991.06 | ---NA--- |
| SEQ ID NO: 7617 | Nga04224.02 | 7724.92 | 8189.01 | hybrid cluster protein |
| SEQ ID NO: 7618 | Nga06980 | 167.13 | 263.98 | ---NA--- |
| SEQ ID NO: 7619 | Nga20916.1 | 595.98 | 459.41 | protein |
| SEQ ID NO: 7620 | Nga07177 | 310.04 | 390.20 | acyl- -binding |
| SEQ ID NO: 7621 | Nga07197 | 446.67 | 500.09 | transcriptional family protein |
| SEQ ID NO: 7622 | Nga07041 | 311.91 | 330.63 | ---NA--- |
| SEQ ID NO: 7623 | Nga03454.02 | 651.79 | 688.18 | protein |
| SEQ ID NO: 7624 | Nga01215 | 752.94 | 777.38 | histone acetyltransferase complex component |
| SEQ ID NO: 7625 | Nga01213 | 279.56 | 319.52 | two-pore calcium channel |
| SEQ ID NO: 7626 | Nga01217 | 1031.07 | 887.40 | predicted protein [Phaeodactylum tricornutum CCAP 1055/1] |
| SEQ ID NO: 7627 | Nga01216 | 937.01 | 844.41 | protein |
| SEQ ID NO: 7628 | Nga01212 | 420.95 | 465.36 | cyclin b2 |
| SEQ ID NO: 7629 | Nga01214 | 961.69 | 965.99 | protein kinase |
| SEQ ID NO: 7630 | Nga06804 | 1372.90 | 1514.50 | wd40 repeat-containing protein |
| SEQ ID NO: 7631 | Nga00303.2 | 394.52 | 401.64 | cytochrome c biogenesis protein transmembrane region |
| SEQ ID NO: 7632 | Nga01938 | 1032.99 | 1027.33 | aldo-keto reductase |
| SEQ ID NO: 7633 | Nga01940 | 917.30 | 751.46 | n-acetyltransferase 5 |
| SEQ ID NO: 7634 | Nga06825 | 149.87 | 207.13 | ---NA--- |
| SEQ ID NO: 7635 | Nga06731.2 | 552.46 | 538.02 | sorbitol oxidase |
| SEQ ID NO: 7636 | Nga06814 | 243.00 | 296.84 | transducin family protein wd-40 repeat family protein |
| SEQ ID NO: 7637 | Nga20295.1 | 569.74 | 470.34 | jmjc domain-containing protein 4-like |
| SEQ ID NO: 7638 | Nga03692 | 918.97 | 917.66 | mitochondrial energy transfer protein |
| SEQ ID NO: 7639 | Nga21245 | 602.81 | 458.80 | protein |
| SEQ ID NO: 7640 | Nga20674 | 90.45 | 87.09 | ---NA--- |
| SEQ ID NO: 7641 | Nga21037 | 1132.96 | 1088.31 | small multidrug export protein |
| SEQ ID NO: 7642 | Nga06795 | 221.17 | 241.63 | white-brown-complex abc transporter family |
| SEQ ID NO: 7643 | Nga06794 | 396.48 | 367.81 | conserved unknown protein [Ectocarpus siliculosus] |
| SEQ ID NO: 7644 | Nga20113.1 | 756.98 | 779.68 | transcription initiation factor tfiid subunit |

FIGURE 24 DQ

| # | Nga model | +N rpkb | -N rpkb | GO |
|---|---|---|---|---|
| SEQ ID NO: 7645 | Nga03126.02 | 9669.35 | 7501.52 | protein |
| SEQ ID NO: 7646 | Nga07261 | 677.61 | 790.06 | taf5 rna polymerase tata box binding protein -associated factor |
| SEQ ID NO: 7647 | Nga02002.2 | 273.62 | 277.56 | sorting nexin 1 |
| SEQ ID NO: 7648 | Nga04671 | 104.58 | 129.80 | fad dependent oxidoreductase |
| SEQ ID NO: 7649 | Nga04672 | 215.19 | 308.52 | ---NA--- |
| SEQ ID NO: 7650 | Nga01150.2 | 730.51 | 797.24 | ll-diaminopimelate aminotransferase |
| SEQ ID NO: 7651 | Nga01154.02 | 513.59 | 528.86 | class 3 |
| SEQ ID NO: 7652 | Nga02700.02 | 1149.43 | 1155.17 | violaxanthin de-epoxidase |
| SEQ ID NO: 7653 | Nga02696.02 | 1319.67 | 1235.29 | hypothetical protein Dole_0419 [Desulfococcus oleovorans Hxd3] |
| SEQ ID NO: 7654 | Nga07037 | 970.99 | 923.30 | nitric oxide dioxygenase |
| SEQ ID NO: 7655 | Nga07038 | 649.77 | 653.93 | protein |
| SEQ ID NO: 7656 | Nga06798 | 709.68 | 454.26 | ---NA--- |
| SEQ ID NO: 7657 | Nga03334.2 | 481.17 | 513.48 | protein of hypothetical function duf482 |
| SEQ ID NO: 7658 | Nga03340.02 | 605.67 | 647.71 | mitotic checkpoint protein |
| SEQ ID NO: 7659 | Nga01884.1 | 524.67 | 603.25 | s-adenosyl-l-methionine-dependent methyltransferase domain-containing protein |
| SEQ ID NO: 7660 | Nga06406.2 | 4746.49 | 4117.57 | fatty acid elongase |
| SEQ ID NO: 7661 | Nga01885.01 | 3082.19 | 1211.39 | ---NA--- |
| SEQ ID NO: 7662 | Nga02365 | 417.18 | 403.17 | ring u-box domain-containing protein |
| SEQ ID NO: 7663 | Nga01493.02 | 10521.37 | 10349.58 | triosephosphate isomerase |
| SEQ ID NO: 7664 | Nga02189.1 | 538.65 | 556.27 | violaxanthin de-epoxidase-related protein |
| SEQ ID NO: 7665 | Nga00143.02 | 842.33 | 907.80 | conserved uncharacterized protein |
| SEQ ID NO: 7666 | Nga00149.02 | 1285.98 | 1034.00 | ---NA--- |
| SEQ ID NO: 7667 | Nga00779.02 | 5335.74 | 3704.86 | ribulose-phosphate 3-epimerase |
| SEQ ID NO: 7668 | Nga04461.01 | 698.16 | 611.27 | deah (asp-glu-ala-his) box polypeptide 35 |
| SEQ ID NO: 7669 | Nga00669.02 | 324.26 | 434.28 | sumo ligase |
| SEQ ID NO: 7670 | Nga00688.2 | 444.61 | 587.43 | protein |
| SEQ ID NO: 7671 | Nga04546.2 | 609.28 | 509.25 | tetratricopeptide repeat domain-containing protein |
| SEQ ID NO: 7672 | Nga03594.01 | 586.49 | 374.75 | protein |
| SEQ ID NO: 7673 | Nga04389 | 4671.93 | 3990.78 | ---NA--- |
| SEQ ID NO: 7674 | Nga04388 | 8332.87 | 6872.00 | ---NA--- |
| SEQ ID NO: 7675 | Nga02428 | 66.97 | 44.52 | ---NA--- |
| SEQ ID NO: 7676 | Nga02427 | 128.46 | 113.65 | protein |
| SEQ ID NO: 7677 | Nga04768.01 | 315.63 | 389.84 | ---NA--- |
| SEQ ID NO: 7678 | Nga04801 | 2199.10 | 2458.26 | protein |
| SEQ ID NO: 7679 | Nga03925.02 | 1104.40 | 1177.48 | ---NA--- |
| SEQ ID NO: 7680 | Nga03920.02 | 772.96 | 741.56 | cytochrome c oxidase assembly mitochondrial |
| SEQ ID NO: 7681 | Nga03921.2 | 4067.70 | 4165.82 | 40s ribosomal protein s7 |
| SEQ ID NO: 7682 | Nga05039 | 590.80 | 640.86 | ---NA--- |
| SEQ ID NO: 7683 | Nga05041 | 1159.82 | 1553.13 | methylcrotonyl- carboxylase biotin-containing subunit |
| SEQ ID NO: 7684 | Nga20928 | 1188.60 | 1378.18 | myc-induced nuclear antigen |
| SEQ ID NO: 7685 | Nga21153 | 87.79 | 103.36 | ---NA--- |
| SEQ ID NO: 7686 | Nga05040 | 1147.36 | 1530.53 | carboxylase:pyruvate acetyl-coa propionyl-coa |
| SEQ ID NO: 7687 | Nga03857.2 | 105.93 | 100.30 | 72 kda inositol polyphosphate 5-phosphatase-like |
| SEQ ID NO: 7688 | Nga07205 | 55.56 | 55.16 | coiled-coil domain-containing protein 65-like |
| SEQ ID NO: 7689 | Nga03696.02 | 1150.15 | 933.60 | ---NA--- |
| SEQ ID NO: 7690 | Nga07145 | 254.81 | 214.31 | nucleotidyltransferase-like protein |
| SEQ ID NO: 7691 | Nga02493.2 | 102.33 | 114.38 | glutamine |
| SEQ ID NO: 7692 | Nga02330.01 | 2612.90 | 2387.77 | nadh-ubiquinone oxidoreductase kda subunit |
| SEQ ID NO: 7693 | Nga20189.1 | 117.34 | 185.91 | conserved unknown protein [Ectocarpus siliculosus] |
| SEQ ID NO: 7694 | Nga03125.02 | 120.22 | 139.10 | ---NA--- |
| SEQ ID NO: 7695 | Nga20273 | 293.45 | 261.73 | protein |
| SEQ ID NO: 7696 | Nga05831.02 | 1936.49 | 1515.83 | pentapeptide repeat protein |
| SEQ ID NO: 7697 | Nga00081.02 | 451.40 | 552.43 | cyclin dependent kinase |
| SEQ ID NO: 7698 | Nga04797 | 412.18 | 393.31 | phosphatidylinositide phosphatase sac1 |
| SEQ ID NO: 7699 | Nga02218 | 361.78 | 287.13 | abc1 family protein |
| SEQ ID NO: 7700 | Nga00397.02 | 144.85 | 165.12 | fidgetin-like protein |
| SEQ ID NO: 7701 | Nga20048.1 | 923.93 | 819.54 | nudix hydrolase |
| SEQ ID NO: 7702 | Nga20722 | 42.65 | 46.20 | ---NA--- |
| SEQ ID NO: 7703 | Nga01484.02 | 310.61 | 434.34 | mitochondrial phosphate carrier protein 2 |
| SEQ ID NO: 7704 | Nga03849 | 612.78 | 584.38 | ---NA--- |
| SEQ ID NO: 7705 | Nga03846 | 1958.88 | 1520.66 | membrane-associated protein in eicosanoid and glutathione metabolism |
| SEQ ID NO: 7706 | Nga03848.01 | 156.46 | 132.64 | ankyrin repeat-containing protein |

FIGURE 24 DR

| # | Nga model | +N rpkb | -N rpkb | GO |
|---|---|---|---|---|
| SEQ ID NO: 7707 | Nga03845.01 | 493.55 | 405.34 | AF391290_4unknown [Branchiostoma floridae] |
| SEQ ID NO: 7708 | Nga02323.01 | 2494.69 | 2768.12 | elongation factor 1- |
| SEQ ID NO: 7709 | Nga02322 | 1582.21 | 1823.69 | protein |
| SEQ ID NO: 7710 | Nga04994.01 | 756.49 | 695.19 | stromal cell-derived factor 2 |
| SEQ ID NO: 7711 | Nga04996.01 | 1387.65 | 1414.89 | ntp pyrophosphohydrolase |
| SEQ ID NO: 7712 | Nga04995.01 | 2294.03 | 2284.03 | nad-dependent epimerase dehydratase |
| SEQ ID NO: 7713 | Nga05007 | 313.73 | 435.42 | cdp-alcohol phosphatidyltransferase family protein |
| SEQ ID NO: 7714 | Nga05008 | 1831.28 | 1903.46 | protein |
| SEQ ID NO: 7715 | Nga05009 | 101.85 | 70.21 | ---NA--- |
| SEQ ID NO: 7716 | Nga01866 | 598.30 | 732.56 | protein |
| SEQ ID NO: 7717 | Nga05105.2 | 914.78 | 737.06 | ---NA--- |
| SEQ ID NO: 7718 | Nga00965.02 | 26928.68 | 20938.84 | oxygen-evolving enhancer protein |
| SEQ ID NO: 7719 | Nga00966.2 | 738.21 | 652.14 | mitogen-activated protein kinase |
| SEQ ID NO: 7720 | Nga03311 | 221.35 | 267.99 | threonyl-trna synthetase |
| SEQ ID NO: 7721 | Nga03313 | 221.35 | 267.99 | dihydropteroate synthase |
| SEQ ID NO: 7722 | Nga03315 | 221.35 | 267.99 | acetyl-carboxylase |
| SEQ ID NO: 7723 | Nga03316 | 221.35 | 267.99 | aspartate aminotransferase |
| SEQ ID NO: 7724 | Nga03314 | 221.35 | 267.99 | glutamyl-trna amidotransferase subunit a |
| SEQ ID NO: 7725 | Nga03312 | 221.35 | 267.99 | cytidine and deoxycytidylate deaminase family protein |
| SEQ ID NO: 7726 | Nga07084 | 159.17 | 136.77 | predicted protein [Phaeodactylum tricornutum CCAP 1055/1] |
| SEQ ID NO: 7727 | Nga20511 | 175.37 | 189.97 | ---NA--- |
| SEQ ID NO: 7728 | Nga07083 | 168.04 | 125.33 | ---NA--- |
| SEQ ID NO: 7729 | Nga20479 | 277.72 | 288.70 | protein |
| SEQ ID NO: 7730 | Nga04553 | 1097.85 | 1210.19 | eukaryotic translation initiation factor 3 |
| SEQ ID NO: 7731 | Nga20092 | 338.11 | 378.47 | low-co2-inducible protein |
| SEQ ID NO: 7732 | Nga01995 | 49.65 | 53.78 | ---NA--- |
| SEQ ID NO: 7733 | Nga01994 | 2155.14 | 2136.95 | caltractin |
| SEQ ID NO: 7734 | Nga01993 | 806.14 | 814.72 | s-formylglutathione hydrolase |
| SEQ ID NO: 7735 | Nga04569 | 757.58 | 652.40 | ---NA--- |
| SEQ ID NO: 7736 | Nga20300 | 162.62 | 170.08 | methyltransferase-like protein mitochondrial-like |
| SEQ ID NO: 7737 | Nga20470 | 502.48 | 469.22 | e3 ubiquitin-protein ligase upl6 |
| SEQ ID NO: 7738 | Nga20371 | 329.60 | 489.58 | ---NA--- |
| SEQ ID NO: 7739 | Nga04568 | 414.36 | 443.29 | phosphoenolpyruvate carboxylase family protein |
| SEQ ID NO: 7740 | Nga21163.1 | 233.08 | 154.75 | myb-like dna-binding |
| SEQ ID NO: 7741 | Nga01975 | 1652.73 | 1534.90 | ---NA--- |
| SEQ ID NO: 7742 | Nga01973 | 460.09 | 491.87 | swib complex baf60b domain-containing protein |
| SEQ ID NO: 7743 | Nga04897.2 | 463.73 | 488.96 | dnaj-like protein |
| SEQ ID NO: 7744 | Nga05758 | 48.39 | 54.36 | transcription factor |
| SEQ ID NO: 7745 | Nga05761 | 755.60 | 776.30 | ---NA--- |
| SEQ ID NO: 7746 | Nga05757 | 370.27 | 376.69 | protein |
| SEQ ID NO: 7747 | Nga05756 | 1174.35 | 1042.14 | like domain-containing protein |
| SEQ ID NO: 7748 | Nga05752 | 335.44 | 498.33 | phosphoribosylamine--glycine ligase |
| SEQ ID NO: 7749 | Nga05754 | 1135.11 | 1198.99 | e3 ubiquitin-protein ligase rnf8 |
| SEQ ID NO: 7750 | Nga05753 | 504.20 | 694.85 | ---NA--- |
| SEQ ID NO: 7751 | Nga05750 | 863.79 | 826.46 | alanyl-trna synthetase |
| SEQ ID NO: 7752 | Nga05760 | 451.22 | 359.98 | ---NA--- |
| SEQ ID NO: 7753 | Nga05751 | 968.95 | 1052.15 | methylmalonyl coenzyme a mutase |
| SEQ ID NO: 7754 | Nga21045 | 596.74 | 600.89 | signal peptide peptidase |
| SEQ ID NO: 7755 | Nga20265 | 253.15 | 278.76 | predicted protein [Thalassiosira pseudonana CCMP1335] |
| SEQ ID NO: 7756 | Nga05749 | 615.18 | 617.28 | leucyl-trna synthetase |
| SEQ ID NO: 7757 | Nga05759 | 398.55 | 366.33 | myb-like dna-binding shaqkyf class family protein |
| SEQ ID NO: 7758 | Nga05755 | 17316.27 | 15548.33 | transketolase |
| SEQ ID NO: 7759 | Nga05762 | 507.64 | 560.93 | zinc-protease albf |
| SEQ ID NO: 7760 | Nga05748 | 732.66 | 702.46 | ---NA--- |
| SEQ ID NO: 7761 | Nga20370.1 | 283.02 | 324.46 | autophagy ubiquitin-activating enzyme |
| SEQ ID NO: 7762 | Nga04989.01 | 994.89 | 888.85 | protein |
| SEQ ID NO: 7763 | Nga01196.02 | 576.98 | 703.95 | cop9 signalosome complex subunit 2 |
| SEQ ID NO: 7764 | Nga00848.01 | 912.07 | 750.95 | ubiquitin-conjugating enzyme |
| SEQ ID NO: 7765 | Nga00847 | 509.43 | 562.06 | hypothetical protein AURANDRAFT_63946 [Aureococcus anophagefferens] |
| SEQ ID NO: 7766 | Nga00851.01 | 151.62 | 199.44 | ---NA--- |
| SEQ ID NO: 7767 | Nga00850.1 | 1465.64 | 1654.48 | ---NA--- |
| SEQ ID NO: 7768 | Nga00846.01 | 193.32 | 915.00 | ---NA--- |
| SEQ ID NO: 7769 | Nga00845.01 | 388.86 | 398.35 | at4g35080-like protein |

FIGURE 24 DS

| # | Nga model | +N rpkb | -N rpkb | GO |
|---|---|---|---|---|
| SEQ ID NO: 7770 | Nga00849.01 | 242.17 | 287.01 | set domain-containing protein |
| SEQ ID NO: 7771 | Nga03576.02 | 333.33 | 350.46 | 60s ribosome subunit biogenesis protein nip7 homolog |
| SEQ ID NO: 7772 | Nga06988 | 10.42 | 22.57 | ---NA--- |
| SEQ ID NO: 7773 | Nga04873.1 | 4269.75 | 3098.89 | ---NA--- |
| SEQ ID NO: 7774 | Nga04419.01 | 1411.92 | 1395.58 | trigger factor |
| SEQ ID NO: 7775 | Nga04420 | 24341.74 | 25732.61 | ---NA--- |
| SEQ ID NO: 7776 | Nga07283 | 656.86 | 727.47 | ---NA--- |
| SEQ ID NO: 7777 | Nga07282 | 258.59 | 299.64 | kynurenine-oxoglutarate transaminase |
| SEQ ID NO: 7778 | Nga04735.2 | 258.05 | 349.26 | aldehyde dehydrogenase family |
| SEQ ID NO: 7779 | Nga04088 | 208.59 | 250.32 | ---NA--- |
| SEQ ID NO: 7780 | Nga01508.2 | 2612.36 | 3093.51 | threonine aldolase |
| SEQ ID NO: 7781 | Nga04090 | 1417.81 | 1758.64 | threonine aldolase |
| SEQ ID NO: 7782 | Nga01081 | 223.50 | 215.49 | duf1253 domain-containing protein |
| SEQ ID NO: 7783 | Nga01080 | 1151.73 | 1030.43 | conserved unknown protein [Ectocarpus siliculosus] |
| SEQ ID NO: 7784 | Nga01083 | 4160.56 | 3647.33 | stress-induced protein sti1 |
| SEQ ID NO: 7785 | Nga01082 | 2228.90 | 1823.67 | amino acid dehydrogenase family protein |
| SEQ ID NO: 7786 | Nga01084 | 194.33 | 223.66 | dhhc zinc finger domain containing protein |
| SEQ ID NO: 7787 | Nga04683 | 169.40 | 134.17 | ---NA--- |
| SEQ ID NO: 7788 | Nga02247.2 | 695.04 | 664.81 | histone deacetylase |
| SEQ ID NO: 7789 | Nga04686 | 279.07 | 214.13 | chloride channel protein 7 |
| SEQ ID NO: 7790 | Nga04682 | 1089.17 | 1282.42 | glutathione reductase |
| SEQ ID NO: 7791 | Nga04685 | 280.25 | 227.00 | monovalent cation:proton antiporter1 family |
| SEQ ID NO: 7792 | Nga20446 | 172.13 | 216.65 | predicted protein [Thalassiosira pseudonana CCMP1335] |
| SEQ ID NO: 7793 | Nga01595 | 215.69 | 252.95 | serine threonine protein kinase |
| SEQ ID NO: 7794 | Nga01596 | 212.45 | 261.88 | mitogen activated protein kinase-like protein |
| SEQ ID NO: 7795 | Nga01593 | 597.08 | 623.68 | aspartylglucosaminidase |
| SEQ ID NO: 7796 | Nga01594 | 1463.39 | 1319.91 | proteasome subunit |
| SEQ ID NO: 7797 | Nga01871 | 2281.25 | 2286.07 | ---NA--- |
| SEQ ID NO: 7798 | Nga01872 | 171.25 | 168.48 | 2-phosphodiesterase 12- partial |
| SEQ ID NO: 7799 | Nga04537 | 76.50 | 102.60 | u3 small nucleolar rna-associated protein 10 and nuc211 domain-containing protein |
| SEQ ID NO: 7800 | Nga02484.2 | 8670.94 | 10558.30 | Aardvark [Ectocarpus siliculosus] |
| SEQ ID NO: 7801 | Nga04666 | 257.73 | 247.54 | protein |
| SEQ ID NO: 7802 | Nga01620 | 7413.76 | 6265.04 | beta-ig-h3 fasciclin |
| SEQ ID NO: 7803 | Nga01621 | 87.41 | 141.22 | adaptor protein kanadaptin |
| SEQ ID NO: 7804 | Nga01619 | 339.74 | 361.30 | rna polymerase ii associated protein 2 |
| SEQ ID NO: 7805 | Nga01419.2 | 357.51 | 406.42 | cullin-associated nedd8-dissociated protein 1 |
| SEQ ID NO: 7806 | Nga01418.02 | 692.90 | 666.08 | protein |
| SEQ ID NO: 7807 | Nga20421.1 | 323.89 | 350.85 | ---NA--- |
| SEQ ID NO: 7808 | Nga01579 | 312.29 | 433.65 | ---NA--- |
| SEQ ID NO: 7809 | Nga01582.01 | 532.14 | 464.71 | ---NA--- |
| SEQ ID NO: 7810 | Nga03017.2 | 404.03 | 455.47 | protein |
| SEQ ID NO: 7811 | Nga01580 | 287.48 | 331.09 | splicing factor 3a |
| SEQ ID NO: 7812 | Nga04279 | 355.04 | 307.34 | ---NA--- |
| SEQ ID NO: 7813 | Nga04280 | 5.21 | 16.93 | ---NA--- |
| SEQ ID NO: 7814 | Nga00267.02 | 818.78 | 835.86 | px domain containing protein |
| SEQ ID NO: 7815 | Nga00264.02 | 515.77 | 588.97 | ccr4-not transcription complex subunit 10 |
| SEQ ID NO: 7816 | Nga20976.1 | 455.05 | 416.63 | conserved hypothetical protein [Phytophthora infestans T30-4] |
| SEQ ID NO: 7817 | Nga04254 | 4281.71 | 3874.40 | 30s ribosomal protein s21 |
| SEQ ID NO: 7818 | Nga04479 | 161.62 | 166.56 | protein |
| SEQ ID NO: 7819 | Nga04480 | 128.21 | 126.72 | protein |
| SEQ ID NO: 7820 | Nga05005 | 980.23 | 1531.01 | ---NA--- |
| SEQ ID NO: 7821 | Nga04872 | 1396.32 | 1556.02 | ---NA--- |
| SEQ ID NO: 7822 | Nga02127 | 1599.40 | 2262.83 | protein |
| SEQ ID NO: 7823 | Nga02128.1 | 271.83 | 466.39 | ---NA--- |
| SEQ ID NO: 7824 | Nga01898.01 | 25470.99 | 15573.13 | light-harvesting protein |
| SEQ ID NO: 7825 | Nga01899.1 | 238.90 | 301.24 | autophagy-related protein 7 |
| SEQ ID NO: 7826 | Nga01900.01 | 3330.41 | 3329.94 | protein |
| SEQ ID NO: 7827 | Nga03733.1 | 793.96 | 825.93 | obtusifoliol 14-alpha demethylase |
| SEQ ID NO: 7828 | Nga03732 | 827.66 | 708.65 | signal peptidase i |
| SEQ ID NO: 7829 | Nga02805.2 | 1504.93 | 1312.22 | uncharacterized fam18-like protein cg5021 |
| SEQ ID NO: 7830 | Nga03146.2 | 107.14 | 107.46 | ---NA--- |
| SEQ ID NO: 7831 | Nga03152.2 | 319.58 | 293.59 | hydrolase-like protein |
| SEQ ID NO: 7832 | Nga21117 | 126.69 | 118.94 | protein |

FIGURE 24 DT

| # | Nga model | +N rpkb | -N rpkb | GO |
|---|---|---|---|---|
| SEQ ID NO: 7833 | Nga20550 | 160.00 | 205.81 | ---NA--- |
| SEQ ID NO: 7834 | Nga04380 | 5927.89 | 6519.30 | ---NA--- |
| SEQ ID NO: 7835 | Nga04517 | 571.63 | 460.95 | peptidyl-prolyl cis-trans isomerase b precursor |
| SEQ ID NO: 7836 | Nga06678.1 | 3382.79 | 2908.75 | protein |
| SEQ ID NO: 7837 | Nga20649 | 131.94 | 173.02 | ---NA--- |
| SEQ ID NO: 7838 | Nga20018 | 48.00 | 60.66 | ---NA--- |
| SEQ ID NO: 7839 | Nga06682 | 3057.97 | 2960.84 | unnamed protein product [Blastocystis hominis] |
| SEQ ID NO: 7840 | Nga03817.02 | 595.45 | 658.24 | soluble pyridine nucleotide transhydrogenase |
| SEQ ID NO: 7841 | Nga06679 | 612.01 | 632.57 | nuclear cap-binding protein subunit 1 |
| SEQ ID NO: 7842 | Nga03818.02 | 401.53 | 394.66 | cop9 complex subunit 7a |
| SEQ ID NO: 7843 | Nga06677 | 765.06 | 883.40 | nitrite transporter nar1 |
| SEQ ID NO: 7844 | Nga06681 | 558.68 | 443.80 | protein |
| SEQ ID NO: 7845 | Nga06683.1 | 417.18 | 427.24 | ufm1-specific protease |
| SEQ ID NO: 7846 | Nga06676 | 1832.86 | 1118.11 | protein |
| SEQ ID NO: 7847 | Nga03820.2 | 594.71 | 774.65 | predicted protein [Thalassiosira pseudonana CCMP1335] |
| SEQ ID NO: 7848 | Nga04907 | 474.78 | 532.11 | ran gtpase activating protein 1 |
| SEQ ID NO: 7849 | Nga20009 | 553.01 | 563.52 | dual-specificity tyrosine- -phosphorylation regulated kinase 1b |
| SEQ ID NO: 7850 | Nga02198.2 | 267.59 | 327.20 | inositol polyphosphate 5-phosphatase ocrl-1 |
| SEQ ID NO: 7851 | Nga01848.02 | 817.03 | 538.20 | ---NA--- |
| SEQ ID NO: 7852 | Nga01689 | 3811.04 | 4211.57 | sigma 54 modulation protein ribosomal protein s30ea |
| SEQ ID NO: 7853 | Nga01688 | 515.24 | 465.10 | protein |
| SEQ ID NO: 7854 | Nga01691 | 157.94 | 152.49 | ribosomal pseudouridine |
| SEQ ID NO: 7855 | Nga01690 | 1668.47 | 2127.86 | sigma 54 modulation protein ribosomal protein s30ea |
| SEQ ID NO: 7856 | Nga01692 | 357.04 | 377.51 | ---NA--- |
| SEQ ID NO: 7857 | Nga21095 | 352.59 | 338.25 | major facilitator superfamily |
| SEQ ID NO: 7858 | Nga01734 | 219.88 | 177.32 | 3-dehydroquinate synthase |
| SEQ ID NO: 7859 | Nga00788 | 1562.80 | 1582.11 | sulfate transporter |
| SEQ ID NO: 7860 | Nga00789 | 588.59 | 442.84 | protein |
| SEQ ID NO: 7861 | Nga01413 | 390.90 | 272.62 | protein |
| SEQ ID NO: 7862 | Nga01415 | 331.89 | 333.66 | ---NA--- |
| SEQ ID NO: 7863 | Nga01414 | 186.44 | 190.59 | drug metabolite transporter superfamily |
| SEQ ID NO: 7864 | Nga20630 | 74.20 | 103.35 | phytoene dehydrogenase |
| SEQ ID NO: 7865 | Nga01412 | 9647.34 | 10464.74 | protein |
| SEQ ID NO: 7866 | Nga07004 | 1041.21 | 1174.87 | h aca ribonucleoprotein complex subunit 1 |
| SEQ ID NO: 7867 | Nga03397.2 | 957.21 | 1058.84 | ribulose-phosphate 3-epimerase |
| SEQ ID NO: 7868 | Nga20136 | 556.89 | 660.97 | glycine oxidase |
| SEQ ID NO: 7869 | Nga07052 | 212.70 | 354.20 | ---NA--- |
| SEQ ID NO: 7870 | Nga06952 | 132.13 | 201.68 | ---NA--- |
| SEQ ID NO: 7871 | Nga03770 | 1866.04 | 2662.90 | ---NA--- |
| SEQ ID NO: 7872 | Nga04630 | 418.70 | 473.36 | fatty acid desaturase |
| SEQ ID NO: 7873 | Nga06739.2 | 1392.58 | 1334.65 | dihydroceramide delta -desaturase |
| SEQ ID NO: 7874 | Nga04550 | 2787.04 | 2693.04 | histone h3 |
| SEQ ID NO: 7875 | Nga04549 | 295.00 | 337.61 | mitochondrial inner membrane protease subunit 1-like |
| SEQ ID NO: 7876 | Nga20987 | 301.08 | 205.78 | ---NA--- |
| SEQ ID NO: 7877 | Nga20391 | 193.55 | 244.60 | wd repeat domain 61 |
| SEQ ID NO: 7878 | Nga21064 | 131.81 | 139.67 | ---NA--- |
| SEQ ID NO: 7879 | Nga04016 | 120.55 | 207.74 | conserved unknown protein [Ectocarpus siliculosus] |
| SEQ ID NO: 7880 | Nga02342 | 94.86 | 85.47 | zinc-binding dehydrogenase |
| SEQ ID NO: 7881 | Nga04346.01 | 876.42 | 824.31 | dna replication complex gins protein psf3 |
| SEQ ID NO: 7882 | Nga04347 | 207.65 | 221.97 | u2 snrnp component ist3 |
| SEQ ID NO: 7883 | Nga04100 | 72.00 | 58.74 | conserved domain protein |
| SEQ ID NO: 7884 | Nga01685 | 424.39 | 547.78 | ---NA--- |
| SEQ ID NO: 7885 | Nga04435 | 185.33 | 271.85 | ---NA--- |
| SEQ ID NO: 7886 | Nga02201.2 | 474.15 | 494.31 | gpn-loop gtpase 2 |
| SEQ ID NO: 7887 | Nga04695 | 844.91 | 1040.61 | ---NA--- |
| SEQ ID NO: 7888 | Nga04694 | 56.79 | 101.64 | ---NA--- |
| SEQ ID NO: 7889 | Nga04692 | 50.96 | 71.30 | ---NA--- |
| SEQ ID NO: 7890 | Nga04693 | 510.52 | 720.79 | expulsion defective family member (exp-2) |
| SEQ ID NO: 7891 | Nga04020.02 | 723.88 | 825.90 | short chain dehydrogenase reductase family |
| SEQ ID NO: 7892 | Nga02071 | 201.14 | 178.83 | ---NA--- |
| SEQ ID NO: 7893 | Nga02070 | 668.07 | 732.02 | protein |
| SEQ ID NO: 7894 | Nga02073 | 257.98 | 249.20 | ---NA--- |
| SEQ ID NO: 7895 | Nga02072 | 23646.06 | 17587.78 | ---NA--- |
| SEQ ID NO: 7896 | Nga04838.1 | 179.49 | 147.21 | ---NA--- |

FIGURE 24 DU

| # | Nga model | +N rpkb | -N rpkb | GO |
|---|---|---|---|---|
| SEQ ID NO: 7897 | Nga01546.2 | 686.04 | 739.21 | ---NA--- |
| SEQ ID NO: 7898 | Nga04830 | 35.21 | 61.03 | ---NA--- |
| SEQ ID NO: 7899 | Nga03988 | 633.15 | 584.30 | ---NA--- |
| SEQ ID NO: 7900 | Nga03986 | 976.83 | 784.28 | conserved hypothetical protein |
| SEQ ID NO: 7901 | Nga03987 | 288.85 | 332.52 | |
| SEQ ID NO: 7902 | Nga20979 | 686.24 | 770.15 | hit-type zinc finger protein |
| SEQ ID NO: 7903 | Nga03985 | 713.93 | 578.67 | myb-like dna-binding |
| SEQ ID NO: 7904 | Nga20324 | 59.21 | 117.59 | ---NA--- |
| SEQ ID NO: 7905 | Nga03989 | 822.53 | 1059.82 | selenocysteine-specific elongation factor |
| SEQ ID NO: 7906 | Nga04772 | 445.90 | 507.88 | ---NA--- |
| SEQ ID NO: 7907 | Nga07054.2 | 473.03 | 488.39 | ---NA--- |
| SEQ ID NO: 7908 | Nga04771 | 225.98 | 181.35 | predicted protein [Micromonas pusilla CCMP1545] |
| SEQ ID NO: 7909 | Nga04250 | 421.05 | 541.62 | ---NA--- |
| SEQ ID NO: 7910 | Nga03715 | 593.50 | 714.33 | ---NA--- |
| SEQ ID NO: 7911 | Nga03712 | 667.32 | 753.19 | taurine dioxygenase |
| SEQ ID NO: 7912 | Nga20222 | 217.35 | 198.42 | methyltransferase like 8 |
| SEQ ID NO: 7913 | Nga03714 | 1523.95 | 1741.61 | ---NA--- |
| SEQ ID NO: 7914 | Nga03713 | 48.03 | 73.37 | urease |
| SEQ ID NO: 7915 | Nga20144 | 360.43 | 338.10 | morn repeat-containing protein |
| SEQ ID NO: 7916 | Nga04749 | 1111.11 | 1152.01 | ---NA--- |
| SEQ ID NO: 7917 | Nga07264 | 31.86 | 20.20 | inorganic phosphate |
| SEQ ID NO: 7918 | Nga07033 | 113.82 | 296.49 | ---NA--- |
| SEQ ID NO: 7919 | Nga04342.02 | 517.79 | 528.12 | dna-directed rna polymerases and iii kda polypeptide |
| SEQ ID NO: 7920 | Nga04343.02 | 18888.24 | 14347.11 | ---NA--- |
| SEQ ID NO: 7921 | Nga01725 | 244.05 | 267.58 | 6-pyruvoyl tetrahydropterin synthase |
| SEQ ID NO: 7922 | Nga01726 | 166.89 | 134.86 | beta-lactamase |
| SEQ ID NO: 7923 | Nga01724 | 167.35 | 202.65 | ap4a phosphorylase ii |
| SEQ ID NO: 7924 | Nga21260 | 126.48 | 119.88 | protein |
| SEQ ID NO: 7925 | Nga04586 | 1903.95 | 2170.40 | ---NA--- |
| SEQ ID NO: 7926 | Nga06887 | 238.64 | 255.57 | zinc finger ran-binding domain-containing protein 3 |
| SEQ ID NO: 7927 | Nga06888 | 213.81 | 182.70 | bis(5 -adenosyl)-triphosphatase |
| SEQ ID NO: 7928 | Nga01188 | 113.06 | 145.70 | conserved unknown protein [Ectocarpus siliculosus] |
| SEQ ID NO: 7929 | Nga01189 | 270.33 | 299.43 | alanine--glyoxylate transaminase |
| SEQ ID NO: 7930 | Nga20239 | 322.96 | 298.49 | aminotransferase class-iii |
| SEQ ID NO: 7931 | Nga03398.02 | 2625.09 | 3123.45 | ---NA--- |
| SEQ ID NO: 7932 | Nga03395.02 | 617.11 | 421.31 | alkaline phosphatase d |
| SEQ ID NO: 7933 | Nga06949 | 28.04 | 60.74 | ---NA--- |
| SEQ ID NO: 7934 | Nga01718.01 | 1024.82 | 1024.72 | glutathione s-transferase |
| SEQ ID NO: 7935 | Nga01716 | 6781.52 | 6113.98 | -epimerase 4-reductase |
| SEQ ID NO: 7936 | Nga01717 | 4875.75 | 4644.83 | protein |
| SEQ ID NO: 7937 | Nga20050 | 281.76 | 207.13 | vacuolar amino acid transporter 6 |
| SEQ ID NO: 7938 | Nga04455 | 6215.19 | 6309.40 | 60s ribosomal protein l31 |
| SEQ ID NO: 7939 | Nga05471 | 209.82 | 257.91 | lipoate-protein ligase b |
| SEQ ID NO: 7940 | Nga05473 | 194.69 | 92.67 | ---NA--- |
| SEQ ID NO: 7941 | Nga05479.01 | 231.58 | 228.05 | ---NA--- |
| SEQ ID NO: 7942 | Nga05475 | 406.14 | 435.33 | short-chain dehydrogenase reductase sdr |
| SEQ ID NO: 7943 | Nga05472 | 4134.40 | 4151.57 | conserved unknown protein [Ectocarpus siliculosus] |
| SEQ ID NO: 7944 | Nga05469 | 412.30 | 455.25 | peptide methionine sulfoxide reductase |
| SEQ ID NO: 7945 | Nga05474 | 444.44 | 404.41 | heat shock protein atpase subunit |
| SEQ ID NO: 7946 | Nga05476 | 644.96 | 725.51 | pyridoxamine phosphate |
| SEQ ID NO: 7947 | Nga05477 | 487.91 | 590.15 | atp-dependent protease atp-binding subunit |
| SEQ ID NO: 7948 | Nga05468 | 167.21 | 232.12 | uncharacterized protein yjr111c |
| SEQ ID NO: 7949 | Nga05470 | 2328.47 | 2825.37 | domain-containing protein |
| SEQ ID NO: 7950 | Nga02423.1 | 477.62 | 861.12 | methylenetetrahydrofolate dehydrogenase |
| SEQ ID NO: 7951 | Nga02425.01 | 694.25 | 646.35 | er lumen protein retaining receptor |
| SEQ ID NO: 7952 | Nga06601.2 | 394.31 | 433.70 | ribonucleoside triphosphate reductase |
| SEQ ID NO: 7953 | Nga04701 | 177.72 | 227.76 | ---NA--- |
| SEQ ID NO: 7954 | Nga04464 | 202.49 | 236.22 | conserved unknown protein [Ectocarpus siliculosus] |
| SEQ ID NO: 7955 | Nga02088.01 | 2302.26 | 2571.78 | protein |
| SEQ ID NO: 7956 | Nga21060 | 449.75 | 535.37 | protein |
| SEQ ID NO: 7957 | Nga03623 | 151.30 | 104.20 | ferroxidase |
| SEQ ID NO: 7958 | Nga07044 | 688.52 | 414.35 | histone h4 |
| SEQ ID NO: 7959 | Nga02813.02 | 226.29 | 307.50 | protein |
| SEQ ID NO: 7960 | Nga02819.02 | 385.71 | 330.13 | ---NA--- |

FIGURE 24 DV

| # | Nga model | +N rpkb | -N rpkb | GO |
|---|---|---|---|---|
| SEQ ID NO: 7961 | Nga02820.2 | 871.08 | 761.16 | ---NA--- |
| SEQ ID NO: 7962 | Nga02817.02 | 1953.22 | 1704.03 | polymerase ii (dna directed) polypeptide e |
| SEQ ID NO: 7963 | Nga01057.02 | 382.95 | 325.41 | protein |
| SEQ ID NO: 7964 | Nga04452.01 | 3876.38 | 5172.26 | ---NA--- |
| SEQ ID NO: 7965 | Nga01642 | 295.88 | 405.71 | ---NA--- |
| SEQ ID NO: 7966 | Nga01266.02 | 264.81 | 275.18 | dhhc zinc finger domain-containing protein |
| SEQ ID NO: 7967 | Nga01990 | 2460.18 | 2358.19 | ---NA--- |
| SEQ ID NO: 7968 | Nga03564 | 909.60 | 843.03 | ---NA--- |
| SEQ ID NO: 7969 | Nga03560 | 1356.82 | 1317.11 | ubiquitin-like protein nedd8 |
| SEQ ID NO: 7970 | Nga03563 | 628.32 | 642.27 | ---NA--- |
| SEQ ID NO: 7971 | Nga20170 | 269.84 | 302.88 | conserved unknown protein [Ectocarpus siliculosus] |
| SEQ ID NO: 7972 | Nga03565 | 495.31 | 734.69 | ribosomal protein l11 methyltransferase |
| SEQ ID NO: 7973 | Nga03561 | 184.50 | 206.85 | atp phosphoribosyltransferase |
| SEQ ID NO: 7974 | Nga20619 | 97.87 | 106.02 | tetratricopeptide repeat protein |
| SEQ ID NO: 7975 | Nga20504 | 60.84 | 94.73 | ---NA--- |
| SEQ ID NO: 7976 | Nga21233 | 67.01 | 117.26 | tpr domain-containing protein |
| SEQ ID NO: 7977 | Nga03562 | 954.35 | 1437.10 | 30s ribosomal protein s9 |
| SEQ ID NO: 7978 | Nga07244 | 475.47 | 380.15 | ---NA--- |
| SEQ ID NO: 7979 | Nga07245 | 287.15 | 229.84 | mmpl domain protein |
| SEQ ID NO: 7980 | Nga04162.02 | 351.85 | 272.24 | ---NA--- |
| SEQ ID NO: 7981 | Nga04719 | 61.47 | 35.85 | ---NA--- |
| SEQ ID NO: 7982 | Nga04720 | 77.80 | 109.07 | ---NA--- |
| SEQ ID NO: 7983 | Nga04261.1 | 719.39 | 1022.90 | adenosine deaminase |
| SEQ ID NO: 7984 | Nga00028.02 | 32.92 | 84.70 | ---NA--- |
| SEQ ID NO: 7985 | Nga00029.02 | 164.38 | 136.85 | mmp37-like mitochondrial precursor |
| SEQ ID NO: 7986 | Nga00923 | 567.52 | 549.29 | nitrilase member 2 |
| SEQ ID NO: 7987 | Nga00920 | 765.38 | 700.92 | conserved unknown protein [Ectocarpus siliculosus] |
| SEQ ID NO: 7988 | Nga00919 | 1813.44 | 1669.20 | long-chain acyl- synthetase 7 |
| SEQ ID NO: 7989 | Nga00924 | 4435.03 | 4967.37 | ribosomal protein rpl30 |
| SEQ ID NO: 7990 | Nga00922 | 169.08 | 99.43 | nuclear prelamin a recognition factor-like protein |
| SEQ ID NO: 7991 | Nga00921 | 916.21 | 895.79 | protein |
| SEQ ID NO: 7992 | Nga01152.02 | 187.30 | 257.91 | ---NA--- |
| SEQ ID NO: 7993 | Nga06934 | 205.61 | 245.68 | amino acid transport protein |
| SEQ ID NO: 7994 | Nga21206 | 138.24 | 127.44 | predicted protein [Phaeodactylum tricornutum CCAP 1055/1] |
| SEQ ID NO: 7995 | Nga21111 | 339.39 | 481.10 | expressed unknown protein [Ectocarpus siliculosus] |
| SEQ ID NO: 7996 | Nga02665.02 | 6477.17 | 6628.01 | conserved hypothetical protein [Phytophthora infestans T30-4] |
| SEQ ID NO: 7997 | Nga01346 | 134.22 | 149.48 | myotubularin related protein 3 |
| SEQ ID NO: 7998 | Nga00257.2 | 709.01 | 743.00 | ---NA--- |
| SEQ ID NO: 7999 | Nga01349 | 1020.83 | 1145.29 | protein |
| SEQ ID NO: 8000 | Nga01348 | 13756.91 | 15883.44 | ---NA--- |
| SEQ ID NO: 8001 | Nga01350 | 26779.69 | 27727.40 | ---NA--- |
| SEQ ID NO: 8002 | Nga01347 | 275.30 | 293.83 | ---NA--- |
| SEQ ID NO: 8003 | Nga04505.01 | 1002.05 | 1358.48 | ankyrin |
| SEQ ID NO: 8004 | Nga04504.01 | 4897.14 | 5041.69 | 3-ketoacyl- mitochondrial |
| SEQ ID NO: 8005 | Nga02057 | 306.78 | 257.23 | 5-methyltetrahydropteroyltriglutamate--homocysteine s-methyltransferase |
| SEQ ID NO: 8006 | Nga02058 | 310.10 | 271.75 | ---NA--- |
| SEQ ID NO: 8007 | Nga04374 | 1280.00 | 1335.99 | protein |
| SEQ ID NO: 8008 | Nga04013.1 | 410.44 | 447.00 | peroxisome biosynthesis protein (pas1 peroxin-1) |
| SEQ ID NO: 8009 | Nga03870 | 146.48 | 213.65 | alpha beta domain protein |
| SEQ ID NO: 8010 | Nga03872 | 422.74 | 375.82 | uncharacterized protein hp_0274 |
| SEQ ID NO: 8011 | Nga03871 | 453.37 | 408.66 | ---NA--- |
| SEQ ID NO: 8012 | Nga05011 | 1133.76 | 917.64 | translation initiation factor 2 alpha |
| SEQ ID NO: 8013 | Nga05010 | 1880.07 | 2385.69 | activating transcription factor 6 |
| SEQ ID NO: 8014 | Nga05012 | 1356.81 | 1362.94 | eukaryotic translation initiation factor subunit 1 alpha |
| SEQ ID NO: 8015 | Nga05774.2 | 266.18 | 279.07 | protein |
| SEQ ID NO: 8016 | Nga03919.02 | 883.08 | 870.36 | like protein |
| SEQ ID NO: 8017 | Nga03917.02 | 409.64 | 453.68 | structural maintenance of chromosomes 1 |
| SEQ ID NO: 8018 | Nga02242.02 | 502.99 | 507.89 | drug metabolite transporter superfamily |
| SEQ ID NO: 8019 | Nga04679 | 140.74 | 176.53 | ---NA--- |
| SEQ ID NO: 8020 | Nga04477 | 7022.60 | 7652.60 | large subunit ribosomal protein l10e |
| SEQ ID NO: 8021 | Nga01713 | 130.26 | 158.47 | mutl homolog colon nonpolyposis type 2 ( coli) |
| SEQ ID NO: 8022 | Nga01714 | 230.28 | 150.35 | protein |
| SEQ ID NO: 8023 | Nga06240.02 | 938.43 | 1181.71 | glucose-methanol-choline oxidoreductase |

FIGURE 24 DW

| # | Nga model | +N rpkb | -N rpkb | GO |
|---|---|---|---|---|
| SEQ ID NO: 8024 | Nga04308 | 1169.30 | 1191.21 | small gtp-binding protein |
| SEQ ID NO: 8025 | Nga00448.02 | 26082.30 | 12065.79 | light harvesting complex protein |
| SEQ ID NO: 8026 | Nga07220 | 1185.86 | 1199.22 | glycosyl bnr protein |
| SEQ ID NO: 8027 | Nga01460.01 | 97.11 | 36.96 | riken cdna 6720467c03 isoform cra_a |
| SEQ ID NO: 8028 | Nga21224.1 | 93.62 | 69.14 | conserved unknown protein [Ectocarpus siliculosus] |
| SEQ ID NO: 8029 | Nga01459.01 | 828.36 | 775.11 | methionine aminopeptidase |
| SEQ ID NO: 8030 | Nga01458.01 | 7968.76 | 9166.47 | delta-9 acyl-desaturase |
| SEQ ID NO: 8031 | Nga01457.01 | 2910.32 | 2344.79 | ---NA--- |
| SEQ ID NO: 8032 | Nga20764.1 | 329.59 | 273.85 | tubulin tyrosine ligase |
| SEQ ID NO: 8033 | Nga20162 | 295.51 | 380.13 | protein |
| SEQ ID NO: 8034 | Nga20819 | 269.04 | 356.40 | conserved unknown protein [Ectocarpus siliculosus] |
| SEQ ID NO: 8035 | Nga01630 | 623.03 | 538.20 | splicing factor 3 subunit |
| SEQ ID NO: 8036 | Nga20191 | 400.53 | 355.83 | kinesin family member 2c |
| SEQ ID NO: 8037 | Nga01970 | 189.91 | 163.93 | ---NA--- |
| SEQ ID NO: 8038 | Nga01969 | 10683.75 | 11280.18 | ribosomal protein l19 |
| SEQ ID NO: 8039 | Nga05775.2 | 126.41 | 162.74 | rep helicase |
| SEQ ID NO: 8040 | Nga04786.01 | 69.89 | 75.71 | ---NA--- |
| SEQ ID NO: 8041 | Nga00735 | 652.75 | 432.21 | ---NA--- |
| SEQ ID NO: 8042 | Nga00736 | 151.79 | 48.36 | ---NA--- |
| SEQ ID NO: 8043 | Nga04113 | 106.71 | 142.86 | low quality protein: uncharacterized protein kiaa0564-like |
| SEQ ID NO: 8044 | Nga04111 | 2798.80 | 2630.40 | ubiquitin family protein |
| SEQ ID NO: 8045 | Nga20114 | 580.61 | 541.88 | polymyositis scleroderma autoantigen 1 |
| SEQ ID NO: 8046 | Nga04112 | 1040.75 | 1186.22 | dihydropteridine reductase |
| SEQ ID NO: 8047 | Nga20565 | 92.49 | 62.61 | ---NA--- |
| SEQ ID NO: 8048 | Nga03834 | 184.19 | 158.91 | wsc domain containing 1 |
| SEQ ID NO: 8049 | Nga03833 | 256.16 | 220.12 | chaperone protein |
| SEQ ID NO: 8050 | Nga06812 | 3180.74 | 4098.64 | ---NA--- |
| SEQ ID NO: 8051 | Nga20589 | 140.85 | 91.54 | cathepsin c |
| SEQ ID NO: 8052 | Nga06608 | 437.13 | 546.94 | protein |
| SEQ ID NO: 8053 | Nga06610 | 4206.79 | 5004.96 | 60s ribosomal protein l3 |
| SEQ ID NO: 8054 | Nga20729 | 345.38 | 360.31 | protein transport protein sec24b-like |
| SEQ ID NO: 8055 | Nga06611 | 239.32 | 370.34 | ---NA--- |
| SEQ ID NO: 8056 | Nga06609 | 24.69 | 13.37 | ---NA--- |
| SEQ ID NO: 8057 | Nga03531 | 176.74 | 189.81 | ---NA--- |
| SEQ ID NO: 8058 | Nga03533 | 183.80 | 276.71 | voltage-gated ion channel superfamily |
| SEQ ID NO: 8059 | Nga03529 | 870.65 | 705.99 | acyl- -binding protein |
| SEQ ID NO: 8060 | Nga03532 | 254.72 | 235.04 | ---NA--- |
| SEQ ID NO: 8061 | Nga03530 | 125.00 | 126.81 | ---NA--- |
| SEQ ID NO: 8062 | Nga06884.1 | 304.21 | 253.28 | soluble pyridine nucleotide transhydrogenase |
| SEQ ID NO: 8063 | Nga05183.2 | 314.78 | 411.62 | protein |
| SEQ ID NO: 8064 | Nga06883 | 320.63 | 281.98 | soluble pyridine nucleotide transhydrogenase |
| SEQ ID NO: 8065 | Nga02260 | 146.50 | 262.18 | ---NA--- |
| SEQ ID NO: 8066 | Nga02259 | 216.56 | 183.99 | derlin (degradation in endoplasmic reticulum protein ) (der1-like protein) |
| SEQ ID NO: 8067 | Nga02261 | 925.61 | 657.81 | ---NA--- |
| SEQ ID NO: 8068 | Nga02258 | 3750.68 | 2491.73 | hypothetical protein [Gracilariopsis andersonii] |
| SEQ ID NO: 8069 | Nga04427 | 923.08 | 999.91 | acylphosphatase erythrocyte type isoform cra_a |
| SEQ ID NO: 8070 | Nga04783 | 76.92 | 77.15 | ---NA--- |
| SEQ ID NO: 8071 | Nga04782 | 211.59 | 222.83 | methyltransferase family |
| SEQ ID NO: 8072 | Nga01030.02 | 2352.40 | 2701.89 | ---NA--- |
| SEQ ID NO: 8073 | Nga01951 | 208.89 | 163.69 | anaphase promoting complex subunit 3 |
| SEQ ID NO: 8074 | Nga04355 | 78.63 | 96.29 | ---NA--- |
| SEQ ID NO: 8075 | Nga02356 | 260.45 | 306.51 | ---NA--- |
| SEQ ID NO: 8076 | Nga02355 | 776.14 | 539.22 | protein-tyrosine low molecular weight |
| SEQ ID NO: 8077 | Nga02358 | 584.36 | 624.69 | hypothetical protein GOALK_097_02160 [Gordonia alkanivorans NBRC 16433] |
| SEQ ID NO: 8078 | Nga02357 | 259.02 | 354.56 | ---NA--- |
| SEQ ID NO: 8079 | Nga04714 | 1287.96 | 1010.02 | gdp-fucose transporter 1-like |
| SEQ ID NO: 8080 | Nga05027 | 1146.84 | 1179.37 | p-type had subfamily ic |
| SEQ ID NO: 8081 | Nga04921 | 848.33 | 1200.58 | leukocyte receptor cluster member 8-like protein |
| SEQ ID NO: 8082 | Nga04922 | 199.31 | 178.68 | ---NA--- |
| SEQ ID NO: 8083 | Nga02239.02 | 275.29 | 249.66 | protein |
| SEQ ID NO: 8084 | Nga00490.02 | 783.65 | 773.93 | adenine phosphoribosyltransferase |
| SEQ ID NO: 8085 | Nga00493.02 | 4304.25 | 4488.03 | mago nashi |

FIGURE 24 DX

| # | Nga model | +N rpkb | -N rpkb | GO |
|---|---|---|---|---|
| SEQ ID NO: 8086 | Nga00494.02 | 791.11 | 849.77 | serine threonine protein phosphatase |
| SEQ ID NO: 8087 | Nga00743 | 352.53 | 354.99 | fungal specific transcription factor domain-containing protein |
| SEQ ID NO: 8088 | Nga00742 | 956.63 | 702.81 | violaxanthin de-epoxidase |
| SEQ ID NO: 8089 | Nga00744 | 119.15 | 135.89 | pentatricopeptide repeat-containing protein |
| SEQ ID NO: 8090 | Nga00741 | 839.70 | 691.53 | solute carrier family 31 (copper transporters) member 1 |
| SEQ ID NO: 8091 | Nga06093 | 85.96 | 106.79 | ---NA--- |
| SEQ ID NO: 8092 | Nga06092 | 445.45 | 459.55 | ---NA--- |
| SEQ ID NO: 8093 | Nga06090 | 263.64 | 324.97 | ---NA--- |
| SEQ ID NO: 8094 | Nga06091 | 475.35 | 416.31 | hypothetical protein CHLNCDRAFT_138448 [Chlorella variabilis] |
| SEQ ID NO: 8095 | Nga07202 | 4983.41 | 5411.27 | nadh dehydrogenase |
| SEQ ID NO: 8096 | Nga07201 | 765.10 | 719.73 | ---NA--- |
| SEQ ID NO: 8097 | Nga03621 | 142.86 | 87.05 | ---NA--- |
| SEQ ID NO: 8098 | Nga03620.01 | 513.86 | 614.05 | endonuclease exonuclease phosphatase |
| SEQ ID NO: 8099 | Nga06864 | 154.22 | 161.83 | ---NA--- |
| SEQ ID NO: 8100 | Nga20809 | 323.63 | 320.96 | phosphatidylglycerophosphate synthase 1 |
| SEQ ID NO: 8101 | Nga05316 | 499.25 | 518.21 | phosphatidylinositol-3-phosphate 5-kinase |
| SEQ ID NO: 8102 | Nga05319 | 297.40 | 488.60 | gram domain containing 1c |
| SEQ ID NO: 8103 | Nga05320 | 730.50 | 626.12 | protein |
| SEQ ID NO: 8104 | Nga05317 | 819.92 | 1054.18 | gram domain-containing protein |
| SEQ ID NO: 8105 | Nga05315 | 640.24 | 780.72 | exosome complex exonuclease rrp44 |
| SEQ ID NO: 8106 | Nga05318 | 1303.03 | 1595.31 | ---NA--- |
| SEQ ID NO: 8107 | Nga07306 | 900.65 | 833.04 | ---NA--- |
| SEQ ID NO: 8108 | Nga07305 | 350.04 | 310.00 | pseudouridine synthase |
| SEQ ID NO: 8109 | Nga04293 | 267.44 | 289.70 | 40 kda peptidyl-prolyl cis-trans isomerase |
| SEQ ID NO: 8110 | Nga04294 | 248.06 | 260.31 | 20 kda cyclophilin |
| SEQ ID NO: 8111 | Nga02723.02 | 176.80 | 214.25 | expressed unknown protein [Ectocarpus siliculosus] |
| SEQ ID NO: 8112 | Nga02725.02 | 954.08 | 1002.07 | ---NA--- |
| SEQ ID NO: 8113 | Nga02735.02 | 456.21 | 452.27 | conserved unknown protein [Ectocarpus siliculosus] |
| SEQ ID NO: 8114 | Nga02731.02 | 1963.61 | 1938.16 | hypothetical protein VOLCADRAFT_89537 [Volvox carteri f. nagariensis] |
| SEQ ID NO: 8115 | Nga01260 | 456.71 | 536.93 | uncharacterized protein |
| SEQ ID NO: 8116 | Nga01261 | 253.77 | 257.06 | ---NA--- |
| SEQ ID NO: 8117 | Nga06923 | 172.04 | 330.02 | protein |
| SEQ ID NO: 8118 | Nga01852.2 | 640.29 | 945.30 | ctd small phosphatase-like |
| SEQ ID NO: 8119 | Nga06399 | 901.23 | 704.77 | ---NA--- |
| SEQ ID NO: 8120 | Nga03683 | 88.12 | 103.76 | ---NA--- |
| SEQ ID NO: 8121 | Nga03682 | 526.04 | 468.27 | ---NA--- |
| SEQ ID NO: 8122 | Nga04887 | 544.74 | 544.17 | aldo keto reductase |
| SEQ ID NO: 8123 | Nga04886 | 420.21 | 442.84 | ---NA--- |
| SEQ ID NO: 8124 | Nga01825.2 | 561.69 | 637.75 | conserved hypothetical protein [Phytophthora infestans T30-4] |
| SEQ ID NO: 8125 | Nga01800.01 | 3475.90 | 4617.92 | gcn5-related n-acetyltransferase |
| SEQ ID NO: 8126 | Nga07089 | 586.21 | 728.38 | glutathione s-transferase |
| SEQ ID NO: 8127 | Nga02092.01 | 1547.45 | 2155.74 | alternative nadh-dehydrogenase |
| SEQ ID NO: 8128 | Nga02151 | 1267.20 | 1143.41 | adp-ribosylation factor |
| SEQ ID NO: 8129 | Nga02150 | 940.64 | 1093.13 | ---NA--- |
| SEQ ID NO: 8130 | Nga02179 | 49.65 | 46.10 | ---NA--- |
| SEQ ID NO: 8131 | Nga02177 | 216.58 | 199.28 | atp-dependent bile acid permease |
| SEQ ID NO: 8132 | Nga02178 | 127.07 | 125.68 | ---NA--- |
| SEQ ID NO: 8133 | Nga04883 | 302.43 | 276.60 | protein |
| SEQ ID NO: 8134 | Nga02026.01 | 127.45 | 159.30 | ---NA--- |
| SEQ ID NO: 8135 | Nga05586.2 | 296.20 | 249.87 | diacylglycerol kinase |
| SEQ ID NO: 8136 | Nga02111.01 | 525.58 | 463.05 | carbohydratebinding protein |
| SEQ ID NO: 8137 | Nga20321 | 330.53 | 330.74 | hypothetical protein AURANDRAFT_62846 [Aureococcus anophagefferens] |
| SEQ ID NO: 8138 | Nga03658 | 293.83 | 304.91 | ---NA--- |
| SEQ ID NO: 8139 | Nga03657 | 347.26 | 243.23 | protein |
| SEQ ID NO: 8140 | Nga03660 | 491.02 | 415.13 | ---NA--- |
| SEQ ID NO: 8141 | Nga03656 | 265.81 | 270.27 | ---NA--- |
| SEQ ID NO: 8142 | Nga03659 | 4714.47 | 4022.26 | ---NA--- |
| SEQ ID NO: 8143 | Nga20790 | 1553.57 | 811.04 | protein |
| SEQ ID NO: 8144 | Nga01257 | 8706.87 | 9058.67 | ---NA--- |
| SEQ ID NO: 8145 | Nga01256 | 8271.83 | 8983.21 | 60s acidic ribosomal protein |
| SEQ ID NO: 8146 | Nga01254 | 412.29 | 367.03 | patatin-like phospholipase domain-containing protein |
| SEQ ID NO: 8147 | Nga04584.2 | 488.89 | 422.59 | 4-diphosphocytidyl-2c-methyl-d-erythritol kinase |
| SEQ ID NO: 8148 | Nga03793 | 982.30 | 1047.63 | protein |

FIGURE 24 DY

| # | Nga model | +N rpkb | -N rpkb | GO |
|---|---|---|---|---|
| SEQ ID NO: 8149 | Nga20845 | 100.70 | 91.33 | protein kinase domain containing protein |
| SEQ ID NO: 8150 | Nga20383 | 170.05 | 236.44 | isoform f |
| SEQ ID NO: 8151 | Nga04842.02 | 173.78 | 173.92 | sulfate transporter |
| SEQ ID NO: 8152 | Nga02376 | 213.25 | 243.25 | ---NA--- |
| SEQ ID NO: 8153 | Nga00988 | 430.35 | 485.03 | rna-binding protein 8a |
| SEQ ID NO: 8154 | Nga03962 | 12.39 | 32.22 | hnh endonuclease family protein |
| SEQ ID NO: 8155 | Nga02348.01 | 345.29 | 397.21 | sam-dependent methyltransferase |
| SEQ ID NO: 8156 | Nga21081 | 418.44 | 414.86 | ---NA--- |
| SEQ ID NO: 8157 | Nga20794 | 481.17 | 614.89 | nucleosome binding protein |
| SEQ ID NO: 8158 | Nga02333.1 | 316.07 | 324.09 | dna polymerase delta catalytic subunit |
| SEQ ID NO: 8159 | Nga03597 | 1948.54 | 3075.15 | kazal-type serine protease inhibitor domain |
| SEQ ID NO: 8160 | Nga03600 | 4740.11 | 5178.94 | ---NA--- |
| SEQ ID NO: 8161 | Nga03599 | 286.28 | 480.65 | unnamed protein product [Blastocystis hominis] |
| SEQ ID NO: 8162 | Nga03598 | 408.90 | 694.62 | ---NA--- |
| SEQ ID NO: 8163 | Nga06983 | 506.88 | 498.27 | proprotein convertase subtilisin kexin type 9 preproprotein |
| SEQ ID NO: 8164 | Nga04219 | 1464.90 | 1876.03 | cytokine-induced anti-apoptosis inhibitor fe-s biogenesis |
| SEQ ID NO: 8165 | Nga06036.2 | 598.46 | 518.61 | uncharacterized protein |
| SEQ ID NO: 8166 | Nga04108 | 750.00 | 654.45 | ---NA--- |
| SEQ ID NO: 8167 | Nga04104 | 134.42 | 168.46 | pre-mrna-splicing factor 38b |
| SEQ ID NO: 8168 | Nga04105 | 473.15 | 428.93 | ---NA--- |
| SEQ ID NO: 8169 | Nga04103 | 1142.34 | 1196.16 | ribosomal rna small subunit methyltransferase b |
| SEQ ID NO: 8170 | Nga04596 | 161.76 | 355.77 | ---NA--- |
| SEQ ID NO: 8171 | Nga04595 | 622.79 | 748.22 | glycosyl family 43 |
| SEQ ID NO: 8172 | Nga04597 | 28.99 | 70.65 | ---NA--- |
| SEQ ID NO: 8173 | Nga04819 | 521.94 | 569.43 | conserved unknown protein [Ectocarpus siliculosus] |
| SEQ ID NO: 8174 | Nga04197.02 | 2880.82 | 2549.74 | protein |
| SEQ ID NO: 8175 | Nga04698 | 2015.17 | 1873.88 | thylakoid lumenal kda chloroplast |
| SEQ ID NO: 8176 | Nga07289 | 162.96 | 147.11 | ---NA--- |
| SEQ ID NO: 8177 | Nga07102 | 1942.51 | 2117.53 | ---NA--- |
| SEQ ID NO: 8178 | Nga03912 | 409.21 | 657.57 | sjchgc05773 protein |
| SEQ ID NO: 8179 | Nga03910 | 468.76 | 480.97 | atp-binding cassette sub-family e member 1 |
| SEQ ID NO: 8180 | Nga03911 | 290.87 | 288.63 | acyl-coenzyme a binding domain containing 6 |
| SEQ ID NO: 8181 | Nga03908 | 404.87 | 334.27 | protein phosphatase 2c |
| SEQ ID NO: 8182 | Nga03909 | 361.55 | 429.85 | protein phosphatase |
| SEQ ID NO: 8183 | Nga03606.1 | 1402.08 | 1990.44 | agc ndr protein kinase |
| SEQ ID NO: 8184 | Nga02051.02 | 393.85 | 450.84 | ---NA--- |
| SEQ ID NO: 8185 | Nga03605.1 | 115.03 | 112.27 | cg3476-pa |
| SEQ ID NO: 8186 | Nga00907 | 422.62 | 381.34 | conserved unknown protein [Ectocarpus siliculosus] |
| SEQ ID NO: 8187 | Nga00908 | 52.08 | 78.99 | ---NA--- |
| SEQ ID NO: 8188 | Nga20841 | 195.95 | 253.24 | alpha beta hydrolase fold protein |
| SEQ ID NO: 8189 | Nga07121 | 84.80 | 78.22 | zinc knuckle (cchc-type) family protein |
| SEQ ID NO: 8190 | Nga07119 | 175.49 | 184.79 | family protein |
| SEQ ID NO: 8191 | Nga07120 | 608.70 | 768.27 | conserved unknown protein [Ectocarpus siliculosus] |
| SEQ ID NO: 8192 | Nga03589 | 1451.86 | 1434.78 | ---NA--- |
| SEQ ID NO: 8193 | Nga03588 | 131.31 | 114.11 | protein kinase |
| SEQ ID NO: 8194 | Nga03587 | 129.17 | 130.89 | protein kinase |
| SEQ ID NO: 8195 | Nga04003 | 183.29 | 195.62 | conserved oligomeric golgi complex subunit 7 |
| SEQ ID NO: 8196 | Nga03800 | 1348.84 | 1252.70 | dolichol-phosphate mannosyltransferase subunit 3-like |
| SEQ ID NO: 8197 | Nga03799 | 256.73 | 226.78 | ---NA--- |
| SEQ ID NO: 8198 | Nga04545 | 436.63 | 441.87 | ---NA--- |
| SEQ ID NO: 8199 | Nga02018 | 230.61 | 242.99 | vacuolar protein sorting-associated protein 11 homolog |
| SEQ ID NO: 8200 | Nga05835.2 | 267.36 | 292.12 | ring zinc finger-containing protein |
| SEQ ID NO: 8201 | Nga02019 | 384.62 | 274.55 | fatty acid desaturase |
| SEQ ID NO: 8202 | Nga00819.02 | 590.02 | 455.69 | uncharacterized protein conserved in bacteria with a cystatin-like fold |
| SEQ ID NO: 8203 | Nga20945 | 1036.04 | 1400.68 | cug-bp- and etr-3-like |
| SEQ ID NO: 8204 | Nga02158 | 366.67 | 333.18 | u4 u6 small nuclear ribonucleoprotein prp31 |
| SEQ ID NO: 8205 | Nga02157 | 575.90 | 700.12 | ---NA--- |
| SEQ ID NO: 8206 | Nga01385 | 7582.38 | 9595.54 | histone h4 |
| SEQ ID NO: 8207 | Nga01092.01 | 455.84 | 478.35 | rpa-interacting protein a |
| SEQ ID NO: 8208 | Nga01090.01 | 3969.61 | 4630.68 | transketolase |
| SEQ ID NO: 8209 | Nga01091.01 | 876.21 | 843.98 | ---NA--- |
| SEQ ID NO: 8210 | Nga01810 | 1273.84 | 1273.93 | u6 snrna-associated sm-like |
| SEQ ID NO: 8211 | Nga04792 | 906.86 | 865.53 | lactoylglutathione lyase glyoxalase i-like protein |
| SEQ ID NO: 8212 | Nga03830 | 759.07 | 900.47 | protein |

FIGURE 24 DZ

| # | Nga model | +N rpkb | -N rpkb | GO |
|---|---|---|---|---|
| SEQ ID NO: 8213 | Nga03831 | 278.39 | 226.17 | ---NA--- |
| SEQ ID NO: 8214 | Nga03829 | 1995.46 | 2006.81 | protein |
| SEQ ID NO: 8215 | Nga03202 | 495.12 | 565.03 | dna mismatch repair protein msh2 |
| SEQ ID NO: 8216 | Nga04972.2 | 198.76 | 224.27 | ---NA--- |
| SEQ ID NO: 8217 | Nga03203 | 344.71 | 362.31 | dna mismatch repair protein msh2 |
| SEQ ID NO: 8218 | Nga03204 | 206.45 | 258.58 | ---NA--- |
| SEQ ID NO: 8219 | Nga03201.01 | 325.52 | 340.66 | trigger factor |
| SEQ ID NO: 8220 | Nga03206 | 409.52 | 402.34 | protein homolog 2a |
| SEQ ID NO: 8221 | Nga04973.2 | 902.78 | 1079.76 | px domain containing protein |
| SEQ ID NO: 8222 | Nga03205 | 187.50 | 101.55 | ---NA--- |
| SEQ ID NO: 8223 | Nga03197 | 338.88 | 385.11 | alpha beta hydrolase |
| SEQ ID NO: 8224 | Nga03200 | 756.36 | 584.07 | protein |
| SEQ ID NO: 8225 | Nga04050 | 347.17 | 363.80 | ---NA--- |
| SEQ ID NO: 8226 | Nga01561 | 126.82 | 182.42 | ---NA--- |
| SEQ ID NO: 8227 | Nga01563 | 282.35 | 360.47 | lipid a export atp-binding permease protein msba |
| SEQ ID NO: 8228 | Nga20851 | 293.04 | 265.85 | at2g36910-like protein |
| SEQ ID NO: 8229 | Nga20388 | 218.21 | 272.08 | atp-binding sub-family b (mdr tap) member 10 |
| SEQ ID NO: 8230 | Nga01562 | 362.16 | 267.88 | kh domain-containing protein |
| SEQ ID NO: 8231 | Nga20481 | 339.26 | 377.99 | conserved unknown protein [Ectocarpus siliculosus] |
| SEQ ID NO: 8232 | Nga02005 | 4235.74 | 4559.02 | ---NA--- |
| SEQ ID NO: 8233 | Nga02006 | 1318.66 | 1265.30 | adp-ribosylation factor gtpase-activating protein agd8 |
| SEQ ID NO: 8234 | Nga02007 | 225.56 | 196.19 | phosphatidylinositol 4-kinase |
| SEQ ID NO: 8235 | Nga04149 | 250.64 | 280.68 | block of proliferation 1 |
| SEQ ID NO: 8236 | Nga01147 | 352.86 | 334.63 | phosphatidylinositol phosphatase |
| SEQ ID NO: 8237 | Nga20644 | 251.80 | 183.14 | ---NA--- |
| SEQ ID NO: 8238 | Nga01148 | 183.51 | 192.79 | trna-splicing endonuclease positive effector-related protein |
| SEQ ID NO: 8239 | Nga01572 | 883.07 | 993.51 | predicted protein [Thalassiosira pseudonana CCMP1335] |
| SEQ ID NO: 8240 | Nga01573 | 171.30 | 130.39 | ---NA--- |
| SEQ ID NO: 8241 | Nga01571 | 438.64 | 441.21 | ---NA--- |
| SEQ ID NO: 8242 | Nga06948 | 1065.45 | 1284.26 | ---NA--- |
| SEQ ID NO: 8243 | Nga04375 | 14.71 | 10.62 | ---NA--- |
| SEQ ID NO: 8244 | Nga04798 | 250.46 | 215.45 | para-aminobenzoate synthase |
| SEQ ID NO: 8245 | Nga21259 | 116.13 | 209.66 | p-aminobenzoic acid synthase |
| SEQ ID NO: 8246 | Nga04039 | 1591.57 | 1582.75 | ---NA--- |
| SEQ ID NO: 8247 | Nga04041 | 1805.77 | 1734.31 | dihydrolipoamide acetyltransferase |
| SEQ ID NO: 8248 | Nga04043 | 1234.57 | 1105.52 | branched-chain alpha-keto acid dehydrogenase subunit e2 |
| SEQ ID NO: 8249 | Nga04042 | 1582.46 | 1500.08 | endoribonuclease l-psp |
| SEQ ID NO: 8250 | Nga04040 | 1717.28 | 1553.01 | branched-chain alpha-keto acid dehydrogenase subunit e2 |
| SEQ ID NO: 8251 | Nga02483.02 | 1542.86 | 1293.69 | peptide methionine sulfoxide reductase |
| SEQ ID NO: 8252 | Nga02482.02 | 461.49 | 468.30 | pre-mrna-splicing factor syf1 |
| SEQ ID NO: 8253 | Nga06756 | 1143.39 | 1183.42 | phosphoethanolamine n-methyltransferase |
| SEQ ID NO: 8254 | Nga00771 | 182.74 | 203.45 | ---NA--- |
| SEQ ID NO: 8255 | Nga00772 | 119.34 | 160.48 | ---NA--- |
| SEQ ID NO: 8256 | Nga00773 | 112.46 | 135.87 | ---NA--- |
| SEQ ID NO: 8257 | Nga06264 | 190.48 | 276.67 | ---NA--- |
| SEQ ID NO: 8258 | Nga06265 | 237.29 | 238.68 | ---NA--- |
| SEQ ID NO: 8259 | Nga06261 | 434.98 | 390.22 | ---NA--- |
| SEQ ID NO: 8260 | Nga06260 | 70.87 | 79.61 | ---NA--- |
| SEQ ID NO: 8261 | Nga06263 | 398.37 | 537.21 | ---NA--- |
| SEQ ID NO: 8262 | Nga06262 | 50.26 | 65.91 | ---NA--- |
| SEQ ID NO: 8263 | Nga04421 | 1349.36 | 1446.35 | hypothetical protein AURANDRAFT_71238 [Aureococcus anophagefferens] |
| SEQ ID NO: 8264 | Nga05735 | 2361.34 | 3298.63 | proline oxidase |
| SEQ ID NO: 8265 | Nga05734 | 331.83 | 375.37 | beta-adrenergic receptor kinase |
| SEQ ID NO: 8266 | Nga05731 | 447.14 | 707.76 | ---NA--- |
| SEQ ID NO: 8267 | Nga05730 | 630.38 | 684.30 | protein |
| SEQ ID NO: 8268 | Nga05736 | 85.31 | 65.03 | aec family transporter; auxin efflux |
| SEQ ID NO: 8269 | Nga05728 | 800.00 | 640.31 | axonemal dynein beta heavy chain |
| SEQ ID NO: 8270 | Nga21074 | 267.86 | 177.96 | endonuclease fl j39025-like |
| SEQ ID NO: 8271 | Nga20946 | 243.96 | 481.16 | sulfate transporter family domain-containing protein |
| SEQ ID NO: 8272 | Nga05732 | 1894.32 | 2003.89 | protein |
| SEQ ID NO: 8273 | Nga05733 | 931.25 | 964.76 | ---NA--- |
| SEQ ID NO: 8274 | Nga05729 | 2218.27 | 2490.89 | dna-directed rna polymerase ii kda polypeptide |
| SEQ ID NO: 8275 | Nga05737 | 1297.05 | 1105.34 | eukaryotic translation initiation factor |

FIGURE 24 EA

| # | Nga model | +N rpkb | -N rpkb | GO |
|---|---|---|---|---|
| SEQ ID NO: 8276 | Nga05942 | 282.77 | 263.71 | ---NA--- |
| SEQ ID NO: 8277 | Nga05941 | 297.39 | 269.04 | sodium-dependent glucose transporter 1 |
| SEQ ID NO: 8278 | Nga05940 | 447.80 | 466.05 | hydroxyacyl glutathione hydrolase |
| SEQ ID NO: 8279 | Nga20359.1 | 1231.91 | 1166.44 | ---NA--- |
| SEQ ID NO: 8280 | Nga20400.1 | 81.76 | 74.94 | ---NA--- |
| SEQ ID NO: 8281 | Nga20583.1 | 42.33 | 85.97 | protein |
| SEQ ID NO: 8282 | Nga00930 | 607.23 | 616.01 | ---NA--- |
| SEQ ID NO: 8283 | Nga20270 | 262.82 | 288.86 | serine threonine kinase 25 (ste20 yeast) |
| SEQ ID NO: 8284 | Nga00931 | 130.28 | 119.71 | wd repeat-containing protein 91 |
| SEQ ID NO: 8285 | Nga01668 | 180.54 | 196.52 | asparaginase |
| SEQ ID NO: 8286 | Nga00831 | 371.17 | 399.84 | protein |
| SEQ ID NO: 8287 | Nga00832 | 293.23 | 317.64 | o-phosphoseryl-trna selenium transferase |
| SEQ ID NO: 8288 | Nga00830 | 209.91 | 304.48 | o-phosphoseryl-trna selenium transferase |
| SEQ ID NO: 8289 | Nga00765 | 301.08 | 350.89 | ---NA--- |
| SEQ ID NO: 8290 | Nga20086.1 | 274.61 | 437.68 | serine threonine protein |
| SEQ ID NO: 8291 | Nga04910 | 1187.64 | 1583.00 | protein kinase |
| SEQ ID NO: 8292 | Nga01780 | 116.35 | 122.63 | dna replication licensing factor mcm3 |
| SEQ ID NO: 8293 | Nga20855.1 | 288.76 | 417.76 | ---NA--- |
| SEQ ID NO: 8294 | Nga00792.02 | 188.24 | 194.48 | nmda receptor regulated 1-like |
| SEQ ID NO: 8295 | Nga01374 | 98.36 | 88.79 | ---NA--- |
| SEQ ID NO: 8296 | Nga01372 | 189.57 | 246.79 | protein |
| SEQ ID NO: 8297 | Nga01373 | 336.02 | 329.05 | 5-formyltetrahydrofolate cyclo-ligase |
| SEQ ID NO: 8298 | Nga02438 | 553.08 | 572.83 | ---NA--- |
| SEQ ID NO: 8299 | Nga02440 | 485.48 | 408.27 | ubiquitin thioesterase otub1 |
| SEQ ID NO: 8300 | Nga02439.01 | 217.65 | 364.79 | ---NA--- |
| SEQ ID NO: 8301 | Nga00889 | 1207.01 | 1163.44 | 50s ribosomal protein l24 |
| SEQ ID NO: 8302 | Nga01340 | 1016.08 | 1188.89 | protein |
| SEQ ID NO: 8303 | Nga01342.01 | 7.94 | 30.09 | urease accessory protein ured |
| SEQ ID NO: 8304 | Nga01339 | 258.95 | 258.87 | myo-inositol monophosphatase 1 |
| SEQ ID NO: 8305 | Nga01338 | 526.56 | 520.40 | threonyl-trna synthetase |
| SEQ ID NO: 8306 | Nga01341 | 1037.88 | 937.57 | nucleolar protein nop56 |
| SEQ ID NO: 8307 | Nga06457 | 347.39 | 271.90 | ---NA--- |
| SEQ ID NO: 8308 | Nga06456 | 617.95 | 276.19 | ---NA--- |
| SEQ ID NO: 8309 | Nga07310 | 2056.17 | 1684.98 | zeta-carotene desaturase |
| SEQ ID NO: 8310 | Nga01475 | 1032.83 | 921.07 | histone deacetylase 1 |
| SEQ ID NO: 8311 | Nga01478 | 167.99 | 161.01 | ---NA--- |
| SEQ ID NO: 8312 | Nga01476 | 369.59 | 400.75 | cathepsin l-like proteinase |
| SEQ ID NO: 8313 | Nga01477 | 456.29 | 535.78 | rCG22628 [Rattus norvegicus] |
| SEQ ID NO: 8314 | Nga06910 | 161.13 | 227.17 | ---NA--- |
| SEQ ID NO: 8315 | Nga06909 | 280.51 | 272.29 | atp dependent rna helicase |
| SEQ ID NO: 8316 | Nga02117 | 3893.33 | 3816.59 | glutamate decarboxylase |
| SEQ ID NO: 8317 | Nga02118 | 693.07 | 695.34 | protein |
| SEQ ID NO: 8318 | Nga02119 | 187.92 | 141.77 | ---NA--- |
| SEQ ID NO: 8319 | Nga05571 | 3318.39 | 3102.78 | ---NA--- |
| SEQ ID NO: 8320 | Nga05573 | 11330.25 | 12414.41 | ---NA--- |
| SEQ ID NO: 8321 | Nga05574 | 458.33 | 558.54 | 3-oxoacid - b subunit |
| SEQ ID NO: 8322 | Nga05572 | 174.13 | 172.46 | ---NA--- |
| SEQ ID NO: 8323 | Nga05570 | 753.13 | 542.59 | uncharacterized protein |
| SEQ ID NO: 8324 | Nga01795.2 | 993.21 | 1478.37 | phosphatidylinositol kinase (pik-f) |
| SEQ ID NO: 8325 | Nga03522 | 506.26 | 368.18 | t-complex protein 1 subunit gamma |
| SEQ ID NO: 8326 | Nga03524 | 1411.11 | 2044.10 | ---NA--- |
| SEQ ID NO: 8327 | Nga03523 | 375.85 | 363.84 | asparagine synthase |
| SEQ ID NO: 8328 | Nga03525 | 194.84 | 215.72 | beta-tubulin isotype 2 |
| SEQ ID NO: 8329 | Nga03519 | 867.89 | 884.21 | atp synthase protein i |
| SEQ ID NO: 8330 | Nga20528 | 275.77 | 274.58 | arginine serine rich splicing factor sf4 |
| SEQ ID NO: 8331 | Nga03520 | 428.77 | 321.88 | beta-tubulin [Holocryphia eucalypti] |
| SEQ ID NO: 8332 | Nga03526 | 254.90 | 237.89 | ---NA--- |
| SEQ ID NO: 8333 | Nga02197.2 | 43.30 | 47.78 | dmt superfamily drug metabolite transporter |
| SEQ ID NO: 8334 | Nga02196.02 | 1176.23 | 1143.45 | ---NA--- |
| SEQ ID NO: 8335 | Nga04529 | 60.61 | 93.79 | ---NA--- |
| SEQ ID NO: 8336 | Nga06994 | 88771.93 | 47391.05 | light harvesting complex protein |
| SEQ ID NO: 8337 | Nga05964 | 78.82 | 133.40 | ---NA--- |
| SEQ ID NO: 8338 | Nga04762.02 | 191.69 | 140.79 | ---NA--- |
| SEQ ID NO: 8339 | Nga04763.02 | 1319.20 | 1103.65 | ---NA--- |

FIGURE 24 EB

| # | Nga model | +N rpkb | -N rpkb | GO |
|---|---|---|---|---|
| SEQ ID NO: 8340 | Nga05965 | 594.71 | 523.32 | protein |
| SEQ ID NO: 8341 | Nga20098 | 622.64 | 559.50 | purple acid phosphatase isoform b2 |
| SEQ ID NO: 8342 | Nga05960 | 784.42 | 880.66 | acetylglucosaminyl-transferase |
| SEQ ID NO: 8343 | Nga05961 | 219.05 | 242.44 | ---NA--- |
| SEQ ID NO: 8344 | Nga20894 | 137.61 | 154.04 | protein kinase domain containing protein |
| SEQ ID NO: 8345 | Nga05959 | 146.85 | 172.96 | ---NA--- |
| SEQ ID NO: 8346 | Nga04052 | 516.26 | 394.10 | polymerase (dna directed) delta regulatory subunit |
| SEQ ID NO: 8347 | Nga06173 | 40.94 | 38.01 | ---NA--- |
| SEQ ID NO: 8348 | Nga01182 | 752.09 | 633.65 | ---NA--- |
| SEQ ID NO: 8349 | Nga03807 | 175.64 | 181.05 | ---NA--- |
| SEQ ID NO: 8350 | Nga02132.2 | 327.33 | 357.83 | dynamin like protein |
| SEQ ID NO: 8351 | Nga01917.02 | 1146.85 | 805.48 | dna-directed rna polymerases and iii subunit rpabc2 |
| SEQ ID NO: 8352 | Nga01012 | 132.01 | 239.53 | ---NA--- |
| SEQ ID NO: 8353 | Nga01013 | 149.04 | 121.52 | hypothetical protein ANI_1_1318134 [Aspergillus niger CBS 513.88] |
| SEQ ID NO: 8354 | Nga04904.2 | 134.02 | 174.96 | cysteine protease family |
| SEQ ID NO: 8355 | Nga05154 | 104.90 | 159.08 | trna rrna methyltransferase -like protein |
| SEQ ID NO: 8356 | Nga05158 | 906.03 | 762.67 | ke2 family protein |
| SEQ ID NO: 8357 | Nga05155 | 3480.28 | 5403.60 | phosphate dikinase |
| SEQ ID NO: 8358 | Nga05160 | 375.07 | 441.79 | potential uroporphyrin-3 c-methyltransferase |
| SEQ ID NO: 8359 | Nga05156 | 520.75 | 595.44 | 3-hydroxyisobutyrate dehydrogenase |
| SEQ ID NO: 8360 | Nga05157 | 309.11 | 420.20 | nodulin 21 -like transporter family protein |
| SEQ ID NO: 8361 | Nga05159 | 510.42 | 678.43 | serine threonine-protein kinase dclk3 |
| SEQ ID NO: 8362 | Nga05153 | 2048.39 | 2009.22 | ---NA--- |
| SEQ ID NO: 8363 | Nga04028 | 1613.77 | 2256.20 | ---NA--- |
| SEQ ID NO: 8364 | Nga04029 | 462.26 | 403.66 | glutathione s- |
| SEQ ID NO: 8365 | Nga04031 | 138.66 | 138.06 | alpha beta hydrolase fold protein |
| SEQ ID NO: 8366 | Nga02412.2 | 517.93 | 535.71 | eukaryotic translation initiation factor |
| SEQ ID NO: 8367 | Nga04059 | 331.92 | 304.47 | signal recognition particle 54 kda protein |
| SEQ ID NO: 8368 | Nga04057 | 111.11 | 159.18 | ---NA--- |
| SEQ ID NO: 8369 | Nga04055 | 108.16 | 140.21 | ---NA--- |
| SEQ ID NO: 8370 | Nga04056 | 1648.60 | 2157.57 | ---NA--- |
| SEQ ID NO: 8371 | Nga04058 | 1038.61 | 922.07 | ---NA--- |
| SEQ ID NO: 8372 | Nga07269 | 118.61 | 194.94 | protein |
| SEQ ID NO: 8373 | Nga06193 | 133.33 | 156.47 | ---NA--- |
| SEQ ID NO: 8374 | Nga06190 | 839.38 | 689.98 | ---NA--- |
| SEQ ID NO: 8375 | Nga06191 | 368.83 | 230.71 | ribosomal rna methyltransferase |
| SEQ ID NO: 8376 | Nga06192 | 212.87 | 225.23 | ---NA--- |
| SEQ ID NO: 8377 | Nga01104.02 | 171.35 | 145.49 | exocyst complex component 7 |
| SEQ ID NO: 8378 | Nga01103.2 | 1040.00 | 1014.42 | endoribonuclease l-psp |
| SEQ ID NO: 8379 | Nga06502 | 494.86 | 525.88 | conserved unknown protein [Ectocarpus siliculosus] |
| SEQ ID NO: 8380 | Nga06504 | 507.19 | 561.96 | conserved hypothetical protein [Neospora caninum Liverpool] |
| SEQ ID NO: 8381 | Nga06506 | 706.78 | 790.09 | protein |
| SEQ ID NO: 8382 | Nga21141 | 238.26 | 506.77 | protein |
| SEQ ID NO: 8383 | Nga06505 | 85.98 | 101.57 | exocyst complex |
| SEQ ID NO: 8384 | Nga06507 | 141.84 | 164.13 | abc transporter g family member 7 |
| SEQ ID NO: 8385 | Nga06503 | 418.18 | 397.84 | mannose-p-dolichol utilization defect 1 |
| SEQ ID NO: 8386 | Nga01928 | 163.35 | 136.66 | ---NA--- |
| SEQ ID NO: 8387 | Nga05044.2 | 479.70 | 517.63 | homing endonuclease rb16 2 |
| SEQ ID NO: 8388 | Nga01927 | 131.27 | 117.11 | ---NA--- |
| SEQ ID NO: 8389 | Nga03185 | 202.61 | 339.84 | ---NA--- |
| SEQ ID NO: 8390 | Nga03184 | 1611.65 | 1461.84 | ribulose- -bisphosphate carboxylase oxygenase small subunit n-methyltransferase i |
| SEQ ID NO: 8391 | Nga03186 | 56.74 | 84.51 | ---NA--- |
| SEQ ID NO: 8392 | Nga03182 | 281.32 | 373.88 | peroxin pex14 |
| SEQ ID NO: 8393 | Nga03183 | 158.70 | 168.22 | serine arginine repetitive matrix 1 |
| SEQ ID NO: 8394 | Nga03188 | 1130.40 | 1118.78 | ribulose- -bisphosphate carboxylase oxygenase small subunit n-methyltransferase i |
| SEQ ID NO: 8395 | Nga03642 | 256.70 | 157.17 | ---NA--- |
| SEQ ID NO: 8396 | Nga03641 | 298.33 | 239.57 | rna binding protein |
| SEQ ID NO: 8397 | Nga01785.01 | 1113.07 | 1258.03 | protein |
| SEQ ID NO: 8398 | Nga01789 | 273.18 | 336.64 | protein kiaa0664 homolog |
| SEQ ID NO: 8399 | Nga01788 | 85.34 | 79.38 | adp-ribosylation crystallin j1 |
| SEQ ID NO: 8400 | Nga01786 | 628.57 | 722.16 | eukaryotic translation initiation factor 3 |
| SEQ ID NO: 8401 | Nga01784.01 | 451.68 | 369.62 | dna-directed rna polymerase ii kda polypeptide |

FIGURE 24 EC

| # | Nga model | +N rpkb | -N rpkb | GO |
|---|---|---|---|---|
| SEQ ID NO: 8402 | Nga01787.01 | 325.16 | 362.85 | charged multivesicular body protein 3 |
| SEQ ID NO: 8403 | Nga20102 | 1629.24 | 1700.23 | predicted protein [Phaeodactylum tricornutum CCAP 1055/1] |
| SEQ ID NO: 8404 | Nga03978 | 903.14 | 850.71 | ---NA--- |
| SEQ ID NO: 8405 | Nga03979 | 981.84 | 940.63 | secreted protein |
| SEQ ID NO: 8406 | Nga04760.2 | 284.95 | 241.69 | uncharacterized protein |
| SEQ ID NO: 8407 | Nga01654 | 314.34 | 310.63 | conserved hypothetical protein [Phytophthora infestans T30-4] |
| SEQ ID NO: 8408 | Nga05457 | 67.25 | 101.36 | tbc domain containing protein |
| SEQ ID NO: 8409 | Nga05456 | 150.30 | 149.68 | telomerase cajal body protein 1 |
| SEQ ID NO: 8410 | Nga05460 | 106.28 | 147.57 | mrna processing protein |
| SEQ ID NO: 8411 | Nga05455 | 712.17 | 605.37 | 2-hydroxy-3-oxopropionate reductase |
| SEQ ID NO: 8412 | Nga05458 | 488.26 | 391.59 | atp-binding cassette transporter |
| SEQ ID NO: 8413 | Nga05462 | 118.12 | 163.01 | protease do-like 2 |
| SEQ ID NO: 8414 | Nga05459 | 528.43 | 511.88 | cg1824 |
| SEQ ID NO: 8415 | Nga05461 | 438.60 | 323.07 | atp-binding cassette sub-family b member 5-like |
| SEQ ID NO: 8416 | Nga05454 | 2050.73 | 2138.99 | transcription elongation factor b polypeptide 1 |
| SEQ ID NO: 8417 | Nga20755 | 29.41 | 47.79 | wd repeat and fyve domain-containing protein |
| SEQ ID NO: 8418 | Nga21162.1 | 119.45 | 129.40 | lysine ornithine decarboxylase |
| SEQ ID NO: 8419 | Nga02232.1 | 22.22 | 6.88 | conserved unknown protein [Ectocarpus siliculosus] |
| SEQ ID NO: 8420 | Nga02231 | 354.67 | 376.23 | ---NA--- |
| SEQ ID NO: 8421 | Nga02233 | 12.58 | 27.25 | ---NA--- |
| SEQ ID NO: 8422 | Nga02337 | 33.47 | 4.53 | ---NA--- |
| SEQ ID NO: 8423 | Nga03750.2 | 134.00 | 198.72 | pstvd rna-biding virp1 |
| SEQ ID NO: 8424 | Nga04780 | 125.98 | 145.00 | ---NA--- |
| SEQ ID NO: 8425 | Nga01637.02 | 752.43 | 562.65 | meiotic nuclear division protein 1 homolog |
| SEQ ID NO: 8426 | Nga06465 | 929.03 | 950.45 | ---NA--- |
| SEQ ID NO: 8427 | Nga06466 | 666.67 | 594.27 | ---NA--- |
| SEQ ID NO: 8428 | Nga06077 | 524.46 | 695.30 | ---NA--- |
| SEQ ID NO: 8429 | Nga06078 | 552.06 | 555.45 | chaperone protein |
| SEQ ID NO: 8430 | Nga06079.1 | 539.93 | 483.32 | mitochondrial carrier |
| SEQ ID NO: 8431 | Nga06080 | 160.39 | 156.01 | ---NA--- |
| SEQ ID NO: 8432 | Nga04465 | 695.89 | 920.01 | ---NA--- |
| SEQ ID NO: 8433 | Nga21002.1 | 133.52 | 184.64 | phytochelatin synthase |
| SEQ ID NO: 8434 | Nga03738 | 100.00 | 74.99 | ---NA--- |
| SEQ ID NO: 8435 | Nga01439.01 | 6.01 | 9.76 | mismatch repair protein 5 |
| SEQ ID NO: 8436 | Nga01434.01 | 1309.20 | 1273.96 | zip zinc transporter family protein |
| SEQ ID NO: 8437 | Nga01435.01 | 321.71 | 320.46 | protein polybromo-1 |
| SEQ ID NO: 8438 | Nga01436.01 | 370.20 | 472.56 | inosine triphosphate pyrophosphatase |
| SEQ ID NO: 8439 | Nga01437.01 | 304.95 | 306.79 | alpha beta hydrolase fold family |
| SEQ ID NO: 8440 | Nga01438.01 | 276.63 | 247.29 | protein phosphatase 1 beta |
| SEQ ID NO: 8441 | Nga06030 | 80.14 | 84.29 | kiaa0562 protein |
| SEQ ID NO: 8442 | Nga06029 | 285.71 | 308.30 | magnesium ion transporter mrs2 |
| SEQ ID NO: 8443 | Nga06032 | 8.40 | 18.21 | ---NA--- |
| SEQ ID NO: 8444 | Nga06031 | 333.99 | 341.89 | uncharacterized protein kiaa0562 |
| SEQ ID NO: 8445 | Nga06028 | 201.55 | 283.10 | potential dead box rna helicase |
| SEQ ID NO: 8446 | Nga01396 | 756.49 | 934.61 | hypothetical protein MYCGRDRAFT_99199 [Mycosphaerella graminicola IPO323] |
| SEQ ID NO: 8447 | Nga01398 | 574.74 | 688.71 | 5 -3 exoribonuclease |
| SEQ ID NO: 8448 | Nga01399 | 283.02 | 314.01 | protein |
| SEQ ID NO: 8449 | Nga01397 | 94.88 | 123.33 | ---NA--- |
| SEQ ID NO: 8450 | Nga05564 | 105.26 | 190.04 | ---NA--- |
| SEQ ID NO: 8451 | Nga05563 | 611.65 | 462.74 | ---NA--- |
| SEQ ID NO: 8452 | Nga05560 | 287.97 | 306.06 | deah (asp-glu-ala-his) box polypeptide 9 |
| SEQ ID NO: 8453 | Nga05561 | 385.96 | 456.10 | ---NA--- |
| SEQ ID NO: 8454 | Nga05565 | 257.50 | 288.48 | ---NA--- |
| SEQ ID NO: 8455 | Nga05562 | 71.65 | 67.49 | protein kinase |
| SEQ ID NO: 8456 | Nga02524.02 | 18205.19 | 18242.25 | predicted protein [Phaeodactylum tricornutum CCAP 1055/1] |
| SEQ ID NO: 8457 | Nga04248 | 134.64 | 162.54 | ---NA--- |
| SEQ ID NO: 8458 | Nga06059.2 | 1347.35 | 1430.84 | protein |
| SEQ ID NO: 8459 | Nga03888 | 140.70 | 168.74 | ---NA--- |
| SEQ ID NO: 8460 | Nga03886 | 1025.81 | 838.63 | cytochrome c6 |
| SEQ ID NO: 8461 | Nga03885 | 1996.79 | 1746.09 | atp-binding cassette |
| SEQ ID NO: 8462 | Nga03884 | 1064.37 | 919.73 | protein |
| SEQ ID NO: 8463 | Nga02237 | 984.99 | 1070.02 | short-chain dehydrogenase reductase sdr |
| SEQ ID NO: 8464 | Nga20715 | 185.76 | 154.27 | ---NA--- |

FIGURE 24 ED

| # | Nga model | +N rpkb | -N rpkb | GO |
|---|---|---|---|---|
| SEQ ID NO: 8465 | Nga02238 | 777.29 | 684.31 | r- vamp71-family |
| SEQ ID NO: 8466 | Nga20917 | 81.08 | 78.07 | ---NA--- |
| SEQ ID NO: 8467 | Nga20514 | 53.85 | 20.83 | peptide chain release factor 2 |
| SEQ ID NO: 8468 | Nga04334 | 253.05 | 297.23 | ---NA--- |
| SEQ ID NO: 8469 | Nga21137 | 156.61 | 197.92 | ---NA--- |
| SEQ ID NO: 8470 | Nga04559 | 137.25 | 140.18 | ---NA--- |
| SEQ ID NO: 8471 | Nga05576 | 2770.94 | 2662.18 | peptidoglycan-binding lysin domain |
| SEQ ID NO: 8472 | Nga04670 | 795.13 | 810.10 | ---NA--- |
| SEQ ID NO: 8473 | Nga21286 | 149.51 | 161.95 | trna-specific adenosine deaminase subunit tad3 |
| SEQ ID NO: 8474 | Nga04187 | 883.36 | 1031.01 | conserved protein |
| SEQ ID NO: 8475 | Nga04188 | 1315.57 | 1073.05 | ---NA--- |
| SEQ ID NO: 8476 | Nga04189 | 445.08 | 361.08 | short-chain dehydrogenase reductase sdr |
| SEQ ID NO: 8477 | Nga21228 | 187.50 | 206.67 | exosome complex rna-binding protein rrp42 |
| SEQ ID NO: 8478 | Nga02352 | 72.92 | 62.06 | ---NA--- |
| SEQ ID NO: 8479 | Nga04082 | 387.10 | 404.93 | ---NA--- |
| SEQ ID NO: 8480 | Nga02408 | 52.53 | 42.68 | serologically defined colon cancer antigen 10 |
| SEQ ID NO: 8481 | Nga02409 | 566.73 | 643.60 | ---NA--- |
| SEQ ID NO: 8482 | Nga02410 | 177.01 | 219.14 | ---NA--- |
| SEQ ID NO: 8483 | Nga02407 | 146.10 | 241.23 | rna (guanine-9-)-methyltransferase domain-containing protein 2 |
| SEQ ID NO: 8484 | Nga05171 | 798.59 | 694.72 | ubiquitin carrier protein |
| SEQ ID NO: 8485 | Nga05169 | 385.40 | 301.02 | ---NA--- |
| SEQ ID NO: 8486 | Nga05173 | 39.22 | 35.40 | ---NA--- |
| SEQ ID NO: 8487 | Nga05172 | 806.34 | 705.28 | cytochrome b5 |
| SEQ ID NO: 8488 | Nga05170 | 235.99 | 236.46 | ---NA--- |
| SEQ ID NO: 8489 | Nga06493 | 679.50 | 686.01 | ---NA--- |
| SEQ ID NO: 8490 | Nga06492 | 899.92 | 819.96 | short-chain dehydrogenase reductase |
| SEQ ID NO: 8491 | Nga06497 | 59.17 | 25.64 | ---NA--- |
| SEQ ID NO: 8492 | Nga06499 | 86.21 | 112.06 | ---NA--- |
| SEQ ID NO: 8493 | Nga06498 | 63.49 | 34.39 | ---NA--- |
| SEQ ID NO: 8494 | Nga06496 | 79.77 | 40.12 | protein |
| SEQ ID NO: 8495 | Nga06495 | 79.84 | 69.19 | protein |
| SEQ ID NO: 8496 | Nga06494 | 137.21 | 138.55 | ---NA--- |
| SEQ ID NO: 8497 | Nga07035 | 303.03 | 393.90 | ---NA--- |
| SEQ ID NO: 8498 | Nga00231.02 | 129.11 | 317.85 | phd zinc finger-containing protein |
| SEQ ID NO: 8499 | Nga00224.02 | 2630.54 | 2139.15 | alanine-2-oxoglutarate aminotransferase 2 |
| SEQ ID NO: 8500 | Nga00230.02 | 292.04 | 421.79 | amino acid permease family protein |
| SEQ ID NO: 8501 | Nga00225.2 | 267.29 | 320.52 | protein |
| SEQ ID NO: 8502 | Nga02384 | 265.50 | 245.62 | nudix hydrolase |
| SEQ ID NO: 8503 | Nga04336 | 315.97 | 274.57 | nuclear nucleic acid-binding protein c1d-like |
| SEQ ID NO: 8504 | Nga02294 | 2855.39 | 3174.96 | ---NA--- |
| SEQ ID NO: 8505 | Nga02296 | 1469.61 | 1349.89 | protein |
| SEQ ID NO: 8506 | Nga02295 | 517.06 | 525.92 | metalloprotease family |
| SEQ ID NO: 8507 | Nga01588 | 1293.75 | 1360.52 | ---NA--- |
| SEQ ID NO: 8508 | Nga21069 | 60.98 | 46.24 | ---NA--- |
| SEQ ID NO: 8509 | Nga01587 | 324.03 | 232.45 | tat pathway signal sequence domain protein |
| SEQ ID NO: 8510 | Nga01589 | 311.93 | 407.45 | ---NA--- |
| SEQ ID NO: 8511 | Nga01699 | 123.81 | 96.29 | cyclophilin |
| SEQ ID NO: 8512 | Nga01698 | 302.42 | 323.22 | cycloeucalenol cycloisomerase |
| SEQ ID NO: 8513 | Nga04356 | 468.92 | 630.21 | ---NA--- |
| SEQ ID NO: 8514 | Nga06719 | 2958.59 | 3107.04 | elongation factor 3 |
| SEQ ID NO: 8515 | Nga06723 | 393.94 | 326.61 | autophagy protein 12 |
| SEQ ID NO: 8516 | Nga06717 | 2964.56 | 2699.58 | protein |
| SEQ ID NO: 8517 | Nga06720 | 3402.56 | 3419.13 | mrna export factor elf1 |
| SEQ ID NO: 8518 | Nga01709.2 | 390.27 | 366.35 | major facilitator protein |
| SEQ ID NO: 8519 | Nga06722 | 138.08 | 148.40 | pre-mrna-splicing factor cwc2 |
| SEQ ID NO: 8520 | Nga06718.1 | 2232.10 | 2335.05 | mrna export factor elf1 |
| SEQ ID NO: 8521 | Nga06133.2 | 325.74 | 374.63 | dna replication complex gins protein psf2 |
| SEQ ID NO: 8522 | Nga20164 | 1099.91 | 1062.88 | protein |
| SEQ ID NO: 8523 | Nga01755.02 | 547.76 | 711.60 | ---NA--- |
| SEQ ID NO: 8524 | Nga01757.02 | 527.21 | 633.73 | 2-oxoisovalerate dehydrogenase alpha mitochondrial expressed |
| SEQ ID NO: 8525 | Nga04385 | 446.19 | 326.96 | protein |
| SEQ ID NO: 8526 | Nga03042.02 | 75.30 | 123.56 | protein |
| SEQ ID NO: 8527 | Nga00960 | 965.09 | 1049.87 | adp-ribosylation factor gtpase-activating protein agd14 |
| SEQ ID NO: 8528 | Nga00961 | 348.88 | 342.77 | fha domain containing protein |

FIGURE 24 EE

| # | Nga model | +N rpkb | -N rpkb | GO |
|---|---|---|---|---|
| SEQ ID NO: 8529 | Nga00963 | 1993.60 | 2049.96 | epsilon subunit of mitochondrial f1-atpase |
| SEQ ID NO: 8530 | Nga00962 | 649.72 | 608.94 | 50s ribosomal protein l13 |
| SEQ ID NO: 8531 | Nga06802 | 161.96 | 233.17 | ---NA--- |
| SEQ ID NO: 8532 | Nga06801 | 568.81 | 724.64 | protein |
| SEQ ID NO: 8533 | Nga00458.02 | 9447.11 | 8268.63 | chaperonin 10 |
| SEQ ID NO: 8534 | Nga00461.02 | 902.98 | 815.05 | abc subfamily abcg |
| SEQ ID NO: 8535 | Nga02486.2 | 775.30 | 706.74 | ankyrin-2 isoform 1 |
| SEQ ID NO: 8536 | Nga04303.01 | 490.09 | 462.59 | n-ethylmaleimide-sensitive fusion protein |
| SEQ ID NO: 8537 | Nga04302.01 | 284.54 | 377.94 | pak1ip1 protein |
| SEQ ID NO: 8538 | Nga04304.01 | 390.41 | 650.43 | protein |
| SEQ ID NO: 8539 | Nga06996 | 352.68 | 431.52 | regulatory-associated protein of mtor |
| SEQ ID NO: 8540 | Nga01769.1 | 448.64 | 619.83 | 5-oxoprolinase |
| SEQ ID NO: 8541 | Nga01768.01 | 13904.11 | 18448.36 | heat shock protein hsp20 |
| SEQ ID NO: 8542 | Nga01770.01 | 189.25 | 218.98 | zinc transport |
| SEQ ID NO: 8543 | Nga01310.02 | 1417.46 | 1344.22 | mfs transporter |
| SEQ ID NO: 8544 | Nga04488 | 285.19 | 391.17 | ---NA--- |
| SEQ ID NO: 8545 | Nga04487 | 3339.20 | 4071.49 | argininosuccinate synthase |
| SEQ ID NO: 8546 | Nga04489 | 497.44 | 466.62 | armadillo repeat-containing protein |
| SEQ ID NO: 8547 | Nga07013 | 7.30 | 31.63 | nadh-quinone oxidoreductase |
| SEQ ID NO: 8548 | Nga04341 | 2207.28 | 2742.98 | protein |
| SEQ ID NO: 8549 | Nga20368.1 | 1223.30 | 1139.32 | transthyretin family protein |
| SEQ ID NO: 8550 | Nga04204.01 | 12867.52 | 15623.75 | acyl- dehydrogenase |
| SEQ ID NO: 8551 | Nga04205.01 | 1129.97 | 1359.07 | ---NA--- |
| SEQ ID NO: 8552 | Nga01793.02 | 333.88 | 304.94 | protein |
| SEQ ID NO: 8553 | Nga01792.02 | 1814.89 | 1902.29 | expressed unknown protein [Ectocarpus siliculosus] |
| SEQ ID NO: 8554 | Nga01794.02 | 1708.62 | 1941.74 | ---NA--- |
| SEQ ID NO: 8555 | Nga02303 | 1410.31 | 1323.03 | uracil-5-carboxylate decarboxylase |
| SEQ ID NO: 8556 | Nga02304 | 417.53 | 549.11 | thioredoxin-like protein |
| SEQ ID NO: 8557 | Nga02305 | 377.98 | 498.52 | ribosomal rna methyltransferase nop2 |
| SEQ ID NO: 8558 | Nga01934 | 177.67 | 166.86 | nadh:flavin oxidoreductase nadh oxidase |
| SEQ ID NO: 8559 | Nga01935 | 559.78 | 721.17 | ---NA--- |
| SEQ ID NO: 8560 | Nga21213 | 457.87 | 459.46 | ---NA--- |
| SEQ ID NO: 8561 | Nga01936 | 1210.14 | 990.61 | protein |
| SEQ ID NO: 8562 | Nga01933 | 2305.07 | 2532.19 | pyrroline-5-carboxylate reductase |
| SEQ ID NO: 8563 | Nga01729 | 1477.19 | 1757.80 | pyruvate carboxylase |
| SEQ ID NO: 8564 | Nga01730 | 318.25 | 270.81 | retinol retinaldehyde reductase |
| SEQ ID NO: 8565 | Nga07146 | 1529.41 | 1390.59 | protein |
| SEQ ID NO: 8566 | Nga20139 | 863.11 | 1198.76 | prolyl 4- alpha subunit domain protein |
| SEQ ID NO: 8567 | Nga07147 | 809.88 | 1005.28 | calcium-independent phospholipase a2-gamma |
| SEQ ID NO: 8568 | Nga05428.02 | 459.75 | 494.95 | aminotransferase class i and ii |
| SEQ ID NO: 8569 | Nga01646.2 | 1423.30 | 1713.42 | iojap-related protein |
| SEQ ID NO: 8570 | Nga01645.02 | 604.10 | 504.81 | lysophospholipase-like protein |
| SEQ ID NO: 8571 | Nga20646.1 | 237.20 | 195.62 | ---NA--- |
| SEQ ID NO: 8572 | Nga00508.02 | 6980.90 | 6051.63 | glutathione peroxidase |
| SEQ ID NO: 8573 | Nga00500.02 | 4996.24 | 4992.33 | glutaryl- mitochondrial precursor |
| SEQ ID NO: 8574 | Nga00512.02 | 74.11 | 81.85 | ---NA--- |
| SEQ ID NO: 8575 | Nga00499.02 | 3887.18 | 3369.14 | ---NA--- |
| SEQ ID NO: 8576 | Nga05420.02 | 13110.33 | 13438.71 | ribosomal protein l27 |
| SEQ ID NO: 8577 | Nga05415.02 | 1324.32 | 1401.09 | protein |
| SEQ ID NO: 8578 | Nga20622 | 65.75 | 80.13 | conserved unknown protein [Ectocarpus siliculosus] |
| SEQ ID NO: 8579 | Nga07152 | 106.80 | 91.15 | ---NA--- |
| SEQ ID NO: 8580 | Nga07150 | 408.47 | 489.82 | tyrosyl-trna synthetase |
| SEQ ID NO: 8581 | Nga07151 | 2242.83 | 1910.60 | 58 kda |
| SEQ ID NO: 8582 | Nga01821 | 212.66 | 198.47 | cln3-like protein |
| SEQ ID NO: 8583 | Nga01820 | 265.82 | 233.10 | protein |
| SEQ ID NO: 8584 | Nga21067 | 269.33 | 348.47 | ---NA--- |
| SEQ ID NO: 8585 | Nga07125 | 444.80 | 357.63 | ubiquinone biosynthesis protein |
| SEQ ID NO: 8586 | Nga04439 | 145.56 | 182.25 | protein |
| SEQ ID NO: 8587 | Nga20210.1 | 152.67 | 150.91 | transcription factor iiic-gamma subunit |
| SEQ ID NO: 8588 | Nga20424 | 313.87 | 266.20 | duf726 domain protein |
| SEQ ID NO: 8589 | Nga20227 | 317.68 | 220.38 | ---NA--- |
| SEQ ID NO: 8590 | Nga00134 | 1936.36 | 1472.57 | protein |
| SEQ ID NO: 8591 | Nga00142 | 266.83 | 247.24 | protein |
| SEQ ID NO: 8592 | Nga00138 | 621.64 | 649.37 | autophagy protein 16 |

FIGURE 24 EF

| # | Nga model | +N rpkb | -N rpkb | GO |
|---|---|---|---|---|
| SEQ ID NO: 8593 | Nga00135 | 1868.46 | 1696.82 | conserved unknown protein [Ectocarpus siliculosus] |
| SEQ ID NO: 8594 | Nga00129 | 1274.04 | 707.88 | ---NA--- |
| SEQ ID NO: 8595 | Nga20276 | 808.06 | 751.28 | alpha-ketoglutarate-dependent taurine dioxygenase |
| SEQ ID NO: 8596 | Nga20840 | 186.48 | 210.84 | c2h2 zinc finger protein |
| SEQ ID NO: 8597 | Nga20119 | 533.23 | 554.16 | erd (early-responsive to dehydration stress) family protein |
| SEQ ID NO: 8598 | Nga00139 | 292.60 | 354.64 | duf221 domain |
| SEQ ID NO: 8599 | Nga00130 | 2123.92 | 2144.62 | ---NA--- |
| SEQ ID NO: 8600 | Nga00132 | 521.59 | 667.57 | atp-binding cassette superfamily |
| SEQ ID NO: 8601 | Nga00137 | 349.87 | 336.57 | conserved unknown protein [Ectocarpus siliculosus] |
| SEQ ID NO: 8602 | Nga00127 | 730.57 | 913.77 | wd repeat-containing protein 43 |
| SEQ ID NO: 8603 | Nga20742 | 457.50 | 456.41 | ---NA--- |
| SEQ ID NO: 8604 | Nga00131 | 328.66 | 459.19 | rna 3 -terminal phosphate cyclase family protein |
| SEQ ID NO: 8605 | Nga00140 | 3504.04 | 3267.22 | ---NA--- |
| SEQ ID NO: 8606 | Nga20432 | 89.80 | 69.25 | armadillo-like helical domain-containing protein |
| SEQ ID NO: 8607 | Nga00125 | 8248.34 | 8201.31 | alpha tubulin 1 |
| SEQ ID NO: 8608 | Nga21097 | 732.58 | 826.90 | bromodomain containing protein |
| SEQ ID NO: 8609 | Nga00128 | 476.74 | 530.82 | wd repeat domain 76 |
| SEQ ID NO: 8610 | Nga00136 | 1434.46 | 1562.78 | nuclear lim interactor-interacting protein |
| SEQ ID NO: 8611 | Nga21248 | 599.54 | 518.07 | mannosyl-oligosaccharide glucosidase |
| SEQ ID NO: 8612 | Nga00126 | 2048.23 | 1908.23 | protein |
| SEQ ID NO: 8613 | Nga00133 | 810.31 | 845.85 | u3 small nucleolar rna-associated protein |
| SEQ ID NO: 8614 | Nga07301 | 208.67 | 167.33 | conserved hypothetical protein [Albugo laibachii Nc14] |
| SEQ ID NO: 8615 | Nga03835 | 1252.08 | 1067.44 | purple acid phosphatase |
| SEQ ID NO: 8616 | Nga03836 | 213.94 | 153.63 | ---NA--- |
| SEQ ID NO: 8617 | Nga21176 | 259.46 | 357.17 | ---NA--- |
| SEQ ID NO: 8618 | Nga02285 | 35442.74 | 23984.62 | photosystem ii reaction center m plastid precursor |
| SEQ ID NO: 8619 | Nga06312 | 562.77 | 576.79 | ---NA--- |
| SEQ ID NO: 8620 | Nga06311 | 3585.68 | 2936.64 | ---NA--- |
| SEQ ID NO: 8621 | Nga00376.02 | 2173.73 | 2140.08 | centrin 3 |
| SEQ ID NO: 8622 | Nga00379.02 | 689.68 | 757.11 | protein |
| SEQ ID NO: 8623 | Nga04337 | 315.97 | 274.57 | hydrophobe amphiphile efflux-1 family |
| SEQ ID NO: 8624 | Nga00022.02 | 707.38 | 651.38 | hemolysin iii |
| SEQ ID NO: 8625 | Nga00027.02 | 6926.51 | 8021.43 | fad-dependent pyridine nucleotide-disulfide oxidoreductase |
| SEQ ID NO: 8626 | Nga00447 | 2010.50 | 2027.90 | 2-dehydro-3-deoxyphosphoheptonate aldolase 3-deoxy-d-arabino-heptulosonate 7-phosphate synthetase |
| SEQ ID NO: 8627 | Nga01570 | 254.39 | 215.38 | phosphoacetylglucosamine mutase |
| SEQ ID NO: 8628 | Nga00192 | 141.67 | 234.70 | ---NA--- |
| SEQ ID NO: 8629 | Nga20124 | 520.39 | 507.56 | heat repeat containing 2 |
| SEQ ID NO: 8630 | Nga00802 | 2918.70 | 2730.10 | ---NA--- |
| SEQ ID NO: 8631 | Nga00062.1 | 197.39 | 174.17 | biopterin transport-related protein bt1 |
| SEQ ID NO: 8632 | Nga05112 | 228.41 | 262.51 | alcohol oxidase |
| SEQ ID NO: 8633 | Nga03822.01 | 8692.90 | 8393.50 | gtp-binding nuclear protein ran |
| SEQ ID NO: 8634 | Nga05506.01 | 360.95 | 301.25 | ---NA--- |
| SEQ ID NO: 8635 | Nga02743 | 430.94 | 553.59 | serine palmitoyltransferase |
| SEQ ID NO: 8636 | Nga06381 | 1955.70 | 2136.48 | fatty acid desaturase a |
| SEQ ID NO: 8637 | Nga20478 | 748.06 | 779.06 | membrane protein |
| SEQ ID NO: 8638 | Nga03996 | 362.03 | 389.77 | ---NA--- |
| SEQ ID NO: 8639 | Nga20090 | 289.98 | 291.67 | kiaa0789 protein |
| SEQ ID NO: 8640 | Nga00878 | 858.60 | 635.73 | pantoate beta-alanine ligase |
| SEQ ID NO: 8641 | Nga00066 | 2393.81 | 2295.95 | nadh dehydrogenase 1 alpha subcomplex subunit 8 |
| SEQ ID NO: 8642 | Nga01454.2 | 106.36 | 85.99 | phosphopantothenate--cysteine ligase |
| SEQ ID NO: 8643 | Nga00838.1 | 940.72 | 973.95 | uv excision repair protein rad23 |
| SEQ ID NO: 8644 | Nga03138 | 515.75 | 387.47 | protein |
| SEQ ID NO: 8645 | Nga00581.01 | 395.78 | 432.88 | dna polymerase v family |
| SEQ ID NO: 8646 | Nga01059 | 294.53 | 308.06 | histone deacetylase superfamily |
| SEQ ID NO: 8647 | Nga03451 | 1041.55 | 1062.54 | fg-gap repeat domain protein |
| SEQ ID NO: 8648 | Nga01255 | 60.87 | 65.94 | ---NA--- |
| SEQ ID NO: 8649 | Nga06472 | 816.59 | 938.97 | snf1-related protein kinase catalytic subunit alpha kin10 |
| SEQ ID NO: 8650 | Nga03082 | 256.64 | 245.13 | hypothetical protein [Magnaporthe oryzae 70-15] |
| SEQ ID NO: 8651 | Nga01124.01 | 1733.86 | 1392.93 | mannose-p-dolichol utilization defect 1 |
| SEQ ID NO: 8652 | Nga03284 | 768.74 | 830.40 | conserved hypothetical protein [Phytophthora infestans T30-4] |
| SEQ ID NO: 8653 | Nga03068 | 258.02 | 282.84 | lariat debranching enzyme |
| SEQ ID NO: 8654 | Nga05679 | 1265.28 | 1358.45 | eukaryotic translation initiation factor 2 subunit 3 |
| SEQ ID NO: 8655 | Nga00552 | 219.24 | 165.98 | translesion dna polymerase-rev1 deoxycytidyl transferase |

FIGURE 24 EG

| # | Nga model | +N rpkb | -N rpkb | GO |
|---|---|---|---|---|
| SEQ ID NO: 8656 | Nga01472 | 61.62 | 69.79 | ---NA--- |
| SEQ ID NO: 8657 | Nga03187 | 755.12 | 871.20 | beta-glucan synthesis-associated |
| SEQ ID NO: 8658 | Nga00495 | 1697.29 | 1688.12 | transmembrane protein 184c |
| SEQ ID NO: 8659 | Nga00728 | 997.98 | 982.12 | nuclear receptor corepressor 2 |
| SEQ ID NO: 8660 | Nga06424 | 937.50 | 1154.27 | protein |
| SEQ ID NO: 8661 | Nga00182 | 456.20 | 449.81 | retinol retinaldehyde reductase |
| SEQ ID NO: 8662 | Nga05994 | 271.55 | 278.59 | protein |
| SEQ ID NO: 8663 | Nga20156 | 503.89 | 463.16 | ph domain-containing protein |

FIGURE 24 EH

USE OF ENDOGENOUS PROMOTERS IN GENETIC ENGINEERING OF *NANNOCHLOROPSIS GADITANA*

CROSS REFERENCE TO RELATED APPLICATIONS

This application claims benefit of priority pursuant to 35 U.S.C. §119(e) of U.S. provisional patent application No. 61/548,157, filed 17 Oct. 2011 and U.S. provisional patent application No. 61/578,110, filed 20 Dec. 2011, both of which are hereby incorporated by reference in their entirety.

SEQUENCE LISTING

A Sequence Listing submitted in computer readable form (CRF) is hereby incorporated by reference. The CRF file is named 229741-US-2_ST25-v1.txt, was created on Oct. 17, 2012, and contains 9380 kilobytes.

TECHNICAL FIELD

This disclosure is directed to the production of biomass and lipids from algae. Specifically, this disclosure is directed to isolated microalgae nucleic acid control and coding sequences and variants thereof, methods of modifying microalgae, and use of modified microalgae for the production of biomass and lipids.

BACKGROUND

In recent years, a detailed understanding of the many biosynthetic pathways that can be used for the production of biofuel feedstocks and higher value bioproducts has emerged, and novel pathways for the production of specific bioenergy carriers are continuously being discovered in a variety of organisms. (Steen, E. J. et al. Microbial production of fatty-acid-derived fuels and chemicals from plant biomass. Nature 463, 559-562 (2010); Radakovits, R., Jinkerson, R. E., Darzins, A. & Posewitz, M. C. Genetic engineering of algae for enhanced biofuel production. Eukaryotic Cell 9, 486-501 (2010); Rude, M. A. & Schirmer, A. New microbial fuels: a biotech perspective. Current Opinion in Microbiology 12, 274-281 (2009); Jang, Y.-S. et al. Engineering of microorganisms for the production of biofuels and perspectives based on systems metabolic engineering approaches. Biotechnology Advances (2011); Li, H., Cann, A. F. & Liao, J. C. Biofuels: Biomolecular engineering fundamentals and advances. Annual Review of Chemical and Biomolecular Engineering 1, 19-36 (2010)).

Further improvements in strain productivity have been hampered by the lack of a genetically tractable model system for these highly productive oleaginous algae. Currently, the algal model species are the green alga *Chlamydomonas reinhardtii* and the diatom *Phaeodactylum tricornutum*, both of which have genome sequences and established transformation methods. (Merchant, S. S. et al. The *Chlamydomonas* genome reveals the evolution of key animal and plant functions. *Science*, 245-250 (2007); Bowler, C. et al. The *Phaeodactylum* genome reveals the evolutionary history of diatom genomes. *Nature*, 239-244 (2008); Siaut, M. et al. Molecular toolbox for studying diatom biology in *Phaeodactylum tricornutum*. *Gene*, 23-35 (2007); Zaslayskaia, L. A., Lippmeier, J. C., Kroth, P. G., Grossman, A. R. & Apt, K. E. Transformation of the diatom *Phaeodactylum tricornutum* (Bacillariophyceae) with a variety of selectable marker and reporter genes. *Journal of Phycology*, 379-386 (2000); Boynton, J. et al. Chloroplast transformation in *Chlamydomonas* with high velocity microprojectiles. *Science*, 1534-1538 (1988); Kindle, K. L. High-frequency nuclear transformation of *Chlamydomonas reinhardtii*. *Proceedings of the National Academy of Sciences*, 1228-1232 (1990)). Genetic engineering approaches have been used to improve biofuel phenotypes in both of these organisms (Radakovits, R., Eduafo, P. M. & Posewitz, M. C. Genetic engineering of fatty acid chain length in *Phaeodactylum tricornutum*. *Metabolic Engineering*, 89-95 (2011); Work, V. H. et al. Increased lipid accumulation in the *Chlamydomonas reinhardtii* sta7-10 starchless isoamylase mutant and increased carbohydrate synthesis in complemented strains. *Eukaryotic Cell*, 1251-1261 (2010); Wang, Z. T., Ullrich, N., Joo, S., Waffenschmidt, S. & Goodenough, U. Algal Lipid Bodies: Stress induction, purification, and biochemical characterization in wild-type and starchless *Chlamydomonas reinhardtii*. *Eukaryotic Cell*, 1856-1868 (2009); Li, Y. et al. *Chlamydomonas* starchless mutant defective in ADP-glucose pyrophosphorylase hyper-accumulates triacylglycerol. *Metabolic Engineering*, 387-391 (2010)), unfortunately neither of these algae in their native form produce high amounts of biomass or lipids and as such, extensive genetic modifications will be needed prior to their use in biofuel applications.

*Nannochloropsis* is an algae that can accumulate biomass through photoautotrophy, it also stores lipids (Rodolfi, L. et al. Microalgae for oil: Strain selection, induction of lipid synthesis and outdoor mass cultivation in a low-cost photobioreactor. *Biotechnology and Bioengineering*, 100-112 (2009); Converti, A., Casazza, A. A., Ortiz, E. Y., Perego, P. & Del Borghi, M. Effect of temperature and nitrogen concentration on the growth and lipid content of *Nannochloropsis oculata* and *Chlorella vulgaris* for biodiesel production. *Chemical Engineering and Processing: Process Intensification*, 1146-1151 (2009); Gouveia, L. & Oliveira, A. Microalgae as a raw material for biofuels production. *Journal of Industrial Microbiology & Biotechnology*, 269-274 (2009); Pal, D., Khozin-Goldberg, I., Cohen, Z. & Boussiba, S. The effect of light, salinity, and nitrogen availability on lipid production by *Nannochloropsis* sp. *Applied Microbiology and Biotechnology*, 1429-1441 (2011); Zou, N., Zhang, C., Cohen, Z. & Richmond, A. Production of cell mass and eicosapentaenoic acid (EPA) in ultrahigh cell density cultures of *Nannochloropsis* sp. (Eustigmatophyceae). *European Journal of Phycology*, 127-133 (2000)) and may be cultivated using natural sunlight in either open ponds or enclosed systems by companies such as Solix Biofuels (Fort Collins, Colo.), Seambiotic (Tel Aviv, Israel), Hairong Electric Company/Seambiotic (Penglai, China) and Proviron (Antwerp, Belgium).

What is needed is an alga that has high lipid and biomass production, whose genome sequence is know, with established protocols for genetic manipulation, and can be cultivated at commercial scale.

SUMMARY

The present disclosure relates to novel polynucleotide control sequences that regulate transcription. In addition novel polypeptide sequences, polynucleotides that encode those polypeptides, and antibodies directed to those polypeptides are disclosed. Expression vectors comprising the disclosed polynucleotides are also described. The present invention also relates to transgenic alga, methods for growing transgenic alga, and methods for obtaining biomass from transgenic alga.

Described herein are purified polynucleotides comprising nucleotide sequences homologous to sequences selected from SEQ ID NOs: 1-8663; wherein said nucleotide sequence has transcriptional promoter activity. In some variations, the described nucleotide sequences are operably linked to coding sequences that encode polypeptides selected from SEQ ID NOs:8664-8838. In some variations, the described nucleotide sequences can regulate a polynucleotide encoding a polypeptide in a lipid biosynthetic pathway, or a polypeptide that regulates a lipid biosynthetic pathway.

Also described are purified polynucleotides comprising nucleotide sequences that encode polypeptides selected from SEQ ID NOs:8664-8838. The disclosed polypeptides can be operably linked to nucleotide sequences selected from SEQ ID NOs:1-8663. Polynucleotide sequences that hybridize to nucleic acid sequences coding for the disclosed polypeptides are also described.

Methods of obtaining algae are described, wherein the methods comprise, placing at least one alga in a medium, wherein the alga comprises a purified polynucleotide sequence selected from SEQ ID NOs:8664-8838, operably linked to a polynucleotide sequence encoding a polypeptide; allowing the alga to reach a stationary phase; and separating the algae from the medium to obtain a purified algae. The disclosed method can also include steps for reducing the nitrogen content of the media.

Methods of modifying at least one alga is also described, the method comprising, a) introducing a purified polynucleotide sequence selected from SEQ ID NOs:8664-8838, or a purified polynucleotide sequence encoding a polypeptide selected from SEQ ID NO:8664-8838 into at least one alga; and b) contacting the transformed algae with a medium.

BRIEF DESCRIPTION OF THE DRAWINGS

FIG. 1A is a list of Chlorophyll (tetrapyrrole), carotenoid and sterol biosynthesis genes. The list of FIG. 1A is continued on FIG. 1B-FIG. 1C. In FIGS. 1A-1C, "a" designates *N. gaditana* gene model encoding corresponding enzyme; "b" indicates if given gene model has transcript support from RNAseq of a pool of conditions including: +/−nitrate, logarithmic phase, stationary phase, heat shocked culture (2 h at 37° C.), cold treated culture (2 h at 4° C.), culture after 12 h dark, +/−$CO_2$; "c" indicates if the gene model is located in the nuclear genome (N) or chloroplast genome (C).

FIG. 2*a* is *Nannochloropsis gaditana* production of biomass, lipids, protein and sugars quantified during continuous growth over a period of three months in 50% salinity seawater medium supplemented with nitrate, phosphate and $CO_2$ grown with continuous 1000 μE light. Every week half of the culture was harvested and replaced with fresh medium. FIG. 2*b* is a chart illustrating harvested biomass compositions, the majority of which consists of lipids even under nutrient replete conditions. FIG. 2*c* is a table describing the yield in mg/l/d and the biomass composition as a % of total. FIG. 2*d* shows a comparison of *N. gaditana* lipid production rates with other algae examined in this work. FIG. 2*e* is a comparison of *N. gaditana* large scale production rates with other biofuel production platforms. Bars in green indicate our estimations; bars in gray indicate estimations by Atsumi et al. 2009. The values for *N. gaditana* have been extrapolated from 1 L cultures and adjusted for our observed productivity in 12 h/12 h light/dark cycles. The *S. elongatus* production values are for 24 h light and would presumably be lower in 12 h/12 h light/dark cycles.

FIG. 3*a* shows lipid droplets in cells during logarithmic growth. FIG. 3*b* shows lipid droplets in cells during stationary phase. Lipid droplets are fluorescently labeled with BODIPY (492/503) (green), chlorophyll autofluorescence (red). FIG. 3*c* is a GC-FID chromatogram showing a typical *N. gaditana* fatty acid profile.

FIG. 6A is a table comparing the chloroplast gene content of several different organisms with *N. gaditana*. The table of FIG. 6 A is continued on FIGS. 6B-6E.

FIG. 8A is a table of various gene clusters from *N. gaditana*. The table of FIG. 8A is continued on FIGS. 8B-8C. In FIGS. 8A-8C, "a" is the gene ontology (GO) term that defines gene cluster; "b" is the gene ontology term description; "c" is the name of contig that gene cluster is found on; "d" is the corresponding *N. gaditana* gene model; "e" is the *N. gaditana* gene model description; "f" is the gene location in cluster.

FIG. 9*a* is a schematic phylogenetic tree of stramenopiles and photosynthetic algae. The tree is adapted from Eisenreich et al., 2004 and Tyler et al. 2006. Filled green circles on the right indicate photosynthetic species. The inset cladogram outlines the relationship between the different species of *Nannochloropsis* based on 18S rRNA. FIG. 9*b* is a Venn diagram representation of shared/unique genes in comparison of *N. gaditana* with brown algae, diatoms, red algae and green algae. FIG. 9*c* is a pie chart showing the StramenopilePhotoCut of genes common to photosynthetic and absent in non-photosynthetic stramenopiles. Green sector: fraction of the StramenopilePhotoCut that is also found in the GreenCut2 of genes common to the green lineage; yellow sector: genes unique for the photosynthetic Stramenopiles (not found in green or red lineages).

FIG. 11A is the first view of a table of "StramenopilePhotoCut" genes. FIGS. 11B-11S are continuation views of FIG. 11A. In FIG. 11A-FIG. 11S, "a" is the name given to *N. gaditana* gene model by manual curation, "b" is the conserved protein domain(s) ID assigned from NCBI-curated domains, Pfam, SMART, COG, PRK, or TIGRFAM databases, "c" is a description(s) of conserved protein domain given, "d" is algal lineages with homologs to *N. gaditana* gene model. B—Brown, D—diatom, R—red, G—green, "e" indicates if *N. gaditana* gene model has homology to a Green-Cut2 gene. P229741.US.03 Use of Endogenous Promoters FIG. 12*a* is a chart showing the "StramenopilePhotoCut" of genes comparing photosynthetic and nonphotosynthetic stramenopiles. Green indicates the fraction of the "StramenopilePhotoCut" which are found in the GreenCut2 of photosynthetic genes; yellow indicates the "StramenopilePhotoCut" genes that are found in diatom and brown algal lineages, but not found in red or green algal lineages; red indicates the "StramenopilePhotoCut" genes that are found in diatom, brown, and red algal lineages; light green indicates the "StramenopilePhotoCut" genes that are found in diatom, brown, and green algal lineages, but not in GreenCut2; purple indicates the "StramenopilePhotoCut" genes that are found in diatom, brown, red, and green algal lineages, but not in GreenCut2. FIG. 12b is a chart showing the number of "StramenopilePhotoCut" genes with select Gene Ontology (GO) terms. The organisms that were included in the analysis of the "StramenopilePhotoCut" include *N. gaditana* and the photosynthetic stramenopile algae *Ectocarpus siliculosus, Aureococcus.anophagefferens, Phaeodactylum tricornutum,* and *Thalassiosira pseudonana*, the nonphotosynthetic stramenopiles *Phytophtora sojae, Phytophtora ramorum, Phytophtora infestans, Blastocystis hominis,* and *Albugo laibachii*. In addition the red alga *Cyanidioschyzon merolae* and the green algae *Chlamydomonas reinhardtii, Chlorella variabilis* NC64, and *Ostreococcus lucimarinus*, were used to determine if "StramenopilePhotoCut" genes are found in other algal lineages.

FIG. 15A is a table listing lipid metabolic pathway genes. The table of FIG. 15A is continued on FIGS. 15B-15C. In FIGS. 15A-15C, "a" is the candidate *N. gaditana* gene model encoding corresponding enzyme; "b' Indicates if given gene model has transcript support from RNAseq of a pool of conditions including: +/−nitrate, logarithmic phase, stationary phase, heat shocked culture (2 h at 37° C.), cold treated culture (2 h at 4° C.), culture after 12 h dark, +/−$CO_2$.

FIG. 17 is a table comparing lipid metabolic genes in various organisms. "a" is a comparison of the number of copies of lipid metabolic genes that are homologous between *N. gaditana*, brown algae (*E. siliculosus*), diatoms (*P. tricornutum*), red algae (*C. merolae*) and green algae (*C. reinhardtii*), "b" Total number of genes in this organism, "c" Category of lipid metabolic genes, sorted by fatty acid biosynthesis, TAG assembly and lipid degradation, "d" Total number of genes that are listed in specified category of the lipid metabolism, "e" Total number of genes in all listed categories of lipid metabolic pathways.

FIG. 18 is a table of selected GO-term expansions/reductions. "a" are the expansions and reduction of GO-terms. Green indicates over-representation in comparison with both *P. tricornutum* and *C. reinhardtii*, while red indicates under-representation. Lighter green and red indicates over-representation and underrepresentation in comparison with *C. reinhardtii* alone, "b" is the gene ontology term description, "c" signifies whether the GO-term is over- or under-represented in comparison with *P. tricornutum* and *C. reinhardtii*, "d" is the probability for over/under-representation in comparison with *C. reinhardtii* and *P. tricornutum* calculated by Fisher exact test.

FIG. 19 is a list of over-representation of amino acid metabolic GO-terms. "a" expansions and reduction of GO-terms relating to amino acid metabolism. Green indicates overrepresentation in comparison with both *P. tricornutum* and *C. reinhardtii*, while red indicates under-representation, "b" is the gene ontology term description, "c" signifies whether the GO-term is over- or under-represented in comparison with *P. tricornutum* and *C. reinhardtii*, "d" Probability for over/under-representation in comparison with *C. reinhardtii* and *P. tricornutum* calculated by Fisher exact test.

FIG. 20A is a list depicting transcriptional regulation of metabolic pathways. The list of FIG. 20A is continued on FIGS. 20B-20H. In FIGS. 20A-20H, "a" *N. gaditana* gene models differentially regulated during nitrogen deprivation, "b" fold regulation of gene, >1 signifies up-regulation, <1 signifies down-regulation, "c" *N. gaditana* gene model description. A green label indicates a function in photosynthesis; a blue label indicates a function in nitrogen utilization or protein degradation/recycling, "d" conserved protein domain ID assigned from NCBI-curated domains, Pfam, SMART, COG, PRK, or TIGRFAM databases, "e" is a description of conserved protein domain given.

FIG. 22a Genomic PCR confirmation of the presence of the transgene. FIG. 22b Southern blot indicating the nuclear incorporation and copy number of the Zeocin resistance gene in three different transformants (lanes 1-3), and the lack of the transgene in a wildtype control (WT lane).

FIG. 23 is a list of polypeptide sequences and their corresponding SEQ ID NOs, and reference names.

FIG. 24 A is a list of polynucleotides and their corresponding SEQ ID NOs. The list of FIG. 24 A is continued on FIGS. 24 B-24 EH. FIGS. 24 A-24 EH also present reference names and the relative expression levels of these genes under control of their native promoters.

DETAILED DESCRIPTION

Figure 2:
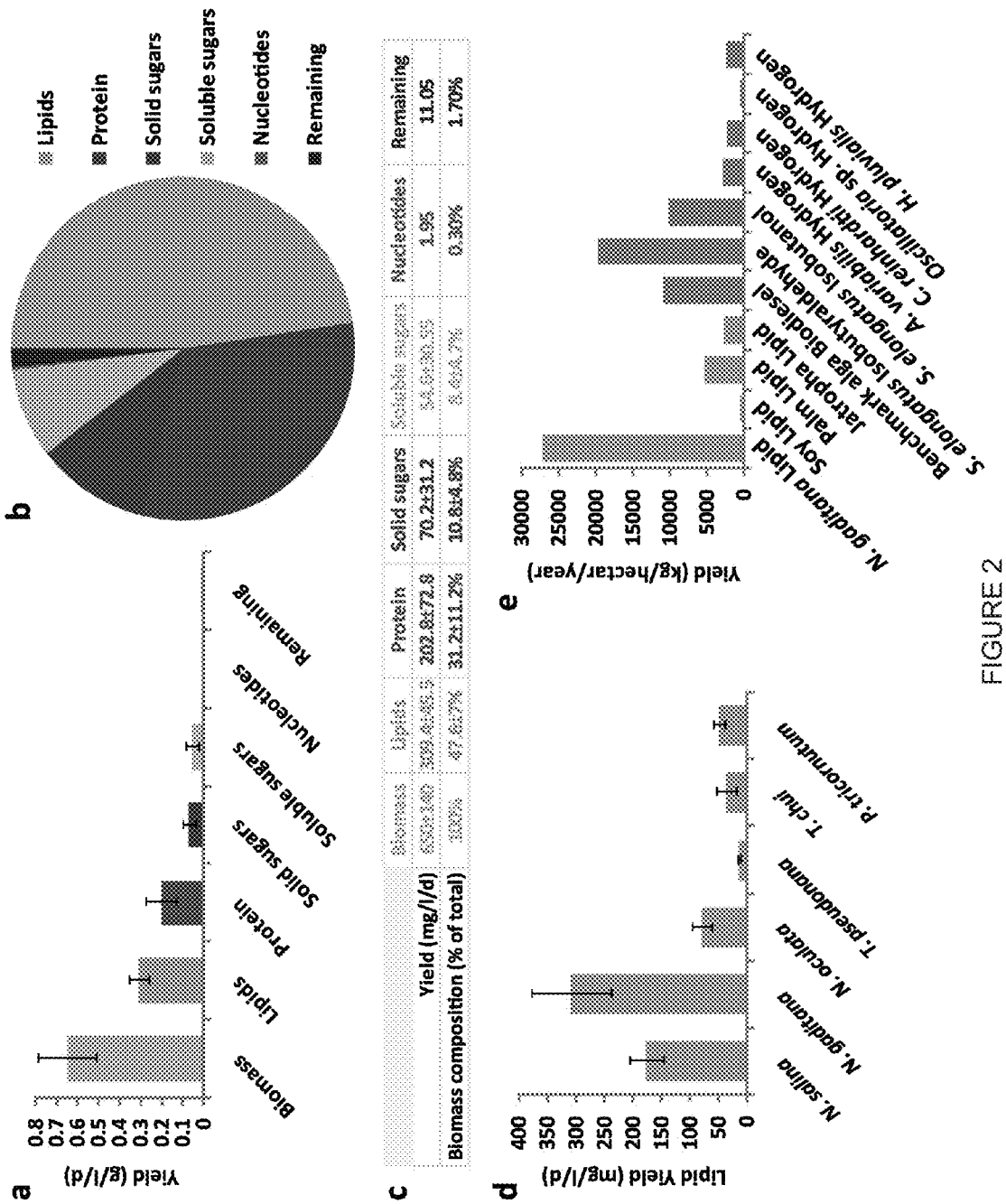
FIG. 2 depicts biomass production by *N. gaditana*.

Disclosed herein are polynucleotides and polypeptides of the algae *N. gaditana*. The disclosed sequences comprise control regions and polypeptides implicated in biomass biosynthesis. In some cases the control regions comprise expression and transcription regulatory sequences, promoter sequences, enhancers, and transcription factor binding sequences that can aid in controlling the expression of operably linked gene sequences. Also disclosed are amino acid sequences involved in biosynthesis of biofuels and biomass, and nucleotide sequences that encode the amino acid sequences.

Also disclosed herein are methods of introducing nucleic acids into algae to create transgenic algae. The nucleic acids can comprise control regions and coding sequences. The transgenic algae can be used to produce lipids, proteins, and other valuable products for use in biofuel and biomass.

The present disclosure relates to novel polynucleotide control sequences that regulate transcription. In addition novel polypeptide sequences, polynucleotides that encode those polypeptides, and antibodies directed to those polypeptides are disclosed. Expression vectors comprising the disclosed polynucleotides are also described. The present invention also relates to transgenic alga, methods for growing transgenic alga, and methods for obtaining biomass from transgenic alga.

Described herein are polynucleotides comprising nucleotide sequences homologous to sequences selected from SEQ ID NOs:1-8663; wherein said nucleotide sequence has transcriptional regulatory activity. In some variations, the described nucleotide sequences are operably linked to coding sequences that encode polypeptides selected from SEQ ID NOs:8664-8838. In some variations, the described nucleotide sequences can regulate a polynucleotide encoding a polypeptide in a lipid biosynthetic pathway, or a polypeptide that regulates a lipid biosynthetic pathway.

Also described are polynucleotides comprising nucleotide sequences that encode polypeptides selected from SEQ ID NOs:8664-8838. The disclosed polypeptides can be operably linked to nucleotide sequences selected from SEQ ID NOs:1-8663. Polynucleotide sequences that hybridize to nucleic acid sequences coding for the disclosed polypeptides are also described.

Methods of obtaining algae are also described. Methods of obtaining algae can comprise, placing at least one alga in a medium, wherein the alga comprises a control polynucleotide sequence selected from SEQ ID NOs:1-8663. In various cases the control polynucleotide can be operably linked to a polynucleotide sequence encoding a polypeptide. The method may further comprise allowing the alga to reach a stationary phase, and separating the alga from the medium to obtain a purified alga. The disclosed method can also include steps for reducing the nitrogen content of the media. In other cases, methods are disclosed for using algae that have been modified to allow biomass and biofuel production during the growth phase.

Methods of modifying algae are also described. Methods of modifying algae can comprise introducing a control polynucleotide sequence selected from SEQ ID NOs:1-8663, or a purified polynucleotide sequence encoding a polypeptide selected from SEQ ID NOs:8664-8838 into at least one alga and then contacting the transformed algae with a medium.

Homologous Nucleotide Sequences Aligned with BLASTn

In one case, the disclosed nucleotide sequences homologous to SEQ ID NOs:1-8663. In various cases, the nucleotide sequences can be identical to the sequences of SEQ ID NOs:1-8663. In other cases, the nucleotide sequences can be homologous to a portion of SEQ ID NOs:1-8663, for example more than about 5 nt, 10 nt, 15 nt, 20 nt, 25 nt, 30 nt, 35 nt, 40 nt, 45 nt, 50 nt, 60 nt, 70 nt, 80 nt, 90 nt, 100 nt, 150 nt, 200 nt, 300 nt, 400 nt, 500 nt, or 600 nt, and/or less than about 700 nt, 600 nt, 500 nt, 400 nt, 300 nt, 200 nt, 150 nt, 90 nt, 80 nt, 70 nt, 60 nt, 55 nt, 50 nt, 45 nt, 40 nt, 35 nt, 30 nt, 25 nt, 20 nt, 15 nt, 10 nt, or 5 nt. In various cases, the homologous sequences can include deleted nucleotides or inserted nucleotides.

In various cases the homologous nucleotide sequences can be aligned by a nucleotide sequence alignment algorithm. For example, blastn for aligning two nucleotide sequences, wherein the program is optimized for highly similar sequences (megablast) or for somewhat similar sequences (blastn; this can be useful where sequences have less than about 90% identity or the sequences have low complexity). In various cases the maximum target sequence is set to the length of the longer of the two sequences to be aligned, the expected threshold can be 10, the word size can be 28, the match/mismatch scores can be −1, −2 and the gap costs linear. In various cases of homology between nucleotide sequences, homology can be expressed as percent identity.

In some variations the nucleotide sequences, when aligned with the sequences of SEQ ID NOs:1-8663, can have identity of more than about 40%, 45%, 50%, 55%, 60%, 65%, 70%, 75%, 80%, 85%, 90%, or 95% and/or less than about 100%, 95%, 90%, 85%, 80%, 75%, 70%, 65%, 60%, 55%, 50%, or 45% identities. In various cases the sequence alignment can have gaps of less than about 15%, 14%, 13%, 12%, 11%, 10%, 9%, 8%, 7%, 6%, 5%, 4%, 3%, 2%, 1%.

Homology Based on Hybridization

In some cases, the inventive nucleotide sequences can hybridize to the sequences of SEQ ID NOs:1-8663. Hybridization can occur under various stringency conditions. Stringency refers to the binding of two single stranded nucleic acids via complementary base pairing. Extensive guides to the hybridization of nucleic acids can be found in: Tijssen, Laboratory Techniques in Biochemistry and Molecular Biology-Hybridization with Nucleic Acid Probes Part I, Ch. 2, "Overview of principles of hybridization and the strategy of nucleic acid probe assays" (1993), Elsevier, N.Y.; and Sambrook et al., Molecular Cloning: A Laboratory Manual (3rd ed.) Vol. 1-3 (2001), Cold Spring Harbor Laboratory, Cold Spring Harbor Press, N.Y. The phrases "hybridizing specifically to", "specific hybridization", and "selectively hybridize to", refer to the preferential binding, duplexing, or hybridizing of a nucleic acid molecule to a particular probe under stringent conditions. The term "stringent conditions" refers to hybridization conditions under which a probe will hybridize preferentially to its target subsequence, and to a lesser extent, or not at all, to other sequences in a mixed population (e.g., a DNA preparation from a tissue biopsy). "Stringent hybridization" and "stringent hybridization wash conditions" are sequence-dependent and are different under different environmental parameters.

Generally, highly stringent hybridization and wash conditions are selected to be about 5° C. lower than the thermal melting point (Tm) for a specific sequence at a defined ionic strength and pH. The Tm is the temperature at which 50% of the target sequence hybridizes to a perfectly matched probe. Very stringent conditions are selected to be equal to the Tm for a particular probe. Often, a high stringency wash is preceded by a low stringency wash to remove background probe signal. An example of stringent hybridization conditions for hybridization of complementary nucleic acids which have more than 100 complementary residues on an array is 42° C. using standard hybridization solutions, with the hybridization being carried out overnight. An example of highly stringent wash conditions is a 0.15 M NaCl wash at 72° C. for 15 minutes. An example of stringent wash conditions is a wash in 0.2× Standard Saline Citrate (SSC) buffer at 65° C. for 15 minutes. An example of a medium stringency wash for a duplex of, for example, more than 100 nucleotides, is 1×SSC at 45° C. for 15 minutes. An example of a low stringency wash for a duplex of, for example, more than 100 nucleotides, is 4× to 6×SSC at 40° C. for 15 minutes.

In some cases, the disclosed inventive nucleic acid sequences can bind to *N. gaditana* control sequences with low stringency.

Nucleotide Sequence Form

In various cases the homologous nucleotide sequences can be single-stranded, double stranded, or a combination thereof. In some variations, the nucleotide sequences can comprise natural nucleic acids, synthetic nucleic acids, non-natural nucleic acids, and/or nucleic acid analogs. The nucleotide sequences can further comprise other non-nucleic acid molecules such as amino acids, and other monomers.

In various cases, the nucleic acids of the disclosed nucleotide sequences can include nucleotides that are metabolized in a manner similar to naturally occurring nucleotides. Also included are nucleic-acid-like structures with synthetic backbone analogues including, without limitation, phosphodiester, phosphorothioate, phosphorodithioate, methylphosphonate, phosphoramidate, alkyl phosphotriester, sulfamate, 3'-thioacetal, methylene(methylimino), 3'-N-carbamate, morpholino carbamate, and peptide nucleic acids (PNAs) (see, e.g.: "Oligonucleotides and Analogues, a Practical Approach," edited by F. Eckstein, IRL Press at Oxford University Press (1991); "Antisense Strategies," Annals of the New York Academy of Sciences, Volume 600, Eds. Baserga and Denhardt (NYAS 1992); Milligan (1993) J. Med. Chem. 36:1923-1937; and "Antisense Research and Applications" (1993, CRC Press)). PNAs contain non-ionic backbones, such as N-(2-aminoethyl) glycine units. Phosphorothioate linkages are described in: WO 97/03211; WO 96/39154; and Mata (1997) Toxicol. Appl. Pharmacol. 144:189-197. Other synthetic backbones encompassed by this term include methyl-phosphonate linkages or alternating methyl-phosphonate and phosphodiester linkages (Strauss-Soukup (1997) Biochemistry 36: 8692-8698), and benzyl-phosphonate linkages (Samstag (1996) Antisense Nucleic Acid Drug Dev 6: 153-156).

Control Activity of Nucleotide Sequences

In various cases the disclosed nucleotide sequences comprise control sequences having transcriptional regulatory activity. Control sequences with transcriptional regulatory activity can include sequences that can affect transcription or expression of a nearby or distal transcribed sequences. In various cases, the disclosed control sequences can enhance or suppress transcription from nearby or distal genes and coding sequences. In various cases, specific sequences can be used to enhance and/or suppress transcription from a nearby gene. In various cases, these nucleic acid sequences can provide binding or recognition sequences for proteins and enzymes involved in transcription, for example TATA binding protein, RNA polymerase (I, II, or III) and DNA binding proteins, such as transcription factors. Disclosed nucleotide sequences can comprise core promoter sites, transcription initiation sites, proximal promoter sites, or distal promoter sites.

In various cases, control activity of a nucleotide sequence can be tested by the use of a coding sequence operatively connected to the nucleotide sequence. In various cases the coding sequence can be a reporter gene. In various cases the reporter can be screenable or selectable. Selectable reporters can be required for survival in certain media, for example in the presence of an antibiotic. Screenable reporters can be observed visually, or easily assayed.

In various cases, less than the entire control region can be used to regulate transcriptional expression of a nearby gene. In various cases portions of the disclosed control regions ranging from less than about 700 nt (nucleotides), 600 nt, 500 nt, 400 nt, 300 nt, 200 nt, 100 nt, 90 nt, 80 nt, 70 nt, 60 nt, 50 nt or 40 nt, and/or in various cases more than about 50 nt, 60 nt, 70 nt, 80 nt, 90 nt, 100 nt, 200 nt, 300 nt, 400 nt, 500 nt, or 600 nt can aid in regulating gene expression. In various cases the described control sequence can be a contiguous sequence. In other cases non-contiguous portions of a control sequence can be connected, and internal portions removed. In various cases portions of a control sequence can be inverted relative to their native orientation. In various cases the control sequences can have internal nucleotides removed. In other cases, nucleotides can be added, or deleted, or the identity of a nucleotide changed.

The disclosed control regions can comprise nucleotide sequence from more than one control region. In various cases the multiple control regions can be operably linked. In various cases the operably linked control regions can be in the same orientation, for example a direct repeat. In other cases, the control regions can be oriented in opposite directions.

In various cases, the disclosed control regions can be modified to include binding sites for specific proteins or enzymes, for example N. gaditana, or non-N. gaditana proteins or transcription factors. In various cases, control regions can be modified to include binding sites for transcription factors and proteins that maybe regulated. In various cases, regulated transcription factors can suppress or enhance transcription from nearby genes in response to environmental stimuli or specific molecules and/or intra-cellular and inter-cellular signals.

The disclosed control regions can be used with promoters, enhancers, and other genetic regulatory elements from different control regions.

In various cases the inventive control sequence is all or a portion of: SEQ ID NO:8336, Nga06994; SEQ ID NO:2473, Nga02045; SEQ ID NO:1992, Nga00934; SEQ ID NO:2325, Nga00965.01; SEQ ID NO:5027, Nga02886; SEQ ID NO:1069, Nga02524.01; SEQ ID NO:2171, Nga00078; SEQ ID NO:3600, Nga04463.1; SEQ ID NO:6398, Nga00714; SEQ ID NO:4944, Nga00519; SEQ ID NO:3025, Nga01286; SEQ ID NO:1712, Nga03241; SEQ ID NO:5909, Nga05308; SEQ ID NO:8316, Nga02117; SEQ ID NO:928, Nga02604; SEQ ID NO:1397, Nga06559; SEQ ID NO:3381, Nga03303; SEQ ID NO:5521, Nga06692; SEQ ID NO:6585, Nga00109; SEQ ID NO:5453, Nga02544.

In various cases, the polynucleotides can have transcriptional promoter activity. In these cases, the control regions can initiate transcription of an operably linked nucleic acid sequence, in various cases the linked nucleic acid is a coding sequence, gene, or non-coding sequence. In some variations, transcription can initiate within the control sequence, in other cases, transcription initiates at an operably linked nucleic acid sequence. In various cases, the coding sequence can code for an N-terminal methionine of an operably linked coding sequence.

Operably Linked Nucleic Acid Sequences and Transgenes

In various cases, the disclosed nucleotide sequences can be operably linked to a coding sequence. Operable linking of nucleic acid sequences can include where a nucleic acid is placed into a functional relationship with another nucleic acid sequence.

In various cases operably linking two or more nucleic acid sequences can form a transgene. In various cases, transgenes can include transcriptional and translational regulatory nucleic acid sequences and nucleic acid sequences encoding a polypeptide. In some variations, the transcriptional and translational regulatory sequences can include promoter sequences, ribosomal binding sites, transcriptional start and stop sequences, translational start and stop sequences, and enhancer or activator sequences. In various cases, the operably linked nucleic acid sequences can comprise an expression cassette. An expression cassette can comprise one or more coding sequences and control sequences that regulate expression of the coding sequence. In various cases, the control sequence can be a promoter sequence, and the coding sequence can comprise untranslated sequence or region that can further comprise a polyadenylation site. In various cases, the expression cassette can be contained on a plasmid or vector. In various cases, expression cassettes further comprise nucleic acid sequences allow for selection or retention of the cassette within the organism.

In various cases, the nucleotide sequences comprising a transgene can be incorporated into a genome of a cell, or can be an unincorporated plasmid or vector. In various cases, a plasmid or vector introduced into a cell can later become incorporated into the cell's genome. In various cases, genome can refer to nucleic acids including coding, non-coding, and regulatory sequences in linear or circular form. In various cases a genome can be one or several chromosomes. In various cases a genome can reside in the cytoplasm, nucleus, or organelles such as mitochondria or chloroplast.

In some cases, the disclosed nucleotide sequences can be operably linked to non-heterologous *N. gaditana* or non-*N. gaditana* coding regions. In some cases control regions operatively linked to coding regions can result in greater or lesser expression of a specific gene. In some cases, the control/promoter region can result in the gene being expressed in response to specific stimuli, for example, a coding sequence that was previously not highly expressed during nitrogen starvation can become highly expressed during nitrogen starvation when operably linked to one or more the disclosed nucleotide sequences.

In various cases, non-*N. gaditana* nucleic acid sequences can be operably linked to the disclosed *N. gaditana* nucleic acid sequences. In various cases, non-*N. gaditana* can refer to other *Nannochloropsis* algae (e.g. *N. gaditana, N. salina, N. oculata, N. oceanica, N. granulate, N. limnetica, N. Nannochloropsis* W2J3B), other photosynthetic algae (e.g. *Chlamydomonas reinhardtii, Chlorella protothecoides*), other eustigmatophytes, and stramenopiles (e.g. *Phaeodactylum tricornutum, Thalassiosira pseudonana, Phytophtora* sp., *Ectocarpus siliculosus, Aureococcus anophageﬀerens*). In various cases, non-*N. gaditana* can refer to sequences from bacteria, fungi and higher plants as well as sequences that have been synthesized to be codon optimized for expression in *Nannochloropsis*.

Disclosed herein are polypeptides sequences homologous to SEQ ID NOs: 8664-8838, as well as nucleotide sequences that encode polypeptides of SEQ ID NOs: 8664-8838. Polypeptides disclosed herein can include amino acid sequences that are identical to the disclosed amino acid sequences. In other cases, the claimed polypeptides include amino acid sequences that can comprise conservative amino acid substitutions as compared to the disclosed sequence. Conservative amino acid substitutions can include amino acids that share characteristics with the substituted amino acid. In various cases, substitution can be made without significant change in the structure or function of the polypeptide.

Conservative amino acid substitutions can be made on the basis of relative similarity of side-chain size, charge, hydrophobicity, hydrophilicity, etc. In various cases, substitutions can be assayed for their effect on the function of the protein by routine testing. Conserved amino acid substitutions include amino acids with similar hydrophilicity value, as wherein amino acids have a hydropathic index which can be based upon an amino acid's hydrophobicity and charge. In various cases, conserved amino acid substitutions can be made between amino acids of the same class, for example non-polar amino acids, acidic amino acids, basic amino acids, and neutral amino acids. Conservative substitutions can also be based upon size or volume. Amino acids can also be classified based upon their ability to form or break a given structure, such as an alpha helix, beta sheet, or intra- or inter-molecular interaction. In various cases conservative amino acid substitutions are based upon more than one characteristic.

Currently disclosed polypeptides can include both natural and non-natural amino acids. In various cases, natural amino acid side chains can be substituted with non-natural side chains. In various cases, amino acids can be derivatised.

The disclosed polypeptides include polypeptides that are homologous to the sequences of SEQ ID NOs:8664-8838. Homology can be expressed as % identity or % similar or % positive. In various cases, % identity is a percentage of amino acids that are identical between two aligned polypeptides, and % similar or % positive is a percentage of amino acids that are non-identical but represent conservative substitutions; for example, lysine to arginine can be considered a conservative substitution where charge is considered.

In various cases, two polypeptides can be aligned by algorithms, for example BLASTp. In various cases, the BLASTp perameters can be set with a maximum target sequence length equal to, greater, or less than the length of the longer of the two polypeptides, the expect threshold can be set to 10, the word size to 3, and scoring matrix can be BLOSUM62, with gap costs of 11 for existence and 1 for extension. BLASTp can report homology of aligned polypeptides as "Identities" and "Positives." The aligned sequences can include gaps to achieve the alignment.

In various cases, homology of amino acid sequences can reflect the percentage of identity or positives when optimally aligned as described above. In various cases, the % homology (% positive) or % identity can be calculated by dividing the number of aligned amino acids within a comparison window. A comparison window can be the entire length of one or the other polypeptides, if the two polypeptides are of unequal length. In other cases, the comparison window can be a portion of one of the polypeptides. In various cases the comparison window for measuring homology or identity of two polypeptide sequences is greater than about 40 aa (amino acids), 45 aa, 50 aa, 55 aa, 60 aa, 65 aa, 70 aa, 75 aa, 80 aa, 85 aa, 90 aa, 95 aa, 100 aa, 150 aa, or 200 aa, and/or less than about 200 aa, 150 aa, 100 aa, 95 aa, 90 aa, 85 aa, 80 aa, 75 aa, 70 aa, 65 aa, 60 aa, 55 aa, 50 aa, or 45 aa.

In various cases, the claimed amino acid sequences can have % identity or % homology (% positive) over a given comparison window, that is greater than about 60%, 65%, 70%, 75%, 80%, 85%, 90%, 91%, 92%, 93%, 94%, 95%, 96%, 97%, 98%, or 99% and/or less than about 100%, 99%, 98%, 97%, 96%, 95%, 94%, 93%, 92%, 91%, 90%, 85%, 80%, 75%, or 70%.

In various cases, a sequence alignment can be performed using various algorithms, including dynamic, local, and global alignment. For example, the algorithm of Smith and Waterman, 1981, Adv. Appl. Math 2: 482; the alignment algorithm of Needleman and Wunsch, 1970, J. Mol. Biol. 48:443; the similarity method of Pearson and Lipman, 1988, Proc. Natl. Acad. Sci. USA 85: 2444. In various cases, computer programs can implement these algorithms (such as EMBOSS, GAP, BESTFIT, FASTA, TFASTA BLAST, BLOSUM, etc.).

In alternative cases, conserved amino acid substitutions can be made where an amino acid residue is substituted for another in the same class, where the amino acids are divided into non-polar, acidic, basic and neutral classes, as follows: non-polar: Ala, Val, Leu, Ile, Phe, Trp, Pro, Met; acidic: Asp, Glu; basic: Lys, Arg, His; neutral: Gly, Ser, Thr, Cys, Asn, Gln, Tyr.

In some cases, conserved amino acid substitutions can be made where an amino acid residue is substituted for another having a similar hydrophilicity value (e.g., within a value of plus or minus 2.0), where the following can be an amino acid having a hydropathic index of about −1.6 such as Tyr (−1.3) or Pro (−1.6)s are assigned to amino acid residues: Arg (+3.0); Lys (+3.0); Asp (+3.0); Glu (+3.0); Ser (+0.3); Asn (+0.2); Gin (+0.2); Gly (O); Pro (−0.5); Thr (−0.4); Ala (−0.5); His (−0.5); Cys (−1.0); Met (−1.3); Val (−1.5); Leu (−1.8); Ile (−1.8); Tyr (−2.3); Phe (−2.5); and Trp (−3.4).

In alternative cases, conserved amino acid substitutions can be made where an amino acid residue is substituted for another having a similar hydropathic index (e.g., within a value of plus or minus 2.0). In such cases, each amino acid residue can be assigned a hydropathic index on the basis of its hydrophobicity and charge characteristics, as follows: lie (+4.5); Val (+4.2); Leu (+3.8); Phe (+2.8); Cys (+2.5); Met (+1.9); Ala (+1.8); Gly (−0.4); Thr (−0.7); Ser (−0.8); Trp (−0.9); Tyr (−1.3); Pro (−1.6); H is (−3.2); Glu (−3.5); Gln (−3.5); Asp (−3.5); Asn (−3.5); Lys (−3.9); and Arg (−4.5).

In alternative cases, conservative amino acid changes include changes based on considerations of hydrophilicity or hydrophobicity, size or volume, or charge. Amino acids can be generally characterized as hydrophobic or hydrophilic, depending primarily on the properties of the amino acid side chain. A hydrophobic amino acid exhibits a hydrophobicity of greater than zero, and a hydrophilic amino acid exhibits a hydrophilicity of less than zero, based on the normalized consensus hydrophobicity scale of Eisenberg et al. (J. Mol. Bio. 179:125-142, 184). Genetically encoded hydrophobic amino acids include Gly, Ala, Phe, Val, Leu, lie, Pro, Met and Trp, and genetically encoded hydrophilic amino acids include Thr, His, Glu, Gln, Asp, Arg, Ser, and Lys. Non-genetically encoded hydrophobic amino acids include t-butylalanine, while non-genetically encoded hydrophilic amino acids include citrulline and homocysteine.

Hydrophobic or hydrophilic amino acids can be further subdivided based on the characteristics of their side chains. For example, an aromatic amino acid is a hydrophobic amino acid with a side chain containing at least one aromatic or heteroaromatic ring, which can contain one or more substituents such as —OH, —SH, —CN, —F, —Cl, —Br, —I, —NO$_2$, —NO, —NH$_2$, —NHR, —NRR, —C(O)R, —C(O)OH, —C(O)OR, —C(O)NH$_2$, —C(O)NHR, —C(O)NRR, etc., where R is independently (C$_1$-C$_6$) alkyl, substituted (C$_1$-C$_6$) alkyl, (C$_0$-C$_6$) alkenyl, substituted (C$_1$-C$_6$) alkenyl, (C$_1$-C$_6$) alkynyl, substituted (C$_0$-C$_6$) alkynyl, (C$_5$-C$_{20}$) aryl, substituted (C$_0$-C$_{20}$) aryl, (C$_6$-C$_{26}$) alkaryl, substituted (C$_6$-C$_{26}$) alkaryl, 5-20 membered heteroaryl, substituted 5-20 membered heteroaryl, 6-26 membered alkheteroaryl or substituted 6-26 membered alkheteroaryl. Genetically encoded aromatic amino acids include Phe, Tyr, and Tryp.

An apolar amino acid is a hydrophobic amino acid with a side chain that is uncharged at physiological pH and which has bonds in which a pair of electrons shared in common by two atoms is generally held equally by each of the two atoms (i.e., the side chain is not polar). Genetically encoded apolar amino acids include Gly, Leu, Val, Ile, Ala, and Met. Apolar amino acids can be further subdivided to include aliphatic amino acids, which is a hydrophobic amino acid having an aliphatic hydrocarbon side chain. Genetically encoded aliphatic amino acids include Ala, Leu, Val, and Ile.

A polar amino acid is a hydrophilic amino acid with a side chain that is uncharged at physiological pH, but which has one bond in which the pair of electrons shared in common by two atoms is held more closely by one of the atoms. Genetically encoded polar amino acids include Ser, Thr, Asn, and Gln.

An acidic amino acid is a hydrophilic amino acid with a side chain pKa value of less than 7. Acidic amino acids typically have negatively charged side chains at physiological pH due to loss of a hydrogen ion. Genetically encoded acidic amino acids include Asp and Glu. A basic amino acid is a hydrophilic amino acid with a side chain pKa value of greater than 7. Basic amino acids typically have positively charged side chains at physiological pH due to association with hydronium ion. Genetically encoded basic amino acids include Arg, Lys, and His.

A % amino acid sequence identity value is determined by the number of matching identical residues divided by the total number of residues of the "longer" sequence in the comparison window. The "longer" sequence is the one having the most actual residues in the comparison window (gaps introduced by WU-Blast-2 to maximize the alignment score are ignored).

The alignment can include the introduction of gaps in the sequences to be aligned. In addition, for sequences which contain either more or fewer amino acids than the protein encoded by the sequence the disclosed polypeptide, it is understood that in one case, the percentage of sequence identity will be determined based on the number of identical amino acids in relation to the total number of amino acids. In percent identity calculations relative weight is not assigned to various manifestations of sequence variation, such as, insertions, deletions, substitutions, etc.

In one case, only identities are scored positively (+1) and all forms of sequence variation including gaps are assigned a value of "0", which obviates the need for a weighted scale or parameters as described below for sequence similarity calculations. Percent sequence identity can be calculated, for example, by dividing the number of matching identical residues by the total number of residues of the "shorter" sequence in the aligned region and multiplying by 100. The "longer" sequence is the one having the most actual residues in the aligned region.

Coding Sequences

In various cases, nucleotide sequences encoding the polypeptide sequences of SEQ ID NOS:8664-8838 are included. These nucleotide coding sequences can be translated into a polypeptide having an amino acid sequence identical to the disclosed polypeptide sequence. The inventive coding sequences can further comprise untranslated sequences, for example poly-adenylation sequences. The inventive coding sequences can also comprise intron or intervening, non-translated, sequence that are spliced out of a transcribed mRNA prior to translation. In various cases the transcribed mRNA can be capped with a terminal 7-methylguanosine.

In some variations, due to the degeneracy of the genetic code, multiple nucleotide coding sequences can encode the same polypeptide sequence. These inventive nucleic acid coding sequences can also be homologous to nucleotide sequences that encode the disclosed polypeptides. The nucleotide coding sequences can be aligned by BLASTn, as described above. In various cases the homology (or identities in BLASTn) of these aligned nucleotide sequences can be greater than about 40%, 45%, 50%, 55%, 60%, 65%, 70%, 75%, 80%, 85%, 90%, or 95% and/or less than about 100%, 95%, 90%, 85%, 80%, 75%, 70%, 65%, 60%, 55%, 50%, or 45%. In various cases, the homologous aligned sequences can be less than about 700 nt, 600 nt, 500 nt, 400 nt, 300 nt, 200 nt, 100 nt, 90 nt, 80 nt, 70 nt, 60 nt, 50 nt or 40 nt, and/or more than about 50 nt, 60 nt, 70 nt, 80 nt, 90 nt, 100 nt, 200 nt, 300 nt, 400 nt, 500 nt, or 600 nt.

In various cases, the coding sequence directs transcription of a ribonucleic acid sequence that can be translated into amino acid sequence according to the standard genetic code. In various cases, the code can include variations to the canonical code. In some variations, the coding sequence can include introns, or intervening sequences that do not code for amino acids, but can be transcribed and later removed before the ribonucleic acid is translated into a polypeptide.

Sequences Related to Biofuel and Biomass Biosynthesis.

The disclosed nucleic acid sequences, amino acid sequences, organisms, and method can be involved in lipid biosynthesis. In various cases, lipid biosynthesis can include lipid metabolism, such as synthesis of fatty acids, assembly of triacylglycerides, and activation of lipids. In various cases the disclosed nucleic acid sequences and amino acid sequences are related to lipid metabolic pathway genes, fatty acids biosynthetic genes, triacylglycerides assembly genes, lipid activation genes, and genes can regulate transcription and translation of these genes, as well as proteins that regulate these genes and proteins that regulate the enzymes in these pathways. Some exemplary genes are described in FIG. 1. In various cases, lipid metabolic pathway genes include transcription factors and other regulatory genes and polypeptides. In various cases the coding sequences to be expressed include, thioesterases, acetyl-CoA carboxylase, acyl-transferases, carbonic anhydrases, bicarbonate transporters, nitrate transporters, nitrite transporters, ammonium transporters, glycerol 3-phosphate dehydrogenase, lipases, acyl-CoA oxidases, malic enzyme, malate dehydrogenase, pyruvate dehydrogenase and PEP carboxylase.

Transgenic Organisms

Transgenic organisms are also described. In various cases the described nucleic acid sequences can be introduced into various organisms to create transgeneic organisms. In various cases, the nucleic acid sequences introduced into the organism can be control sequences, coding sequences, or both. In various cases where a transgenic organism comprises both control and coding sequences, the control and coding sequences can be operably linked, for example on an expression cassette.

In various cases, the nucleic acid sequences are incorporated into the genome of the transgenic organism, or are included on a plasmid or vector in the transgenic organism. The inventive nucleic acid sequences can be translocated, re-arranged, deleted, or duplicated within the transgenic organisms. Nucleic acid sequences that are translocated, re-arranged, deleted, or duplicated include single derivatised nucleotides, native nucleotides, single nucleotides, and multiple nucleotides. In various cases, the disclosed transgenic organisms can further comprise native or non-native nucleic acid sequences.

Stably integrated nucleic acid sequences can be passed to progeny. In various cases, stably integrated nucleic acids can have selectable markers that can aid in selecting transgenic organisms. In various cases, selectable markers may be retained by the progeny. In various cases, a selectable marker can confer resistance to a drug or chemical, which can retard the growth of organisms which lack the resistance selectable marker. In various cases, the selectable marker can be an antibiotic resistance gene.

In various cases the transgenic organism can be algae, e.g. *N. gaditana, N. salina, N. oceanica, N. oculata, N. limnetica, N. granulata*, Nannochloropsis W2J3B, *Phaeodactylum tricornutum, Thalassiosira pseudonana, Fragilariopsis cylindrusl, Ectocarpus ciliculosus, Aureococcus anophagefferens*.

Production of Biofuel and Biomass

In various cases, the described compositions and methods are useful in the production of biofuel and biomass. Biofuels can be fuels used for electricity, heat, and fuel that can be derived from renewable resource, including plants and microbes. Biofuels can include alcohols, alkanes, lipids, isoprenoids, fatty acid methyl/ethyl esters, oils, and gases. In various cases, the described organisms can be induced to produce biofuel during a relatively high lipid production stage, or stationary phase. In various cases, the stationary phase can follow a logarithmic growth phase, in which the number of organisms is growing rapidly. The logarithmic phase can be a stage of lower lipid production stage than the stationary phase. In various cases, a stationary phase can be induced. In various cases, the stationary phase can be induced by low nitrate levels. Low nitrate levels can be achieved by nitrogen depletion, removal, sequestration, or lowering the amount of nitrogen being added to a given environment. In various cases, a modified organism may be used that may allow high lipid production state during rapid growth. In various cases, these modified organisms may be genetically engineered to allow high lipid production during rapid growth. In various cases the genetic engineering may include expression cassettes comprising the claimed nucleotide sequences. In various cases, the modified organisms may comprise modified control sequences.

The described organisms can be grown in a liquid environment. In various cases the liquid is a culture medium. In various cases the culture medium is a defined medium. Other liquid medium include fresh water, salt water, waste water, and treated water. In various cases, nutrients and other substances can be added to the liquid medium. In various cases antibiotics are added to the water.

*Nannochloropsis gaditana* CCMP526 (Provasoli-Guillard National Center for Culture of Marine Phytoplankton, West Boothbay Harbor, Me. (CCMP)) was cultivated in either f/2 medium or artificial seawater medium as indicated. The f/2 medium was made using Boothbay Harbor seawater (CCMP) diluted to 50% salinity with $diH_2O$ and supplemented with f/2 trace metals, 8.82 mM $NaNO_3$ and 0.1448 mM $NaH_2PO_4$. A defined artificial seawater medium (ASW) was prepared as follows: 15 g/l NaCl, 6.6 g/l $MgSO_4.7H_2O$, 5.6 g/l $MgCl_2.6H_2O$, 0.5 g/l $CaCl_2.2H_2O$, 1.45 g/l $KNO_3$, 0.12 g/l $KH_2PO_4$, 0.04 g/l $NaHCO_3$, 0.01 g/l $FeCl_3.6H_2O$, 0.035 g/l $Na_2$-EDTA, 0.25 ml/13.64 mM $MnCl_2.4H_2O$, and 0.5 ml/l trace metal mix (20 mg/l $CoCl_2.6H_2O$, 12 mg/l $Na_2MoO_4.2H_2O$, 44 mg/l $ZnSO_4.7H_2O$, 20 mg/l $CuSO_4.5H2O$, 7.8 g/l $Na_2$-EDTA). The pH of the trace metal mix was adjusted to 7.5 and the final pH of the ASW was adjusted to 7.3. No significant difference in growth was observed between the f/2 and ASW media. In various cases seawater or brackish water from any source can be used. In various cases, the total salt concentration in the medium can be reduced to as low as 4 g/l with no NaCl. In various cases, fresh water with added trace metals and minerals can be used.

Methods of Transformation

The claimed nucleic acid sequences can be introduced into an organism, for example an alga. In various cases nucleic acids can be introduced into an alga by electroporation. In various cases, field strength can be greater than about 10,500 V/cm, 10,600 V/cm, 10,700 V/cm, 10,800 V/cm, 10,900 V/cm, 11,000 V/cm, 11,100 V/cm, 11,200 V/cm, 11,300 V/cm, 11,400 V/cm, 11,500 V/cm, 11,600 V/cm, 11,700 V/cm, 11,800 V/cm, 11,900 V/cm, or 12,000 V/cm, and/or in some case, the field strength can be less than about 13,00 V/cm, 12,900 V/cm, 12,800 V/cm, 12,700 V/cm, 12,600 V/cm, 12,500 V/cm, 12,400 V/cm, 12,300 V/cm, 12,200 V/cm, 12,100 V/cm, 12,000 V/cm, 11,900 V/cm, 11,800 V/cm, 11,700 V/cm, 11,600 V/cm, 11,500 V/cm, 11,400 V/cm, 11,300 V/cm, 11,200 V/cm, 11,100 V/cm, or 11,000 V/cm. In various cases, the field strength can be between 10,500 V/cm and 12,00 V/cm.

In some cases, transformation can include various enzyme mixes for creation of protoplasts prior to transformation.

Genetic Transformation of *N. gaditana*

Genomic DNA from an axenic culture of *N. gaditana* (CCMP526, Provasoli-Guillard National Center for Culture of Marine Phytoplankton) was purified as previously described using a phenol/chloroform extraction protocol (Radakovits). A full 454 sequencing run was used to generate a preliminary Newbler assembly of the *N. gaditana* genome. BLASTx was used to annotate the obtained sequence and identify potential genes by homology. The *N. gaditana* genome is similar to the genomes of *P. tricornutum* and *T. pseudonana* in that many genes have 0-2 introns, this characteristic allowed us to identify many full length genes including their upstream promoter regions. From the identified full length genes that included an upstream promoter region we selected three for testing in transformation experiments.

For these experiments the following upstream control regions were obtained: a 608 bp portion from the heat shock protein 70 gene (HSP), a 520 bp portion from the beta-tubulin gene (TUB), and a 710 bp portion from the ubiquitin extension protein (UEP). The control regions were amplified and purified from the genomic *N. gaditana* DNA using the following primers:

```
HSP forward primer:
ATGCTCCGGAGCC GAAGCCCTGTCG ACCAC

HSP reverse primer:
AGCTTGGCCATGTTAGTCTGTCAAAAAATGACGTTGCG

TUB forward primer:
ATGCTCCGGAACTGCGCATGGATTGACCGA

TUB reverse primer:
AGCTTGGCCATGCTTCACAAAAAAGACAGCTTCTTGAT

UEP forward primer:
ATGCTCCGGAGCTGCTGCCCCGACCGTATC

UEP reverse primer:
AGCTTGGCCATCCT GCTGTATGATTTTGGCACAACG.
```

The amplified, purified fragments were inserted into the pPha-T1 plasmid in front of a bleomycin (ble) resistance gene by replacing the *P. tricornutum* fcpB promoter to create the pPha-T1-HSP, pPha-T1-TUB and the pPhaT1-UEP plasmids.

*N. gaditana* was grown in f/2 50% seawater medium under cool white fluorescent lights at 100 μE (24 h illumination). After two weeks of growth $5\times10^8$ cells were harvested for each transformation experiment. Cells were washed twice with 375 mM sorbitol before resuspension in 100 μl 375 mM sorbitol containing 5 μg plasmid DNA linearized with ScaI. Electroporation was done using a ECM630 BTX electroporator (Harvard Apparatus, Inc., Holliston, Mass.) set at 500 Ω, 50 μF and either 900, 1050 or 1200 V using a 1 mm cuvette, resulting in a single 17-20 ms pulse. After electroporation cells were resuspended in 10 ml f/2 medium and kept overnight on a shaker at RT in low light ($50\,\mu\text{mmol}\,\text{m}^{-2}\,\text{s}^{-1}$) before plating on f/2 zeocin selection plates. $5\times10^7$ cells were plated per 10 cm plate containing 3 μg/ml zeocin. Zeocin-resistant colonies were detected after 5-6 weeks and picked after 7-8 weeks. No colonies grew on control plates with cells electroporated without plasmid and survival of cells plated without zeocin appeared unaffected even at the highest voltage. The highest number of zeocin-resistant colonies was generated using 1200 V (12000 V/cm field strength) and the promoter with the highest number of transformants was TUB followed by UEP.

In some embodiments a plasmid may comprise a control sequence operably linked to coding sequence, wherein the coding sequences is a nucleotide sequence coding for a polypeptide. In some embodiments the plasmid may be the pPha-T1 plasmid, or a similar plasmid. In some embodiments the control sequence may be selected from SEQ ID NOs:1-8663. In some embodiments the coding sequence may be selected from SEQ ID NOs:8664-8838. In some embodiments, introduction of a plasmid, comprising a control sequence and a coding sequence, into an organism such as *N. gaditana* may aid in the production of biomass and/or biofuel.

Confirmation of Successful Transformation by Genomic PCR and Southern Blot

Picked colonies were grown in f/2 liquid media and $10^9$ cells were harvested for verification of transgene incorporation into the genome of the zeocin resistant colonies. Genomic DNA was purified as described previously (Radakovits) and either used for genomic PC or digested with the StuI and ClaI restriction enzymes over night for Southern blot analysis. The resulting DNA fragments were separated on a 0.7% agarose gel before transfer onto a nitrocellulose membrane which was used for hybridization with a 371 bp DNA probe specific for the ble resistance gene. The ble probe was generated by PCR using the following primers: ble forward primer: CCGGGACTTCGTGGAGGACGAC; ble reverse primer: GCTGCTCGCCGATCTCGGTCAT. Probe synthesis and hybridization were performed using the AlkPhos Direct Labeling and Detection Systems as described previously, according to the manufacturer's instructions (Amersham Biosciences). The chemilumiscent signal was detected by a LAS-4010 imaging system (GE Healthcare Life Sciences), 20 h exposures gave good results. The differences in the size of the bands indicate random insertion of the transgene while the presence of multiple bands in some mutants signifies multiple insertions.

Disclosed herein are nucleotide sequences and polynucleotide sequences of an alga that may be genetically manipulated to possess desirable biomass production characteristics. The alga has been successfully cultivated outdoors at commercial scale. *Nannochloropsis gaditana*, *N. gaditana*, is a stramenopile alga of the Eustigmatophyceae class.

Photosynthetic algae have long been considered a possible renewable feedstock for biofuel production and have recently experienced intense interest due to diminishing petroleum reserves and increasing atmospheric levels of $CO_2$. One of the main challenges has been the lack of a genetically tractable model alga capable of industrial biofuels production. Described herein is engineered *N. gaditana*, *N. gaditana*-derived sequences, methods of engineering *N. gaditana*, and methods of using engineered *N. gaditana* for the synthesis of biofuels and biomass.

*N. gaditana* is a model organism for oleaginous algal biofuel and biomass production. Modification of *N. gaditana* provides a cost competitive system for photoautotrophic production of biofuels.

Figure 3:
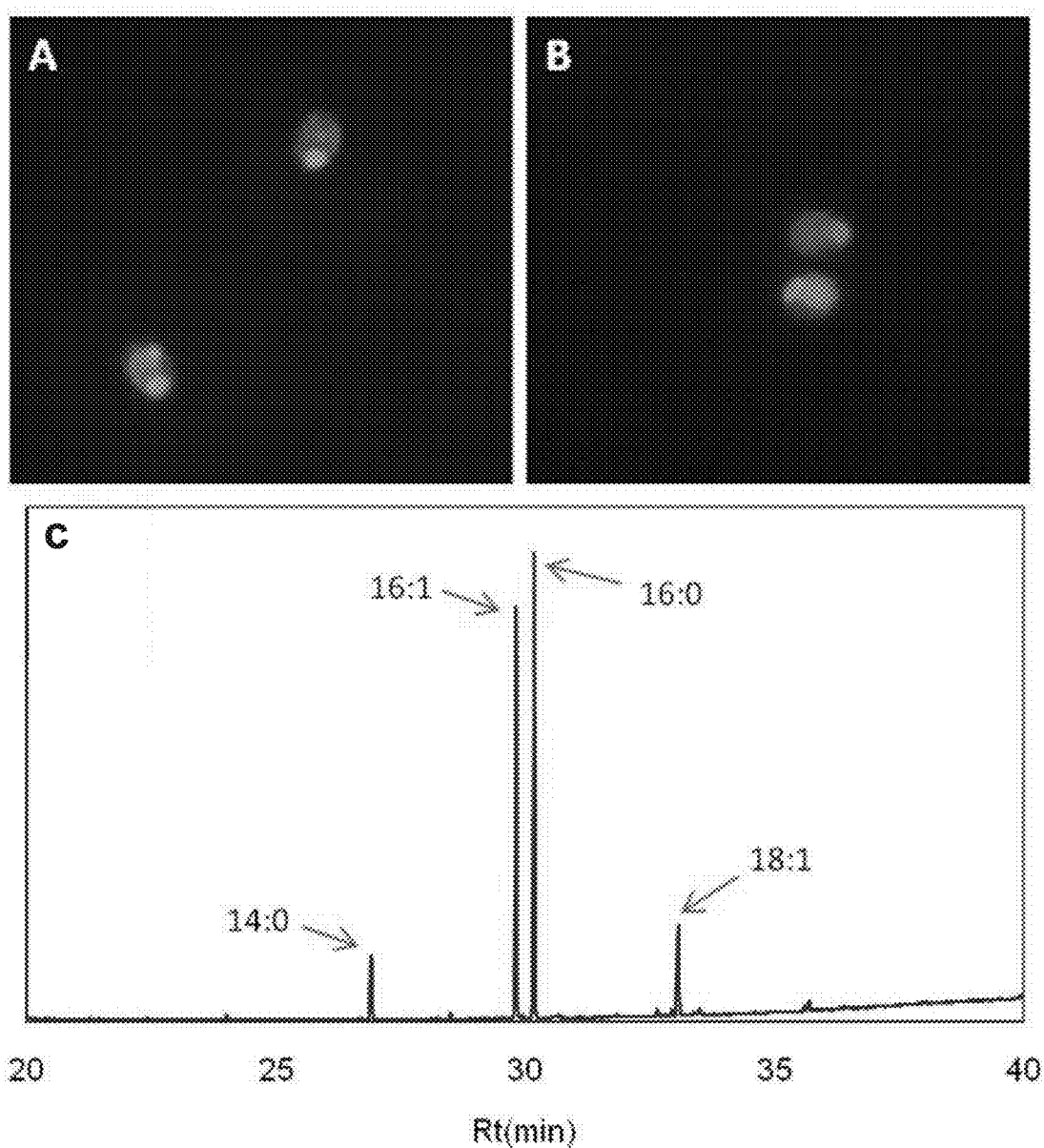
FIG. 3 depicts characterization of *N. gaditana* lipid content.

*N. gaditana* is an oleaginous microalga and can store lipid, in the form of triacylglycerides (TAG), even during logarithmic growth (FIG. 2 and FIG. 3). Various strains of *Nannochloropsis* have been investigated for their biomass and lipid production characteristics and several isolates have been grown for aquaculture purposes. *Nannochloropsis salina*, *N. oculata* and *N. gaditana* have received attention due to their exceptional lipid production characteristics. (Converti, A., Casazza, A. A., Ortiz, E. Y., Perego, P. & Del Borghi, M. Effect of temperature and nitrogen concentration on the growth and lipid content of *Nannochloropsis oculata* and *Chlorella vulgaris* for biodiesel production. *Chemical Engi-* neering and Processing: Process Intensification, 1146-1151 (2009); Simionato, D. et al. Acclimation of *Nannochloropsis gaditana* to different illumination regimes: Effects on lipids accumulation. *Bioresource Technology*, 6026-6032 (2011); Boussiba, S., Vonshak, A., Cohen, Z., Avissar, Y. & Richmond, A. Lipid and biomass production by the halotolerant microalga *Nannochloropsis salina*. *Biomass*, 37-47 (1987)) *Nannochloropsis gaditana* uses photoautotrophy to accumulate biomass and lipids, and can grow to densities of >10 g/l, while tolerating various pH, temperature, and salinity. *N. gaditana* may be a good candidate for development into a model organism for algal biofuel production and the availability of a genome sequence and reliable transformation protocols are steps in this direction. In addition, there are some suggestions that homologous recombination can be more tractable in eustigmatophyte algae than in green algae. (Kilian, O. & Vick, B. Homologous recombination in an algal nuclear genome, Patent number: US 2011/0091977 A1 (2011)). This present disclosure indicates that *N. gaditana* may be a model species.

Current algal model organisms are not robust producers of biomass and lipids. Described herein is a highly productive engineered microalga, *N. gaditana* for use as a new model organism for biofuel production. Further described are methods of genetically engineering *N. gaditana*, including transgenic expression of genes. Also described is the identification and characterization of native *N. gaditana* promoters for the expression of transgenic coding sequences. The disclosed method can be used to express both native and foreign genes for the production of biofuel and other high value products.

Current algal model species are not competitive production strains. Here we present a draft genome sequence, nucleotide and polypeptide sequences, transgene constructs, and a method for genetic transformation of the marine microalga, *N. gaditana*, CCMP526.

The genome assembly of *N. gaditana* includes nuclear (~28 Mb) and organellar genomes, and contains 9,052 gene models. The genes associated with glycerolipid biogenesis are defined and the differential regulation of many genes during nitrogen limited lipid biosynthesis is detailed.

Phylogenomic analysis identified genetic attributes of *N. gaditana*, including unique stramenopile photosynthesis genes and gene expansions, that can explain the distinguishing photoautotrophic phenotypes observed. The availability of a genome sequence and transformation methods can facilitate investigations into *N. gaditana* lipid biosynthesis and can aid in creating genetic engineering strategies to further improve this naturally productive algal strain.

In an effort to transform an oleaginous alga into a model system for biofuel production, the genome of *N. gaditana* was sequenced, and a method for genetic transformation of microalga, *Nannochloropsis gaditana* CCMP5 was developed. Biofuel production rates of *N. gaditana* were compared with several other marine microalga and other biofuel production systems to demonstrate that this alga has favorable biofuel production characteristics.

Despite its ability to produce biofuel, relatively little is known about the metabolic pathways and adaptations that allow *N. gaditana* to reach the cell densities it does, while accumulating lipids. The lipid metabolic pathways in *N. gaditana* both on a genomic and transcriptomic level have been investigated and characterized by quantifying gene expression levels during a relatively low lipid production stage, (logarithmic growth), and a high lipid production stage, (stationary phase) after nitrate depletion. Additionally we have conducted comparative and phylogenomic analysis among other algal lineages to determine genes unique to *N. gaditana* and also to identify sets of conserved proteins across photosynthetic stramenopiles. The genome sequence, its analysis, and the development of genetic transformation in *N. gaditana* are beneficial steps in improving this industrially proven, oleaginous algal fuel biofuel production.

In some cases of nucleic acid sequences that can function as control regions, the sequences can be modified to create higher or lower affinity binding sites for DNA-binding proteins. In some cases, control regions can be modified to bind fewer or more DNA-binding proteins.

In some cases of inventive nucleic acid sequences which code for proteins, the sequences can be non-identical to *N. gaditana* sequences disclosed herein but can code for proteins, peptides, and/or fragments thereof with greater than about 95%, greater than about 90%, greater than about 85%, greater than about 80%, greater than about 75%, greater than about 70%, greater than about 65%, greater than about 60%, greater than about 55%, greater than about 50%, greater than about 45%, greater than about 40%, greater than about 35%, greater than about 30%, or greater than about 25% identity to *N. gaditana* proteins, peptides, and/or fragments thereof.

EXAMPLES

Example 1

Analysis of Biomass and Lipid Yields from High Density Cultures of *N. gaditana*

The yields from *N. gaditana* cultures grown in f/2 medium at 50% salinity are shown in FIG. 2a-c. Yields of 0.65 g/l/d biomass and 0.31 g/l/d total lipids were achieved over a period of three months in 1 L Roux Flasks sparged with air/2% $CO_2$, when half the cultures were exchanged for fresh medium every week. Lipid body accumulation can be triggered/enhanced in algae by nitrogen deprivation or other stress conditions (Hu, Q. et al. Microalgal triacylglycerols as feedstocks for biofuel production: perspectives and advances. *The Plant Journal*, 621-639 (2008)), and the lipid content (47.6%) in actively growing cultures of *N. gaditana* is likely facilitated by the rapid depletion of nitrate in dense cultures (3-8 g/l) during growth. The laboratory productivity numbers have been extrapolated to calculate potential lipid yields in comparison with other algae (FIG. 2d) and to other biofuel production platforms (FIG. 2e). In FIG. 2e, the green bars indicate our extrapolations, while gray bars indicate estimations originally provided by Atsumi et al. (Atsumi, S., Higashide, W. & Liao, J. C. Direct photosynthetic recycling of carbon dioxide to isobutyraldehyde. *Nature Biotechnology*, 1177-1180 (2009)). The yields from *Nannochloropsis* scale from 25 ml cultures to 8 L cultures under laboratory conditions, to 10 hectare outdoor ponds where it is grown on a commercial scale (Hairong Electric Company, Penglai, China and Seambiotic, Tel Aviv, Israel).

*Nannochloropsis gaditana* is a producer of both biomass and lipids under a wide array of culture conditions, including minimal f/2 seawater medium and artificial seawater (10-120% seawater salinity, pH 7-10) supplemented with nitrate, phosphate and $CO_2$. The key components to achieving high yields are the augmented supply of $CO_2$ (1-2%), high concentrations of nitrate (8.9 mM), and inoculums above 3 g/l. Optimal lipid yields were obtained with a starting culture density of ~3.6 g/l. It is likely that self shading is the main limiting factor at higher starting densities. Low density cultures (<0.5 g/l) can be growth inhibited by high light (>200 μE) but the higher density cultures have good production between 1,000 μE and 2,000 μE. For medium to high density cultures (3-10 g/l), no substantial increase in productivity is observed upon increasing the light from 1,000 µE to 2,000 µE, supporting the hypothesis that self shading becomes the limiting factor at these densities. The yields from cultures grown in f/2 medium at 50% salinity are shown in FIG. 2a-c. Yields of 0.65 g/l/d biomass and 0.31 g/l/d total lipids were achieved over a period of three months in Roux Flasks bubbled with 2% $CO_2$ with half the cultures being exchanged for fresh medium every week. Lipid body accumulation can be triggered in algae by nitrogen deprivation and other stress conditions, and the lipid content (47.6%) in these actively growing cultures is likely facilitated by the rapid depletion of nitrate in these dense cultures (3-8 g/l) during the growth cycle. These productivity numbers have been extrapolated to calculate theoretical lipid yields in comparison with other algae (FIG. 2d) and to other biofuel production platforms (FIG. 2e). In FIG. 2e the green bars indicate our extrapolations, while gray bars indicate estimations originally provided by Atsumi et al.4. It is noted that some of the values represent actual production yields from large scale cultivation (Soy, Palm)$_3$, 41, while other values are extrapolated from small scale cultures with 24 h light (*S. elongatus* Isobutyraldehyde and Isobutanol). The *N. gaditana* lipid production yields have been derived from small scale cultures with 12 h light/12 h dark cycles and therefore provide a more realistic estimation relative to *S. elongatus*. The yields from *N. gaditana* scale from 25 ml cultures to 8 L cultures under laboratory conditions, to 10 hectare outdoor ponds where it is grown on a commercial scale (Hairong Electric Company, Penglai, China and Seambiotic, Tel Aviv, Israel). The lipid content of *N. gaditana* cells is apparent upon fluorescent labeling of algal triglycerides with the lipophilic dye, bodipy. Actively growing cells have a constitutive lipid droplet that expands within cells in stationary phase or during nitrogen deprivation (FIGS. 3a and b, respectively). Some of the lipids in *N. gaditana* are composed of palmitic and palmitoleic acid with a minor content of myristic and oleic acid (FIG. 3c), resulting in a relatively simple fatty acid profile, and these fatty acids can be used for the production of biodiesel or biopetrol.

Example 2

Sequencing, Assembly, and Analysis of *N. gaditana* Genome

DNA sequencing reads obtained using both Roche and Illumina (including both unpaired and LIPES protocols) technologies were trimmed for quality, and then assembled separately. These assemblies were merged, followed by removal of scaffolds of bacterial contaminant(s), producing a genome assembly of 2,087 scaffolds, with an N50 of 253 and an L50 of 38,300 nts (TABLE 1). There are 35 scaffolds longer than 100 kb, a total of 561 longer than 20 kb, and a total of 1,447 that are longer than 2 kb.

TABLE 1

| Assembly Statistics | |
| --- | --- |
| Number of assembled contigs | 2,087 |
| Estimated genome size | 28.4 Mbp |
| Contig N50 | 253 |
| Contig L50 | 38,300 bp |
| Genomic G + C content | 54.20% |
| Gene Statistics | |
| Predicted number of genes | 9,052 |
| Chloroplast genes | 124 |

TABLE 1-continued

| Mitochondrial genes | 36 |
| --- | --- |
| Genes supported by ESTs | 8,359 (92.3%) |
| Genes supported by homology (Blast e-value cutoff <$e^{-10}$) | 6,308 (69.7%) |
| Unique genes | 2,744 (30.3%) |
| Average coding sequence length | 1069 bp |
| Average intron length | 220 bp |
| Introns per gene | 1.62 |

Figure 4:
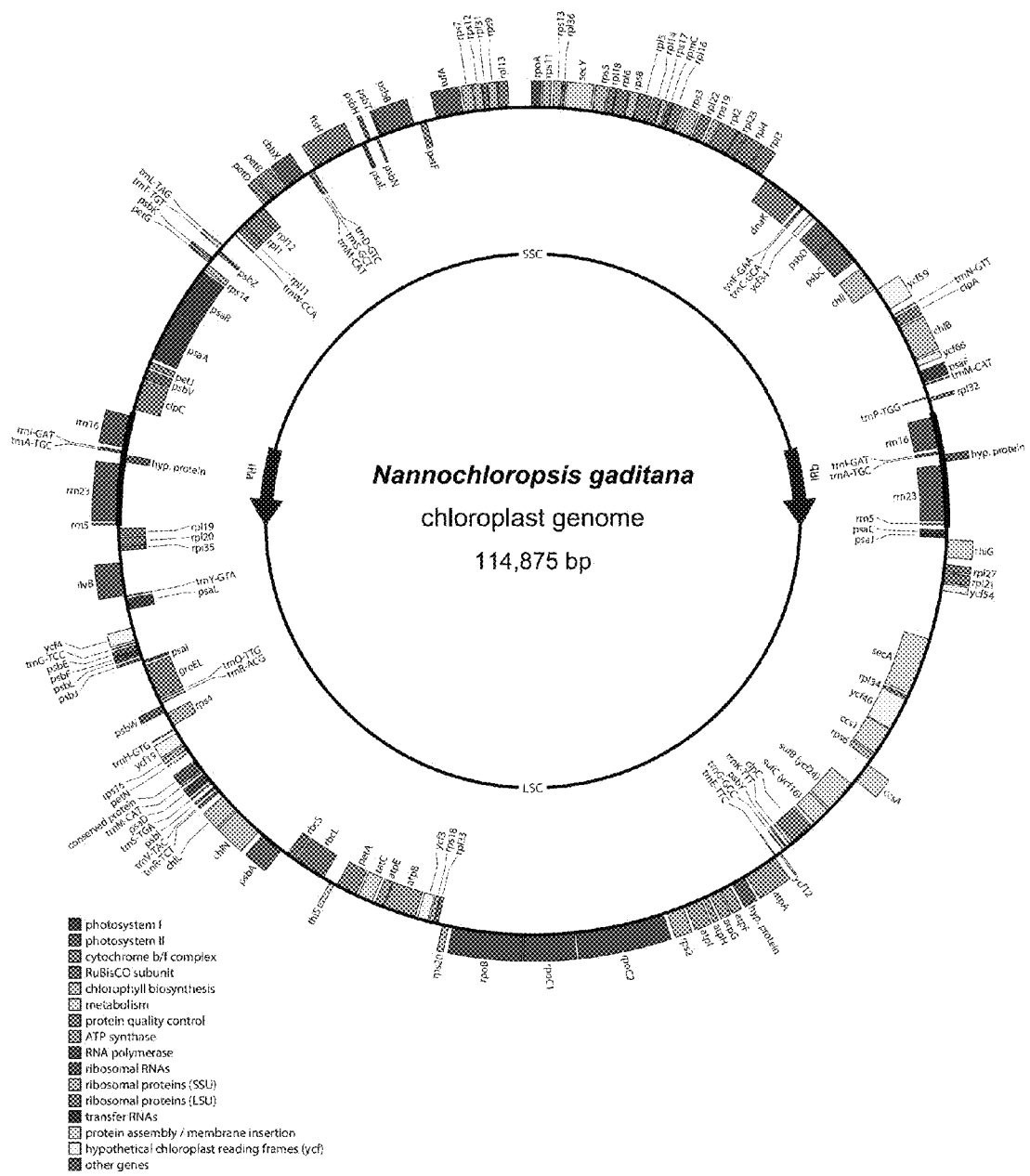
FIG. 4 depicts the *N. gaditana* chloroplast genome. Genes on the inside are transcribed clockwise, and genes on the outside are transcribed counter-clockwise.
Figure 5:
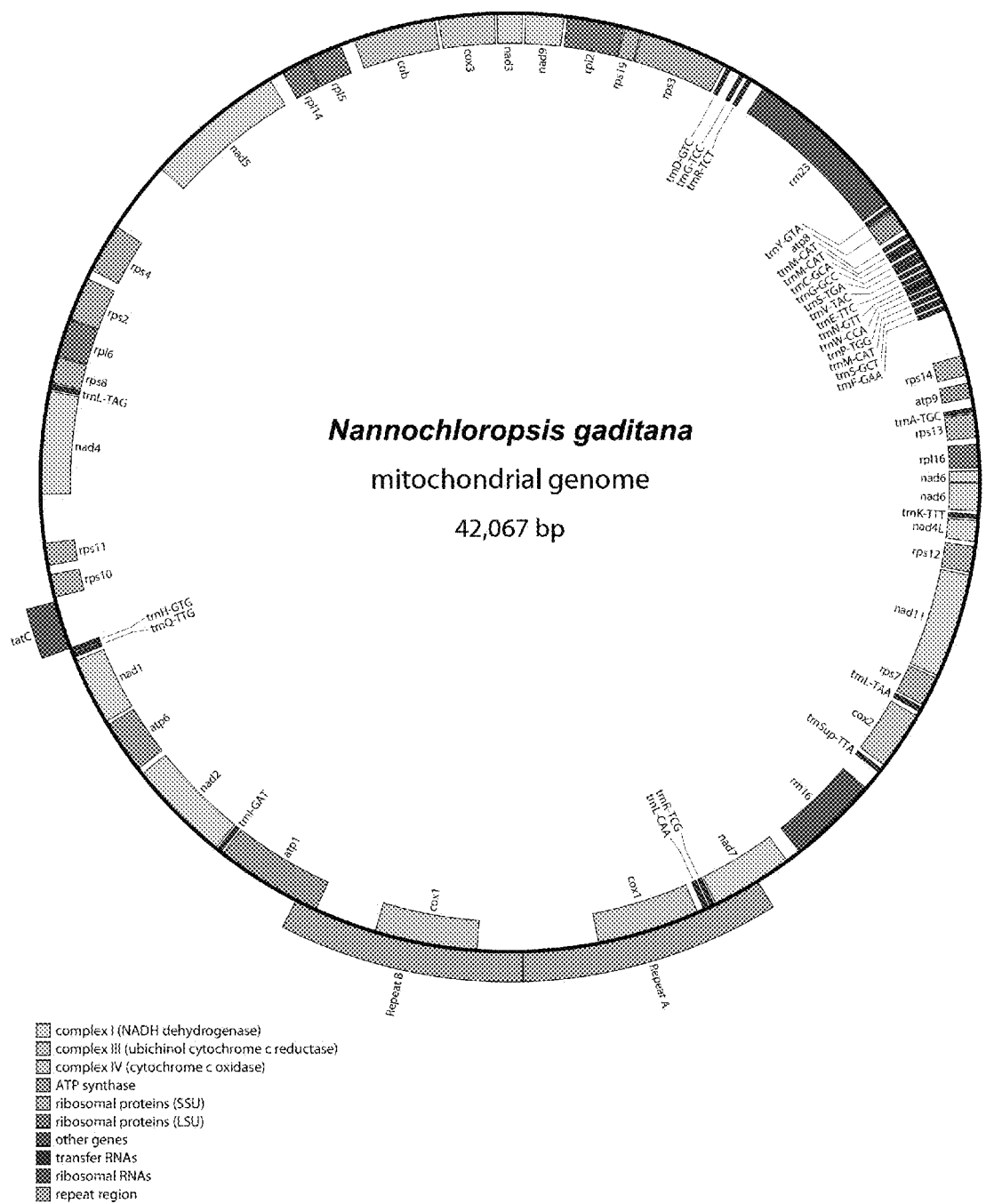
FIG. 5 depicts the *N. gaditana* mitochondrial genome. Genes on the inside are transcribed clockwise, and genes on the outside are transcribed counter-clockwise.

In addition to the nuclear genome, the plastid and mitochondrial genomes were also sequenced, assembled and annotated (FIG. 4 and FIG. 5). Relative to the organellar genomes of *P. tricornutum* and *T. pseudonana*, significant conservation of gene content and gene organization was observed, with some notable exceptions. (Oudot-Le Secq, M.-P. et al. Chloroplast genomes of the diatoms *Phaeodactylum tricornutum* and *Thalassiosira pseudonana* comparison with other plastid genomes of the red lineage. *Molecular Genetics and Genomics*, 427-439 (2007))

Plastid and Mitochondrial Genomes The circular chloroplast genome is 114,785 bp, which is similar in size to those of *P. tricornutum*, *T. pseudonana* and *E. siliculosus*, (Oudot-Le Secq, M.-P. et al. Chloroplast genomes of the diatoms *Phaeodactylum tricornutum* and *Thalassiosira pseudonana* comparison with other plastid genomes of the red lineage. *Molecular Genetics and Genomics* 277, 427-439 (2007); Le Corguille, G. et al. Plastid genomes of two brown algae, *Ectocarpus siliculosus* and *Fucus vesiculosus*: further insights on the evolution of red-algal derived plastids. *BMC Evolutionary Biology* 9, 253 (2009)) and contains 124 protein-encoding genes as well as those for 5S, 16S and 23S rRNAs, and 27 tRNA, which satisfy all translational requirements. Due to the close phylogenetic relationship between *N. gaditana* and diatoms we compared the plastid and mitochondrial genomes with *P. tricornutum*, *T. pseudonana* and *E. siliculosus* (FIG. 6). The gene order is not strictly conserved but there are a number of conserved gene clusters, such as that of ribosomal genes. The *N. gaditana* chloroplast genome contains all the subunits of the light-independent protochlorophyllide reductase (chlB, chlL, and chlN) which is needed for chlorophyll synthesis. Neither chloroplast genomes of *P. tricornutum* or *T. pseudonana* encode these subunits, while the chloroplast genome of the evolutionarily more distant green alga *C. reinhardtii* does. (Li, J., Goldschmidt-Clermont, M. & Timko, M. P. Chloroplast-encoded chlB is required for light-independent protochlorophyllide reductase activity in *Chlamydomonas reinhardtii*. *The Plant Cell* 5, 1817-1829 (1993)) The circular mitochondrial genome is 42,067 bp, which is similar in size to those of *T. pseudonana* and *P. tricornutum*, and contains 36 protein-encoding genes as well as those for 16S and 23S rRNAs and 27 tRNAs, which satisfy all translational requirements except for tRNA-Thr, which is also missing in other heterokonts. (Oudot-Le Secq, M.-P. & Green, B. R. Complex repeat structures and novel feature in the mitochondrial genomes of the diatoms *Phaeodactylum tricornutum* and *Thalassiosira pseudonana*. *Gene* 476, 20-26 (2011)) The *N. gaditana* mitochondrial genome has two complete copies of the cox1 gene lacking introns in two duplicated regions. This is a different configuration than what is found in *P. tricornutum* or *T. pseudonana* where the cox1 gene instead is split into exons and introns. This change in configuration can suggest that the duplicated cox1 gene in *N. gaditana* is an older configuration which has been modified in *P. tricornutum* and *T. pseudonana*. Heterokontophyte brown algae have only a single intron-less copy of cox1. (Oudot-Le Secq, M.-P., Loiseaux-de Goër, S., Stam, W. &

Olsen, J. Complete mitochondrial genomes of the three brown algae (Heterokonta: Phaeophyceae) *Dictyota dichotoma, Fucus vesiculosus, Desmarestia viridis. Current Genetics* 49, 47-58 (2006))

Genome Annotation

A variety of methods were used, including ab initio predictions, homology detection, and RNAseq matching to the genome assembly, and then these were reconciled into a single gene set using Maker. Contigs from the transcript assembly that had strong homology support but were otherwise not part of the Maker gene set were added in to form gene set version 1.1 with 9,052 members (TABLE 2).

TABLE 2

*N. gaditana* Genome Statistics

| Assembly Statistics | |
| --- | --- |
| Number of assembled contigs | 2,087 |
| Estimated genome size | 28.4 Mbp |
| Contig N50 | 253 |
| Contig L50 | 38,300 bp |
| Genomic G + C content | 54.20% |
| Gene Statistics | |
| Predicted number of genes | 9,052 |
| Chloroplast genes | 124 |
| Mitochondrial genes | 36 |
| Genes supported by ESTs | 8,359 (92.3%) |
| Genes supported by homology (Blast e-value cutoff <e−10) | 6,308 (69.7%) |
| Unique genes | 2,733 (30.2%) |
| Avg coding sequence length | 1069 bp |
| Average intron length | 220 bp |
| Introns per gene | 1.62 |

Figure 7:
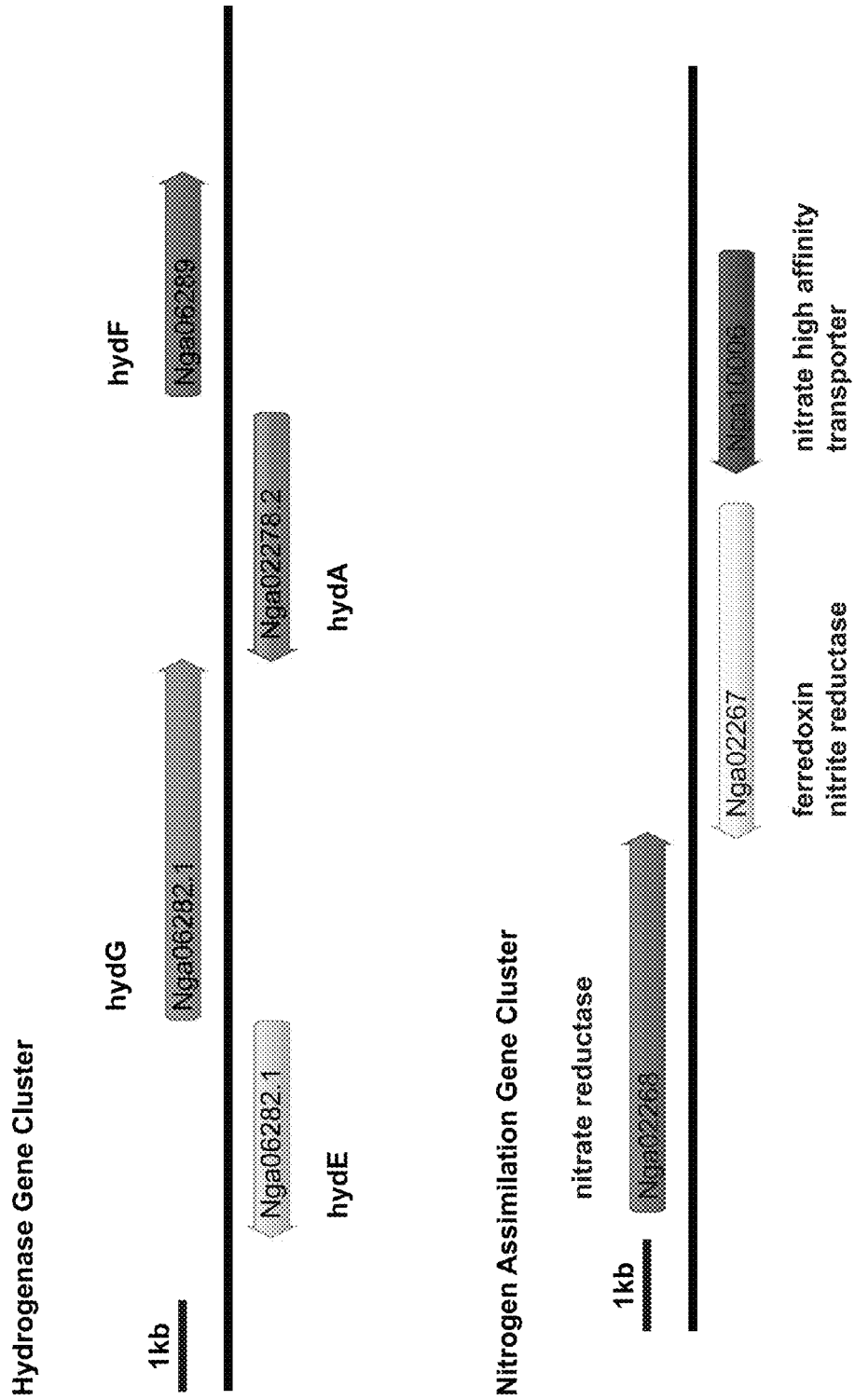
FIG. 7 depicts two functional gene clusters, involved in hydrogen metabolism and nitrogen assimilation, identified in the *N. gaditana* nuclear genome. Arrows indicate gene direction.

Several uniquely organized functional gene clusters have been identified, including a cluster of four genes involved in hydrogenase function (HYDA1, HYDE, HYDF and HYDG) and a cluster of three genes involved in nitrogen assimilation (nitrate reductase, nitrite reductase and a nitrate transporter) (FIG. 7). Clusters of genes with similar ontology annotations are observed in *E. siliculosus*. (Marchler-Bauer, A. et al. CDD: a Conserved Domain Database for the functional annotation of proteins. Nucleic Acids Research 39, 225-229 (2011)). However, while a similar cluster of nitrogen assimilation genes can be observed in prasinophytes and *C. reinhardtii* (Emanuelsson, O., Brunak, S., von Heijne, G. & Nielsen, H. Locating proteins in the cell using TargetP, SignalP and related tools. Nature Protocols 2, 953-971 (2007); Götz, S. et al. High-throughput functional annotation and data mining with the Blast2GO suite. Nucleic Acids Research 36, 3420-3435 (2008)), no such cluster can be observed in the more closely related *E. siliculosus*. (Marchler-Bauer, A. et al. CDD: a Conserved Domain Database for the functional annotation of proteins. Nucleic Acids Research 39, 225-229 (2011)). An expanded analysis of functional gene clusters can be found in FIG. 8.

Comparative Genomics

Figure 9:
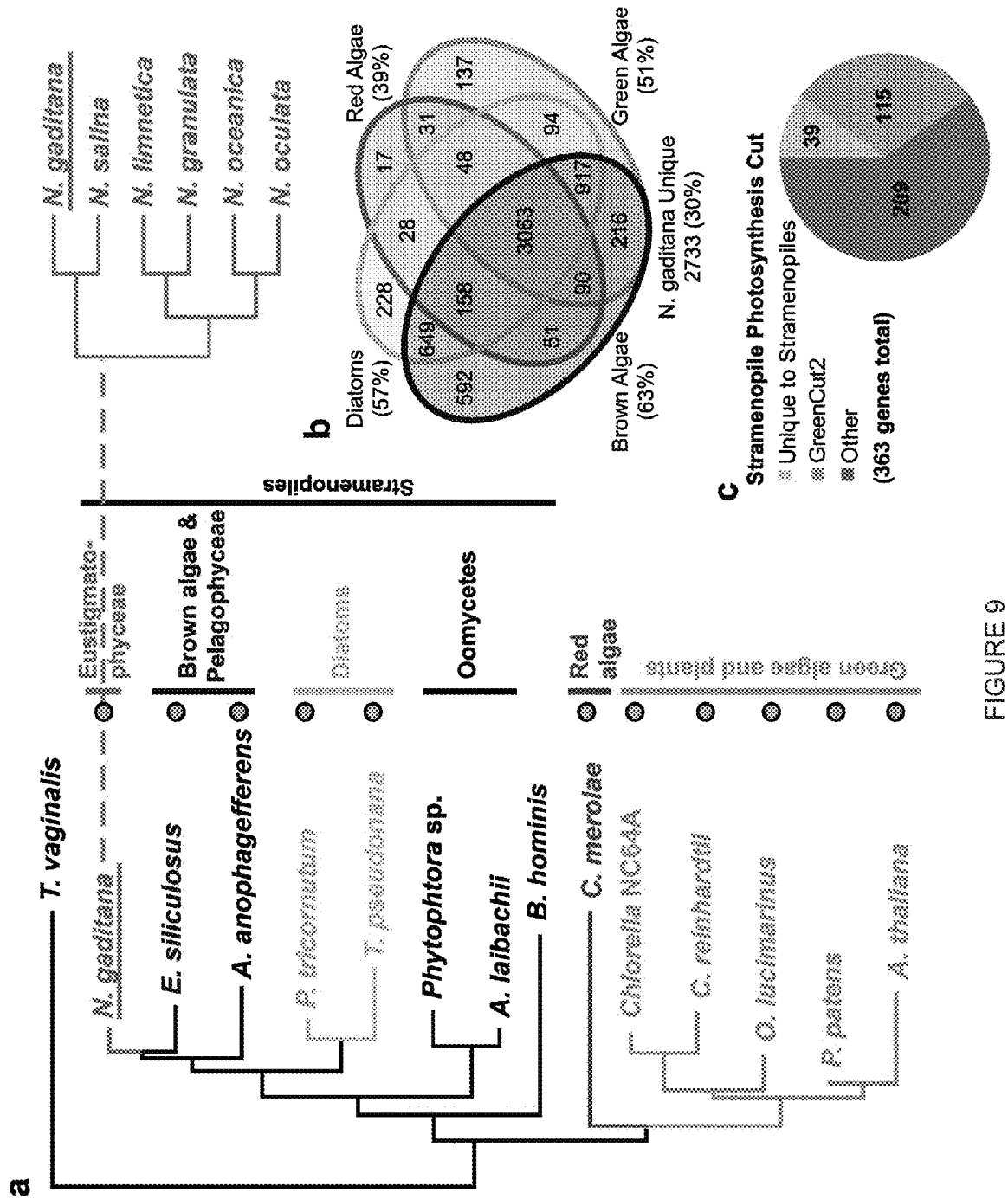
FIG. 9 shows characterization of *N. gaditana* relatedness to other organisms.
Figure 10:
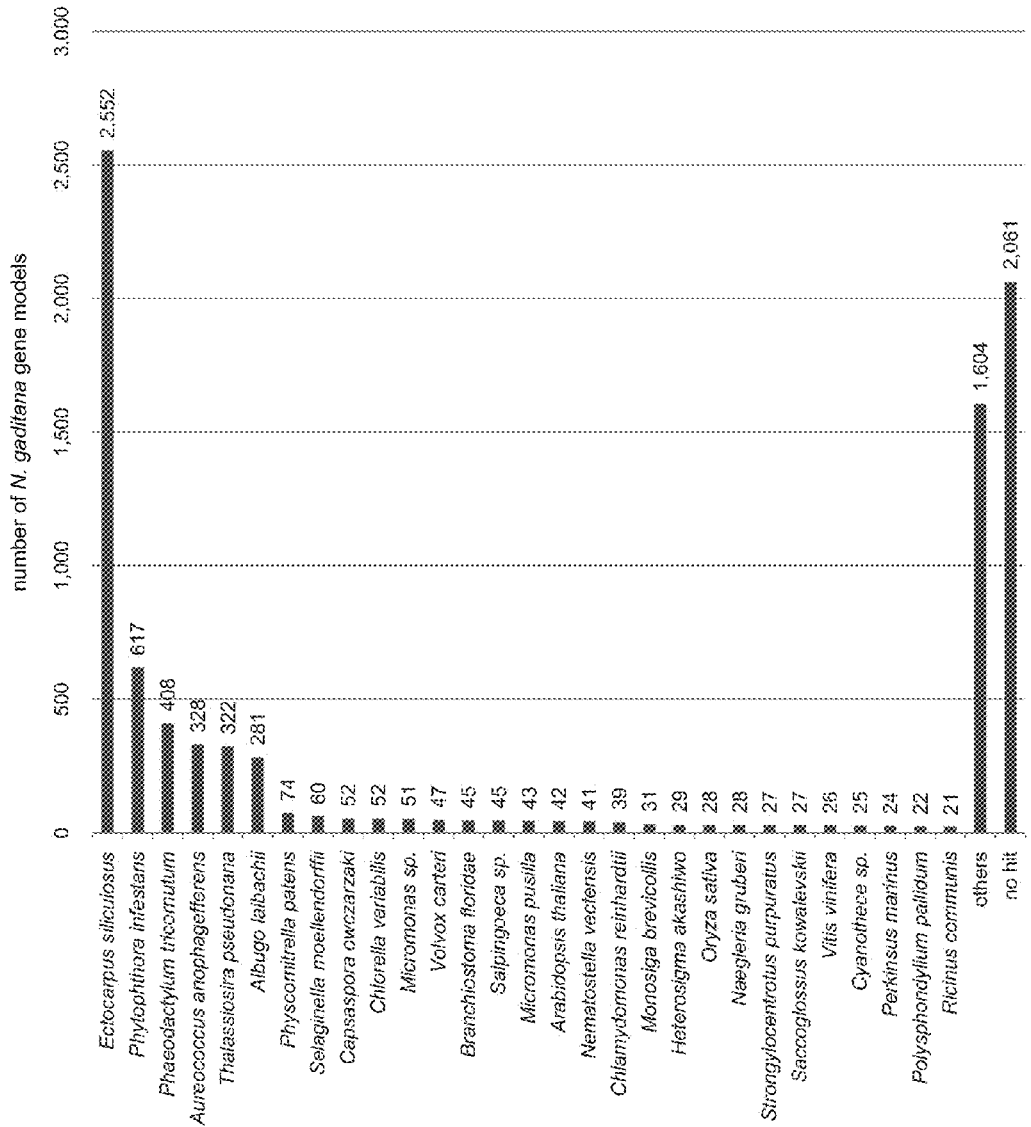
FIG. 10 depicts *N. gaditana* gene models from BLASTp top-hit by organism. *N. gaditana* gene models were compared to all previously sequenced genomes in the nonredundant (nr) protein database using BLASTp. The number of times an organism was the top BLASTp hits (e-value less than 1E-3) of a *N. gaditana* gene model is indicated.

*Nannochloropsis gaditana* is a eustigmatophyte alga that is closely related to the Phaeophyceae (brown algae), with the closely related organism having a fully sequenced genome being the multicellular brown alga, *Ectocarpus siliculosus* (FIG. 9a; Cock, J. M. et al. The Ectocarpus genome and the independent evolution of multicellularity in brown algae. Nature, 617-621 (2010)). To identify novel features of the *N. gaditana* genome, we determined which *N. gaditana* genes have homologs found in brown algae (Cock, J. M. et al. The Ectocarpus genome and the independent evolution of multicellularity in brown algae. Nature, 617-621 (2010)) and the pelagophyte *A. anophagefferens* (Gobler, C. J. et al. Niche of harmful alga *Aureococcus anophagefferens* revealed through ecogenomics. Proceedings of the National Academy of Sciences, 4352-4357 (2011)), green algae (*Chlorella variabilis* NC64A and *Chlamydomonas reinhardtii* Blanc, G. et al. The *Chlorella variabilis* NC64A genome reveals adaptation to photosymbiosis, coevolution with viruses, and cryptic sex. The Plant Cell (2010), Merchant, S. S. et al. The *Chlamydomonas* genome reveals the evolution of key animal and plant functions. Science, 245-250 (2007)), red algae (*C. merolae*; Matsuzaki, M. et al. Genome sequence of the ultrasmall unicellular red alga *Cyanidioschyzon merolae* 10D. Nature, 653-657 (2004)), and diatoms (*T. pseudonana* and *P. tricornutum*; (Armbrust, E. V. et al. The genome of the diatom *Thalassiosira pseudonana*: Ecology, evolution, and metabolism. Science, 79-86 (2004), Bowler, C. et al. The *Phaeodactylum* genome reveals the evolutionary history of diatom genomes. Nature, 239-244 (2008)). This analysis confirms the close evolutionary proximity between the Eustigmatophyceae and Phaeophyceae (FIG. 9b), and provides us with 2,744 genes that may be unique to *N. gaditana*, not found in the other algal genomes queried. This corresponds to 30.3% of the total gene repertoire in *N. gaditana*, which is similar to the fraction of unique genes found in *T. pseudonana, E. siliculosus* and *P. tricornutum*. (Bowler, C. et al. The *Phaeodactylum* genome reveals the evolutionary history of diatom genomes. Nature, 239-244 (2008); Cock, J. M. et al. The Ectocarpus genome and the independent evolution of multicellularity in brown algae. Nature, 617-621 (2010), Armbrust, E. V. et al. The genome of the diatom *Thalassiosira pseudonana*: Ecology, evolution, and metabolism. Science, 79-86 (2004)). Comparison of *N. gaditana* gene models to the non-redundant protein database (BLASTp) yielded top hits from a variety of organisms, the most frequent being stramenopiles (FIG. 10), which was expected based on the phylogeny of *N. gaditana*.

Figure 12:
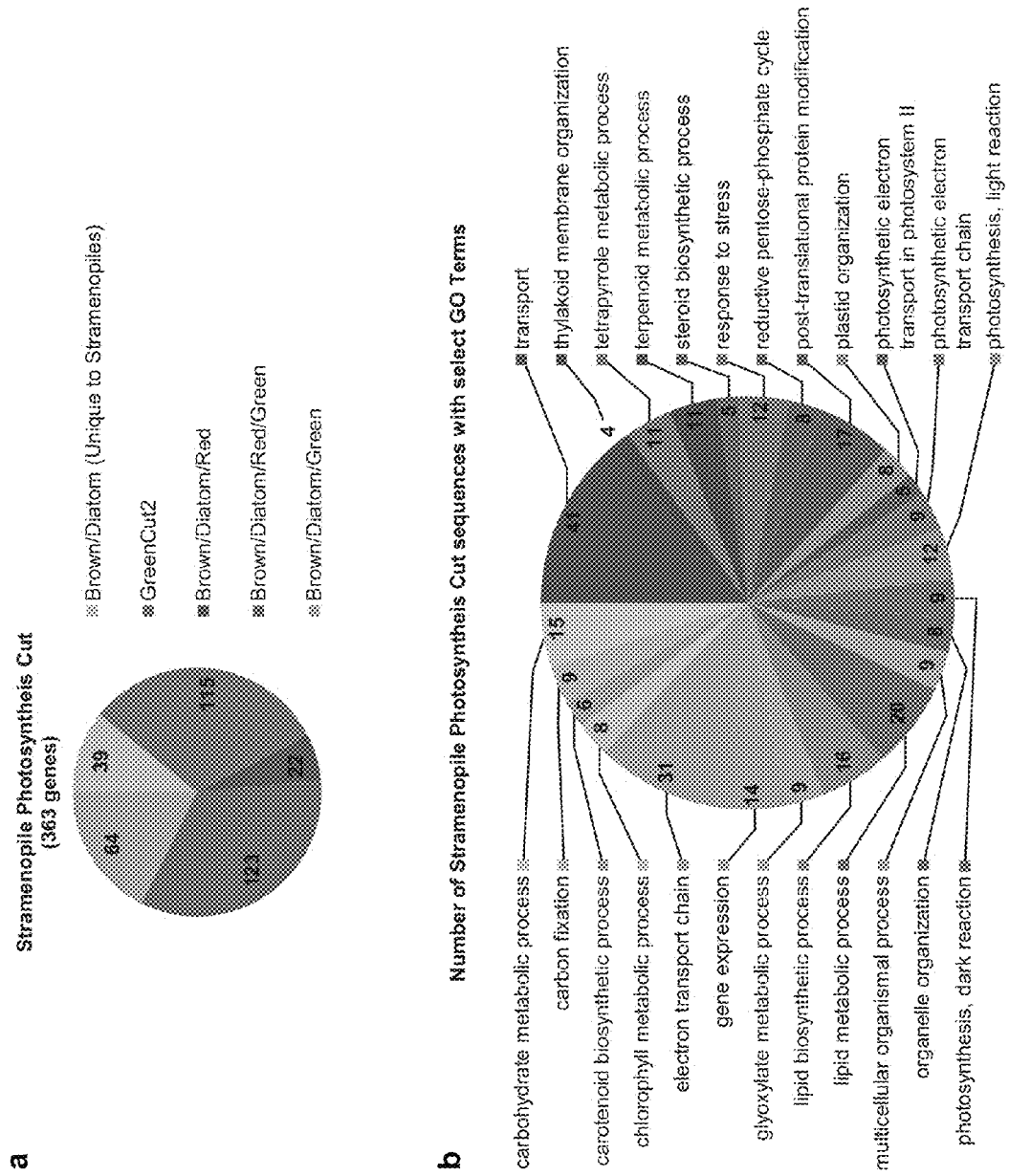
FIG. 12 depicts an expanded version of "StramenopilePhotoCut".

Previous attempts have been made at establishing the minimal essential set of genes needed for photosynthesis, the "GreenCut" of photosynthetic genes, which is a set of 597 orthologs that are conserved in plant and green algal lineages, but not in non-photosynthetic organisms. (Merchant, S. S. et al. The *Chlamydomonas* genome reveals the evolution of key animal and plant functions. Science, 245-250 (2007), Karpowicz, S. J., Prochnik, S. E., Grossman, A. R. & Merchant, S. S. The GreenCut2 resource, a phylogenomically derived inventory of proteins specific to the plant lineage. Journal of Biological Chemistry, 21427-21439 (2011)) We decided to take advantage of the fact that there are both photosynthetic and non-photosynthetic stramenopiles to generate an analogous set of genes conserved in photosynthetic stramenopiles. To establish this "StramenopilePhotoCut" of photosynthetic genes, orthologs common to *N. gaditana* and four photosynthetic stramenopiles (*E. siliculosus, A. anophagefferens, T. pseudonana* and *P. tricornutum*), but not present in non-photosynthetic stramenopiles (*P. sojae, P. ramorum, P. infestans, A. laibachii* or *B. hominis*), were selected, resulting in a list of 363 genes. (FIG. 9c and FIG. 11). The majority of these genes have orthologs in the green and red algal lineages and 115 are found in the "GreenCut2" (Karpowicz, S. J., Prochnik, S. E., Grossman, A. R. & Merchant, S. S. The GreenCut2 resource, a phylogenomically derived inventory of proteins specific to the plant lineage. Journal of Biological Chemistry, 21427-21439 (2011)); see FIG. 12 for an expanded characterization of the genes in the "StramenopilePhotoCut"). However, 39 genes with homologs found in photosynthetic stramenopiles are present in the genome (FIG. 11). Similar to many genes found in the "GreenCut", some of the 39 stramenopile-specific "StramenopilePhotoCut" genes are of completely unknown function, but several of the genes have known domains, including several peptidases/proteases, DNA-binding proteins/transcription factors and transport proteins, as well as genes that are thought to directly interact with the photosystems. Due to the photoautotrophic growth rates exhibited by N. gaditana we also characterized the complete pathways for synthesis of chlorophyll and accessory pigments (FIG. 1). All expected genes could be identified except for those encoding the mevalonate pathway for isopentenyl-pyrophosphate biosynthesis (see analysis of bioenergy metabolic pathways).

Bioenergy Metabolic Pathways

Figure 13:
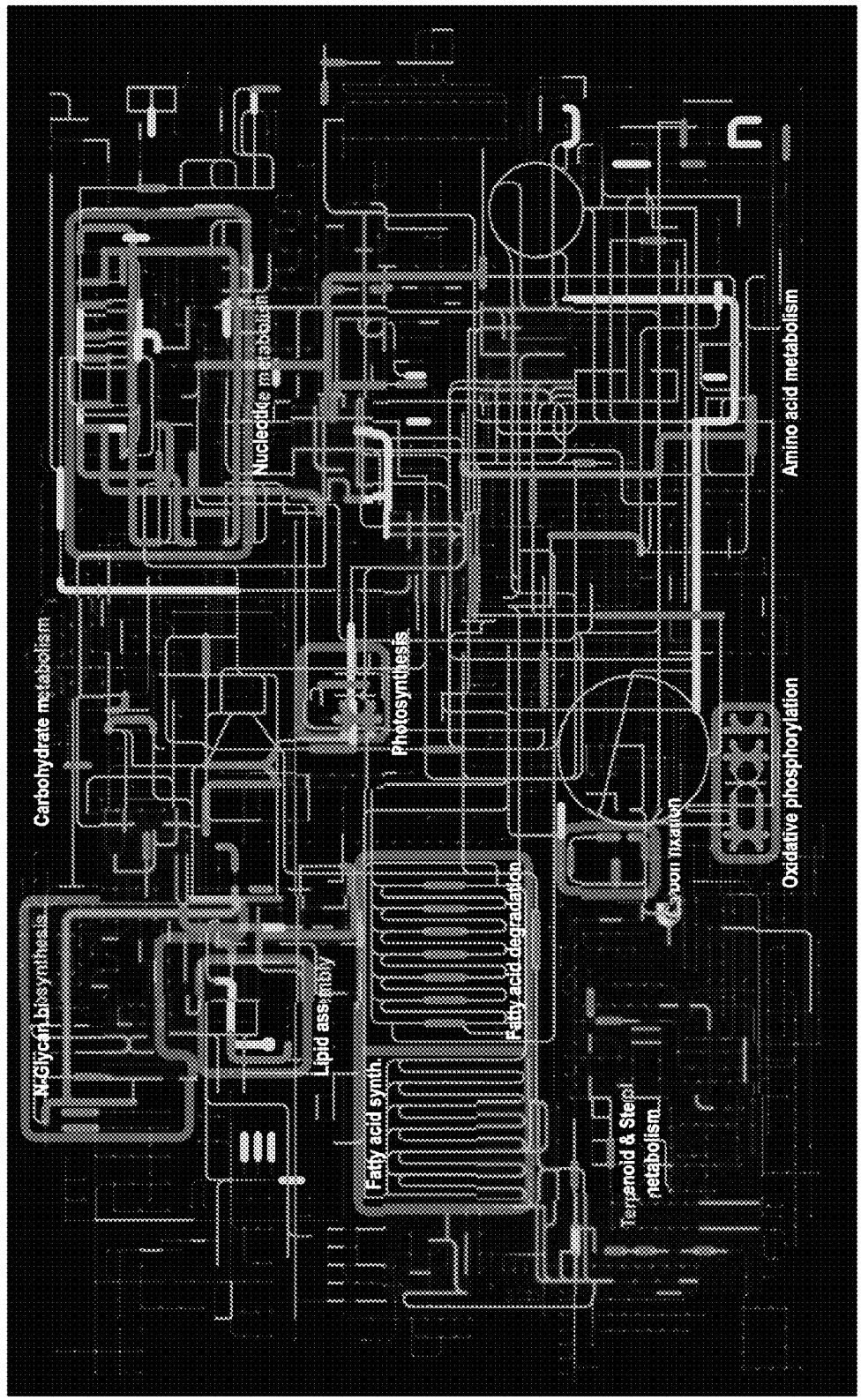
FIG. 13 depicts metabolic pathway map of genes found in *N. gaditana* genome in green. Genes that are up- or down-regulated during nitrogen deprivation are labeled in yellow and blue, respectively. Light gray background traces indicate KEGG pathways not encoded by the *N. gaditana* genome.
Figure 14:
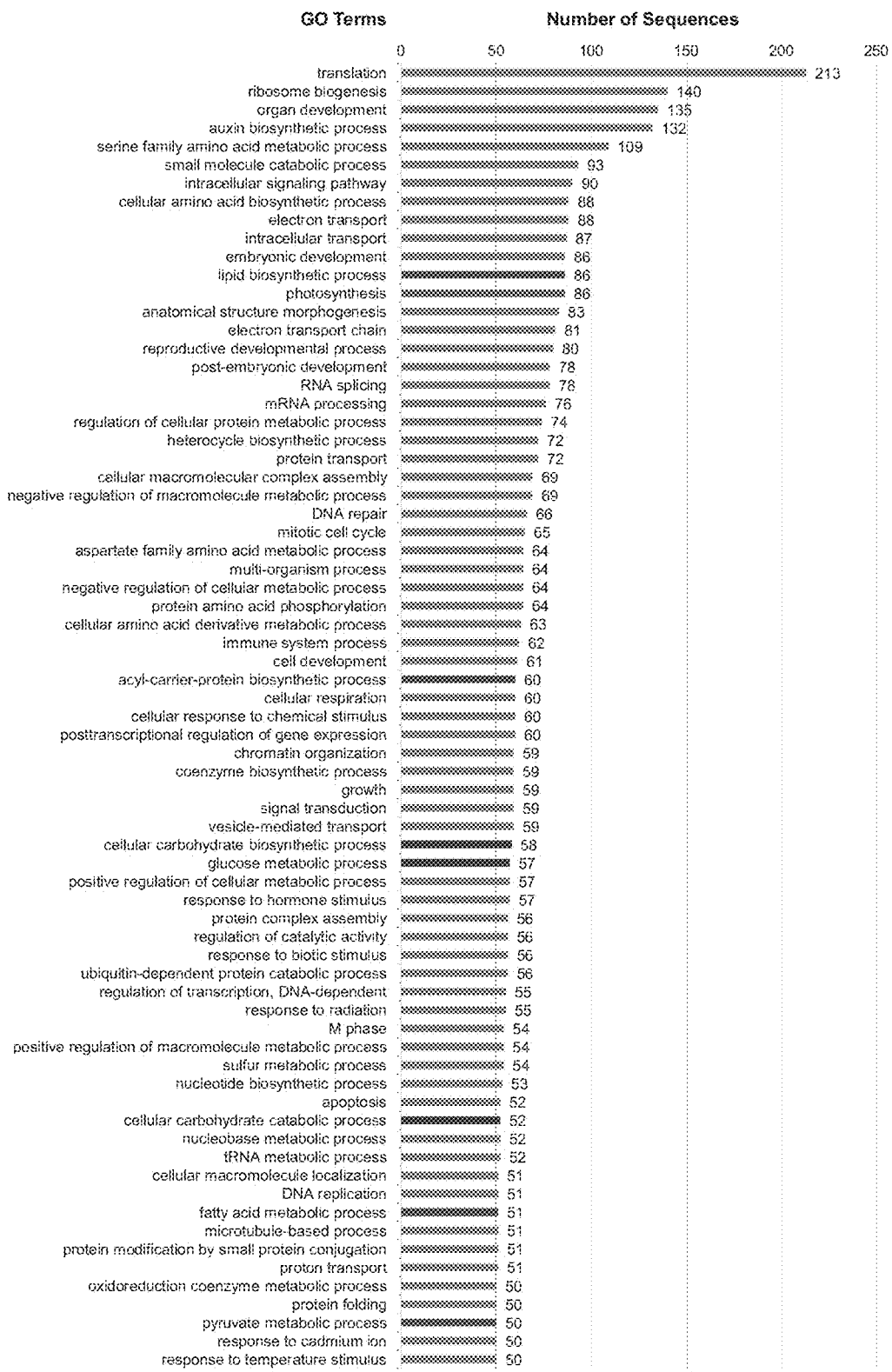
FIG. 14 is a bar graph of the most abundant GO terms assigned to *N. gaditana* gene models. Number of gene models assigned to specified GO term. GO terms associated with lipids (red), carbohydrates (purple), and photosynthesis (green).
Figure 16:
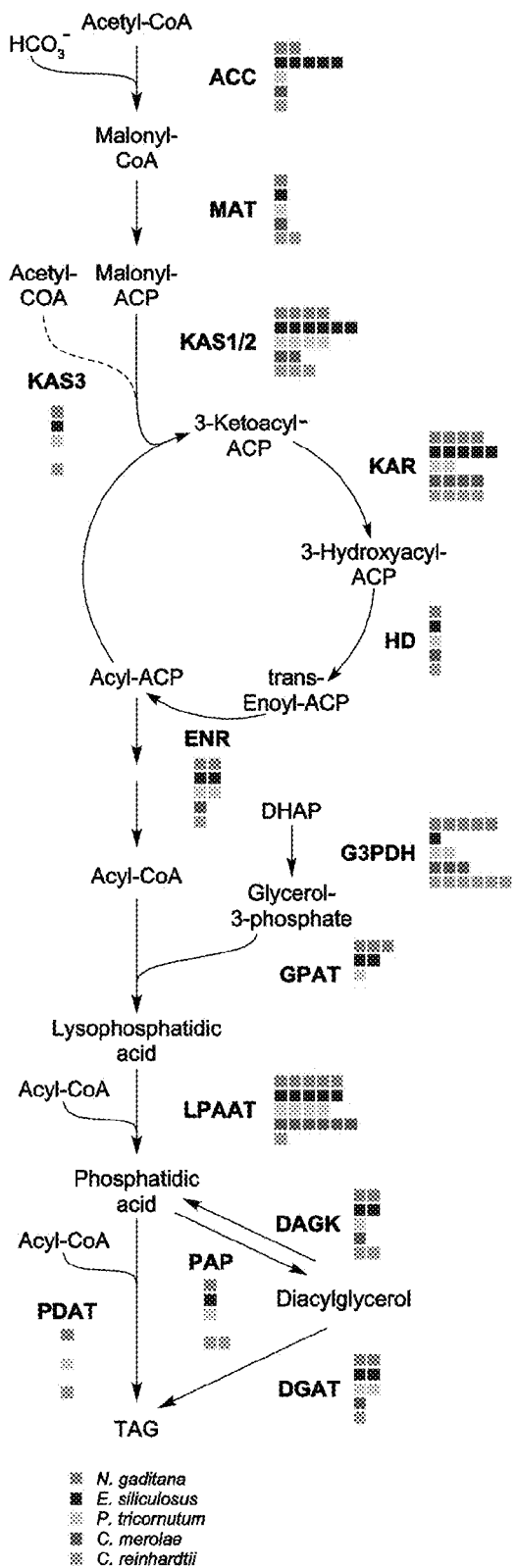
FIG. 16 shows the number of gene homologs in the TAG biosynthetic pathways in *N. gaditana* as compared to a brown alga (*E. siliculosus*), a diatom (*P. tricornutum*), a red alga (*C. merolae*) and a green alga (*C. reinhardtii*). For each reaction, colored squares denote the number of homologous genes in *N. gaditana* (orange), *E. siliculosus* (brown), *P. tricornutum* (yellow), *C. merolae* (red), *C. reinhardtii* (green). See the table at FIG. 18 for an overview of these gene homologs.

To investigate metabolic pathways of interest for biofuel production functional annotations were assigned to N. gaditana gene models. Gene Ontology terms were assigned to 3,838 gene models, from which 2,766 genes were identified as performing enzyme-catalyzed reactions representing 700 unique EC numbers that were in turn used to populate metabolic pathway maps (FIG. 13). Some of the most frequent Gene Ontology terms, aside from housekeeping functions, are terms involved in auxin biosynthesis, photosynthesis, and lipid biosynthesis (FIG. 14). Due to the exemplary lipid production by N. gaditana cultures we focused on characterizing lipid metabolic pathway genes, including those involved in fatty acid biosynthesis, TAG assembly and lipid activation/degradation (FIG. 15). BLASTp was used to identify homologs of the N. gaditana lipid metabolic genes in red/green/brown algae and diatoms. Comparison of the number of genes in each step of the lipid metabolic pathways suggests that N. gaditana has an expanded repertoire of genes involved in both TAG assembly and lipid degradation, including glycerol 3-phosphate dehydrogenase (G3PDH), glycerol 3-phosphate acyltransferase (GPAT), long-chain acyl-CoA ligase (ACSL) and acyl-CoA oxidase (ACOX) (FIG. 16 and FIG. 17). This increased number of lipid metabolic pathway genes is likely significant considering that N. gaditana has fewer total genes than all other algae used for this comparison, with the exception of C. merolae. To further examine the expansion of gene families in N. gaditana we compared the prevalence of gene ontology terms (GO-terms) with P. tricornutum and C. reinhardtii using the Fisher exact test. A selected list of over- and under-represented terms is shown in FIG. 18. This analysis confirms the overrepresentation of the GO-term for acyl-carrier protein biosynthetic processes and also indicates the expansion of several other gene families that can be of importance for the exemplary biomass production phenotype of N. gaditana.

For further analysis of the expansion of gene families/enrichment of gene ontology terms (GOtems) in N. gaditana we compared the prevalence of GO-terms with P. tricornutum and C. reinhardtii. Gene Ontology terms were assigned with Blast2GO and the complete gene ontologies for P. tricornutum and C. reinhardtii were obtained from B2G-FAR database. (Götz, S. et al. High-throughput functional annotation and data mining with the Blast2GO suite. Nucleic Acids Research 36, 3420-3435 (2008), Götz, S. et al. B2G-FAR, a species centered GO annotation repository. Bioinformatics (2011)). The Fisher exact test was used to analyze the significance of the expansions/reductions through the use of the built in Gossip algorithm. (Conesa, A. et al. Blast2GO: a universal tool for annotation, visualization and analysis in functional genomics research. Bioinformatics 21, 3674-3676 (2005), Blüthgen, N. et al. Profiling of gene groups utilizing gene ontology—A statistical framework. arXiv:q-bio (2004)). A selected list of over- and under-represented GO-terms with a maximum P-Value of $4 \times 10^{-03}$ and maximum false discovery rate of $5 \times 10^{-02}$ are shown in FIG. 18. Several expanded gene families that can be of importance for the exemplary biomass and lipid production characteristics of N. gaditana include those for acyl-carrier protein biosynthetic processes, auxin biosynthetic processes related to the production of plant growth hormones, carbon utilization, response to stress (including chemical, temperature and salt), and pyruvate metabolic processes. A large number of GO-terms associated with amino acid metabolism are also overrepresented (FIG. 19). In addition, GO-terms for chlorinated/halogenated hydrocarbon metabolic processes are also expanded, which is also observed in E. siliculosus, Cock, J. M. et al. The Ectocarpus genome and the independent evolution of multicellularity in brown algae. Nature 465, 617-621 (2010), where it is thought that these genes can protect against halogenated compounds produced by kelps as defense molecules, allowing epiphytic growth on these organisms, Cock, J. M. et al. The Ectocarpus genome and the independent evolution of multicellularity in brown algae. Nature 465, 617-621 (2010). Nannochloropsis gaditana, Merchant, S. S. et al. The Chlamydomonas genome reveals the evolution of key animal and plant functions. Science 318, 245-250 (2007), growth does not rely on exogenous sources of vitamins, which is reflected in the underrepresentation of genes involved in vitamin binding.

Example 3

Sequencing and Analysis of N. gaditana Transcriptomes

RNA was isolated from a variety of culturing conditions and growth phases, converted into cDNA, then sequenced using the Illumina SIPES protocol, followed by assembly of these reads using the commercial package from CLC Bio (Katrinebjerg, Denmark) into 37,055 contigs.

To assist in the identification of genes and to improve metabolic pathway maps of N. gaditana we sequenced the transcriptome (RNAseq) under a variety of physiological conditions. Additionally, transcriptome sequencing was conducted during logarithmic growth (low lipid production) and during stationary phase due to nitrate deprivation (high lipid production) to discover how transcriptional changes in N. gaditana modulate increased metabolic flux into lipid biosynthesis during nutrient deprivation. Genes that are strongly regulated during these different conditions are shown in FIG. 20. Similar to the findings in C. reinhardtii37, some of the up-regulated genes are involved in nitrogen assimilation and protein degradation/recycling, while some of the down-regulated genes are involved in photosynthesis. In addition, we annotated some regulated pathways on the metabolic pathway map (FIG. 13). This map highlights the decreased expression of genes involved in photosynthesis, carbon fixation, and oxidative phosphorylation that would be expected during stationary phase due to nutrient deprivation. Surprisingly, few genes that are directly involved in lipid biosynthesis are transcriptionally up-regulated to a significant extent. Because N. gaditana constitutively produces TAG, even during logarithmic growth, a possible explanation for this low amount of differential transcript accumulation is that the lipid production machinery can already be abundant within the cell, and existing levels can manage increased metabolic flux. In support of this hypothesis, we found that genes assigned with the GO-term for posttranscriptional regulation of gene expression were overrepresented in N. gaditana in comparison with P. tricornutum and C. reinhardtii, while the GO-term for transcription factor activity was underrepresented (FIG.

18). These results demonstrate that genes involved in gluconeogenesis (fructose-1,6-bisphosphatase, fructose-1,6-bisphosphate aldolase and phosphoglycerate kinase) are down-regulated, which could help direct carbon flux away from carbohydrate biosynthesis into lipid biosynthesis. To determine the exact mechanisms of lipid accumulation during nutrient deprivation further transcriptomic, proteomic, and metabolomic investigations are needed.

Other pathways that are of interest for bioenergy applications are the two isoprenoid biosynthesis pathways, the mevalonate (MVA) and the non-mevalonate pathways (DXP). Ancestral eukaryotes generally have the MVA pathway while many photosynthetic organisms have acquired the DXP pathway, most likely through a cyanobacterial endosymbiont or secondarily through a red algal symbiont. (Zaslayskaia, L. A., Lippmeier, J. C., Kroth, P. G., Grossman, A. R. & Apt, K. E. Transformation of the diatom *Phaeodactylum tricornutum* (Bacillariophyceae) with a variety of selectable marker and reporter genes. Journal of Phycology 36, 379-386 (2000).

Figure 21:
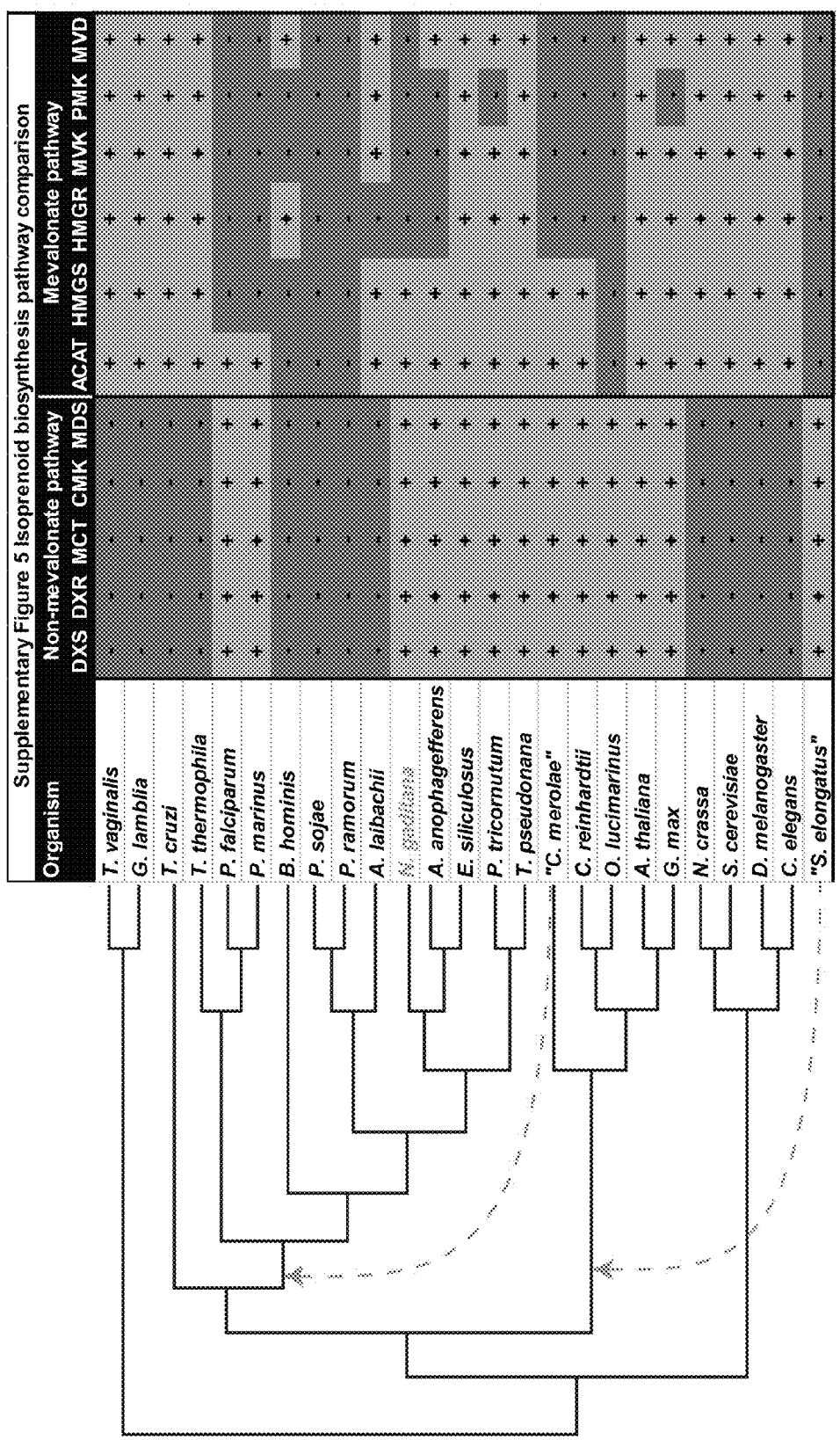
FIG. 21 is a comparison of isoprenoid biosynthesis pathway. Simplified phylogenetic cladogram and table showing the relationship between organisms with different sets of isoprenoid biosynthesis pathway genes. Green arrows indicate the acquisition of photosynthetic symbionts thought to have brought the DXP pathway into modern plants and algae. The names of *S. elongatus* and *C. merolae* appear in quotes to indicate that the symbiotic events do not refer to the *S. elongatus* or *C. merolae* but rather unknown relatives of these species.

Some higher plants have kept both the MVA and DXP pathways, while the green and red algae (*C. reinhardtii, O. lucimarinus, C. merolae*) have kept the more recently acquired DXP pathway and eliminated the more ancestral MVA pathway. In a similar fashion, stramenopiles that most likely acquired the DXP pathway from a red algal symbiont have in the case of diatoms and brown algae (*P. tricornutum, T. pseudonana, E. siliculosus*) kept both the MVA and DXP pathways, while *N. gaditana* and *A. anophagefferens* have the DXP pathway (FIG. 21 and FIG. 1). Parasitic chromalveolates, including stramenopiles, seem to differ in their isoprenoid biosynthesis capacity depending on whether they have kept at least a remnant plastid. Both *P. marinus* (has a functional plastid) and *P. falciparum* (has a remnant plastid) have kept the DXP pathway, while *P. sojae, P. ramorum* and *A. laibachii* (no plastid) have lost both the MVA and DXP pathways.

Example 4

Genetic Transformation of *N. gaditana* Using Electroporation

Transformation protocols for common laboratory model algae, such as *C. reinhardtii* and *P. tricornutum* have been available for more than a decade, (Zaslayskaia, L. A., Lippmeier, J. C., Kroth, P. G., Grossman, A. R. & Apt, K. E. Transformation of the diatom *Phaeodactylum tricornutum* (Bacillariophyceae) with a variety of selectable marker and reporter genes. *Journal of Phycology*, 379-386 (2000); Boynton, J. et al. Chloroplast transformation in *Chlamydomonas* with high velocity microprojectiles. *Science*, 1534-1538 (1988); Kindle, K. L. High-frequency nuclear transformation of *Chlamydomonas reinhardtii*. *Proceedings of the National Academy of Sciences*, 1228-1232 (1990), Apt, K. E., Grossman, A. R. & Kroth-Pancic, P. G. Stable nuclear transformation of the diatom *Phaeodactylum tricornutum*. Molecular and General Genetics, 572-579 (1996)), but relatively low biomass production rates in some of these strains have kept them from becoming industrially relevant. There have been reports of successful genetic transformation of *Nannochloropsis oculata*. (Chen, H. L., Li, S. S., Huang, R. & Tsai, H.-J. Conditional production of a functional fish growth hormone in the transgenic line of *Nannochloropsis oculata* (Eustigmatophyceae). *Journal of Phycology*, 768-776 (2008); Li, S.-S. & Tsai, H.-J. Transgenic microalgae as a non-antibiotic bactericide producer to defend against bacterial pathogen infection in the fish digestive tract. *Fish & Shellfish Immunology*, 316-325 (2009)) However, 99% of the transformants lost the transgene after 1.5 months of cultivation, indicating that the majority of the transformants had not truly incorporated the transgene into the genome. These earlier attempts at transformation of *N. oculata* relied on the use of foreign promoters, from *P. tricornutum, C. reinhardtii* or viral promoters and did not utilize antibiotic selection. Here we show for the first time the successful transformation of *N. gaditana*. Transformation efficiency was greatly improved by the use of endogenous promoters, identified through preliminary sequencing of the *N. gaditana* genome, to drive the expression of a bleomycin resistance gene. In addition, previously described protocols for the transformation of *N. oculata* involve the use of various enzyme mixes for creation of protoplasts prior to transformation, (Chen, H. L., Li, S. S., Huang, R. & Tsai, H.-J. Conditional production of a functional fish growth hormone in the transgenic line of *Nannochloropsis oculata* (Eustigmatophyceae). *Journal of Phycology*, 768-776 (2008); Li, S.-S. & Tsai, H.-J. Transgenic microalgae as a non-antibiotic bactericide producer to defend against bacterial pathogen infection in the fish digestive tract. *Fish & Shellfish Immunology*, 316-325 (2009)), while our protocol simply relies on the use of electroporation at high field strength. We selected three promoters for use in our transformations, which included the promoters from the genes encoding beta-tubulin (TUB, Nga00092), heat shock protein 70 (HSP, Nga07210) and the ubiquitin extension protein (UEP, Nga02115.1). The efficiency of the transformations was strongly affected by the promoter used (Table 3) and efficient transformation was achieved using the TUB promoter which resulted in an efficiency of $12.5*10^{-6}$. This was achieved using a very high 12,000 V/cm field strength during the electroporation. Use of lower field strength (10,500 V/cm) resulted in 5-fold lower transformation efficiency ($60*10^{-6}$). We also attempted using the fucoxanthin binding protein B (FcpB) promoter from *P. tricornutum* without success. The highest efficiency achieved, ($12.5*10^{-6}$) is comparable to the efficiency ($10*10^{-6}$) observed with transformations of *P. tricornutum*. (Apt, K. E., Grossman, A. R. & Kroth-Pancic, P. G. Stable nuclear transformation of the diatom *Phaeodactylum tricornutum*. Molecular and General Genetics, 572-579 (1996).

TABLE 3

Number of clones generated by different promoter constructs and field strengths

| Promoter construct[a] | 9,000 V/cm[b] | 10,500 V/cm[b] | 12,000 V/cm[b] | 12,000 V/cm efficiencies[c] | +N RNA quant[d] | −N RNA quant[d] |
|---|---|---|---|---|---|---|
| No plasmid[e] | 0 | 0 | 0 | 0 | N/A | N/A |
| TUB Nga00092 | 0 | 3 | 40 | 12.5 * 10-6 | 6,992 | 7,149 |
| UEP Nga02115.1 | 0 | 8 | 18 | 27.8 * 10-6 | 1,491 | 1,341 |

TABLE 3-continued

Number of clones generated by different promoter constructs and field strengths

| Promoter construct[a] | 9,000 V/cm[b] | 10,500 V/cm[b] | 12,000 V/cm[b] | 12,000 V/cm efficiencies[c] | +N RNA quant[d] | −N RNA quant[d] |
|---|---|---|---|---|---|---|
| HSP Nga07210 | 0 | 3 | 3 | 166.7 * 10-6 | 5 | 2 |
| pPha-T1-fcpB[f] | 0 | 0 | 0 | 0 | N/A | N/A |

[a]The promoter used for transformation.
[b]Number of colonies generated at the different field strengths used during electroporation.
[c]Efficiencies of electroporation, colonies generated per electroporated cell.
[d]Normalized RNAseq quantification measured in number of reads per kb of the corresponding genes during normal and nitrogen deprived growth.
[e]Negative control went through entire electroporation protocol without any plasmid DNA. Survival appeared unaffected on positive control plates without zeocin.
[f]pPha-T1-fcpB indicates use of the *P. tricornutum* fcpB promoter.

Figure 22:
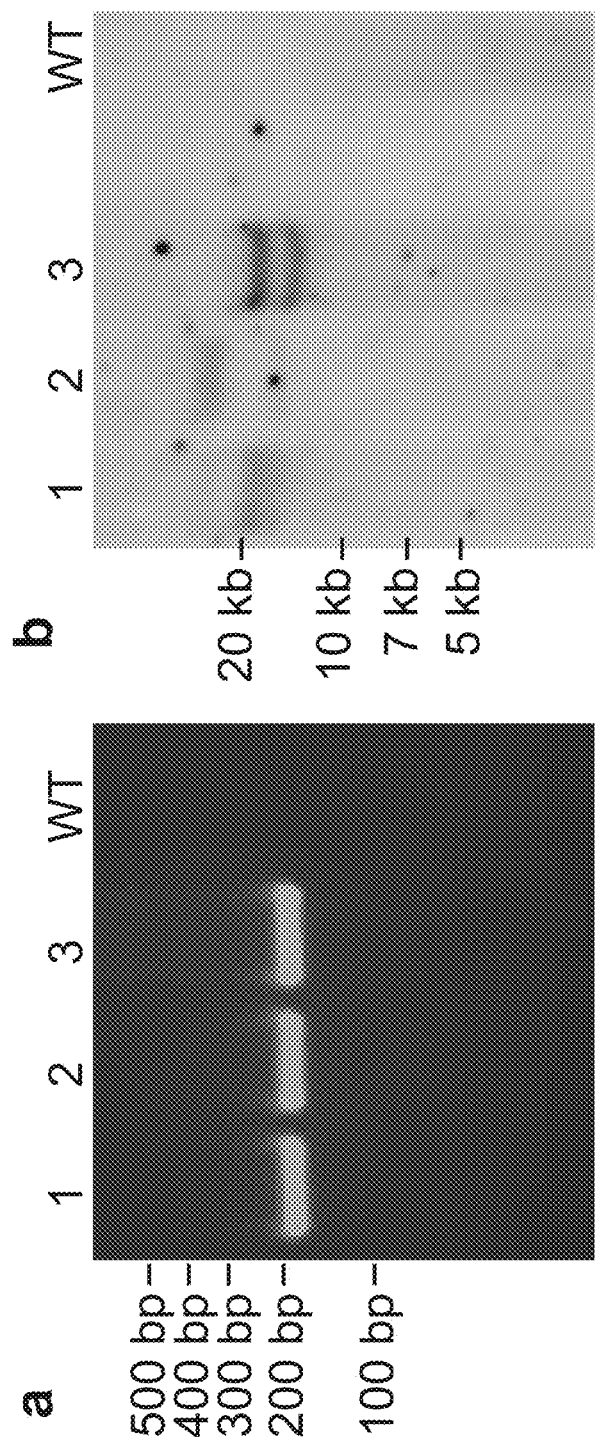
FIG. 22 shows successful transformation of *N. gaditana* by electroporation.

Confirmation of successful *N. gaditana* transformation was done after 4-5 months of growth with antibiotic selection. Genomic PCR confirmed the presence of the transgene in selected colonies and Southern blot analysis confirmed successful incorporation of the transgene into the nuclear genomes of the mutant colonies (FIG. 22). The Southern blots also indicated that in various cases multiple insertions of the transgene occurred, and that integration into the genome with the construct used is random. Our results demonstrate a straight forward approach to genetically modify this oleaginous alga, and we anticipate that the ability to further engineer *N. gaditana* will allow this organism to emerge as an important model species for algal biofuel production.

It is appreciated that certain features of the invention, which are, for clarity, described in the context of separate embodiments, may also be provided in combination in a single embodiment. Conversely, various features of the invention, which are, for brevity, described in the context of a single embodiment, may also be provided separately or in any suitable sub-combination. All combinations of the embodiments pertaining to the nucleic acid, polynucleotide, amino acid, and polypeptide sequences are specifically embraced by the present invention and are disclosed herein just as if each and every combination was individually and explicitly disclosed, to the extent that such combinations embrace operably sequences (i.e., sequences that produce the desired effect and can be tested for biological activity). In addition, all sub-combinations of the sequences listed in the embodiments describing such variables are also specifically embraced by the present invention and are disclosed herein just as if each and every such sub-combination of sequence was individually and explicitly disclosed herein.

All cited references are herein expressly incorporated by reference in their entirety.

Although certain preferred cases of the invention have been specifically described herein, it will be apparent to those skilled in the art to which the invention pertains that variations and modifications of the various cases shown and described herein can be made without departing from the spirit and scope of the invention. Accordingly, it is intended that the invention be limited only to the extent required by the appended claims and the applicable rules of law.

SEQUENCE LISTING (8838 sequences)

SEQ ID NO: 1 - DNA, 703 bp, Nannochloropsis_gaditana
atccttctctgcttcgtcgtctacctttctccgcctttgctgttcgttttgcttcctctggcgcttggacggccctgcctgtgctattatattagcctcctccggccccacgcctgcctcttgatccagctcgttatccacgtctagggtcccaaccatctcgttttcctctcgatcgacgtagaaaagcggcgctgcatccttgtcaggagcatcggggggctgcgagtcaggcacccgctctccctctccaggggggggcttgcctgcgcccccccgggacgaccgtcgggcacccgatggcatggcacgctggtctcggaaactgcctgtttttaagtgcatggtgtcgcattgttgtttaaagcagtaaaagatgaacaaaagcgtggacaaacctcaagatattggcacgaccggggggcagttcaccgggaacgtgcttggccctctgatggcgagtcgccaggcctcgctgctccttcccagcgtctcgggccaccctttgccttctagtttcctctccttccctgtcgccctttcgcacattgtaattttaagttttcccctccacgtcaaccgaaagtgtcccgtcggagcatcgggatagccgacgcgaaggtgcaaaagacggggaaccggcgttaaaagcacaaaccgggtactgaacgccgtcactcctacgtgtacagcaagcagtatg

SEQ ID NO: 2 - DNA, 703 bp, Nannochloropsis_gaditana
gctgcgagcagtaatactgtccctgtattttcagctaatggtatgcttgatggatctatcgtcatgcgcaaagaggagctagcaatgcgcggcgcaggtggtgctaattgatgaaaagaggaacgaggcagaccttttggaggaatgaaagcttgagccggaaggccgacaaatgccagcaaggtgaagatgatgccatggcagaggattactagacgcatctttcggcagcgttcgctgtgaggttgatcggcgttgagaaacaaaaggtcgaatcagtaaaggttggccgttcaacctcccggctactagtcctcctactgagatctagtagatctcagctgtgacacagtcaatcgttggttctaagtcgcggtggtaagagacttctgacacaaatcaattaaaagcatcaaagcacaatcttgtcatgtccggggaggctcacaatttatgtcgatagagggagcatatttcttacaaacgggttaggtgtctcggccgcgagacgtgctcgcctccgtctagctagctgggtagcctgcaggctcggcttcgatctggtcgggcatgccagctagttggtcgacagttgagacgttgttcacaagattaagcaaccttgctcgatcacttaaaaatacatgtcaggatcgcggggcagggcaccagcgaccactcgctctgtgcgtgaggcgtaatg

SEQ ID NO: 3 - DNA, 703 bp, Nannochloropsis_gaditana
aggcttggctagcgcggtctggtcttcagcttctttcttggccagcgcccggtttctgtcagctccactaagcatactgaagatgctcctagaagcgcatccggctggccccgccagcattgcaagagacggtgatgctggtctcctaatcacacagcgtgtgatgagagggtggcccgtaccatgtgcgcgctgggcacaatgagtgccgcggttgccagtacggagcaaggcacgaaccagcatgttggtatgcaggaggtctcggtgggacacgtatgcgactgtctgcggccgaactggctaaagttcgcagaaatgtggaaccgggatgtgtatattatacatatatgttagtgcaggcaacgactcgcgaagatggtaggaaatatgacagggagcggcgcaatgtgtgtgaatggaggcattgttatggtcacggcctatgctagtgtcgtgactcgcctgcttcctctcctttcccccccagacccccccccctttcctactacgagcacagccctccccccgcgttcaaaactcaggcatttgtaagcttactgtggaccttaatatttcaatacctatatcacatacccggcacagggaaagagtgacttttgtcttttacccttctttctgttgctcgcgcagcctccggcccctgcggcgcaaagcttaggcatcagtgctcaaagaaatg

SEQ ID NO: 4 - DNA, 703 bp, Nannochloropsis_gaditana
tggtgctgtgtgccaaggtcatacgaggccaacgcctcatggtcttgcaaaatcttgcaccgatgcagaaggtactgctcctcaactgccacgcctatcgcggtcgcaacctgggctttgagatcctggacgcgcatgtcgccctgcacgttgagagggtagcactgtcccccaggcccacgcactatcaagttgttcgttaagggtgagcctcctcctggggtctccccccatgccttatcttcctctccgatcaataaagcatggtcgtacaaaggcatctttgtgacgcggcgtctgaattctaatttcaattatgtgggtacaagtagcgtggggatggaatggtcagaacgtccgtaggatggaagtgaagaaaatggcgagcatctgaagggggcgggcgataggcacgaaggggaagcgacgctctcttgagtcttgaatctccctcttacgattagcccttctgtgctgacccgctttcgaaggccactgtcacacgggtcgatggacgagaaagtgtggctacctatgtcttcgagggtcgtctgctcccaacgggacgaactacgcttagatcgagcatatcacacgcccgggcccctcacttgcgattcctccactctctcgatctgcccgacaggcctcaaagggtaatgagccggaaaggtatggctctcttccccgcaaaagcgtcatg

SEQ ID NO: 5 - DNA, 703 bp, Nannochloropsis_gaditana
aattaccacttgggaacatgtccagagttcatgaaaatcatctatacgggccttgcatgaaagatgcatgcaaaataagccactcatgaccagatggaactgtagcagaaatccagagcgtttaccttcggcaacgcccgccccgagccaagctgtactgctcttgcaggaagcggtgcaccgatgcctccgagctaagattgatcgacgtagcctcgctttcgtcctcttcgtccaccgctagacggcttctggaggggcaggcagcatcttcatagtgacgggaagaacgacctcccacccctccttcgtctctgcctccctcttccaggcctttgaagaaaattccgcccatgctaatggaattactgtggcagcaaaatttagggagctttttgtaatttacgagggggaaatctcgtttcaagacgccatcacgggatacaataaacacgcgttgcaactcgagccgtcaggccctcggcgttagaagcgaggcgcttccgaacttcttgaagcagtcgcctcgccctttaagttgacgccaaggtcaaggaattacgggacaaatttctcacgctcaaaatcccacaatttctcgaagcgatcaagcgagtgcatggcagggtaggcaaggcagcatgggggcagtcgtggcaaagtaagatcgcaacactttagaatattgatcatttctactatg

SEQ ID NO: 6 - DNA, 703 bp, Nannochloropsis_gaditana
gttttttgtctggtgagcgccggtgaccagcttgtagtgccttcatgtggcggctcatccatgagcatcagatgcccgtgccgctcgagacttttcgtatactgcttaatgcttgggtgaggagaaagggtgtctggtgtggggaggaatgcctgacagctgaggcaaagcgagctaagcaccatgcacagtgtcataaaacgcagacaccacattgtatgtaatgaagggcgctgtggaggcggtgtgtttccttcctttcccacgtgtgttatgagtagcatggagcaaagagtggctaggaggtgcggcgcccaagttgccgggtgtgccccgtctcctcttgattcccaggcccagcaggatccaggtcctgcgacctgcttgttgcggacattaaattgccagagatgggaaagacgaggaaggcgtgagatccggctcgatcgctcaaccccggccgcacgtctgcctggccctatccccgcgctagctccgagaggccctgggagagtcgttacatcctttcctcgttccaattgatctacgccgcatgcacgcacgctcacaccccgaacatacacacgcgcttttacatggtacagctcacggaaggaggacggaggttacacctcaagcgaccactgtggccttcctcaagctcaaccctctacgaacgcgcttcaatcgatcttccgcgatg

SEQ ID NO: 7 - DNA, 703 bp, Nannochloropsis_gaditana
ttgagcaaaaagtatttttcgacattgcgagagttcaccatgtcggcgcgtgtctggcgaagacaaagattttggaaaataggtgcaacgggcatagccttttggggagtcgggttgtttttaacatacattgctgtaagcaagagaagtggaaagttgcaatagaaatctgaacaaatgtaagcgaggcaaatgtataaactatttatcataacgagctaaaaggttcattacagcaaccgccacaagttttcaaaaagattaggtgaacgatttttcaacctgtatccaacattgtatgaaaatatgagagtgttttattgcagcgaatgccgggtttacgcgttcttaaaatcggaagcctcggcaacctcctctgataaacggtcgagctcgagtcaacggtcgacgccgcgtaacgttcagtcgtccggcatagcagagggttcatgctcactatatcgctccggtcccccttctgaaacatgtcagctgttatttaataataaaatgtatattttacattttgtgtagaaatatgagggaaactcaccacgtgtctaatcatacacgcttcccacttgcagtttatttaagttcaggtcacttctaacggacatttttgaactctttggcaaatcagtgcctctaggaacgaaaagcatcggtcgcaatcatggtgcaaacacgccggatgaccatg

SEQ ID NO: 8 - DNA, 703 bp, Nannochloropsis_gaditana
taaacgccctcgacatggatcagtagtgtatccttattcacgatgaagaaagcatttctaagaagttcaaattaaaaatggtatggagggtagtctccactgcccactgtcgaggacagaggcttactttggaaagaaaagaaggggtctgctcatagtgcccgcgggcctgggactcaggcggcctcgtgacgtcacgatggttcaaaagctctgacgccatcttcaaggtgtcgtgtccattttatcggctgtccattacactcatcgcgctgccaacacgactttgcgggacttgcacgccatccagacccatgtgtggcataagtgcttcagtactccttgtaaagagaagattcagagagcacaacttaatttgttttttaaatggctatcttgtcaggggccgacaaggacgcaacgttcagtggccttccttcttccgcgaaacgtgccatgcatttgtcacttatcaccaacatccagggacgtgtgatagtcaaggcttctacagctatcaaaaaatatttgtaccatattgcgaatgatatacatacaatttttccacaaattacagttctcgtcgcacgagtagtgagaatttgcgctgtactctttcgatccgcccggcttggcgtcgaccatccctgaagcaatcgtagtggtttttggggcatctaagcagaaccttcaagtaatcatg

SEQ ID NO: 9 - DNA, 703 bp, Nannochloropsis_gaditana
acttgcgaagagttagagactttatctcaagtgtaagggacttgcattgttgcctcttgcccaaaagcagggcaacctcaaacaggacaatgaagatcaggaggggtagaaagtaaggagatggcggctccaccagcgtgatagccatttggacgagccacgtgtcaagattctaccctgatgcgattggagctagacaattgtgcgtttctggtatcgctctgtggtcgtgggtgaaagaggttggggggattccttcaaagtactggagaggcggagctgcaacctcgctgtcgcccgcgctactagtctgtctcaccacccctgtaccaccgatgctcccgaaaccaacatcatctcaatcttttcttggtcatacggcacatatttgatgcagggcagcgtatgccgatatcaagccacgggggttgctaggagaaggttcttcgaccctccgtcacaagcttgggttgctgcaacagcgacatcccgcatggcccgccatgactgcgctcctagcaatcggacacgcagcaccagactatggcaacgtgaaactctcttgttttcagtcacccttctttatgtcacggcttcggcctcctcgagccacactcttcgccatgctgccttcctttccagcttgcccccacggcgaccgacaaatcaggttcatggtgcgctgcccccgggaaaagaaatg

SEQ ID NO: 10 - DNA, 703 bp, Nannochloropsis_gaditana
caacaaggtgagacaaaatcgtaaaggatgggctgttatagcggagtttgtcacaggcgcaggtccatccagactgcgtttgccggtgtcattttccatccagtgtcggcgtcgaagttacttgttcccggaaaatgtggagctacctgacacaaaagtgcggaaaggactgaagtgacgtccctcctctcaagccaccgaaacgaagttgagaacgtaggtacagcagggttgcacagagcttcatttcccacaaaaaaataaaatgaggattagtcattcgagcaagttgagctgaaagcgtcggctgagatcatgcttcttcatgaaccaatagaagatacgacacaaaatgcattgtcatacttcgcacacgactacaaccgcaccagcagcggacaaaaaccagccctgaaaatggcattttcgcccggacgcggccacgagggcagggagtaacccccctaagcctcgccctctccctcccgagcgagtctccatactctcgtgccagtcccgcgtgacagcggccgcgctttctcgggccctcgctgcccctttctgaccgctcttcctctcgcatgtccgcgcacgaaggtctgcagtcgtctgcttgtctgtttgaatcactcactgggcgccaacccccctctcagcaacttcatcacctccatccaggcccccgggacggcaagcagggatg

SEQ ID NO: 11 - DNA, 703 bp, Nannochloropsis_gaditana
tctgaaagccggcaagttgtccggggtatgtcgaaaatccagttgcggtcagggcgaaaatggaaagtagaagggagaggcaagcgagggatacatgggcggcgcgcatggctgtgtgtgggagctaaacttccgcaggacgaaccggcggaggttgcaaaatcaatgttggaagataaaatagtaagccctcgagcctcaccctctgcacctggctcttaaggcgccgagaggcgggttaaatggagtgaagaggcgtgtgtttctacaaatggaaaagtgtggggttggaccatggaataaaatgagattcgtttcgcgcgtggaacgggagagttcctccctcctgatgacgatgctgctccgtcaccaaactcactccacacgtctcggaaatttcacgtgtgtcatcagaaaaaatatccttcatgcgcgtgtagtagtcatcacctttccaattctgcccggtgatggcgacgcataaaattgctctccgacaggcgtcaggagaagtgtcacgctcttcgcgatgccgcctaacctcgtttcgtgttctctcccgcaaatttcgagttgccatccaatttgcgcatgtcgctcatcacggctgggacagccgtttttaagaggggatgatgatgcccactaagctttcatactgcctcatcctgcacatgctaggtgggggctttccttttgcatg

SEQ ID NO: 12 - DNA, 703 bp, Nannochloropsis_gaditana
cttgaatatgttgaaccagctttctcagcctgaatgaatgttagtgccatgatgcaacatgaacaagcgtgttacctcggacccttgtaaaatgaatgctgattggcgcagtccaggccttgtccctatcgcattgaaacctggaagtgagaaggtcttgttgaggggggccaaatcgcttttgacagcgccctccaaacttactaagggcggcagtgtggtgtacgggggatgtgacaaagcccacgggagcgcttccagaacggccactgaattaattatgagtatcggtgtataagcacttcaaacatcgaagaccgtccttgaggtcgagggatccgatcagcgtcgagcaagatggcccgcccactcttatgcactccatattacagtacctgaagcagacaagaaccgcagccagaacgctaaacccgcgaaaaatctttctgaatgacatagattctaacaatacctgctaatcggtacaaaagttggattgattgatattgtacatgccacacgagcagtgcaatgtgagacgagcaaggaggcggaagagaacgcacttggacatgataggaggcaaaaaaagaaaagtgctgtgaaacggatgctggatatcatggttgtcttggtgggagctacgataccgacaacatgacatgaaaaagaaagggggcacgacgtgtagtcgcaggggatg

SEQ ID NO: 13 - DNA, 703 bp, Nannochloropsis_gaditana
agaatggcaagcccatgcatcgcccttgcccttgtcgcagtccatttcgaatgccagcatccgctcctcatactcgggatcgatagcttgaagcccctcgatcatgaccgtcttacttgcctcaatctatccaggcctaagcagagtgttcgttgtgagccagtactattattcacgtatgatgccgtgtcattcatgtcattcattcagtcgtactggcgactctcacgtatggatgcatgagattcgcaacttgctagtgtatacgtaccgttccacacttctctttggtcccttcttggagatccttaaaggtacagagggatgcacgtcgcgagtggggaggttggtgagtagctagtgtatacgtaccgttccacacttctctttggtcccgtcttggagatccttacaggtacagaggaatgcacgtcgcgagtggggaggttggtgagtagccattcgtcgcacatggagacgaagcactgtcatcaggatggctgtgtgaccttctaaggaaggatgtaaggaagcaggcacgtacatccctgagtcacatggatgggcaagtgcctcgcccaattttgacgttctctcttccttgtccccttgcagaggacaaccgcttccgcctggttcgttcctttttcttgcaggtcgcacaactcctcttcaatttgatatcagttcactctcgattcag

SEQ ID NO: 14 - DNA, 703 bp, Nannochloropsis_gaditana
tgacgtcccttggcctttgccgtgagcggcgaggacccgtcccaatctgattcgacctcgaacatctcacacgtgcaacccactactgcatcctccattaaagagcgccttcgagcattaaggatgccgaggtaagctggttgtccgcgtcgttgagaaaaggctaaaagaaggaggagacgtacatggtgcagctcccagacgcgcagaggaagattttctccgggaaagagcactacatgtggcaaaactaatattggcagttccacttccgtattcgatggtaataactgggatctggccaagctttccatgttcgcgacaccaaaacatgctagagtgacaaccatttcgaaaattgaggagggaggttgagtttccaaaccacaagccggaggcatggggcatagatgtggagcccctcgcaccaaaccgtgtagacactgtccatccatgaaggttcagaggcaggccgtggaattgcctacggccagagactgcgattgaccacacctctgacgtcggagcatcgtccgcgcaacgatacgcatgcaccaggctggagaggcaactggggaggtcggatcgtgaatcccgaagtgtgaggtattaaatagcaggaatatgtgtttctttcattctactccttcctctttcattctactccttcacacaggcctgattgggtgggtggagttgcatg

SEQ ID NO: 15 - DNA, 703 bp, Nannochloropsis_gaditana
ttttcgattccatgtttttgccgcgtttcctcatgagggttctcgtcttcttggcagtcaagctgggcaggaatcaccatccaaggacaattcacaaatgcattccaattacctcctttaaatctaaactatatccagaggattggggatcgggacgtgtggtttttttcccatgatcatgcattcttacggtcttcgagagtagtcgagaaagaggatggcgcatttccgactgttttgagggcaccgactgtccacagccttctctttgtcttccgttcccgtctcgctttgtctggcatagaatttgattggagtaatgtatgcttcagcacgattgcgactgaaagttatctccaaaatttgcttgctcgggtcaatttcgaagctcatcacgagacgttcctcacgtacctcctcaacactcccaagcaggcgcctgtggatcacttttgaaagatagaaccatgttggaaaaacagcaaaagtatgaagtggaagaaggttgacgtcacagtggttgcggtggcgtaaatttgtgtcggacagaagcaaagctgcagcgtggagctcgacctggctgtgggcacgtcgcctgttgggccgtaagtatataaataatatcgacttgcggtagcgattatcagcagcagccatagaggtgaagtcggcggtgttttaaaaggcgggtcgtttgagcatg

SEQ ID NO: 16 - DNA, 703 bp, Nannochloropsis_gaditana
ctgtagtttgggcagttctttctcaatattcttgaggactgcttctgacatgccacttgcttggctgatgcttttccagtctgagtgagtacttactccagatcactgctttgagatatatatattgtttcaccgtcattatttacatttaaatgttgaggttgtatcttttatgtcattctgatatcacaaaagtggcgcatgaaaaggacgtactgaagaataccaagttacgaagaaagggggaagaccatgacgtgtcacgatgccactcaaaagtccaaacaaagctgcagggggagaagaaatcggctttattggactactcgtttgtttttctccagacaatttcatgataattttcgcatcgatcccttcaagccaccggctatgcatgttttttccaaaaaattcattaaaaaagctggcgacggcgaggcaggaaaaccgaccctctcgcccgcccatcatttcccgccctccctcgccgacaaaggctctgagttgctgttttcggtcggcgggctttcgtgaaagagccgcgtcaaggcatccacgtttcatgaaggagcctacaccacacgattggcctgcgaaaagtggcaatggttgctgggctgactaggcagcctgagggacgccacgccatctttaagatcctactaattcttcgcgtatcccctctcccccaagaagagccatg

SEQ ID NO: 17 - DNA, 703 bp, Nannochloropsis_gaditana
aaacggctattactgcaatcatagctgctcccccaaaaataatgttccgcgtgggggaatttttccacgcacgtaaagccgcactccttattgtagtagtcatatgctgcaatttcggtattgtagaagacttgctagcccggcgcggggcagcgtaattgcgacgtgggggcatttctcgtgctctgtattgtttgctaaaaggtacaatggtggacgtagacggctgaccacgttttttgcttggtttttcaccttgacatcttaatcctgatccttatgcttcattcatggaaaagctaagaagggaaatgttctacgaatgctccctcgaacgtgtttttacgcaactggcccggctggaaatttctcggcggggaggttgatcaacggctcggatcggttggcggcgtgggccctcgcccaaacgtctgcccggccttcaaccttctccctggcccggacatgttgcgctccctgtctcatatcatgaggcactgccaccctgcaggtttcatcgcgtcttggaaacagccacatcacctgtctccttgtcgtctctcaaattgaacgccctcatcgtgcggcgaggctgtctaagagctccacgagagcgaagggtaaaaagttcgaggccgatcatcatcgacctgacagtcataggacagctctttctggtcatacttaacgtgctgcgaggatg

SEQ ID NO: 18 - DNA, 703 bp, Nannochloropsis_gaditana
aagccttataaaacttcttaccttcatggtggcagtgtgtaaagagctacggcctcctttaaaataagagatgagaagggaaaagcgtttgcgtgggaggtggtgggtggggagataaacgagggacagagtggcatgcccggacaaattaagcttccactccttccatggcccctcataggactacacatataggtaacattcgagtagagggatcacgatggaagtgcgacacctccaggctgcacgtgactgcgccatccaccacacccacccttcctcggcgagggcaaagggtagggaggcaacagccccgcccagccatttacataccacgcaaagcatctccatagacgcaaatgcacagatgtcatgtggtgaacacacagagtgtaaaaaaatccaagtccgcacgaggcggcatggcaaccaaacgcggggcaggcagaccgccttctttctccgtgatgtgtggcggcgaggccgtgcgagtgtgcggacacacactgtcacagcgccggccccgccccgcattgttccgccagggcactgaggcactcaaagtgtaccgaatataactgacacgtcaggattccttgcattttcaatagagtacacgagcctctgtaaacgtctccaaacaaggtaggggaggaagagaatttccgtccagaaggagaaaaggggggccatccaaaatatg

SEQ ID NO: 19 - DNA, 703 bp, Nannochloropsis_gaditana
cggaccaaatttagcgacagcatggtaccttcctccctctcctcctccttgccatctttggagccacgcgtcacagcgctgaggacacctgcaggtctgacacacgagacagctcactcaagtccatgcgcattagtcagtggtatatcttgtctttgccttctggaggtagctttggcaaagcaagccctcgccgctggtcctttgacaaataaaataacatgtcaacaacgggcacttcgtgttctggtgcagcaagaacgcttgaagattgtccaacaacaagtacaagagtatccgcttcctgaggcttcatcaacggctgagagagtaacagttacgtccgaattgctgagtgacgcctcttttttgacagacgaggaggatgtgctggcactaatgacaaggtgggatggtccgactcccagccatgaatcgcctctccaaaatgtagtgatggaacaagggcggacatcggtaatcaaggagtacagaacaaaggagcgacaagacgcagcggcgctgaagaaccttcttcagcatcaccatctatcggacagtacgctcacaggggtccagcgtcaaggtccatttgcgcccccaacctcttcgaggcaacctcatgtgatctccaatgtctcaatacagcattttcgttcacctgtttcttatggcggggcggtaacgtcatctcaccatgatg

SEQ ID NO: 20 - DNA, 703 bp, Nannochloropsis_gaditana
ctcgacccgcagccaaggcaagccctagcagtgcatgatcacaccccacatctacaattcccttcgcatgtgaaggtacaaggcggtaaacggcagacaaacgaggacccaatttttgcagaattgttgaggattgacttgcttgcttttgaaaagcaaaagcagcgattgccgtcttcaacggcatcagtaggcccgtccatcccatgtactcttccctgaagcagcaaataaagtaaaggagagattaagtccattaagctgcgtgagattcactaggggaaaaaaggaagtagcaccagggtgcgagtggagggaggaggttaccctcaggttgatgacgacatcgatcgccttgcgaggcgcaataaggtttgtacgaggaccgtgcctttcaatgctctcatcacgtgtgaaacgcacaagcagattggcggcagggccctcagagaggcgacgtaggccatggcggcacagggtcatggccttgcggtggcaatgcgcgtgctctgttggtgcctgacgttatctttcctcgtgcacgccttcacgcttcagcagcagccgaaacgacacctccatcccttgtatgcaggaggaggcggggacaaagaacgagttgccaaactcctacgtttgaaaaaaattaaggagggtggaggagactataaccgcttacttgatggaggggtctccggcagcg

SEQ ID NO: 21 - DNA, 703 bp, Nannochloropsis_gaditana
ccacacacattacgggtcctcgccatcactgacaccatgttggtaactgctagatcgtcggatgcgaaaggtacgactccaaaggagtcatacgaggcgcgatttgcggtgtggacacgggcgggataagcagtagggctccaattagtttgtgtatatacctgcatgttgatggcagaagctgtcatgcgttagtaatttgataggtccaataaattatgtattgagtggcgagtaataaacaatgaaccagtgaaagccgagtcataagcttcccggtggtgggggggaggttatgaggaggttatcgagggatcgatatggcccgtttcgcggcctgcgcgcacctagcacatgcttaaacttcgtacattgtgtcacttctatgcctgccgactgtcagctttgtattgaatcctcggtcatagcacacacccctgaaatctgtctttgttccggcggctacattttttagggccggaaccggttacgcgctccgtcgttgctcctctcccccagcccgcacgatgtacgtctaaacaacgcataagaagagcattgaatgcgtctcgaaggccaccgatatgaaaaaaagacccgctcgcgtcagaatttgtgatgaattagcttgttgaaggagcaggatttgcatgcttcttctgaatcttgatcatctctttcttttggcgttgataacaggatg

SEQ ID NO: 22 - DNA, 703 bp, Nannochloropsis_gaditana
gctatgagtacgccttcaacgcccattccgtcttcaccgtcattgccacctacgtccgcgtgacgaacgacacagccctcctcgacttgaaaatcgggaccgcggagagagggaaaggaaaaatgacggtgggccagcggctggaggaggtggcgctggattggaggcgtcgacgcgtgcccaaacccggaagcaaagggagggaatcagaggcggggcgtgctgggccgatgcctggtggcgggctcaggacgatgagtggcagcgacgcggaagctgttgaggaccgagagataatgtcatggcactggccgggggacaggaggcgcagttgcaacactagaacgagtgggagcgaggaatttgcagagtcgccgcctccaaaaggtgtaggggggttggagggagcggtgggcactgtagacgaggacggggtctccaggggggaaagagctccagaagacgacgaggacgatgatggatatttttatatcgcagactacggcccgcgcccagaaaacttcctggaatgcgtccctacctacatccatgtggtcccggcgctccaagctgccaacgtcgaaataacggcctccctcgctacgctgcggtccgcggagggcaatcgctcaggcgcggtgagattggcaaagatggcccggcggttggcgagagagactgtggagcacctctacatgcccgg

SEQ ID NO: 23 - DNA, 703 bp, Nannochloropsis_gaditana
tctgacacccccgccgttaaatttttccctctcgccccagcctcaacatcgatcttggacctcagttcttgaatcgaggtatcttcgggggggcgtggagagccatccaatgaaaggcgcgtgtcctcaattgtcacgatggtgtctcaggcatgcagaaacatgtgtgtagggttgaaatcttggtaactcggtgtccaaagacattgttctgccgaaagatatggggcagagggactgtcgccttcttgtgatgctcaggcactttctttgaccatcgtcggcgccataccccgcagatattttaagtcttgcaattcgatgtcaattatcagggtgatcccgtgccattagtggtgcgcatgattatgcacatttctattttcggagcaatgagggaggtacatgctggtgttgtcgctagacaggccagttggcacggagatcaagctttgccccgtctcttggcctactctcagaccctctgccctattttctgacaccagaaatcaagtccctaaaaaaatccacacatatcccttcacactcatacaattcatttaattttacaggtccgcattggtctagaccgaggtctgcctgtgttatcattccctcgaaacaagccctttcctagtcttcacctttcgagaagcgctctggaaagcgacacggcacaagcttttttcacgcaagtaccatg

SEQ ID NO: 24 - DNA, 703 bp, Nannochloropsis_gaditana
gagccgccttttggatgagacctcctcctccatcgcctctctgaaactgggggtcgggagccccacacgcctgtctttcggcccctcgtccctccctccaccctcggatcaatcttcttcgaagtccctggttgtacagggggggaatcgggtgctcaagacgggggcgacagcggctttgggcatgcaggtagccttgtacgccatgtccgcggtgcgaggggaaggggggagcgtgacgagggtcgagagagggagggaagaggaggagggagttgaggtgcctgcggcgggggagacggcaagtggagggaggtctgagcggagcaggagttgttgcgggaaaggggggagcgaagaagaagaagaggagacggagtggcggaaggagtggggaaaagaggtagaggagaagccacagtggagagagttggtcaggcacgtgacagcgacggcggcagagctcttgtccttgcttcctttcggagaaaaggaagcggccttgtcctttgtcctcctccacgcgggcctcaacctggctctgacctgtgtggatgctattcctcagggctgtcgaggttgcgattggggcgaccatggggtcgaggggcgggaaaggtcgtgggaggggacgtggatggggcaaaggagggaaaaagacggaggagaatgtgcggagacatgctcagattggacacctatg

SEQ ID NO: 25 - DNA, 703 bp, Nannochloropsis_gaditana
gagcaaggggagaatggaagcgcattccccgctttcacgtagtgacacaagacctttggggggggctcttcagggccatgtcgcgcaatttattggcatgtgcttcgtatgctccgacgagcggaagtccaggtgtcttttcaggtgttcagaaaccctatcccaaagccccgtgctcggtgtttgttctaggagtggaagggaataaaaagcgcggagacagaggcatggtctgcgtgttgggcgcgtgaagaagaccagcagttcccagcttactagacgtcgagcggattgaaacgagtaataaacataccaaggcttttttttgtccatttgatattcgaatatcctttttgtcacggcggacactggatcggaagaacagttgtgtgtgtcttggagcttcatgtaacagcgcttgcgagcaggtgatgattccttatctaatcctatttttttccatccttgtcgctcaaacgttgagaatcaattacatcaaggattctccttgattattcgtttcgtctgcatcgctttcgggtctcaaggggccatgatcttccgatatccaggatactttacctctgctcagctacctccccctcccctatcttgtgcccgccccacctcatcaagcaggccgatatcctggataactcagcaattctgatagtgtaaaactcggatataaaagtgaaggatg

SEQ ID NO: 26 - DNA, 703 bp, Nannochloropsis_gaditana
cagctcaagccatgcacaaagcgtcactcagagaacgggagggcgcggagagcgaacccttttaagccgacatacttacctaaacgttccccagtctcagtatcccagaccgtgggggttttgtcactggctgcggagaaaagcagatctccatcgcgattgaagagcacacgggtgatattccgctcgtgacccttcatgaccatgaccctctttcaatgccaaagtaaggggaggggggcaaatgattacataaacgccgaaaacgcacgcggggggcgaggaagacgtaccatggttgctgtccgaaagagggcacgtttcttgcaatacttcgcttgtccacgccgactgcccactctagaatgtgtgcgacgattggatctgtgtatgacaggagcaaaaatgtcagggggccgatgtactcgatggactattactacacgctaggggtggtggagcaccacacagaaggaggtcgccagccgtctacgagagcgcgagtctttttgagggaggagggagtcatcagctttgttcgatgaaacggggcgtgcttcgctcactacaggaatatacgtgctcttagtattattatgtggaggagtgtgcatcggtgataatgtattccacgaaagtgtcaaaggcagagtctaagttgcgtcatggaatggggaaggctctatcgctcctcgtagcaata

SEQ ID NO: 27 - DNA, 703 bp, Nannochloropsis_gaditana
ttcattgctctgttatctagcagtgtctagacatcccggtatcgccatgtctgcttcagctcctcgctaacaggaggaggaaggagggcgggttttcctgaaccttcctccctcttggcaagccaaacacaaagttttcgtgtgatggtttcacgaaagataggtctcggtaaatcttacgaagcgattttgcataacgtagctattggccgtactatcaagaagagggttgaaagaacgcctcgagacgggggcgcacaacgcgcggcgcgttcgctgtcgctgtgaggtactcttcattccctcgttatataagctgtacactcgacttatcctgtacaaagacacttgtttacaataattgaagtccttgaattacatagaatgtcatgaaggagaatggtgatttcaatctcctctttgggcgttctaagctcgttcgagactccgtggttcttcatgctgttctcattgcaaggcaggccttcaaaggccttctgataatgttcttctttctcgcctcacaaatttgtcaataaacttcaaacgcaggcaaaaaaaaaacaattcacggtcgccagttgtcttaagtcgcccctcccgagatagccaaggacgcaacttagcaccagcctggacgcctgctttcgaccctccggacaagaattacttcgcctgacattcccttggcataagcaccatg

SEQ ID NO: 28 - DNA, 703 bp, Nannochloropsis_gaditana
ctctctttctgtccttcttgccgttgctgccgccggtactcccacttcctcctcgcgcaccactcaagatcaattaatttcattgaacaacatctcctcgattaagtccgccgcttcttcttctttgacttcagtacctcaaaggaatcaaacgtgggctgaatcttccctttggaaagttttgctggcaaacgtcttcggagcctgtggcgcggtgattggtggtcttctagccttcacctttgcctcccgttgccaagaccagtttcccaagccggtcctggctaaaatcgtcgcctcaattgccaccacccacatcggtggctccataaactttttccaagtagcccgtagcgtgggtcttgaccgggaggggcaaggcttgctaggtgcagtggctggggcagacatattcttgatggcactgcatttcgcggcgcttttgggcattcagagaaacccgacagggacagcagcgtttataaatcgtagtgatattgaccaaacatcttggaaagtgtcagtcgcggcgtttacgccctcatcttcgatttcgtccaacgaaacaagacaatgtcgtgaggccacagaaactcgaccgttggcgctccatgcacgaaatgcgttccctcatgctactctaacacctgctgtctcggacactttattgcccgccatatttgcattactcctcgctctcatg

SEQ ID NO: 29 - DNA, 703 bp, Nannochloropsis_gaditana
tgaaaggatgcgcctttcatgcagcctggaaaacccgggcagaaaacccgggccatgcactccataaacgacattttttaatgccgtgcgaacggggaggtgggacgtgtcgtgtggaagtggaattggcctcggaacccgatggtagatgacagtaggatcatgggagagagaacaacggatcgtcgcccagagcctctccgttgcagaagctggggaggatttatccctctggccgacttttacgctttgtcacccgttatgccagtatgccctcttactgtctcgatctcactgtgccaacgtggaacttgctcgagttgcagccgattttagccgcattgtcttttttagccaagttttaggctgctgaatgtcgtcacggtcaccatcattgcgtgtatcgtccccacaaacagcgcatcaaattgtccgccgcgatggcccaatcccaccaatcttcgaataaattgacggaattggtcacagatctagccgtgaaattggagaaagcctgtgagcctgcacggctggacgcagcgttggcaggagacgtgctaggagaactggaaaccattgatatgacggtggacatcttgaaaaaaagcaaggcaggatttgctgtcaagaaatgcaaggctgtcaaggccgatggagcctttgcatccgtgtgtgaacgtgcatcgcttctgttcaagaaatg

SEQ ID NO: 30 - DNA, 703 bp, Nannochloropsis_gaditana
gaaaggatacgcaggcatgtcttgcggccatcatgggcatggctgctctgtcccgcaggcaaaaacacctgtcaagcatgcacgtacacttgtcacggtctagcggcacgcctggaaaattacctcgagtgtgttttatttcccccccttttctccccccccccgggggcttgaaaaaaaagtcacggccccggaccggccctcgcccccctcgaacggcgacacagagcaaggacatgacaagccaggtcccgcattcctgccccgcgtgcccccccggggcacgtcacgtgcatgcgggccggagggagacaagaagaaaggggaggatggtggtggttggcttgcggtggaggtggggatgatttggggggggggcaatgacgtcgtatcatgataggcattggcgtgtcttcaggcaacatgtaactgaggagcaactttacggtcactgtgtaccctgtgctgtgcctgatcttggcggtctgcgcggtcgttacgcgtctcaccaccagcaatttacacacaggcggccaagcagagagtagagactcactgcgaaggatacgtgtgcagtttcaattgagtggtcagggaatactaccagcactttcccttcaatttacctgtctcgcaggacgctccacttcaggaagtcctccccgctaaaagacacccactacacagtgtcagaagcacaatg

SEQ ID NO: 31 - DNA, 703 bp, Nannochloropsis_gaditana
tcgacatgcagatacttggcgtagtgacggctcttgtgtggcttttaatgactcgcaatggcataaaagccgtgccggagtctgcgagcaggaacgcaactacggaggcaaggaaggaggtgcatgctccagcccttgaatgcgtcctcccgcgcctccccaaaggcttcaaaccttttcccacatccgtatcagcattcatcgcagcgtcctccatggagaccctgtattgtgtcattggatgaagaacgaggggactcagaggacgtgtgtaggaacacagagggagacctcgctgagatgcgacgcgctgggggcgggaggaaggagtacgtcatacctatatccccaggggaggtcggacgctgttttgaagcacgcgtagcgaacgcatgcaatgtgcgccgtgggagaatgatgatgtcgtgctggattggcattttatatgctgtactggtctgcgtgagtctgcaacatgcgcgagcgaagttggtagtctgtaggaccttttgaaaccgcagcatgggacttcgtccctcctctgtgtgacaacacttacgacgcatttcccgcaatcccgcacatgacagaggggggaagactgccttcgtgacttcttctttacttcttgttaccccttcgctacagtctaggagctttcgcgtgagaccagtctcctcattgctacagacgctcccgaatg

SEQ ID NO: 32 - DNA, 703 bp, Nannochloropsis_gaditana
cggagaaggaggaagggaaggaggacggggggaggaaggggaggaagagacgaccgaggccttgacggtggccgcggaggaggtcgggggacaggaaggggtgtccgaccccggttcccgtcgagaggcccaccgggtggcggagctggacgcccgcctgaaggagcacatggaacggatcggatcgctggaggcccacctcttgagccggcccgagcaggcggggggctggtcggtgggggacgcggtgcggtggtcctgtgtggccgtggccttggcggaggcggcgatggaggaggtgggccggccggtgcggcgggcggaggagcggtggtggcggggggagagggagggaggcggggagggaggggtggagggagggggaggggagaaggtctggagggccgtgaagcaaggcgttggggatgcggtccatgaaatgggccggcgtttacgggagggaggacggtcccgggacaaggaggcggtggaagagggaaaggcgggtgaggaggggtcaactcccgccatggctcccgaggacagcccctccgtcccttccgatgccgcccccgcccctccttccccggtgaattgggcgaacctgggcgcacgcgcctccctgaccatcgggcacgcgctcacgctccgcaaccgggtggcgagccacttggagacccacgacctggaccggcccaagatg

SEQ ID NO: 33 - DNA, 703 bp, Nannochloropsis_gaditana
tttccatcatatgctttctaaggccaacgaccttcataacagggcaaaagcatggaggaaatggtctccgaattgacgggtcacatgatacagcatcgaatgggtactcctgcggaaatagcggctgttgttgccttcatggccagcgaggatgctagttttgtttcgggcgcctccctcttagtggacggggggtactcggctctgtaatctgccacaggagtccccggaggaagggaaaatatggactgaaaacccacgaggccagacgacaggctgtagctatatgagaaaagaacattgatattgaattgatttcatacattgttttcggaagtgtggttggtctacatttccgaatgacgccaaatgggccgcgaataacctcctcacatgttcccctctgagatggctgctctactttcagcaccgcaaggctccgatcgccttccttctcactcacaagcaccgtacaagctatagatgataatagttttctccccctcctcttattttgcacggtcttctgtgttcgacttctttgagcgcgttttgatccgtaagattgtatggcctgcgtaagcctcgcgataagggatgaccgaccatccttttcaattcatcaaagaagctaagatgcaccttgaaagcatttgagacgtagtgccttacaaaagttttcacggctcttcgtcattacaca

SEQ ID NO: 34 - DNA, 703 bp, Nannochloropsis_gaditana
gatcaagcccaaacgtctaatatggaacaagtcctccggaataagacgccgaagattattgacaagtgcaaattgagtcagaagaaatctctcaatcctgtgagtaacacaccgtacgctggtaaaagcgggaaacctgtttcaatcattcccaacggtgctgccaagtgcggttgtgatcaaaaggcttgccctccatatgttgcggtgggggcaggtcgattggtacaaacacgagtaaatggaggtaagaaatgtgcttgacgacagtcatgaggcttttgactgctactcattcatatgtattcgcatatgcgtattccatgaagctgtggcatctaatttcaccggcgccggtatgtcggtcacgaactctgtcaaggtgggcactggcttcgagctccaatcaggtaactcatccctttaccggccggttacattatgctttgattcgcataatgcgtctcctaaacggaagttggctactacctaactctaaacaggtcctttcatggcgacaactgataattttgatgtccagagtgacgatattaccatgtcgtacagcaacagatttcagctaagtgtgacgagtggaaccgcaatgagagctggtgacatatcattaagtgaagcttcagcacagatatacacagaacccggagtgctcaggctttccactggtgctgcaacttttgccatg

SEQ ID NO: 35 - DNA, 703 bp, Nannochloropsis_gaditana
caagttgtctgtgtgtggaggcagcattatacccgcatgcatgcactttacacacgtcttcgcatgcaccgccgcttctgccagcactcgaatgaccttttttcgtaacatggtcgatcgcgtcaggcctttcggtcggcttggggccttcatcgagagaggtcgaatgcttacttgatctccaagagcggtgaattggccgctccaaattcaacagcgctgcgtgtcttgactctggcatcttttcttaaatgtgaaaaaaaaaagctggatgacgagagaaaaatgggctttcgatttcatttttcatgagaaaatgacgaaaatatcacgcgagggaggatacgtacgcctgtagcccgactctccgagtcgccaaagaacaaagacacgcacagacagtgctactactagtagtgctactactagtagtacgagcaaggaggtacagggatagagcttaccagcatccttttcgaacacggccgcatagtaacacaagccttagtttcctacccttctgttgtacaggggagtgttggaggaaggagaattcaaaaaggtcttatgactgatggtaaagtgattgcttcaatgctcaaagctcatcacacaggcatcacaatcacacagcactgtgctatacagcaattgctacaacatcaagagcaaaaaagcgaacggcggaaaacattgcgcgatg

SEQ ID NO: 36 - DNA, 703 bp, Nannochloropsis_gaditana
acgcctcaacgagacgcagcgacggtcgatacaaccgacccattcattatgcctttcacagcgatggaataacgaagctttgtgaagtggaatatggcaaaattggacctgcccgctaggagcctttttgctcattatgttttcagtcctattgccgggcaatagacgagtggcgcctgaaagctgcttccaaacatcgttcaattaattctcctctgtctgccacacaatgcattcacttttgatcaaaagaaattctacaaacaaaaaatgtgcaaatgcgacgcgtggtccgttttttaaaaaatgttgtctatcccctttcaatcacagggaggaaggctgcttcgaccgatcgagactctagtatcgggaaatgccaacacatctggtttcgtcgtttttccgaaaacctgatggcgaatcaatggtggcagacattcccgactgctcgactcctgtgtcgagtcagagcatagtagaagcattcgacgacaaaagatgctgtccatcttcatcttgtcctgctgtctcgcctggggcaatcggtggcagagaagagagcgcaatcgacatagttgacgaaggaaaaggatggagcaacgacgacaaggaaggaggaaaaccaccaacggcccaaagcaatggagccaggccccggaaatgcgtcgactcaccgcagagagtcccagcggctcggggt

SEQ ID NO: 37 - DNA, 703 bp, Nannochloropsis_gaditana
tggcgacgatttaccttcggtctggggcgtcatcaaaaagagggttgtatccgctgtaactactgctggagtggcgtctggtggcgaaagtattacgagactttagttgccggacaacgctgcatgccagcgtggataagaaagaaggctgcacaagtctcatggtactcagaggcgaaatcacggaggccaacgtctcaactgttttaagtaaaaggagcaggcagagctgtgagatggaaaagcaccagcagcgtatataaaaactgctgcgagaatgactatagatcaatcgctggtgcaaagctcacaccagaaatgactatgaggcaagtcgctttataaagtcctgtgaaggctgttcggacaacacgagactagaagttggataaatcaactcggggggcgtccctctcatgttgacccaaccagcaacgatcgcgcagaaggattgaaacatttgcttccagctacctcaacaaatatgttgcatgttctgcatgaagatacctgttgactcttgctttgcatcgataatcagggcccagcgcgtaggcattcccacctgctctctgataaaatatcaacctcctggtcctcgctttcgcatcggacaaattccaacccgctccagaatgtccttgaccgcccgtgcggtctgactcacgtagctcgaattcaccctgatcaaatcacaggaatg

SEQ ID NO: 38 - DNA, 703 bp, Nannochloropsis_gaditana
cgatggggagaccgacgagttgcaagataagggaacgcgccgtccccgcaaaaaccacgtcgtgaggcgtggacaaaaaaagaaagagctcctttcccgcgcgggcgtgcccgcggttgcaaggggtgtcaaggcccgggcacggagaggggaaacctcggacaaatcgatagaccctccggctcgctctctggtgctacataagggtatctcaggatacatgctttatatgcaaacacgccaccgactggcgagtcgggtgaaccgcatgcgccgacctcgtgggggacaccaggctttctctttaaagacaagatgatatacatacggtacacgtgtcttcgtcctgcaagatgtgcgcacgctcaccggacataagcttggatggccaaatgccttcttttcgggctaaagcgggggaggcgagaccatctccagcgtctttcgcctcataatcgcgaggcggcgaccataatcaatatcgagctgcacccagggccagcctctcgctggtcgggcagggcgacatacacaaaacgtgtggtttctttgaaggcatttttttatgcaaggaaccaactgtggcatcgtcacctcattgcccgctccttctccttctttttacacgacaacacattttttcacgacgaaatcacacttccatcacacacacagcacagacaacctttagactgccaccatg

SEQ ID NO: 39 - DNA, 703 bp, Nannochloropsis_gaditana
gatggcgatcaagggataggtggctggatcggccaagaatggaggcagctttttctccttgtggggttggtgtggttttccgattgtgctagacatacctcgacacaggttgtggactttaaaaaaggtacgtcggacggacagcgaaagcatatctgggcagtaatttgtgatgcacattacatttaagagatagattttatgaataggcagaaaactagtatatgtcatctacacgatttcttttcgaaaacattcctctctttcgcgtggagatcgcgcgttcggactgaaaagctacccggatcctggaaagcccaggagggcgatgaacggctcagagcgaagaaaagaagcgaggcactaagaaggtacttgatagccgttcccttacccgtttccaccgactcctggtttccatcattagctgatcgtacgcatacgtcgaagggagtgtgggtatctggatggagggtggaggggattatgtgatcaaaatccctgcctgcagggctgccgtcctaatcctcctccaagcaccatcaatttctctctctccctactcgagcgagatgcagctgtggacttgctgcctggtaaattattgacatccatactcatatgtatactcattggctctcctacaggtcgtgccttatcgttgccagtacttggaagggtcagactcgacgaagcagatatg

SEQ ID NO: 40 - DNA, 703 bp, Nannochloropsis_gaditana
aggaggagcaagaggaaaccagcgaccctcctgcatcgctgagcttttgccgcgacgggggaatgtacttttccgggaggggaagtcccttaatcgcccggcggagcgcaggttcatgggtcttaagcatgcgtttgacctgacctccaccctgaataccctttccgaagagtaagtcaaaaagaagcagggagaggaggttgggatctcgaacttgcttccgaagggtggtctggagatctgaccggtggaggatggcagctagggtcgatttataccgaagcgtctcggtaaccagggcacttacaaagcgctgcaaggtttcggtcggttagaatggaggagaaatagttttatttgtctcttggtaaccattttttcgagggggaggttgagcagttgaattgcaagcacgcaccttgttacggatgccatctgctaaagccaaagttttaacgctccctttcttggccaaaacatctttaaggacccgtgaggcttgttggtagtggtccatgcgcctgaacgtgtaaaaatgtggcgtgagagggacgggtggacgccggggctgggggtggggaggttcgcctgttcgtcgaggctgcgggactccaaattgatggcacccgtcccattgtttgtacaggtaattccactcactcccgcctagctattgcataggtaggcttgcaaagtctccatg

SEQ ID NO: 41 - DNA, 703 bp, Nannochloropsis_gaditana
aagagctggtgccggggggaggtgcgacaggagcaggaggctgggagccgccaacacccccgcctcggattcctgcgaacaatgcacgggacttgcggcgaggcaatgtgctggaagcgccatcacgagactttttaattatgtagctatctttttggagccggggggagttgccgttgccggcgctgcgtgatgaggatggtgttgctgacacgaacgtcagaaggctagacaccaacaagaggacgaatagcgctgcccgaaattgccgagacattcttcaaactgttcaaagatatgggaatgatgttggttgggtgcttgtagtcttgtgaatgacacccatccactgggcggcttcaattgagcccccgggcgaggaaagggcgaggcccggggcctcgccgtggccggcatgcttgttatcgagctccgttgtcatttctactgagaacattagggttgtcagctcgagcgtacaactttggtaggatatagaacctttgacgccacggatggcgtacttgttttaatttgtgcatggcaaattctacagcccccttacctttacctccccaccccatacaatttgcaggcacgatcagaagaagacttcttaaatgctgctttcacctatcatcattctagtcggtcgccagccttcttgctagttgaagttgtttgatagggcagcaaagcaatg

SEQ ID NO: 42 - DNA, 703 bp, Nannochloropsis_gaditana
actttcaataggtatcaattgtcttatatgagattgactccggtgccgagtgcgcgttccgagccgttccttccccgcaccctctgaggctcgcctcctgttgccctgagatagcctcgcaagtcaccagcaccaaagacggcaacctgggatttcgcacgcaattccagcggaaggacttgtgagcattctcatagaaaggtgtaggtgccgtgtgcatttcgtcgctgcttctttgatggagacatggcaagcaatgtttttggagacccttttttagaggaggtactagatccttacctaggtgtggttcatgtccgtccatcccaccacaacgactacatgtcatcaatgacaccgcgtgtcattcttctagagtattacatctataccatgtgtctcctggtgtatgcattgaatttttagtgttgaacgggtggcattaccggttgatttacggatgtccatctagcttgtccgtcatcttagggtccaacccccatacccaccgatatttcgatctgagagcttaaacatttccttcctttgcattgtacagtgtatgcacggtgcgagatttacatttgcactcgcgacctctagcttgttcattctcctggtaatttgcctgttgcccctgcaatccatcgcctttgccgtccacacacctcaccgttctctgcagtcaccaagagcacacatg

SEQ ID NO: 43 - DNA, 703 bp, Nannochloropsis_gaditana
taaactgatgggtgctttggtctctattgtgattatcacctgtcgaggtttgaaaggaaatctaatttcaacacatgtccgtcgtattaaccccttcgtcgtccaatatgggcatggtcgcagggcctggcgctctctgtgttgctgatgttgcatttgactgctgccggggtattctgaaaactatgcccactcggacgttcaaaagtatgtgcttcattctgaagcaagtcctgcatgttttcttcttattactagcactgctttgtttttcttttcatttcatcctgtcgccgcgggtgaagacgtcttggtagaagtaattcaatctcttgtctttgtctccttatcctccggctggggcatcgctccgttgcttcaacgtctttatgtcctaggagagacgccttttgtaacaagcatgcctccccgtatcctacaatacccaataatacagagccctggccgtcaccgtacattttcgactcgatcctgcgtgcaccctgctttacaaggctctgtgtgtctctctctctttatcaacgccgctccgcccctgccctgtccacttgaagtgcaagactggctacgccagccgattgtacaggctgtactataggccaagctatcacttctggcggcatagctacacaatactttattttctaggataaggacttcccagttttgtcgtatagctatg

SEQ ID NO: 44 - DNA, 703 bp, Nannochloropsis_gaditana
tcctcttcgtcatctcgctcgtctgcttcggttgctccagcacccggtgtgtggggcttcgatcacttcgacagccgccccgtggtgctagagccccgggtcgtggagaacatcaagggtcgagactcccgagtagggcttattcgaaaggtaaaattaaattttctgcttttataaatcgttcatcaccctagatacttactatgtcgtctaacagacgcccgtgtctccttccattcactggcttcgtgtgattggacctgaagatcctgccctgcaagatctgagctactcatatgcaatatcattctaacagcatggatggctcgcgcaccttttatatccacccacaggtctatgctatcctgggcattcagctctttctcaccgccgcggtgacgtttgtatttttccaaaagcctgccctggtctccttccttttcacgaaagggagctgggtggtacttctttcagtactggcgagccttgggtcggcgattgccttgggaatgcgatacagtcgagtctttccgaccaatctgggccttttgtctctgttcacggcgggcgagtccgtactcattggtgagtacgaagaggaaacaataaaacgttattcaaacgccaccgagaatgtcctgcccattcaccactttgtgcggtctctttcaggctcactcaccttcctgccattgtcttgatg

SEQ ID NO: 45 - DNA, 703 bp, Nannochloropsis_gaditana
ctcgccctccgctgaaaagctacccactacattcgcgccaccctccactgataatgagctctgtaatgttgtctccccggtcacggtgagtacgcctcccacattcgctgaactcttggccgagaaggcgtcgtccacagttgcggttccccgtacttccagattctcatccaacaacgtgttcccagatactcccagggttcctgttatattcgtaggggctgtgatttgcagccgactagctttgatatcggtctcatctcctgacgccattgaaagggttgtagccgcctcaaaagcgatggcccctgtcgcctccgtaaacatcgttgtagctttcaagaaaaagttgccgtacaaagatgtatttcctacgactgtcaaagcacctggcgaagggctctcaccctcgggaaatgacggagagatcagccagggcttgtccactgtcaggtaaggacctgtgatgttgacatctcccggtaactcacggtaactcccacgcactcttccgtaggcagcctgaaacacctgagcgctcgacgttttggaccagggaaaccccgtgaaaaatgacaatcctcccgtttgctgctcgcatgcagaagtttgattatcggagctagtgcaatagctctggagtggcgcgaaaccttgtgacaggcccaatcctagcaccagagaggcctggttaccgtccatg

SEQ ID NO: 46 - DNA, 703 bp, Nannochloropsis_gaditana
ctgtgacggcccaagtggggcgtgggaaggcggaatccagcgaggacgtggcccaccccccccgtaggcaggctgcatcgtggagaccatggcttttgcgatacaaattgggaaagtttcatgctgagatgactcgtaaagggtggcctcgccgtgagaacattgcgagcaccaaaaatcgcaggaacatggccttcaatgtcattctactatgacttcgatggccggaggttatgaatggctgaatatgcggctggggcagacatttttcactcatcctatttttttcccttctattccctacaccttttcgatataggggtaggaaaacatggtatttcgtgtaaaattaccattgccgtcctcggcggacgatgtatttatggacgaggagggcgtgctaatagacatcacgagtccagtcccatggggaggtacgaagtctgtgaccacagaggagacttcgattaacttgcccgtgcgagaaatagaaacatgcggccttgcctactttcgatatcagttgaagagacaggcgatcgaggcaggagaggcagggagcggaggctttgatccatgtaaacgcctcagagacgaggccgaaggggaggaggaaataggggagggcggggagggcggctcggatgacacgacattccggtttcccaagaagaccctgacacctaaggatgtgaagaagatg

SEQ ID NO: 47 - DNA, 703 bp, Nannochloropsis_gaditana
ttcactttattgctttagcacggaagtgtttgaacttccctctccgcaatttcaatgatgctaaaccacgatactccaagtcgcatttccatcgcaaacaaaacttttatcacaggcctggcaccagcaaagtcctcgaatggcggtagagctaggatagaaacgttgtccgcaaacgtgatgagcgtatgaagtaaagtggtcattgaccatcttcgtctggaaatgaatgcacaaaatatgttaaaaaaagggacaaaaagactaaatgtgaatcgctgaagaacttcaacaaaaaaacgcgagatgcatctcgagaatcagacgattatccatgtgaattaatcccaatagcctcgacctggagcctaaaggtctgaatgtctctttgattgatctactgtcttgacaaggctgctgtggtgaaggtgcatcgtttcgagtaagcaagcaaggtgatagaattttgtggtgcacagtatatgagtcgaggcgggcttcccagtagatgagagacagagtcagtgcaggttaggaaggaggctaagcggtctctgattttggatcgcacttttttcttgatttttatctcttccgtgggacgtagaagcagtgtttatttctggcgtacttagctgtcatcggtatcttcttcgttaattttctcttacacacgcctcagatatagaatcctatccccatg

SEQ ID NO: 48 - DNA, 703 bp, Nannochloropsis_gaditana
ccatgtttcgaccaaatgaagcaaaagttcatgctttggcgcccttgaatcaaggtatctcatcaatcgaattattccctatcccattccatcagaatatctcacgcaggtgtatttaaacgattgtaatatcagggcatctaagttcaccacgatccatcataaagcgttcctccctcctgcatcaagacgactataaggcggttggtttcgcaccggcagcttcataaaaaagtgtcttatgccaacaacacggtcaactcataatggtcattatcgtacaatgcaaacagccacttctagctcctacagtgagcaagagggcggggacgatgatttcagcgtcaaatacacctcgctccgtgactccccctctttgtcacaaaatcatagctcgcccccgcccgccacggacaacagtatgaaagactcctgcaccgttaagggcttctccaacggcagtaaatcttccggcttatcacctgaaatgaattctccagctgcgggacccaatgtctcaaaaccacgtcgcacatatggttcgattatgcatgccattatcatctgttggctggtaatagccatgtccttcgggctcaacattcttaattttctcgtgtacttgacggttcggccctggtcccggaggacggcgcgacggctaataggaaattggttccaaagcatgtgggtgagtgtcatg

SEQ ID NO: 49 - DNA, 703 bp, Nannochloropsis_gaditana
agcagcagcggaggcagctgccagcccctggaaagcgatggcctccgacgggtggcttacgtggacgataggagcgggatggccatcctgcagacgtcagacggggacattgttcgctacgagaatgtccaaggccgggatggacgcgtgacggcccatattcaggtggcccaccgctttgcgattgggagcaaaggcacgtacacttacccttccgacagcatttctagccaagacacccagaagggcgacagccccgtccgtcgaccggggcgcggcgtcggccaacgccctctccccaagtctgtgactgggccgccgaggcctggcatttccacctcctacccccccgcgggagggcttctcgacgaggcgggggacaatctcctagagctggggtttctggggcgcggtgccggctctgtggaggtggtcaaggctttgcatttcccgaccatgaagatggtggcggtcaaaaaggtgcccatcgacaagccgagcaagctcagccaagccatccacgaactcgaacagcttttgagcaaccaggtcatgatccgagagcgcattgcagacgactcaacacgagtgcacccgtgtcgtttttccctgacgaccacggcgggagggggggggggaagggagtactgcccttttattgtcagcctctacgatgcctacaagcaccattcccagatccgcc

SEQ ID NO: 50 - DNA, 703 bp, Nannochloropsis_gaditana
actgggccgccgaggcctggcatttccacctcctacccccccgcgggagggcttctcgacgaggcgggggacaatctcctagagctggggtttctggggcgcggtgccggctctgtggaggtggtcaaggctttgcatttcccgaccatgaagatggtggcggtcaaaaaggtgcccatcgacaagccgagcaagctcagccaagccatccacgaactcgaacagcttttgagcaaccaggtcatgatccgagagcgcattgcagacgactcaacacgagtgcacccgtgtcgtttttccctgacgaccacggcgggagggggggggggaagggagtactgcccttttattgtcagcctctacgatgcctacaagcaccattcccagatccgcctggtcatggaatacatgaacggcgggtcgcttcaagatttagtcgacaagggaggttctcgggacgaagctctcttggccaagatcgcctacaacgtgttgcgaggccttagttacctgcacagccagggcaaaatccatcgggatgtcaagcctggcaatctcttgatcaactccaaaaatttcgtaaaactggctgattttgggttggccgcaagcctggataaggtcaaatcgcagacggttggaaccaatcggtacgttccgcccgaaatgttggattccaagatggaggacgaggagatcgagg

SEQ ID NO: 51 - DNA, 703 bp, Nannochloropsis_gaditana
atctgtgtgttgggaaaacaaggaaggagctgtgggtccatgaacgagggctgaatgtactgttaaactctaagaatggatgtattcgtcgatcaggatgtctcggtattgaataggagttcgtaaaaggctagttgggttgaaaagcgccaaggtgacggagagagggggccgttgccaaggggagggtcgattggttgagggttaaatatgaatgaattccgacgacaagtgctttccacgaggtcgtatggcatacagttatgacaagggtttcatttccatactctactgtgctcttccgtgccggtgttttgcaccaaaagtcccccgacctgaaggacgtggggcttcatgtatccacagcgtcgcgctggcatccggcgagacggtatggaggggggtcgtggtaaataatggaccctcaccgcccgcttgcatgccaccgttccgtgtcaggaacaatgtcatgcgcgtactatgcctctctccgttagtctacgtgggcgcgcatgccatgccagcgttccggaggtcgttgtgctgaatttccctcctagctaggaggtgctatcagtggtctcctgctcggcgcccgactactgtcccgtgttgattcagtcctccctttttctctcccaaggattgtgttctcggctaaacgatacaaggcttgttacgctcgtaatcggcagtattcatg

SEQ ID NO: 52 - DNA, 703 bp, Nannochloropsis_gaditana
ggggggtatcgtggtgtggatactattgtattgccctgtcggacacttggagcctgaaatcaacattcgcggattagaatcgcaacatgaatgcaccagcttccttgcctaacctatgcttcaactttcgcatgcacagacaagaaattatgactgtacaggggctgcacttcgagcaaacattgctgatcttaggccttcgaccaaaacagtgccttctccctgaaattttgcactccacaggggcataatatgggaatgttgataaaaatgccagacaatattcgtaggaatcgcatgcatggtgttattgggccagcaatctacttccctattagggttaatctggagcgatctccactcgggttggcgagcggctgcggtcttccgagtcaattgtcacagcgatactgagaccaaacccaaaacgctttccacgacccgtttgctcattgaaacctccatacaatactctgttcatactgctatgtcttttaaatgtcgacccaccctgaccctctttttcgcattccacatcgctatcacggtggatcagtggctgcaagagggaaaaggctcggatagggaggaacgcacacgccgatcatcagggtgtgagtcaaagcgtcttcctcgcaaaattaacatccttgctcttggccagcactcctgattgcatctcacctgcgacctttaaaccatg

SEQ ID NO: 53 - DNA, 703 bp, Nannochloropsis_gaditana
atcgaagcagacacggtcgttcgcatggttccgtttccccaaaaaaatgctgatagtacgaaaaatgttgcaaggtgagcagtcgcccgggtctatcatgtggtgcgctgtgccagacgcttgacaggaaatgtgaacacgtcatgggccaggcaagatcgggtcgacgggcacgcactccgagcgagagtgccacatggagagcaaaacaagcaccaccataccacaaattaacaaatatcacacatcaggcatgctcctattagaatacccttcagatatatagggcaccagcgaccatacatgccgggaatgtgaggaaaaaggaaagtggtgtgccgcgtccctgccctccttttttcctgctcggcttggaaggaaatattcgattggcgacatcgcgtaaaattcactccttaaaggacaccattactggaagtcttttcgatcacgatgaagtcacaggcgtgcgtcacgtgcctgggggtacgaacttgttttttttcccgttggtcgcatggttgttcgatgtaaaaaggggacaaactttcttttgagtcgtggtactggcaataaggtactggtaataaggatgacaccatcgcatatgtacagcccgacatatgaagtcacggagaccctccgtggggtcaaaactcatcacctgacaaaccacacaacacattccatcacacacatcata

SEQ ID NO: 54 - DNA, 703 bp, Nannochloropsis_gaditana
ggcaggaacaggaatcgcgttgaccaaggacaaacatgcggtttttcagaaacaacttgtgcgagacacagaaaatttcattgtttggacaacaaagcgatgtgccggcaatttgtgcgcatacgcgtgcatgtttatcgggatacggtgggaaagagtgataacacatcgttaactcaggcggggggtaagggcaacctcaaagctctgaaaagggtgatacaaaaggaggcaagcaaccaatctattgacagcctagtcaagatggttgatctgatgacttgtttgaaatttgggaagagacatttccaaaccggtactccagtgctggcctatcactcgtggcatttttaacgttgagagcgcgacgggggggatgatggtggcgagagggaaggagagctcgtacggccatcgatatggaccaatgaacggggaatttggttcgtcaacgaactatgtcacatggatggctacgatatgcatacgggactgcttgaagacgcagatttatgggtctcttgctttttttaaagtcacaatgttttacatctccatcctccacctcctctctcaacagagccctcgacacctctcctctcccacaattttgtttcatttcttaagagctgcgacaagatacgcgacattcaagaacataacatcttcttaaaactcctgcacaagcgctttatctgtcatg

SEQ ID NO: 55 - DNA, 703 bp, Nannochloropsis_gaditana
attccatggccttcgtacatgcttgagcacgctgatgggtagggggacccttggtggcgtgtgtgccatgtggaaaaaggctttcaagcgttgtccctaccgttgctcagagaagatcagtcactctccgtatctttctggctgtgcgtcgccccgcccgctcgatgctttgatcaggcacatgcttttcttttcttttgtaagtgaacctaaagcagcggtgtgtatgacgataagcgcatggatagatagctgtgtgtggtggcggacatgccttttttcctgtgagaacgaaccatatgtacagtgttctcccgttccggcccagggccactcgctctatcttttgggtacgacaacacgcaagcaacgtacacaagtaaaaatgaaccatgatcaggccccaacctgttgaatcatgcagcatcagcatagtcaatgggatactctgttgtagctttggtcttctcagtactgaaatcgtcgagatcttcgattggccgctgcgagccgaacggaggatcgtcttgacgctgaccactgggcaccatgttgccagaaataaaaatgtgcccacgcttttacaacatcttgattgaagcattggtgtacgatgtgttatgatgcacgcatttctcacgttttccctggtttcatcgttcctgcacatggttacagtcacactcccataatccttcagatg

SEQ ID NO: 56 - DNA, 703 bp, Nannochloropsis_gaditana
cttgggtctaagagagtagaccaagcgtattcccttgagccggtggacattgattgatcaaataactcacgcacagtatgttgtaaagactatgtaatcaataattaaaaactactgtacaagccaactgaatcgctttgcaagcagcagcaaacccgaataaaagaattaatgaacgtggtcagccaattatttattcttgcctcagaagtgtcgatacattcgtgtaggaaaagtgccgtgctccaaagtagaagggttaatgcaaacgtcaaccttgcctacgattctcgttacgtcagggtaaaggttgccaatattagaaatcacgtgctgacaacaaagcctatcgaaatctagctaaggccattgtatacatgatactttagagatttcgtcgttcaagacaggttaaaaattaaaataatgtagttcacaaagttatcacccggtgggggtggggaggttgacatcgtctgaagaacattgtcgtgagcgactccaggattttttaggacttacatactcccactcaccgttgacaggaggagcaaagattgccttttaaatacttgataacggtgccactttaagaaaacattaagagttgatgatttgtatactgaatgaccctggtcaatcgagaaagtgatctcctcactgcgcactctacacagccagtcacacagcagaagcagccatg

SEQ ID NO: 57 - DNA, 703 bp, Nannochloropsis_gaditana
gacgcggacatgcaggagctaggagggggcggggctgggaggacggaggaatgttgctgggcatgctttatccaagccaccgggagcggaaaggaatgagagcgggacacgggcgcagaggatggcaagactgtcgacgcaacagtagctatcgcagctaagatcagcggcaaggacatcagagacgccttcctgcgacatcgcatggtcgccacggtagaggggctcccacccctcgtgttcgttaaagacacttcaactgcctacgtttgtggaaagtgtggggtgggtatgaggacgatacgctaggtcatggtctgggacacgcagtccactcgtgattgagtacatatacacaatcaggacacaaaaaagtcttgacaaggtcctgaaagtcttcatttttggagattgatatcttgcctcctcctcagcgaggaaagcggcaacctcctctattctatgtagctcctcgagcaaaatgctcgaagcaagagattgaaaaagacgtcacacagtccgttgatagaatagaaatgtcaaaccagggaattgcaaagaaaagcaattgagcgacgcgtggatgtagccctgaacactttcgctttcgctctgatatgcctgtcgttgttacatacttatcatataataattatgtatccacttaaacaatttgtgcatctcaacgaaggcaggacaaatg

SEQ ID NO: 58 - DNA, 703 bp, Nannochloropsis_gaditana
gcacacgctccaatggtccgcgaggtccggtcacatttttcccacacctgtcggcggctagcgtcgggggcgggggcgttgcagggggctgggtctctaggggcggagggcagacttcagcgggcgcaggacgccgcggcgccgattccggactctgagcaaagcgctgcggggtgcgaggagggacgagggggggggggggagaagacgggcccctgctcataatgcccaccatgcagaaatctcggctggacactgtccgcttcggaccggaggtagaggaggagaaggaccggtgcctggagcgcttcgtggccttcgcgcggcccctctgccagggcctgcgaggccaaggcttctgggccgacttcatcgatccctgctcgggcctgcccatgctaaccccgcactgcacgcgcccctacagcgaagtcgccggcttcgagcacctgctgcgctacaagacacaaaacgcaggctgctgcaagatcctcctccacccccgctggggttcgtcgtgctacccggccaccattttcacgaccgcgccggtgaagacggtgcgggcggcgattcaaatgctggagcgcgaagtagagaggatgggggagagtaggaaagtgtgtgagcttggacacgcggttcatgagggccccctggctgtggcgtgagtccgggcgaggtacagattttgctagcgctg

SEQ ID NO: 59 - DNA, 703 bp, Nannochloropsis_gaditana
tgttgatcggcttcacggtaaccaccgcgcttggaaactttctccgcaaccatggtggatgcctgatggaggaggaaggggaggagatgagatggagaaaacagagcaatgggtatcaacgcactccggcgtggggggttaggctgtcgtgcacctcttttagacttctataccactccaatcatgccgctggaatttcctcgaaagtataattctggattactgaacaagacgggcatgacggtaccgctcgtctcgtcgaaagcggtagcgccccacaaggagagcatcttcatcgccattcgtgtgtcaacgaaagatagagtcacacagaattcgaaagaaacatattacagagcatgctaagggagaatgacgcgtccatgaggccacagaggcacggggcagggcgggaggaaagaagggtggctgggtggctggctggcaggctcggagggccgcaggatgaggtctcccgcccccgccgacatggcccccccgtgcccctgccaacactgcggcctttctggcactagggacaggcggggtgacccggcctgccgcatgtctcttatgtcttcgagcatgtctgaaggactctgtgaatattctttcaggggtcgtcacaacggtgcacacaagatttcaccattaacctcccccctctcgggtgttcccacagttcgtcgtacagattaccatg

SEQ ID NO: 60 - DNA, 703 bp, Nannochloropsis_gaditana
tgtcgtcaagtacggccttgttgcgtgcctccgcatcactgttattcccgtcctcgtcagaggtgtcatacatattcagcaaaccctccatcgctatttcgatcacttctcatgcgctgtaaagaatatcctggacagggataggcacccagccaagtttggctccttgcgtggcaagcaccagcttaattaaatagtgtacttcgaggtagatgcgaactgctggtattgccttgtcatattattgttggaaaggagaacaaatgtgattggaaaggggtacgtcatcatcttgcccaactgcacagtcgggaaaggagagtcattcgcgcgttgtggtcaaatcagcggctcacatgccatgcagtgaatttccgtatgagttttgtggctgtctattttgcaagatgtcctgcgtccttttgggttgcagtgcctccggtgctaggcgcggccagcgacactcaagctgtctctgcgaatcgctttccctcgctttttctcccctctggcgactcgaaactcggccatagaaagccagcgagatcaacgcaaaaatcgcgtctcaagggcaagcacaccccctatggcggcacagcgatccagtctgtcatacttttctgctcatatatcctctcgaaaatcattctgtatcaaaaaaggcaaaggaagtgcgtgcgaagagccaggaggcagcaccatg

SEQ ID NO: 61 - DNA, 703 bp, Nannochloropsis_gaditana
atggcgaaaaagaggtttaagatgacctcttttgtgaattagggttctctcttaccgaagtgttcctgtcgtgcttgtgctgcataaaaatgagaaagtttgagaacagatcccaccaaattcagttgaattcgtgtacatagtcacggaggcctgcacgattttcatcagccgctcacatgtaaatgtctcctgtttagccctctcgatcttcttcaattgtccatgtacggtttgaaaaagatatagcatgagtcttaactcgcaggtcccatttaaatgtattaatttgggactcgatcagcgttacgctaatgggccggcaacatgtcatggtctttcgactgccccatctctatgtcacctccagagggggccgttgattgcaaaaaaaaaagagctcaatttgagacaggtgtaagctttgcaatcgactcccacttggcagcgacctaataagggcggggagagtggtgatgtctaaattcacgttttgcaggcatgcccatttcggtgcccctcgatgacgctacccccgccgcggcggccccctccacttgcgctcaactcccttcaggtcacagagtttcacaaaaaggggctcacaacgacagaaacacgatggatctcgctgtgggccaacagcctagcaacagtttggcgtacacgaatcggtgagtcccttaataattctgcagacatg

SEQ ID NO: 62 - DNA, 703 bp, Nannochloropsis_gaditana
ctcccaccacgctttagcacaggttttgaatctcacagggttcgcccaggccatcccaacttcacgcgtgcgtctcctccaggtggcacacgttcaacgcttcgctttccgccaagaaagagtgtgtgacaacttataaatttgtcatactgcccgccaagctatctagtgcacttgcctgtccctttgcgtggcgaccaggtaaggataaagggaggtgagggaagacgagaaggtcacgggaggggactcgagttggaaaggaaggcaaggatctcagcgtgcatgacgaggttgtggggccgccgccaatgactcccgtttaacgcttaaatcttacccgacaagcgggatgcggcaccggtgagggctgaaactcatgcaattggcgctgaggcggcaggccggttatgtgccctcctttctcatcatggacctcatgaagccgtccccgccatcactcgccctcctaccaggtgctcaatcctctcttacgtgctgtccttggcgtcctcgcttcccttttgttttccttgcgctgccctgcgtcgtgcctgtgccgaagctcttgcaccgcgtccacagacgtcacggatttcgatttgcccgctcccgcgcgcactctcggcagtcgttgttgttgtcttgaagacgacacacaccggcttcccttctctcaccccgttttttaaccccgtccatg

SEQ ID NO: 63 - DNA, 703 bp, Nannochloropsis_gaditana
gtcggcagggccgaagtcgaagtcttccgagctcatctgcctgtagtcaatgtcatgtactccaggtattgagacggtaccgcttgagtcatgcacatgtcggggtacacgccttaaaaagccctgcctccaatggccccgatcatgtaactgtccccacgactactgggaaaaagtgctaggaaaaaaatcgctgtgctacgactaattttttatgagtttccggaggttacctggtgagcagccgggtaaaggaggggacaagtgttctacggtgatatgaaggtaaggaagaagcccaacccgaaagcagccaagacacgcgagcgaaggctgagatcttgagcatgcacttcgcaccccagtccaagccaagccctgtgtgtccgtgtgggcagagatcgcctgagtgtaacagtgaccactttttgaggggctgtgggcgatagcgagacggagtagcagcggatcccgatgctcgtcgcagcaggtgggtgttcaaaagacaatccaatactcatcaaccccttctccccccccccgtatcacctaatcaatgttaggcattgggaggcttatgccgggatcaggcctacttatgtgatgccagtgtccgattgaaaggcttccgggagacaggcaattgactggctcgttcgcttgctttcagtgcctgctcccaactccgaccttgtgcgtcatg

SEQ ID NO: 64 - DNA, 703 bp, Nannochloropsis_gaditana
accacaacatgatccgaccccaccgctatacgccggcacagctggtcgtgcgtctcaaggttgcctttgacgaaaccgccgccgtgcgcgtacagaagaaccgggagcgtcgcgtcaattttgggagaatacacccggaccttcactgaagcgttgccatccaacgaggggatactgaggtcctccacgcgtcggacgcttaggtatggcccccccaatgcccgtgcggccgcctccatcttggcccgacccacgtcgagaggcatgtctcttgcagggggcgcgttcggagggaagatctgggccaaaaaagcttgcgatgccggggtcaagctcatcggagatggcattatcagggcctgataagattttgggatgtgtgtggaggaggactatcgtgccattgatcgtagggttcggtgtggagtggagcatcatgataccgaggtgaggatgcgcaggaagatatagaatgcttttccctcggtaagtctgatggccctcgtttattaacgcctgggtagaggcaatgaatttaatttttgcgcagaattcgcagttggatggtcgacgtgcgatcttatccttaagtccgaggcgagaacatcatgttgcactcagacgttgctctcgctgaggctggcgaggaagttgcacgcaccgggacgcaaccggcatcacctcacttattttccccatgaac

SEQ ID NO: 65 - DNA, 703 bp, Nannochloropsis_gaditana
tttatggtactttctcgtagggtctggagtgcgtggcgagcatgagaatttgtgagcgtgatgcgggtcatggcaagtgctagacacgatatgggcatgggcacctcattggcagcattcaaaaaaagcgaaaagcaatgacgaactcagtgcagccaatgcaatatcttccacaagccccgaaatgcaacattgaacccgcaggactgtcgacgaggaaatcaagagcggaggaagggcctttcgttcaaaagcccccgaatggcatgttctggcgtcgcgatcgccgtcgcgtcgctcgaccctcccagcgacgacgagcagacgatgtccacaaagacctgcactcacaaggcgggggcaggttgggctggcggcttgagtgagggcgtgtaaacaacagtgcctttgtatctcctcaatgactgttttcacgccatgattgcggcggtgtgtttttcatagggtatatttctttttttttggcgggaaggacgaatacagaataagctgaagccaccgcccgggagcagtcagcatgtggaaggaaaatggaatatacttacccacatcaccgttggtatgaactcgcacgtatttttagttgaagtcccaataccaagactttatgagcagctttggacaaggtggagagggaggaggagagggaggcgaggcaaataagcgtcggcgtgtgctgatg

SEQ ID NO: 66 - DNA, 703 bp, Nannochloropsis_gaditana
ccgacctgatcgacagggcaaggcctggggaggacattgaggtcaccggcacctacaagtaccgggctgaggggctgagcgggaagcagaaggggggcttccccgtcttcagcacctgcatcgaggccaactacatccacaagcgggaggacctcttcagcatgttccacatcaccgacgacgacaaggcggacatccatcgcatcgccgccgcccccaacacggcggagctgctgaccaggtgcgttagcgtgggagttctcatccaggccgcgggggcttgcatagctgcccttgtagacaggggtcctcgtccatgagactcgcaagtgtatgttccatgcattcaaatgatctcctcctccttttcgcacaccaccgcctggcagcgcctttgccccttccatccacgggcacgacaagatcaagcttaccctgctccttgccctcttttcgggcgtggagaagaatgtctacaacaagcacaggatccgcggggatatcaatgtcctactgctaggagaccctggtaccgccaagtcgcaattcctgaaatatttggagaaagtcgcacctcgagctgtctacaccacaggcaagggggctagcgcggtgggtctaacggcaggcgtgcatcgagaccccatgacgaaagagtggaccttggagggggggggcgctcgtcctggcggaccgcggcatg

SEQ ID NO: 67 - DNA, 703 bp, Nannochloropsis_gaditana
aatcatacaaaagcacctacaattgactcatggttgcattcgaaccaaagacttatttttttatgtaacttgcacatttgcacaatgacaagaattaatttaaatcactcgggaaggcagaatactttttgggagtgtttcgattttgaatgacgacgatggtgtgcttcgcatgcctagggtgaggtcatgcacgttaaagactctgaaacaagtcggatattttccgtatcagtatgcttatcacaaattcattcataatgcttactaagactcatgcccgaattgtttgagcctcaaggagtcacctgtgtagctacagaacgcatgcctcggtgtcgaaatgaaggccacgaccagcaaacattgaggtattatgttggtgtcccagaattttgcgcaatgatgatgctcttcagcaagagaagtgacaggctatattcaaaatgacttctcacttgtccaattttggcaaggccatggttgcacccgaccgtcggggtggtcgcacttgatgcactgcggtggttcgcataatttgaaattttcggcgagcagctgcgtctcctcaacggttcgcaacggtctcgaggctacgttccactcacctgatatctaatcactttgtatagtcttacaatagatatggcccgacgtcggcatggactcgagcacccgcttggtacattacaaatgctggcat

SEQ ID NO: 68 - DNA, 703 bp, Nannochloropsis_gaditana
gtacgctggataggacatcatcttctgtaggaaatgagaaacgctgaggggaaaaaaaactccgctctttcctccatcggccggaacggaacgtatccacgttgtggacccagagagaatcccaacatggcacgtcaaaagatcacatttttctatcacgacaacccctcgacattcttaaatcggaaattgccagcttttgcctggaccgtggaggtattcttccgtatgggccgtgcgtcatcatcgccgcgggcgaggccctccgccgctttttcctcaacgcagcgcggctcaagttcctctgatgaaactctaacctgcgaaccatatgcgtccgcaacagcacaaaatttccaacgccagtgcaggtgcattttcggaaagtcgatgcaagtgcgctaaaaccccaagtgtgccgctcctagcttgctggctacagtcgtcgcccacggcaacgtgccatatcctttcgccaagcatagaaaagagggccccaagcacacggctaccgcagcataagcattaggttacgattggaaaactaaatataagcggctgagacttcggaaaagggttggctcgtggatttctaggacgcaacagagggacaagtggaaaatcgaagaggaccgtatgaaacatcgagtaaaagactgccacacaaacgtgctgcagttgctggagaatcgtcgtcggcatg

SEQ ID NO: 69 - DNA, 703 bp, Nannochloropsis_gaditana
cggggccaggaattgcttgggcagagggtcatagaaagcggctcccagtttgaggtgtatcaagcaaatagcgatcgaaccttgatgagcatgctttcctcacgacgccgcgccgcggtaccaacctttgtaatgctcggtcaacgatggcttgctgtgtccccgtcaccatacttgcgggcgttgtcgacaaaaccgcccctttcctcgcgccctcccaacctgtacaaggctcctcctccaggccctaaagctccacgaggccaacccccctcctcccgccggccccgagccgcccgctcagaaagcatccggcggattcggcttgggcgcagctctaggcatgattgtgctcgctggcgggactgccgcaacggggtattactatgtgcttgcggaccaaaatgagaaatctcaaatggagggttacctcgcgaaagtcaagtcaaccgtaggcctcgcccccccctttgagatcgagacaccaccgactggagatgccacgagcaatcgagaaaatgaagtgaagaacgcaaaaggcgatgttgaagcagctactgccggggctgcggcaagtgtgaagacagagcttcagaaagctacgacacgggcatcacaggcggtgcatgccgtcgaggaaaaggtcgccaccgcactgcgggggggcaaagaggctcctacgtccggtagagaaaatagtatg

SEQ ID NO: 70 - DNA, 703 bp, Nannochloropsis_gaditana
agatacttgttgacaagacctaccgctgcgttgctccataacaacgtctccctttgtaccaaccacagatctctgtggtcgttgcgcgtctcgattgtagcgcctgctatgtatgccattcgtgtgcgttatatgacaaaaatttacgtacaaacttcacgacagtgccaagtcatcgttgtagtcaatcgatcgctcgcgtctcgcgccagaagtatggacatgcatcctcctcaaatagagaaaacagaccttgtgcatcttatgcacgcggctcctcatttattctgtcacctgcttcctactccaacgaacgtgaccgcgcgcttattgtggtcttggctttctggcggataagtgctcgatccgttctttcaggggcttcgggtcttggcgcgtctccatcgaccgtccgtactcggtcgatgctggggtaccccacagttttcagtgtctgtgcatcaagcaggaaggaaacgacgtgcgtggtgacaataatgttgcaaatcattgatccatgcgtttaattggcatgattggattcgacagagcgaaaaagagaggatagggcggggcagccatgcatcacttcccaacccaatgccctggccgtgaacatcggtagagccacatgacccgccgaacatgcgcttatactttactgtcacactttcacttttttacatagacagcgtcaatcatg

SEQ ID NO: 71 - DNA, 703 bp, Nannochloropsis_gaditana
gtaagaccgtgcatcaggctggcaacctacacctgggctgcgatggtgagtgaggatcatactttagcagggaggtagaatatagaagggaaagggcaaaagcgtgtccggatcaaattgccacctcacgtcccgcacacatctgctcctggcaattctgtccatgtttctcaggtatccagtaacgtgtcaccggggcttccgtctacttgcgacaatcctgaaatggcattaataaccggcccatccccctaacccccgagcttcggcgaggacccgtcataccaaatgccacgcccatggccccattgtgcagccccgtcttcattcacgctgaaaaaggtcgtcccagggatttgactaaccccaaacccttccttcctttctgttttgggcgtaacgggcttcatgtctgggagttgttgtttacaatcgttatgtgttgattcgaaagggttacatgcggccccctcatgtggaacatggtcctatgagcaggaactcgcctttacccgacgacatgctcttgattttgaaactctctcacagaaagataaacgtctatacttccatcctggttatcgttggccttgggcctctgaagtagccatccgggcggcccacgcgtgcaaaacagcgtcagaacgaggcgggaacctggcacgtagatcgtacgctgtgtacgtaaatcgcgacgaccatg

SEQ ID NO: 72 - DNA, 703 bp, Nannochloropsis_gaditana
aatttcgctgacaaaacgtacctgtcgacgcaccggctgtgaccagggccaaatcagtcaggacgtcgcgtttcccgcccggcatgtttgcaaaaggtggtcgtcctccagcctggccgtggtatgggttcgtgcatgtattggttgagggcatggtaacatgaaagacaaagcggactccgagtctgacgctctcgctaaatttcaaaaaagcacgacattctacgcggaaaggaagttacttgaatctccggactgtgccgttcaaaccactcattgccacctattacacttttcacacagtctggaccgtcttggaagacgcaagcgggatggctaggcacgcgaagctatcagacgatggaggagcaggtgaccatcacttcgggggggttccctcatcaccagtgcacaatgagaggcacgcatacagaacatcatccagaaggcatggatatttcaggcatgcgatgacatttttggggggattcttgttgggcatatatggagcgtttatcttccgcagtgatttgctcacggggtaagtccctcttagaaggaggaatgcaagacccgggaatcgacagcactcttcgatgttttgaaattatgccgcgtccgcgtttgatttcgcttgtttgacttaaaacgtatcatcgcatatttcagccccgcatcgcaaccacggccgtcgcgagaaatg

SEQ ID NO: 73 - DNA, 703 bp, Nannochloropsis_gaditana
ctggaccgtcttggaagacgcaagcgggatggctaggcacgcgaagctatcagacgatggaggagcaggtgaccatcacttcgggggggttccctcatcaccagtgcacaatgagaggcacgcatacagaacatcatccagaaggcatggatatttcaggcatgcgatgacatttttggggggattcttgttgggcatatatggagcgtttatcttccgcagtgatttgctcacggggtaagtccctcttagaaggaggaatgcaagacccgggaatcgacagcactcttcgatgttttgaaattatgccgcgtccgcgtttgatttcgcttgtttgacttaaaacgtatcatcgcatatttcagccccgcatcgcaaccacggccgtcgcgagaaatgatattagatttggaagagaaaccccacacgatcgccccccccccccttcccacgtgcccgccatgcgccaagtaagtaacgtacacaagcagcacgttgggtatgaatatgaagcgtgaacctaatgtatagcgacttaacaaactgaagggtcgattttttcccgcatttcatggatgctcgtcacaggtgcgagaaatgtcagcagtgtccgaaatgcccccccccccccaagccttgtgacaagaccgtgactgacgcaagcaccgacacgggtgcccccccatccggtgcgacggagatg

SEQ ID NO: 74 - DNA, 703 bp, Nannochloropsis_gaditana
aagtgcacggtaaggtgagtactatgacttatttcgaagcgaagaggcttgcgtaatacgacagatcctacagattgcgtggcagctggcgcacatccacgtcaaagggggcataaggtcgagacctgcatatccaaaaacacaaacttagtgttccattactgagttctctgttcaagcacaggccagaagatggaaaatctacaaatcatgtactgatatggatgcagctacaaatttgggagttgcctaggtggcgagcaggagctggcaggtgcactatggatcttggccgcctgttttttttaccctcgacaccgcgacaaagcatagcgcccaccaccagtccaagtctctctcattccatcgcaatagctttctgctatacgctgcgaaacacgcggcccaacacttcatgccaggagtggtgctggcctggaggtggaacaaaggtgcgtggtgtgggcgagagctagcatcgtcatcaggcagccgttacggccctccggatccttcggacgctttataccgccatgtgcggtgggaaagacgtaaattgtattatatatcgttggaacatattaataactatgcatttaattagatttttggatatgtgaattcctcttgaatcgatgtatggactgcatccgtacagttaggtttcggcctatccgcaaagttttggcgcgagtgatgtgtt

SEQ ID NO: 75 - DNA, 703 bp, Nannochloropsis_gaditana
agaaggaaacgttattgagtgctggagcacgggaacgatttacaccaggctcaaaataatctgcccgtgtcaatctgtctcggttctcttctttcatgctattctgtaaagttttcaggtgcggcgaggtcacaagccagtgcggacgtgcggacagatcggtggacggatcggcacgaccaggaaaaggtccttttccaccatcatcatcgtcatcttacctcccacagggtatgttttccatcattcccggccactcgctgtccctctcccaacaccatccatccaccccccgccctgcgtcttccgccgccgcgactttccgcatttctttccctttgatgtcttttcttgcgttgttggagacaatggtgcaaaccatacaatgtacgccaacgaggggaaatttttcttatgggtctcggagaggtggtctttggtacttattgtgaggaggggatgctcagtacttcttacgtctcgcccaacacttctcccggggtcatgtctggagttttctgtttcaattaaaatatagaaacgcatctttgcacgccacgatatacatatggtagaaatatgtgcgctggtgtgtttaaccctttactttaatgctctttctgacaaacctttcctatacctcccatcactgccttctcaactatcaacaggaagttttttcctccaggcaatccaaagtatg

SEQ ID NO: 76 - DNA, 703 bp, Nannochloropsis_gaditana
tatgtccttcaagcagcgtgcgaattgtacgcatggaaactgcccctgtctgtgtctgctcgtgaagggcgcctaactcggcatcgcggcgcgcgccatccctagcaagttgctcctggagtttcgtgatttcagtcccttgctgatgcaatgcttgaagcaagcatcgaaatgttaaccgcacacttttttgcaagcctgcgtagggtcctgttccaatatatagatcctctaggcttatatcacggatagaagaaatgctatcagccgccatcccttgatgtcgccttactgcactgctaaaagcacacgtgaaaaacaatgaattgcgacaaagaggaagcttccagaagacgattgaggggtctgtgttaataattatggtgtgtatttgtcacagagagctttctatcttgccctttagaggctttgtagatggagttacgttcctgaaagtggcggggcttctctggcgaaagtcttacaggagggcggcgagacacaggcgttcattcgagaccacgaggccacagtttgagaaaaaaggacacaagcgctacacttattgaatccagttatccatcgcaggggcaagacggcatttctctggctaaatagggcaaggtccgtggaaattgtgaccacaaaggacgacgaaatcttgtcccaccacggctagtgctccatcctgtgcgacaacatg

SEQ ID NO: 77 - DNA, 703 bp, Nannochloropsis_gaditana
gaaaacgaagtagaggaagatgccttgtaaatgaaagatagacgaaagttgaagaggttgtgtaagcaatgccatcgcggccaagagctgttttttaactttttgctttctcagactatatgtccccccttttgaatattttagcgggcggctcgagcccgctaaaagggtgagaaagatactggtggctcgatgtctcatacccacccaccacgcactaccctgtcgactgctcaggccaccacacccggtcatttttcagacgtttgtggccggtatgcatgtggtgagtgtggataacgaagggtgtggcacgcatctggggcgtcggccggcggagctggcggggctgtggattgatctcagcgctcatgcccgttgcctgttttgggtggcgggcgcgaggcagacccatacgtacaccaacccgtttttctcttggcactgccggtctcctagccagctttaatgaccatggctccacaccctggcgtcgcgtatatataactgcgctcccatgtatgaattaatggcggagtatgggacttacggtggccacgttggtgacatgcgctcgtgacggggagaggaattgctctctggagaagggatgagagccccccttcctcctttttaatctggaggattggttgtattagctactgcatacattcacacatcggaccacatcttacgtctcaca

SEQ ID NO: 78 - DNA, 703 bp, Nannochloropsis_gaditana
caagtgcttccaaaatgtccggcacgttccgggctatgtctctggtttctgggtctgtgaacaaccccttggctccggaatacttggcttccagagcttcggcatccgatacgagaaaattcgcatttaagccttcaggatagtgatctgacagtgtgcggtaacgctcgtgctcagtctcacagtatggatcacttggctgttcgataaagtgggaaggcgaggcaaacacctcacatggctggaggagtggaggacgtacctctgtcgaaagtcaccgtaccttcctttggctctgccatcgacagaaagttcgttgaatctctctgagatattgatggaagtaaaaaaaatattttgggtgctcctacagttatttaaggatgcaaaaaaaaaacaggcatattgcttggagagataatatcttggatgcaagatatggctccttctgctgaaagagctcgcgccacgacctcggacactaccacgtttcagccactgtcggagatagccatttccttacataaactttccttgttggtttcaagctccgtcaagtgttccatcgccagggacccgaccccgtcgctcgctcttcgccaggtctccttcctcttgctagtgatgccatagacatggaaaaagggagtcattctatccatactgatccacgcacagacgcattccaatcgggtcacttatg

SEQ ID NO: 79 - DNA, 703 bp, Nannochloropsis_gaditana
agaggcgctcagtgccttggcgtaacggatttttgaatgtgaccaaggaacacatccaggcaagcccgttaatgcctcgaccccaccacgcacacacacgaccacagacccacagctcctctcgacgtgttatgcgaatggaggataaagatcaggagcagcccttggtggggccagccagagacattgcggatttggaggattttgggtctgttgaagtgactgacaaatgctgtggtgccatgacctgtcgcgtcttggctcctgaaatatttcatgaagccaaattgggaagcagcttttcagacacacatgggagttcgactcccgacaattttacatacgtaggtcgaaagatcagggacgaaacggagctccggcaggtgcgaagagcagttaaagcgtgcccctttcacgctcttaagttacggcgcggggaaaaaggggcgacagtcatggatgaggacttcaatgctgcctaccctattcaagtagatcagagcggggccgtgtatttgttggggcactactccccgaaaaatgccggggcgacttgctacttgatcgtacgaccaaacggcgggaatgttctggtcgattgtcccgtacccaatgccagcctcgtagagcgtatcaaggaattggggggggcaaaatatctggtatttactcataaagatcatacggcgttcacgaaagaatg

SEQ ID NO: 80 - DNA, 703 bp, Nannochloropsis_gaditana
ctaagcggctcatcactaaatgttctcaatgctggccataagccggctcaagccagtcattcactgtagtttgatccgctcaggatagtaccccggtacaaccctccacaaaaatggccgtagcttttgtccgtgacgcgctctcccgcccggaagattgtccgcgggggcgtgggtggtggagcagccttgctggacgttctgtgtgggacagcctcagcctgaacgaggacggaggggcgcgtgccccaatctattcctttggcatcatctgcccgcaagatttgttggaaactctctcggccacatcttcacttggggcttcagctgcaagtgacggatggacaggatttctttttttgaaattctgattagataactgccctgagccttgacacacctcgtaagctcctcgaacgagtcacgcgaagagttgaatgtagcgaggttggctcgaagtgcaatttctcctacaccatggcgctcaattctcttttctttccaactattgagcaggcagggtggcaagaggcgtcgttcaggccactgagacttgtagagtgcactgtctgtccacagacgccgttgggggctaaggagacgaagcacagctacctctgtcttcggctcagcaatatataaacgtacgcgaaaagtcgcgtcaaggacctaaccagccaaggacaaaagcctgataagcatg

SEQ ID NO: 81 - DNA, 703 bp, Nannochloropsis_gaditana
cgaggagagatcctgggtaagggacacaaccgcaccaatgctaccaagaacggaacgcgacacgccgaactggtgatcgtggatgaaatattggcccggggtcatccccccagcgttttccaagaatgtgacgtatatgttacatgcgagccttgtattatgtgtgcgggtgccttaagcttactgaaaatacgcagagtcgtgtttggctgcaagaacgaccgtttcggcgggtgtggctcgattctgagcgtgcacggggcccctcacctgaggcatcgctacgtagcggacgctggtttgatggagaacgaggcaataaggctcttcaagtccttttacgctcgcgaaaatcgacagggtgagtcggattggacaagggagggatagaacggcaagaactaaaaaaggggggaggggaaaggctaatttgtattttggtcataccggtgagattatcagttattgactgagaacgatgcgattgaatggtcccgtgctgccgacggctgtacacagactccctaaaatcattaatctcgatactcacacgcggacgcgcacagcgcccgacacaaaacggcgtaagaaaggactctcggcagttacataggtgggatgagaatgctttgttcacaggcgcttgcctcctctgtgaattcgcgtcaaatgaagcggttatgagttggagagcaacaacatg

SEQ ID NO: 82 - DNA, 703 bp, Nannochloropsis_gaditana
tcctattgtgagtgcagcgcagttggtaagcagccgcgacggtatcaatttcggttttttgatggaagagaccctcccagtgcgtgtgccggtggtggatatggcccgcctgcaggaagcggttggcggcctggtcgagtcagccatggcgcacgccttggaaaacgagaaacctacggtgacgcttgaagtgaggtttctggaggctaatccacggtcggtatcctccgtggtgttcatcgtccaagacaatgggccccgggcgccgggagcagcacggccctctgcctacggcgagattcgcaaggaagtggaaaggataggggcccggctggaaattcgaggctctagcgatttgggaggttgccaggcatgtctgtacatagattgtaaatctgataaagcatgaatccattgactgcagatcgagttgaccgataagctcgtgagtaagggcaaccagaggtgctgcgacccttctttccctgctagtttgcccgcttttatcttcttatttctttggacaatgctatgcgtgtccattttgttgtcagcatctcccaccgtcaaacgcttgcctgtctgtgtggtaacgtcgaaaacatgtctgccgcgcatcgcacaggtctctcgctcaaagaacttcctgtcccgttggcgagcccgcccggccaacagcaactattcgtcctcagccaacatg

SEQ ID NO: 83 - DNA, 703 bp, Nannochloropsis_gaditana
gctatctgtctttcctgctggatgagaaagtgatgggccggatttaggcggccacaggtattgaaatatagttcgctgggatgacttccattgtaaaaccttgagattccatgtccatcttttactgtcgatgctattgccaatcaaagcgggctggatagtatgaggatagcaccgtgaaagccaagaaacacttgccaaggggctgggacaaggcaggaacctcatcaatcaggaaaccggtccaacgtgacgttcatggccaaataaaggagatcttcctgtaaatctgtgcatgtttgtgacattggaatggatcaaacccgcgcacatttatttattgagagtcatgcaagttctccttttttacttgaacgtgcgctgtcgtgacccgttagatgctgctgtgaggtcattagagaccatcccacaattttcaagacgtcaatgaggtccattccacaaagtaaaactgccattcacgcctcttcacaccgccaaggatgtgcttcctcttggagaggacgctccagcttcgggatgatggcgttcagtggaacagaacagtggagacgggcagcagtcaggcactagcgaaagctcaagtcgggtttgggggaaagggcgatcagaaagcgacttcaagctaatcaacattttagcttacgcgacgctttttacactcccggaaactggaagtcgc

SEQ ID NO: 84 - DNA, 703 bp, Nannochloropsis_gaditana
gttcacagggtattttaatttggaccctttcggaggcacgcggggtttttttcatcgtcgacttacaccgcgacaagattcgaaaagagttgcacacggtacaacacttttagatcaagctccgtgggcaacgcccagaaattatttccccatcatgcacaacgcaagcttatgccgtgaaacaacattgccgcaattaaaattgaagctccgtcgcatttgttccgcactgaaaaaaaaaagttataaaaaaagcagtctcaagccgcggtgtccaaacccgttcaggggggatgtcctgaagggaaatgacacaatacgatcatgttcggcctgttatacagactttgtccaggggtaccgcccgtggatagttcgaggtgttgcaagacccaaaaggcacgcacttcaggagaaggagaaaaaagtgcaagcctttgatctgtttcctcatatcgcttggagctctcataaccgaccttctcccaatgccatgaatttcctttccgagcacgcaactactacctcatgccttattcggattctattccatatcatcatgacaaagaaaatggtatccttgtcgatcttggacaacagcatttggttcttgaaggaaaacgcttgattcactccctgccacggcacaggcttgttcgtctagatcgagaaccctctctgtttcctctctgcacttcccatg

SEQ ID NO: 85 - DNA, 703 bp, Nannochloropsis_gaditana
gctatgttggaatttgtggaaggcaaactcctgccaggtgtggaggtcctggacaatgccaagtaatctgacatgagagacttgagcgcaaggatgatggtgctaggacgaaatgggttcgttgaggctagtatatttgcatgtgtgtggggcaatggaacgtcttggagttgatattagtgtaccactacgacaacctcctcatgccttgccaagggcgtgtgtatcccttgtcgatcgacagtgatggaatcaacaaccctgtcattgaacattaaacagcaatcatgttgtgcctgattgtttttgtttgcaatcaaatgtaaggtcattgcacattttctgctttaataagttgtaatcgctggcaggctctcgaaaagccaccgaggcaacagcacgatcgcttgcgctttcactcgttgtagccatgcgcatgatttggtattccacattacctcgctatttgtcaggaagacttccgagcacccacccacacgatgcaggaacaaggggcgtggaaaagtgctcgcactctagtcatttggcattatttgggtgcggcatgtgtcaactctctggatacttttgctgttgttccccctttttctcgggatcagcatgcttgcttcattacctgttgcctttgctatgctgatcctttcgactgacacagccctgcatcttcttttactcacgtagg

SEQ ID NO: 86 - DNA, 703 bp, Nannochloropsis_gaditana
ggaaattcaaacggcgtcgtcatcttttcctgagcctgagcattcatgagtcgcaacaattcagcaatgcaagtcgcggtacctcctcgtaagcatgcttattctctcaaggttaccgatgcagtcagtagatgatcctcgcttgcctggttgtgctggggggaacacctacgatgtgcttcccatgccctatcaagtgggcgggcacaagcctaaagatgccagtgatcctccttacatgttgcgcctgcaaccacgcgtcgcaccccattgctcgaatccttcctccacatcctcaaacgatgcgacccagcctcctcgacttctcaaagtgatccaagcaggggacaagggagcgcgagaagcagctttctatcacaagcttttcggacaggacggcatggatggtttgaaggaagatgaaataaatgtttggcgctccctacgtccctttgtcccgtgttattacggcgtcctgacacgttccgatccgacgggcaatcctcgtcgctaccttgttttggaagatatatcagcacctcccaatccgggggtgaatgatggcttctgtcattgtccgacaatcttggacatcaaaattggtcttcggacatacgctccctgggctacattgcagaagcaaaagcgagagagagataaatacatgcaccaagaagctgtcgggtttcggattgtgggcatg

SEQ ID NO: 87 - DNA, 703 bp, Nannochloropsis_gaditana
aattatttgaaatgtgtgtatatatgaagcctataggtaaagacttgctttgctcgtaattgcattgatggagcttgcgggagagattcgggcgagcacgaactggtcagatagaccagacgggctcaaaatgttatgtttgtcgtttccccgtccagggggacttgtgcgctggagcacaacaaagaattggtgatgaacaatcaacgtgagtgcattttgggaatgttttcgttacttatacgtaagatatttgaggaggattgagattcgatacaaggcattcgatcggcgcatatttaatccgttctacatggcaagaaattatgtactctacagcaattacttgcagtgtttgacaagaaaatgcgcccaaatctttttctcgctcgatttttatccacttaaacctttatagcctgctgtacggaagagcacgtgtctcacaagtccagcgctgagaaacatcgcccacaaggcagtcgcccgcttcttcaacgacgccttcacgcgctcgcactgtgaaactccaaactagatggcatacgagtgctttgaaagtatcctggtgattgcttgacgtgttacagcagatatacaccgcgcgagcagaggcacagtaggaggaacgagattgcaaagaagaggggaggttattttctgatcaatctctcttccacaggcgtgcttttacagccaaatg

SEQ ID NO: 88 - DNA, 703 bp, Nannochloropsis_gaditana
tcatttagattttatgagtaataagaccatattacatagtctgtatgggtcggctttgcggatttacattccattaactgacacagacatacaagctcttctttgaccaacggtggccactgaagagagtccatatctttgatgtccgtcgccgcggtggcctttcttttcaatggtcggacagtacggagctttcctcaataaatatattttaccatggaagaccagtaaagagatgttactcggaaggaaataaatgatatacgcggagagggaaatacctaatcggacacaggaggttggctcttctctgccttctgcatgaggcagatgcaggacgcacattaatactgcatgatagctcaggtttgtaacaggtaaattttgaatcattttattgtgtttaataagcctgatattctggacaacgtttgaacttgtaaagagctgaggtatcatgtcgattgtcgggtctcctttctccgacaacatttaacggctcgccaacggcacggtaacggcaggacacaagctgccataatcgtgaccattacgactcagaaacccttcaccacgtccacggctgtctaaaattctgtttcacttatctatctaccacgcatacaggtcatgtattcgggtgccgtcgtctatggagccaagaatcaatcccgttgtttggcagctgttaaaggggatcacg

SEQ ID NO: 89 - DNA, 703 bp, Nannochloropsis_gaditana
tcggacagaacgcaaggcccacaacggccaagaccacaagaacgatcgtggttttcatcggcgtcatggttgtgttgacgctgttggtgttgtaacggtacgcaacgaaagttccggctacggcagacggagactgcacgatggaaagaatgcccaggaaggctcgcaactttctgtgctgtgaaagagaaacatgagaaatacagcatggcacgccatgcacaagaaaaccagccaccgtgggacgtggttcctggcgctctgggcgcttctgcctggtgtttctgatctggtaaggacgacggtcctcgtctagatacttgtctccggctcgctcagacgctgcagacgggtgtcgcgatgaatgcttaccccaggagagttataaaaagggttgtgccccaggtcgggcggtgttgttgaaaatgttcccggagggatccatggcacgatgaacaaaggaatgaaaggctctgtttgtagcgtagtgcgccggcaaagactggtttgggcacggcttttccacttgttgatctcccgtcccgcctcacattgtccccccccccttctttctacaggtaaaataggacggaaataccaagaagcccgaaattctgccctcgttcagggcaattttccgtgactcaccggttgctggtgttgccagtcttcctgccacgtcaaattttgtccacttgacatg

SEQ ID NO: 90 - DNA, 703 bp, Nannochloropsis_gaditana
cccgagatttctgtcttttccgtacactggctcgggcccagcgtctcctcccggacgaccgggaagccttgtgtccgcgtgagatcttgaggctctggtgttttcctttttccacgcgggcatgcatgggatttttgcatgtttttatatatatatgttcgggctggagcaatttgtgacgtggattgtacacgtggttcggcacgaaaatgccccgaaggcgatgacggtgcgcccaaggacaccactccagaaggctcgtttctcgagcctgatccgtggtgtcccttctcttggcaactttgggattgtcacagctttgatatttgtgtgtggttgtcttcagtgtcgtgtttggcaatggtgcttggtcatgactgcttcaggcttgccgcatgtatttcagagcgacctccctgaaaaatggcatccagaaatgttccagatctcccaaacatgtacttttcactgcacctcacacgttgacatgctttggaatcagggtggaagcatgtgaatgggcttaattttgcctcaagtctcagaaacgtgtcgttgtatccccgcatctctacactaccctccaatcggaacacttcctcactttggacccttttcgcatatcctgtctcaaacacagcgtccacgacagcgaagacaaggtgttacgtctgagtgggagagcctgtaataccgcatcatg

SEQ ID NO: 91 - DNA, 703 bp, Nannochloropsis_gaditana
gccgaattgggtcgtctctggtggcggcacaagcaccacaaaagcaccaccgccatcgcgaaattgctggaaaccctggtggggattcaaggtattgtggatttttttttccacgtcgtcgacttttttttcgtaggagactgcgtcaacatccctcttgggtatgtcctgatgtataaacccctgtcggccctgcaaacggagcgaaccctcatctacaaaagcgtcaaggagggtctgggtctattgagcgtctggtggcacgctgtaaccgcctatgccatatactgctggattgtccgcaagtacagtgccaatcgcttgaaggtccgccggctcccctatctgatcgtggccgccatggtcgtcaccaccactcgcatggtgctttggcaaaccttgcggaaagatttcctggggttgcggctgggcaacattctctacgatttcttggccgtccccctgcccattttgtgcattttccgctggaatctgggctcggctcgtgccttagcggagtacaacaaacacgccttgcccgtgccagccgcgagcgccagcctggtgcccgcccccgtcgacggtgccgggacaaccttgtcgggccatgcttcggaccaggagcaggcagcaggccccctgcagagcctccggtcgcgttcacacctcccacgaggggcgtttcagccttccatggggcctg

SEQ ID NO: 92 - DNA, 703 bp, Nannochloropsis_gaditana
tttcgctcgtggccgtggctgtggtggtggtggtggcgggtccggaggatcgcttgatccctccgcgaacgtgggctacccagtacgaatgctcgcagcgatgaacaaaggaattcaaggaagacgccaaggtagaggatggcaacgaaggaaggaagcgcgacgaacaaagtaaggacgctgaagtggtggtgcgggggcaagaagaggagcgagaggagcacgagagggcggattcctcacattgccaaggcaggcaagatgagcaccgcgcgtccataattgataaaacacacgacaggacgccaagccagagtgcacgccgtcctgcgctcgccttcgttcttcttcgcccatgaagtgtggtgggcatggttgcacaacgagcgtcccatttggggggacgctcgtctcgcatcatggaaaaggaaatgcccctcctagactagcctaaggaaaagcacaggctgcgcgcaacccgacgaatgcgtgcaactcctcctcagccgcatgcagatccttacgttcgtctcgaggaaaacgtgcctggtctttgtgcagggtggaaggctttataaattgaatgtttttagtgtagcagtcgccgtttccgcctccctcgctgacctcccccctttcctccctgtgaccagcacgcgttcacacagggaaatctgtattggtgcccttcacaggggtcatg

SEQ ID NO: 93 - DNA, 703 bp, Nannochloropsis_gaditana
agagatgtgtcgacgcccttgcgtggtattttgatctatatgatcagacacctcccacgtccccatcccccacaaagtagaaaaagcggatcatgttggtggcattgtccatcgtgcactcccgccatgtcctttggctcgtgcgcaatggccatgaaaaggctttaaactctcagcctcgttaaaatgaggcctaggaattgtacttcaggcgtcgctgtaggatcaaacattgtacctgcgagacatgctgtttttttatcgctttaagcgcgagccccagcgtgcggagctggatatcggagagccgccggtcggttcacaacccgaaagcctcttacagtcgagtgttgctcacctttttcatccttttgcaccttgcaggagctgcagggtggtaaggaacggattgcaaagattggaacggtctctacggatgaggcgtttgctgtgtgccgggggaagcgtggccgggagaagaactagcggtgctggaaatgcgtccttgactctgttcggtaaaccgacatctttaccactcacgcaagcgacaccatcagcatccctttcaaccgccacacggttgatggatcggataaattttgagcctcagaaatccggattggacagtaaagcacgtcgggataaaagcactccaccaccgacccgccggtcaggcgccatcgcattgaaagtcggaatg

SEQ ID NO: 94 - DNA, 703 bp, Nannochloropsis_gaditana
cgtattatagatggttaattattccatttctcatgtatcaaataccaaccttactttttcgtatgaacagcattcccagcttatttgtggtcaatattgtaaccatacaatctcagtctggccttacaccctctttcgtaggtgtgtgccgcaaagggcaaagggcaaagggcgaggaagcgaggcgttcctgctcttgtctcctccccttcgaacagcgagaagaaaggatcctctccatggtactcaccacaacgtcgcccgggtataaaattaatgcagtatgcccgccccaccacccgtccctgtatggtttttcaattgtgccccgtcttttgcgggcacatacacgggtggtgtgcttgaaccctgtatcttggtgacgcatgctctcgcagcaaataagcgactactggcttggcccctctgacaagtcatacctggaaatttgatcttcttttacttcaccgcaatggctataatggcattaataatgaaagtcatcgttgcctgacctacgtcgcattgtaaatcgcgcatggtggaccagggttttgtctctattgtgtcatgacgggattggaccgacccaagaccactcatccgaatcagaagaggtttcgattgaccatgttccgcttcccctttgaactctacacatagaccgcggttctccccttcttcccagtcgtttcacaccatg

SEQ ID NO: 95 - DNA, 703 bp, Nannochloropsis_gaditana
cgacaccgtaatatctgcgtggtaagctacacaatatagcggttctttgattctagagacgtggaggctgcttttatggatggataagatgaaagcggcatgtgagcattgagtgcccgttggcactttgcgtcaggaggtgtcatcagatttgagaggaaaatggacagttttcatcccacttgtgccataaatatggtaacgaggggggcaagctgtcaataaatagtaatctacgaggatattgtgccgaaacattcgacgccaactctcccaagacacttgtcacgtcaagtcatctttttcgcccggggcaggctctcatcgtatcaccaaagaagacactcgttgcccttaatttttttcgaatcaaatcccgaagcatccgccgcatctctcctgctacccctgcatgtaattctccgcacggaaatccatttgtaccgacgtcgtctggtcgcattgtataagtattttgttgggacctccctaatgctggagggagaacttcaagacagcagaaggcgagtggatgcactgacaccactccgaaaagacccaaaactcacgcccaaggataatttgagactcaccgtccaaaatacgaaccattttcccgcgtaccataggactccatccgcttcgttcaaagcaccggaatcactgccggtggttttgccgactgggcgcgggaggcctcatg

SEQ ID NO: 96 - DNA, 703 bp, Nannochloropsis_gaditana
tcgaaaagattgcctttgctccgggatcgaatttctgcgggaaggaatttcaaacaaccattcccaaagaggaaccaaagcgccttcaggttaaatcttcagagatgaacaaatctgtagtgtgcgcaaagacaacataaaaatggtcgtaaataccatgactttcgatcgtccacttcccattcctggccaggaccgatcatcccaatgttcgacggccctcaggcagttttgggaggaacacgcgagaccggatgtggtagaaaggcgattatttggtcaccaaccacggtggtggtggcaacctttgaagtagggcgaggccgtagggcgagcgaggacctcccggtctcgtggactttacggcgcgcacatggccacttggggcaaaacgaggacactcaatgtcgtgaaagaaggctttgtgatatcggaggggggcgtgcggtcatggcggcttcataaaggttgtggaagtgggattaatcgggttgtgcggagaggttgcgggttagtatcatatcccggccgattgattctctagcttcaccttaccttttttatgtgaccccggggacaaaggccgatgttcttcacgagaagggtacacaaaggtgttctggtacactctgcttcgtcggacgcgctcacagccttcccactcgttttctccttttcccctgcacgacagcgtggcatcatg

SEQ ID NO: 97 - DNA, 703 bp, Nannochloropsis_gaditana
gaatcctggagggaattcaatttttggaagctccccgtcctttccactgcttcatctctcgaaatgctcgggatcgctcttggccagccgttggggaaattccgtgtcaacgccgacccttcgcgttccttctccgcccgcctcagcgtttgttgacacctttgtgcgcaatgcgcattgtgaatgaagtgtggatcttgtttgtcacgggaccacaaggcttttgacgggctcttacccctgtgatattatgtttttagtttttccaatgggccggctgccacgcgtcacggagtaccatcttcctctgtgtcgccgtgtcgtcttcaatatctagaaaaatacgaccacatgccacattcatgaaaatcaacgatgataatttctttactcttaataaaatgttaaatatgtgcaattcatgttgcgcgtcgtatcgtaattgcggcgggttttcccaaagatctgctcctgacccttaacccccaccttcctgcgtgtttcgacccccttcctcgcgatttgcttgctggatttcacaggaaggcagacactttcaaaaacgcctctcatccatttcctcctactcctaacaagctaactattttttgatggagaaattaacattttttgtttttcgaacgtaccaaacaggaggataggagggacagcttgctcgctttgaggggcttccgaggccatg

SEQ ID NO: 98 - DNA, 703 bp, Nannochloropsis_gaditana
gatttttctgtcaggcgccctcttccttatggccttcccgccctggtcgaaattggggcctatgacacccttgcgttcccggtaagcatcatgacagtgaatataggtagttttaaaggcaatgccgctcatttgtggtgcttgtgagctcgcgatgtgataggaagtgtgggcttggtcgcctgcgttgatgatgacatggccccgcagaaaagcgacgaaagtcggtggcgtcgtctttttccttgatgtgttctaccccctccgaggcctttattccgtcaccaatctgctccgtgtgctgcatgccacacacagccatttcttcagtggcagctaggtgtttacgtgtgcctctgacgccttcgatcttctcttcctccttttacctcgtcacttgggctcggcccacaactcctcttgacacgccctctctttttgttcacgttctcgtctaccccaagacaatcggtatttactcattctaaatccacttctccattttcattttccgacaggagcgcttgcaagtcgtctttcagaactctgtgaaggccaccgcggccatttttccgcgctgggccttgtggtacttcttatctgactttgccctcgacaaagcttatcaaagatgtcaccagtgcaagacccgttcctaatacctcctcatcaatgccggactgctgggacgaaacgcaaaatg

SEQ ID NO: 99 - DNA, 703 bp, Nannochloropsis_gaditana
cgtcgtgctgcagtgtcgttgtcgccagtctgcgtcaaagcgagagaagagagaggaacgaagcacaagcccacgtctgaccagctttgtcggagaacggaggagcatactatttgtcaatctgtttgatagacaggatcgctgtaaatcccagtaacttcgtatggttgcatgcatgtgacccaattacgttccgtgacaggcaggaacaaggaacctcctccttgtattttcgttgtccgatagcccaaccacattttcatccacacccacaattgtttacacgttacggcataaatttgaggctgccgcactcatacgccccacctcggcgtccaggatgacgtctgtttttatttttagtgtgtaattgaagcaaaaggaaacctccctcgctgatattcatggaaacatgtgcgtggcgatgcctgcttcaataaaatgccagccccgggccattccaccccggtccgaaaccattctttcgacggtcgcttgcattccacatgctgctagggataaatgtgatcaactggctatagtaaccattgtattctggctccatttcgacgataggaaggataacttggtgacttatcccccctaacaagcgtgacatcgtttcttttttttttaactcccaccggacaaatgatctacgttcacaaagccacaggctctgtgtgaggcgataacacacatg

SEQ ID NO: 100 - DNA, 703 bp, Nannochloropsis_gaditana
acccaagcccggatccctcctcctccacaatctcctccgtaacacggcgtccttccaccacgtcaaagtccatccgatcaatccgttcccaggtgcataaaacccgccgtcgtcgcttccacgtgatgtcatggcgggcgatttacaaccgcggacatgtggttttcgcggggcaagtacgcctcgctcgcgctcgcccggtatcttccctactcatcatctcggccgcccctcccagcccatcacagcggaggcaatgtttaaacaggccgcaaattgcgtaagctgtgcctgtctcccgccgcctcgtgtcttcgcatggactgtagagcagtagactcaagacgtggtgacgagagtggtgtcaacctgctcgatggaatgggaaaatttttcaatggaggcgcttttcgaaaaaccttctcatcatcgatttctcgccctcgcctattgttctatggaacggggccattcacccattccttatgctttccctccccccctttctaaaatcccatggtacactatctgcgcatgcaccgactacgttgccctttgacaaagtaggtgacgtcgcttgccggcatagcttggaaagcaagtcgaaagataactcatttttttatctctcataaaatttctcaccttcctccctccttttcacttttttggttgcattactaggacgcaatattatatcatg

SEQ ID NO: 101 - DNA, 703 bp, Nannochloropsis_gaditana
atttgctacacaaacgcactataatgttggtcataacatcaaacgcgctgtctaagcttgtaggcaatcataatgataaagtgcttagtgaaaaagaaagatctttatcagcaacattttgcttacatttatatccattgtaaatcacgtagacaacatgtcagcgtttttactcagagacttgtcctagtattcacgctagcccggaatcacattcgcaatcgaaagtttgagcttcgaacaaaaaaaatgatgtccgcttatttgctcccccgggacatcttttcgaggcaaacgcaccatgaagagtcgccgcgatgcccacaaaatgttgatacgcacgatcaatgttaagtccaagcttgaaattggtcatggtcgtgtgaaaagcatttgcttcgttcttctagacaagtctttgtaaaatatggccaacctcctgccctctttctagcagtcaagcgacaataaagcaacacgcattagcgtgctgcaaatcgtgcgaagcttcaaagcactatcaaataatgaacaactagaactcagctatggaaccctttggtttgccattacaacgctccctagactttgccctggtgttcagtctcctcgcaggtcgctcattggaagacgttaacccggagcttctgaatcgctacacaaaaacgttcactttaaaaaactctaccactcacgtgctacc

SEQ ID NO: 102 - DNA, 703 bp, Nannochloropsis_gaditana
ctaaaataaggtagagcgtaaagggcatccccccgccctaacccccagctctgcagctcctccggttggcttcaacacaccttttcaagcaaacgccgggtgtgtgtgacctgattttttggtatatttttttgtacacataaataaaagcccgaggggggagtgaatatttaacctatgtctctttttaggcggcatcgcccagaaaagctccagcgtgagggatccggcgacggcggccgtgtcgcttttagtgcagcaaaaccttacacggcacctcaggccccgagtatttcacggtctcatgtgtcgtatcaggccgatatacaactgtgcacgctgtacgtgccctgtagcgcggaggtggagagtgttcgaacacgtcaaaaaggatacgaggaaccgaattcggagcattgcgatgaagcccgtgccgtaaattattagttagttccaaatggtattcaccctttgacacgaccgcgcgagccaccccgagtatcgtatgcagtggtactccaacgtgtgaagcatgtatcccgtgtcaaaggattgttggggaccctttacgtttctcggttcagtgatctcccgacactgatcctaattgctcgccttcttgtcctttctatttcctacagagtcttgcgcctccagcattcgcccgccaagcctggttcacagcctaggtcccagtatcatg

SEQ ID NO: 103 - DNA, 703 bp, Nannochloropsis_gaditana
ccatttgttttcctttttcaaaattgattgatgtaaattcgttaaaacttcgatttgatgtaaatttataaaaacttcattgcagtgtggcattaattatcatgctcttatacacaagaataaaagggcatactccgatttgtacttcccgttgatatatcttactcctcttcttatctcactgtcgggccgcctcgtgctacccccctcggacaggggatctctctcctccacgcccacagaaaggtttgcaaaggtcgacaccggccatctttggcattaaccagcacgacaacagcatgcacacaaaatttcttctcatgcacgcctgatgttaaggtctttgcccaagcaaagacgtgtgacaggcctttgcgccctttcctcctccctgccgggcgaggctctcggccccgtcagctgtcgccctctctaatccgatatggccgcagcaaatttgaagcagaaaattccgtccgcggcaaacatttgcacgcggaacagatggaggcacctcaaattgaaagataggtttgaggaggatgaaaaggctatggtgtttttataagcaatcctattacacctatacgtacacagcggccgaccaggagcacaagacgacacgaggtagtcagagtcccctcgaacgttgctttgcttgaagccggcgtacacaagcctcactacgcaccacatcaacatg

SEQ ID NO: 104 - DNA, 703 bp, Nannochloropsis_gaditana
ccccttggtcctgctccgcattcggggccgcgctcaccccggaattcatcgccccagcgtcctgttcacatcacaacaattaagagtgagaagcgtgaggtgacaacgaaatcaccttttcaagattttacgcggaacgcatgatgaggatggcggacatcatacgaagatgtgatgggaggtatcattgtgacagcgaaagccaccacaaccgtgccacgcaaattggacgttgcattcctctgcttctcccgcctcgtcttattcccaacacaccctctgcaccttcgtgtccgctccgagctccatagtggggaccacccgtcgaccgcaggacttgtcttcttcgccctgctctaccgcgacgaagaaaatccggagtctctcaaagcgacggttgcccgagcgtaccctgtctcgtgtacatgtacgctcgtgaaagagatttcggcagagagacgcaagcgaaggcggtggccgaaggtcatatagcgcgcgggcagagcagggatttcttcgatggcccccagcgaggcgagacacccgccgccatcccgcccggccgccgaccctgcatcccgagcccacgcccacgtctccaccctcaacgagattccttcacgacgcccgtcacgtgttcctcattaacgattacaggcgacaagaccggacgaccaagagcttgttcgcacctctcaaaatg

SEQ ID NO: 105 - DNA, 703 bp, Nannochloropsis_gaditana
gggcagctggatgtcgctcatttgatattttaccgtctggtcatcgcactgcggttacgattgcacaacaaaagcttgtgggggaattcggggctttcctgtgtccttccctactagtaatattctcgttggctcatgcaccgggagggcccgacagagcggcccctcgcacacgcgacattaaataatcctctcccccttccatcgcaaattcgacaggatatgatcgcttgacagtattcagttaaaaagaagttaagcatgcgaacctcccgccccagcgagtgcgataactactgagtaacgagacatagcaccttcccgcgaatgcattattcgactatgcggccgatcttcttgtggatgaaaaaaatatacgctaggcctttgactaagccattgacaccaatcagaagcgctacttttgagtgttctgtccgcttttctacctgctccatgacccccgaaactcgtcaactcgccgagggtgtccttcgaggaaatcggttagctttaagtagagcgattactttgatagagtccacgaaggagagtcatcgactcgatgctgaggcattgttggaccacgttgtttacgagcggagccgtcgagtccgagaaaagggacgactcaaaccggggaattccacgagcaacgcagcctgtgtcgctgatgagggtagaatcggcacgtctgaaaatg

SEQ ID NO: 106 - DNA, 703 bp, Nannochloropsis_gaditana
agagggttcctgctagggggaaggagaactggcgacgggcgctgctcgcctgcccctgtcggcgagctgagccacgcgggcacagcggcatgcactccgggccgtcgcaatccttcaagaagagtaacctgtttacgatttcacccgcacaggctggtacactgtctaatttcctgtttgggacagagtcagggaggcgacggccggaaaactgggatcctttcgtcaaggccgcgttcctctgctgatccctcctgcaccgacacgccaatccagacaaggatgaatagcattttcaaaatcatgttttccgcgatgggtgcaatggcccttgtcgtgttaagcacaactatggtcgacgctttctgctcgtataggctcactcctatggtcgccggcacgtcaagacgaggagtccttccacggtcctcgcctcctacactttccccacggagagatccccggctcgtgtggatggcaggttgcccaggtaagaatcgcaccaaagaaaagaaagcaaaaacatgaaatggatacaccaagaccccacacaccgcaagtttgcttccaggcaaagacagcaaggctccgattgctgaatcaaccacattctccacccctcgcaggtcattcggatgcacacatgccgttctacgtaagatttcgcgcaaatcctgtcacgcagttcgaaggtatggatatg

SEQ ID NO: 107 - DNA, 703 bp, Nannochloropsis_gaditana
ctcataacgaaatctcttgctcgtggggcgctttaataaagacgagaaaaaagggttagagaaaataaagcaaggtaacgtgtccgaggagcagtcttcctgtcctttccgtacctgccgaaagctgtccatttctttgcgataatagtgcactttccctagccttttgtaggtgtggggagtgatgtgactgcttcgaccagtacgtttgtcaaacatggctccttcactcctgatcctttcccgcccctctcttcttccaacaagaagctccgaacctttgtccgctttcctagtcgaggtgcatgaagggcttcgtaagccaaatcaagacattgatgcattgatacgctttactgaagtttgtgcgttgaaacgccgttctcctagaaggtttcctcactgaagtacgtgccagaagcgcgcggaacactcgctgctggaaggcgggagctgatcaagaggtttgtcgggcgtctacaagttgtcagcaagctggttacaaactttgaggcgtggattatcttctaaccgtgcgttgatagaatggtcggacgagcacgctgcgctcttttgatgctatattatccttcgtcactcattgaaatcgcgctacacaaggaccaaataacatcagggatggtagatttctcgccgttgtaaggattagaggaagcggtctctagatttcgcgacacgtatg

SEQ ID NO: 108 - DNA, 703 bp, Nannochloropsis_gaditana
atgctgatgtcgatatacctggtagatcgtgatgaatgggatcattaattttgatagaaatgtcttctgttgcgcaaaagcaagcgcacacatgtatgttctctcaattgaagccagatacggtcaacccaggatagtagaggaatgggccgatgcttggacgcgcttacgacgatgcctgtttgtcgatctggctttgggcttctccagcactccaaagaaatttgccttttgcataggcttacatcctagcagacctctgacctcccctcatcttaagacagcgggcaggcgcgtttgaggggggtgagccgccgaccggcgtgacgccacttgcccatacgccgctcttagagcaagcgacgaatacgaaaatagcaatttttttattttgaagcgacaaaactcaatgcatccgctgggctgtatcaattgtccacttgtatctttcggtttcgtcatagccaagtatgaagaaagaagaagaagatggagcgcatgtagcagggtagcagggaagtgcgatgtgacacgtacctgatatcagaagtacgccttccaagtaatatcgaaaatcgaggttaaattgtaactagctgtaatttgtcccagcaagttcttctactatcagtatcgagtcgttgggcgtggggcaattaggactgaatttggccatgtccttatctcttttgtcacaaacatg

SEQ ID NO: 109 - DNA, 703 bp, Nannochloropsis_gaditana
actatgaccgaaatttgtccttgcccgagaacggttgcccgagcctccccctccccctcccccccccccttcccactagcccctcctgcccgaaacgaaacattagctccctatcaagattgagggccttcctatcgattacaagagccctgaggcctgaacactctgtcttgtcacttaaaacatttacccgttccttctcatcccgttcggctccccgcgcacacgactcaatttgccaccacttatcctcgtcgtcttcctctttcgaagcgtcattccgttttgcttttggcttgagtagggctactggccgtagctcatgagaaaatctgccaacctcatcgatattttcgtcgtttccttttcccgcctctatgctgtcgtcctcctcgtcgctgctcccgatcaagacgtcaaagcctccccggcagcctcccacgggactgtccgcgtcctccgcaacctccgcgtccacgccatccgccaagcccaggttagatattctaagcgcttttaaatgtcgggcactcattatcctacgtgtgtcttttagaagatatactggtcaggcctttgtacgagcatagcgaggagatggtgaatgccgcctgcgtcgttcaacaggcaacggcgagcgaggaggtaaatgcattgctttctcacattgcacgtcaacaaccgtgacagtcggtcaaccatg

SEQ ID NO: 110 - DNA, 703 bp, Nannochloropsis_gaditana
cagctatttcgtaattaaagagctgtatggcttcagcaatgttcgttattcatttcataataaattattcgttactcgctccatccgctttggctttctcacgtgaactgtgaccttcagtgcgcactttcccaaaatgttcaggcagacaatcaatgtccgctggggtttcgcctacgaaatactttacacatcacttgaatatacgttttaaaaaatgtttgcaacctattgggggggaagtttttggagtcattgaggcaccaccaacgactcggacttcgccttttccacctcatcgccccttttttatggagtcgacgacgaggggacattacgacttataagtttcagaaggctgcacggtgctaatgtgtacattaaggtcacagctgaataatctcgtgcaaatatgacttgccgccggaaatcggaaagtcaagtcctgatgcagactcaaaagcagacaggtttcgaaagcggagaaagatacgatcggagggccctcggtcgcgtactcgagctgtcctgatcctgatttgcgcaaagtataagaaacaatcgattttttttaaagaatactaacctgacgtgctcgtcgattgctcccgcaggcaaccacgtcggtgatgtcacggctgccgacctacgcgttgatgacgtgcctgctcttcctccacaggtcaggtgctcaagtaacatg

SEQ ID NO: 111 - DNA, 703 bp, Nannochloropsis_gaditana
aagggacaagcccctcccgaggccaaaattgggacaagtagcttgaatgtacaaagcgccgccgaattccgattgcgcggcagcgaaaggaaaattttgctcctattttaccagcgtcattccatcattaacgatctgaaatgtcgtttgaccgttcgcacataaatttgagtaagccacgattagcggagtactcaacagaatgggccgcggactccacgcgacagccgcgctcttgtctaccgcgcttcgccttcgagacgttgggcaccagatcctgtccaagacgtgatttagaaagggttccgtgagaagcactgtctttaaatcttccgttaagcactccggttgcaggactggtctactgactgtagaagccatcgcaggcggggctcagtgcctgtactgatctcttcgctctcccgaggtcgcttctttcaccgggaagcttcatctcgtatcactcatcaagctttctttgctctttttctgagacaacagcctctcacatgtgatctttttcacgaggtttttagacgatgtttctcgaactcgtcaccaaacaccaagtgtcaggggcatagcgagtatcggggactcttgatgtcgcctacctgacttcactcgctatgttccatcgtcaggttctcagctccttgtaccccttttcccgcatttcacgaaacaaagaggaaggactatg

SEQ ID NO: 112 - DNA, 703 bp, Nannochloropsis_gaditana
aacgagtgatgacccatttcgtcgtctctgtgtaacagctctttcagcgcatccacgtatcccggatttcgcccgctttgaatgaagttggcaaagatttcacgatgctcatcggggctcagcaaagtgtgcccggcacggataaggcgaactgctgccgcatttctgtgtggcgcgacgggatgaccagcatgaagaggtggaggaggtggagaaggtgacgcatgacagaacataactttgtcaatggcgtatgcaattatgcctgccaatgataaaaaaatgagtcgagatgcaaagaaaaggctgaatgccagtcccttgtgagaaaccccttacaatcaacacatacttcacgtcttctcccaagtatcaagctgctagacttccctcccaaccatcatgctgaatcgagccgcgcgccacgaagcagaaagacctcttcaagcccaacaaacactaaagtacagctagcgcgcggggccgctcaggccttcggctcgtagcgagatcgcagaacacgggaggcacttgaaggagggcagaaaggcattttaagggcgccacgggggaacttgctactcggggcacttgaagaggagtcggcggagtgggagaaagggcgagggtctggcgaggctcaaccggacctgtatcttccctcaccgcccccactcatgcacaggtcctctccaccaatatg

SEQ ID NO: 113 - DNA, 703 bp, Nannochloropsis_gaditana
tctccgctcatcaacgttctttcctcgtacgaatcgagaaagtcgtcctcaacctgtgtgggcccacggctagaaaagctctcattgtcatctcttccactggcaccgcccgctctagcacatggcgcgtcactttgcggcgacagaagcatcaaacgaacgccgtatatgaccgaatagtttggtcgccaccttgctccccaacaattgcacgtgggcaataaactctacaccgtgaatacgaagactgtgcctaggtgtaagctgtaattgacattcgtggacaggcaaatgagtgggttgctacacaatatataagctgtccctatatgctagcgatgttggtacgggtacagaaaccgagcacgagttttcaaggtacacagccccgaggagtcgagtacgctctatccttctcataagtcttcctggctgagagcatggtcgccttcctttggagcgaacgagttaaggccggcgggcaggtgggggcgcccacgctgaggccgtggccggaggaagggtcgccgaggcccttgggcgagcacttgctcctctaccgcccgtgccagtacggcacaccgcgaggacttgctcctctacctcccgtgccagtacggcacaccgcgggaacaggactagtcggaggtctgacagcaccccccgaagatctactctcactggctcgcatgacagggaaatg

SEQ ID NO: 114 - DNA, 703 bp, Nannochloropsis_gaditana
gtatttcgctggaaacggggccgcacgtgaatgtcgattgctccttgagggaggctggtttgcctgtttcgctcttccttttggcccaccatgttcaattacgctcactacattggaagtgacgtgcagaacccgagtatgagcacatttttgtctcggtgcttgtatacgccatgtcatggaatgcgcatccaatgttgccttcgaaaatgatatttcttcggcatgattaaggcacttctcacaggagcttcaacgggttgcggtccctattaaattaagccttccgaagctaacaacgaaaagggatattcaagcacaggattgatcgatatagtctgagccatcatggcaaccaagccatcctcattacgtgagcaggagcatcatagccctgaggactcggtggtaatgtttcaacagttgtcaagctgtgcgcaggcaagcttctggcaggaaatggcgaaattaaaagtagacgtacttggtttagaccagaaacccctggccattacggggacctataccgcgacggggcagaattcttcggcttccgcaagtattccagctcggctttcggtcggaggtgagtcttggttggcatccaaagccgagataattgcagcgggaccgtctccaggaacgaaagggcaaggagagcaccctcgcgcttccaacttgacgaaagattgctgggtgccgg

SEQ ID NO: 115 - DNA, 703 bp, Nannochloropsis_gaditana
ccctggccattacggggacctataccgcgacggggcagaattcttcggcttccgcaagtattccagctcggctttcggtcggaggtgagtcttggttggcatccaaagccgagataattgcagcgggaccgtctccaggaacgaaagggcaaggagagcaccctcgcgcttccaacttgacgaaagattgctgggtgccgggggtggtgcacaatttcaacacggacgaggcgttcagggctttcgataagcgagcatggatggaccgtctgggtctacaggtgtggagggatatcatggagccggggcgtgacgcggccgtgcttagggatccaggtcgcctggcacgcttcggtaccttgtgcttcgcggacatcaaacggaatgttttcatctactggttcgcctttcccgcggtggtcagtgccccgcccttccggcacttgaaggcgcccgcccctttggcagaggctgggcaaggggaaggaaacccgtttttttcagggaccgagtgctctcttctgtaccagggcttgctggcgtaccgtcaacgtcgcttccaggagacgggcgacgcgtcctgtcctcccttcttcctcatcctccgttccacgacccccccccccaaaccgcggacgaccgggaggggggatcctcctccctctccctggaggtctgccctttggatgcctacgagaagatg

SEQ ID NO: 116 - DNA, 703 bp, Nannochloropsis_gaditana
ctagcatgtagccagccttaataccacaaggcaatacattttacgatttcaacctgcgtgcgtaagcatcaaaactatttgatatcgaagtgatcagtgaaaactcattgtgcgcactaaatcgatcctgaaatcgtgtcgaaaatttcaacccaacctcgccatgtgcaacgaggaaggagggacgagaggattgttgctgaaaaccggcaaacgttgggtggaagtctcccaatagagcgaggtcctccagaactgtgacacatgttatctgattttatggcttgaatacaaattagtcttcgcactttgcatatgcgggccacaatttgttggcgccccttggtccagtaaaagacgggaggctttgggtacgttcgttccttctattttccaaaattgcgcttttatcgcaaaggacggttgcaagtttcaaagtaagaaggacgccggccctcacgatgaaagtgtgcattaagcagggaggactcaaagtgacgtcttttgggatactaaattacggctacgcctccagatcgtcccaaatgcgagcttgcctgtgccccctccatgtctttttcgacatatttataaattgacctgatccctccccccatttttacgtttcacagcgttgagagtgaagaaataacacgggtacattgtacgaaaggctgacgagtgcaagtacctgtagagcatg

SEQ ID NO: 117 - DNA, 703 bp, Nannochloropsis_gaditana
cgtcattcagtccatctccagccagggacatgtcctatcacggggatggtgtgcgaaaaaaggggcacaatttagagcaagctcgaggaacaccccagcgtgatgggccggtcgtcacggctgtgctatttctagacagcttgcgtggagggttgaaaaacgcgaagcttctcaggcagtaaccgcaacgagcgaaagtcttgaggattcctcccgtcgatatcctgcaagactgtccaagccccgggcctttgtggggtggtcagtgtgctcgctttggtccctgtaaacaatccttttcgttacgcaaggggggctggcccagctggctgttggtgttgactccatttatccttgtaagtcgacggacggtaagcaaggatccctggaatgatcgcgaggtcaacttggatttctactcccacgctttttgcccaacggcactcttgctcacaatgaagcatgcgcatgcctgtgtgaagtattcagaccttctcccgcttgttatattgttgcacggtgtcctctgtatgaatatttgtaaggatggtaaatctagcgcatgttgagcagcgctcgctcttgccaccatcttaccctcgttcccctcctcttcgactttacacacgtcgtaccatctcacattctctcaacacaacatcttcctccaccagcttttttttttcctgcgcgttcaagaatg

SEQ ID NO: 118 - DNA, 703 bp, Nannochloropsis_gaditana
gagctgtggcatgacatggcactttgaaacacgctcatgcagcatctgaaaatgtgcaggtctgtgagcgggtatttccagttcaagtctaagacggtagcaaatgtttaaaaaaaaaaggctcggaagcgaggaatgcgggaggttggggaagaaacctctgccttgtgtgaccatggcagagtcagaatacttcctggcgattcttatttccgccaccacaatgacttggcgtgagtttttggacaatatcgtggcgtatgaatgaagtggggcgttcccacgtgggtcagtgttttttggcaaagtaattaattattggttgggagggcagtgactatgctcgggcactcagcacaccagatatcttggtatcccgtgacgactcttgagtttcatgatccttttactacttttgcaaaaaacacagaggcagcatgaatgcagccaagaagtttgccgagaacctgggtagcaaaattcccaagggtacgtttgtcaacataatatcagggatacgaggatgggggaatgaagcagcaggaggtctaccatgcatcacagtcttctgcctgcttttcacaacgcgcgtaccatgtcgcacggagttaagactttttcgttccctctcttctctatgtcaggtgctggcatggggggtggcgcgggtggcgggggtggagggggtggccccgggggcatg

SEQ ID NO: 119 - DNA, 703 bp, Nannochloropsis_gaditana
gcggtgggggcgcaggcggcctacaatctgtcaaaccaaaattcactcccctgacacaaaaacaacttggatcaaacttaccaaaccttttgtgatgagccctatgggaacctctaccgatagtggcctcctacaaaagatatgagaggaagcaaggctcaagatccttccactgggacgtgtctgttcccgaacacgcctccaagatcaaccccattggctcggatgcgaccacacagcagtctatgatgccctcaatgccctcatcaggcctgcaagggtgcaatcctgcacacagcatgcgccaggcgtgtccttttcggagcctcccgaggccagcaaggtgtcgcgccgtcgcttgagccatcgctgccgccgctctcggaggggcagaaaaaattctgcaggaaaggtctttagcgtcggagcctttccttttcgcccatgtccgggaaggaaggggagtaagacgactgcagcaatttctgcttggacaagacatgggtcaagtgccagaaatggcatctttgtcggcatctgacacgcagctttggtaggcagatgattccgacatgccaaccgccatcgggtctcacgcatccgagcttcacataccttttccaggcaaaatcctgggaggcaccggcagtccggcacaggagtgcagtgtcacacatgactgccttctttcggcgtaggaatg

SEQ ID NO: 120 - DNA, 703 bp, Nannochloropsis_gaditana
cgtgaaggccagccgagataggggataaaaaaggttccggtgccaagaacctcgatgccactgaggagactgtagcaaacgccgtgcccagatcatgctattccgtgccacgggacggtagcggtatagaataagaagactgtggcttatcggcaccctttcgacgtttgtcggggaagccgaagtaacgggtggcttgccctctctaagctctgtatttggtgcatttgctttgcgagcctgggaataaatgttaaacttttgagaaatgttgtcttcatgagtgaagttacctttttgcatgccgtgctgacactcgtttgcttgcttagacgtacgccgcaattcaacctcctctatgtcttcgatctcccttctcactgtaagcgagtactgaggcagcgttcagtaccaatatcatgctgccgatccacaaagacgactgtcgtgtgcattcgcagaggcctacatccgttgtcttgtctcagtgatgcaattcttagctggttctagcccgctcatgtgtgtctttattatcattaagtactttctccttcacctgcacgatagatacgccggcagcaaggatcgactcagccgttgttgaactgcaaaccatactaataaactccatcgcgcccgcaaacccacgccaaattcaactggaaaagcattggcagggatgaaggtgattgcattcatg

SEQ ID NO: 121 - DNA, 703 bp, Nannochloropsis_gaditana
ccccaccgctttggagagggaggggatgaggaagagggggagggacggcggaagggagggagggaggaaccgacggaggaggaggtcgctgctaccctcgacgccatgtaccagtacttgcgtcaggcgtcggcgtcggcgtcggggacttcgagtggaagcatgtcctccctcccgccctccttcccttcctcgtccttgtccgcgtcccctttcatggcttctcgcgcctccacggaggatggcattggcctggctccttctggggcggagacgaagaagaaacgggcggggaggaagggcgcagggtcgtggaagcaggaagccgccttgtccaaggtccgagactttgtgaccgcgcatggcttgcgggagaaggtgttgatggatctggacgtgccgaaccgaccgaagctgaagcggaaggagttggtgggagtatcgcccggcctctttgagctggaccgagggcgggattcgctcccgatcttgtttggggggggggagaggaagggggggaggagggggaggaggaaggagacgagacggaaagcgagtgggaggaggatgtggaggaggagggaagggaggagggagaggcggaggcggggatggagggaacaccggtgaggggaaggatgaaagtgttggcaagaaggagagaatccttgcttgcggaggtgagagccggagggagggaggg

SEQ ID NO: 122 - DNA, 703 bp, Nannochloropsis_gaditana
ttacctggcttgcacggaaagtgcagacagaagtatgaaaaccgtgcccatgcagaagatacgacctgagactgagaccgttgtaccttccattattgcccaaaaatcacgagttgtcacctgccgacagcttttcaacccacgctgcaaaacatcgtccgtgcaccagtttccaacaaatgggcctcgcatgtgagcttgggctgaagatagcggagggggtcgaatgtatccctagctgtttatcacagatgggagggcgaataacgcgaaaaaatgcgtcggcgaggaagctatggtgcaggcattcgcaatttactcccgcttgagcggaaaaaatgcacgatccgtgcgacaacccatggccatactatgcctcacccttgtgatttttcttgccggtgctgttttaggagagctgtgtttgaaatgtagccgagaatttatcgcaggtgtgcccttcatttgaggacatttttcagccccctggagggttataagacctatgccccaggcattcgtttctctcgtttcagtttcatactggccctaaaataaggagctccgcacacaaacattcctactgtttcccctaacacactaaccgagacccgcctcctttcattttttggcggcttagaaaagtgccatatattccccaccatcgagacgcacggccgtgggataaccgcttcccgcaatg

SEQ ID NO: 123 - DNA, 703 bp, Nannochloropsis_gaditana
aacatagttgcccgcgttccttgcgtgttcagtagcaaggtatttacgaggcggccgtatcatatgctgtaaagcagcatttcttcatcactcctacctcccgatcccttcaaaaatgtgcctcttcatagaaaaggagctccatgatgcatgaagagtgtaaaagtgatactcaacgtgtcgcgcgtgaagtgctgtcctacgctcctgcagtggacctcagtaggactggccatgtcatgccatggatgtttcgcgacatcccccgttatccccgcctatctttttaagatttgtgcgtgtgagcctcacaggatgacaatccaggcgcactgcgctcgcaagtgtggaagcctttgccttgcattagacaaggctatgtaaatattgtcggtaccaaagtgacgggcatgtataacgcgctcgacgctttcaacttcatcctgaaccccatcatccatcacagatctagtgtattacaaggctatcatcagccttcacctcaaagaatcatgggcattgatttcaccgacaaaattgtgaaacggcgcatcatcaccggttcggtgctcagtctcctcatcgcgctatccattgccatgacctgttttgacgcgaagaaggggggcgcctacattatggccgaggacgatccatccatcatcaactacaacgcagccttgcccaccgaagaagagcccca

SEQ ID NO: 124 - DNA, 703 bp, Nannochloropsis_gaditana
tttttcttctcttccttcttttttttctccagctccattgccttaagttgtgcttccaattccttcaattcattgctctttgctgcttgtttggaatttactacctttttgggctttatcttcacggaagctgccatggcgttttcctgctcttccaacgccttcagctctgctttcttggcatctcttgcttgtgctttcctttcttcctcttccttccgttttgctgtcctaagatctgcaccatcgcaccaagctgccgcttcttgagcctcgagtgctgctgctttcagactcgccttcacgctctcattagcggccttcttttccatggccgccgcctttttcgcgtgaacacccttgggtggcatggtggccctatgaatttgatgaggtcgcgtaaaagagatccttagaaacgtgccttcatgtacaaagcggtgataaaaccacaattattgcggtaaaatggatatgtgacgacgtgagtcccaggcgagcctttcttcgtcagtttccaccccgcacggtcccgtaagatatcactgtctgggaaacttttctggttggcgacaaggctacttgtactttgcacactcacgcaaaacttttcctttactgcaggttagaggattgcgttacatttcgggtgtgcctgccgtgattcgcagtcgtaatttccctccgcctcgccgtcttcatg

SEQ ID NO: 125 - DNA, 703 bp, Nannochloropsis_gaditana
cgcagcaggaaacgaagcaggtctgcctgcttcttgcgccaaagctcttccaaaaatttgtaggcccccatgctactgcaaaactgtatgccataaattttataaagcaggtgatagtgggcataaggtgaatgagatgtcagtgtaattgaaaacttacagtacacagggggagagggtcgactgaagaaaacgtggtgagcagtaactctcaagcaaaattcaccacaaaatcgtccgtcattctgtcattcaaagcaaccaactcccgacgcacgacaaaatgtgcccgtccgccaacaatcctacagcatacacccaaacaaacaccactttcatgccataatcagggaccaaagggcggcggcctcctcgccctccattgcgcctcgccagccgttggatgcacgcactcaaaccgcacacagcacgtcctagcgcccgccccacccccatgcacttgttccagcgcggcctggggggatgccaaaaggtgccttttcatggtttcacagcggcttcctgtcactccattaattacgcaggtgtcctttccgctaaacacacaccctgagtcgcatctggtcgcctttggcctgccagggggtagcagagcaggaaaatcgcggcactgcatacactcacaggaagtgatgccctctacttgccattatctcttctgccctcacctctctaaatcatg

SEQ ID NO: 126 - DNA, 703 bp, Nannochloropsis_gaditana
ggcatttgccctcgttctattggtggtgtccggcattcagcaactctccctggggaatgtgtttgatgacgaagagaagtctgcctcgtcgagtggggccgtggcccgtcgaatgaacatgcggaatagaagtttcttcaagaagaagtaaacgaaagccaggggaaagtgtgagggcagttgcaacgcttcatgtgtacatatgaaatagcgatgccagctttaacaatgcagggtccagtcaataaagaggagcaagaaatttgaacttttgatgcaacaggataacgaaaccatatgacagcacgaaatagaatcgctatgcccaaaactttatacttatttctttcaccgatatgttgatttgctgtagtcttcgaatggaaagtgctgcgaagcgtttttttgagcggctcgaattgattggaccgcacccttaaccagtctcaaggaggcttgtgtgtcgtcgctgagtgtgcgcgtgagaccccccgattgcattcacgtccacgtttcacgcaagcgacaccttcaagggacgatgtgccgaatgttttggagcgtagggaggcgtcggcaaattttggctgtgggcttgcaaagtggaatgcaggtttgagtcgtctttgcctgccccggcgctcctttctcacaataattctcgaaccgcaaagcaatcaaccataggatagtggccgaaatg

SEQ ID NO: 127 - DNA, 703 bp, Nannochloropsis_gaditana
agtgttgtactccaaaacatgcatggttttcctgactatcttcttctatgcctgatgcacttctcatccttgctcgcatttcttcaatattgacgttgccagactgggcctatgaccaatgggctatccgtcgcctccaaatcactggccgaccggacttagaggtgatattgaagcagcgtcaagaggagctcaagaaaaaagacttttcgtgtgatgacgaaggggaatgcgaaattgattgggataagctgtagagtgtgtagggcaaccattgacagtgagggatgggtggcaatgagaatctgttcaacgaaggtgtaggaagaattttggcggggaggttggtctgcctccaactatgttgtcgactataaaagcaaatggagaagttttggtttgctgttgtggtatatggtcactctcatcattagcgcccatgtccatactatcattttcgtgtgtcacgtgtgtcacgactgattttaccactttttccttcctgtttgatgtcattttgtcaaattgaacaccgcctttcgccgccgtccgacttacatcgcacgccccaccgctcataccacatacacacacatctctgtaccatttcaaacacataaacgcacaacacgcacgtgcagcactacgactgcgatatctgcgaggacgagggactatgttgcgaccctgggggttatgtcga

SEQ ID NO: 128 - DNA, 703 bp, Nannochloropsis_gaditana
gagggtcatgccctttatgggcacgacggcaggattttgatttttgaaagaacttctttcggctgtaagtcttcaaaaaagaagaaagcggggacggaaacttcttgcttgtgtgttatacattacaaagtcctctacaattctacagtcctaattgttcacgcgacttcacgcagcagaccagatttatagctttgcatgatcgtctccgagcatttcagaatgctataatatggaatgatcttccgctggcacctcattatgcgatacgcactccatataaacacaggtatccctgtccgctatgctttcatgaccacatgaattcagtggctgagcacgcacaaaaggcgacgtccaggcaatcgggggacatacagtagcacaatacttcctaagaaagatgtcgtacgccgaaagacacgcaactacttcaagagggatcgatatttctttgaattgtaggtgtaacctccccccacaaacgtcgacgtatgcgataatggcgacgatatcgcgaggccaggcgcaggcgcgcggtttcatgacaaatatagctgccccatatcgacacagtcttatctctcgttccccgcacgtagaaatattggtcgtgggcaacaatattcaactcctacacctttgagtgggagtctttctcagtggctgagaaccacttctcacttgaagttggctgataatg

SEQ ID NO: 129 - DNA, 703 bp, Nannochloropsis_gaditana
ccgcttccatctttgactgaacgggacgagttagttgactcgacaggataagttttacagacaaaggggaactagaatcctcgacaatggactcgctcgattctgaggtgctctttgagcgaggaaggcctcagggaaaccctgcgtacacagagttaaatgacacgcctaggccacgacgttccggtagggctcgcaacagatcgatggtgaggagagatgtgaagacctgattgtgggaaggggtcgtccatgcgtgggtggggtggtcagcttgcgtttgaaaggaacaaaaacatactttccggtgcccaaagcttcgctcgtctcgctcccgtcgcctgccacagaccttatcaccccaatgtgtaaaaaagaaaagtgtcttttcctcttatcttctcacctaaaaatgtcttttgatttattcaaagtagattgaacatttgaagcaccggaatgttctttttcaatactttttacggtcggattgctcgctgtggctgccaagcttcctctctcagtctcaatcctgatgcctacctccatcactccaataggcaccactattcaactcaagccttcatggtgaacaaaaaacgaaaacaccgtgtgcgcgttgcattgtcagacttggaacagccagaaatatgcttgggcacgctcctgtgcgggaaagccggcagtgcgggggaagaggatg

SEQ ID NO: 130 - DNA, 703 bp, Nannochloropsis_gaditana
cgaatttctagcgagatgtcatgagggcgccctaaggggaagaagacaggcaaagaggtcgattcccgtccgcgcacgttacttgaagcaattggcgagtggaacaaagacacgtacgtgatatgctccagccttgttagttggacaaaacatggcagaaatgaggcgtaatcactccgactgcacgcagcacactagggaaagcaaagagtcgtgtggaaaagctatcagtcccctggcggcgggattggtttgcacacgattgcggatgtggtgcctgaggcgtatttttttaatagacgatatcacaacttgcgtggaatcgaagcagaagcaggagcttgctaccttgcccgcttcttgcggaaacggcggtctctttttctgtgcactccgtggctaattcactgcctgcatccccgtaccgactgtgtgtgcaggtgtgcttgcgaccacctttttccatcgccttggaaaaagagaagttttcatcccaggacgggaaacctctccggcgcactttcctcgcattcagaacaactgcaaccctttcaaaacatcagtactcgccacgctgtcacttcttggaatcatgccgtacatcaccacatctcgtcgcttttcatgcaacttgttacttggagtcattgtcgcgcttagcctaggctgggttcatggtaatggtccttgcactctaccgatg

SEQ ID NO: 131 - DNA, 703 bp, Nannochloropsis_gaditana
gtccagcacacccaatgttagctagttagggttaactagttatcgagcggatgggacgtggccagaagaggcatgtgcgaggagggaggctcggggggataggaggggggtagagggggaggggaggttcggagactagcagccaacgagggcgggcagcgagctgggccccaggcgagccggcggcggggagatggggatcaatcgacgcctgccgcacgtcgaggtagcgagaacgagcccaagtgaagggtgcccgatggggtgtatcgcgaaggaagcgaagtttgttttccttggggcttcagtgcatgtaagagtctacgttgtggaccatgaaaggggcctctcgaattgaatgccgactagcacggatggaggacgtacatacccttgacattgtccaccgttttccctttcatattcgggaaaattttgtctgaaaagttgtaaaggcgtttacaacatcttacttgaagtctctaggggtcgaacggatgtatctatctatttttgttacagtgcaagtcaggagcctacgtgcacgcgcattttttaggaaatcgcgtaccatacacaagctagcgcacgacgacgaccaataacatgcatccaactagtgaacttcctggtaacataaaaacataaactgatgaaagtcttataattcctctcgtctggtcattatagtgcagtagtcatg

SEQ ID NO: 132 - DNA, 703 bp, Nannochloropsis_gaditana
tcagggagtaaccgctgcagatttaggcgtgcgaacgggggaaaccgaaaaggtcgcacttcgacgtaaggtggcgttagggctgcggaagaaaatggatgacgagctcgccaccatgttcaacgccgtcgaggagggcgacctggaatccgtcaagctgctgcttgacaagggctttaaggtaaatacgaccgactacgacctacgttcgagcttgcattttgctgccacgaggggcgaagacaaaatcgtagaactgctcacccaacggggggctgacgtgcactcgcgagatcggtggggccggaatgcgcttcaggatgctatcgacaatggatacacagtcgtggcaagcatgctggcggcccagggcgctgaactgagactgcgaaattcagcaggtcggctgtgtgcggcggcgtttactgataatttgttcgagctccagcgtttgatcgagaatggcgttgattgcaacgtcgttgactacgatggacgcacagcactgcacctaggggcttgcgagggcaataacaaggttgtggaatatctactgctgcccataaataaatgcaatccaggtgttttggatagatggggaatttctccactttttgacgccatcaagcacggaaatttgtccgtagcacgcgttctctacgagaatggcgcccgcctgtccaagggcaaggcggcaacattt

SEQ ID NO: 133 - DNA, 703 bp, Nannochloropsis_gaditana
gcctgacctttcttttccagatcctcctctccgatctcctcgttatgttttcttgtggtcgtgcgattataattttcttccacatgtctctttaaagaaaaagcgaagacaaattaaatatttcgctgagatccagctccactccggctgcaaaccagcatgttgctttttcgtgccgatcctgccgggattgcctatagtctgaagctctgaatagctcgtctgtctatcctctcgtatccttcggtttgtcgaccgtcataccgccccaagaccacgtcatgagatgttttgaactacacacatcgtgactttgcgtcacattttcgttctttgtaccatttggctacccaagctggcccgtttaccgaaagatcataaaagctggatttgtcagtggcccatgccatgttccgatctgttggctgcgagggcgagacatgccatcgatggggcagggagccacccatcaggtcagtcggtgtgtcttcacgaaaaattgtcctctcattttttcgaatttttgtcgaatgtgaaagtgcttacatgcatcttgcatatcaagccatgtgctttttcccgaaatcggaggcgtagacaaacgaaccggccgagtatcttcatgcagtggaaagctgatgggtgaagacgttgacgtagtccgtcattttttctcctcacaatcagcacaaccatcgagatg

SEQ ID NO: 134 - DNA, 703 bp, Nannochloropsis_gaditana
taaatccgtctcaacgcgtcctcaaggataatgctgcctttgatgccgagggcagtaagcgcattcctggcgcgatgattttggtagagcgccgatcctggagcgaagcccttttgttcgacaggaaggggtggttcatctcgatgtgggtcgtggttatgatagtgaatgcgctgtattattttctgagcgtacctttcattatcgccttcctgcgagacgagattcttggtgaatatgaaagctgtctttgggttgcatatgcttttgattgcctcctactctgtgacgtcctggtcaagctcaatacaagttttatagatacttcatgcagtgttttagtcgtcaatcggcgccgaattcgtcatcgctacttgacgggaggtttcctcagagatcttgtcgggatgctacctgtcgatatccttgtgcgatttttgggtggctcaggcacgcttgtggcgttcctgcgtctgcctaaactcattttttgctaccgcctcgtcaattttttcagacgccgctccctcaattcttcatctcgcttggctgtagatcttcaagccctgcttttctcagcgctcggcatgattcacattctaacatgtgtttggttctttatgaccgagggtgatccgggcaattatcaggccttgagcggttatgaagattacggaaattacacaaatgatccttccggtgg

SEQ ID NO: 135 - DNA, 703 bp, Nannochloropsis_gaditana
agcacagcccagagcatgtccacgcactcgctagacttcacagtcgtaggcggtgatgacctcatggaaaaggctatggatagcattgacaaagctaaaaagcggagcaaggagcagcgtatccgctctttttgcaatgcggccgccgaagggaacatggacatcctgcagcgcctcctccggagtggtatcgatataaatggacgagattgtaacgagcgtactgcactaatgctggcgacctgtgcagacaatttcgagcttgtcaaatggttagtctctttgggagcagaagtgaatttgcgagacaagtttgggggctccgctttactggatgccatgcgtcatagtacacccttgcatatggagattatgggctttttaagcaaacaaggcgccgtcttagaactggacgatgcagcgggagagctttgtcaggcagcagcagacggagagaaagaaaaactggctcggatgcttgaattgaatacatcaccagatgtagctgattacgataaacgtactcccctacatctggctgcttcagaaggtcgcctagattgtgtgaaactcctgctggagtattgggcagacgtaaaccctattgaccgaatgggtgggactcccttgtcggatgcggtacggcatgggcaccttcacattcagacacttctacgccagcatggtggtaagctcaatatgg

SEQ ID NO: 136 - DNA, 703 bp, Nannochloropsis_gaditana
gacaaatccatacagtgacagcacatccttcccaagattcatgcttaccggagagcctccgagatgccggcaaggcggaatagaagcaaggtttcgggacgcaactttagctctgtgcgacgcaagggcaagataggaacataatgcacacttcccaatttctcattagatgatcgagtcatctgcaagaattgggctagacaaatggatgacacaatgctgtccgcgtcggcagcttcgtttcccaatactactttgacccgtgccttcttttcattgcacaagagcagtgccgctcgacccttcttcaaaaaggtcggtaagtcttgtgtggttggcgaggataatatcggttccatgtggctcgagagagtcttccgtgcaacacagtatcgggagaccaaacgataggggaggttaccaaggggactgcagaccgaaaaagaaaaagccaccgtgaaggcggcgcatactgttggcaaggcgcaggagatggacgacaatttggaagaagcacgcattcagggcctacttttggcctatgatgaagaaatagaaagctttatataattcgtgtcacagcgggcgaaagacggacctggtgctagactctccgaccgacaacttgctgaacatgcggctgtcagtcaaacattgtcaaggtcgtgcaaaatctggaacccttggtctgcgtgacagcgtg

SEQ ID NO: 137 - DNA, 703 bp, Nannochloropsis_gaditana
agcgagggtgggggtcgagtccatccctagcctcaagcgagagatgcgagttgaggaacttcttgtaaatgccttagagaggcacgggatgatagatgcgatatgtatatcctctcttgtaattttaattgtcctttccgagtgagacgcgtgcattacgctggatcttaccatcccctacctcccctacctcccctacctcccctacctcccctacctcccgactttcctcgaaggagccatcagaggaatgtgcaggcccactaggcaagataagctacatccgcgtgctagtaaaatggccttcgtccttcttttaataagaaatacaataggaagaagggttgcaagcgattcgttttcgccatcagctggtttttcatgtcaaagtcctgtatctacattcgtccgcgccggctcttgcattggctcctacctacccgcgaggtactcgcttgggcgtggcggatcgaccataagatatctcactgaggatgaggagggaggcatgattttgtcgaaaggaacgagatcagtcgtgacaggatcgaagcagaggagaggccgcaaatccaagccgtggcagggtccgtttgcttaccatgaggagctggaactcacagtggaaagcctgactaaccttggttgggggatctgtcgtgcatcgttacctagtgtaccggatgcacaatcccccgaaatg

SEQ ID NO: 138 - DNA, 703 bp, Nannochloropsis_gaditana
agcaactgggggaggaaagtcggcatcacttttctctaggtgacaagctctccagcgctttccaaagaattcgtgtctgggtgacgctcgcgactacagggaaataatcacagtggtaggaaaatgtgaaaattttaaacgcaaattttccttcgccgggttttaaaaagagtgccatgcgtgcgagtcttgcgaagcgggcatattaccacctgaccctgacgctcactcgcaggcgccgacaagcagccggccaaggaaggttttgagcaatagttttgctcgaaagctagccatgaatgcgccacgaggatctcgccaaatttgtatcggagtgccaaaaggggtagtcctggtcccaggcgtgcattcggtagaaactcggccatgcctgattcaagctcgctgggagcgacccgaccggtggggcgccggaccggagggaagtcatggcggacaccccgcaacgacgacagctttacagtcgtagtctgcagggctcctccgcccaaataccttatatgtcaaggtcattgtctgctcgcgccgtccctgtcctcgagcgtgtgcgcaaagttttcgtggaattaaaagggctgtgcacgacaacattctaaccgacgtgctctcttgaatcataccagggaaaggccttacggtgggctagggcttcaaaagtggagcatactctacactgtagatg

SEQ ID NO: 139 - DNA, 703 bp, Nannochloropsis_gaditana
tggcctcccaaggggaaaaatcactgtcttcatcttcctcatcggacgatgatacctcctcctcctcctcctcttcagatgaggtgtcatccttgacgctcctgcgccgcaccataattacaccaggcacaggctcttgtcccaaacgctgtgcctgagagcgggtgtcggagtgtaagtgtgggagggcagtcgagacggcgaggaccaggcgagcggggctcgagccctcatcttggccccccaggctcaagcaacgggtttggacaggcaggagtcgcgcggacactggctttacgcaggggcgtgcggagagcatcgcggcccccgcgctttcgacatgtcatcctcccatgacgtgataggaaggatggtggggacgggaaatgagtcatggggcctttcctgtgtggcttggatatcttgactcagtccgtccactagatgcacttggggatccggcgctgatgtcaattagagctgtagagccgcgccggaattgcgtacatctttctaagcccttttttaatgcagagcgtgaataagtgtggtgtcgatgacctgatcggatgtcatatgtgctcttccaactacaaaatcgtcactccacctcaagtgcaacagactgctccaacacgactcaccttccacgttgataatttcaccgcgcaggtttcgcagtaattaaaaaaaagaagatatg

SEQ ID NO: 140 - DNA, 703 bp, Nannochloropsis_gaditana
tgaaattcttgctccggcatcgataaccacgaaggaaaaggaaacgatacctcatcctttccgagttgttttttatattatttctctacccgtcaactgcaacaacgacgcagatagacatataatgtaggggatgaatagacatgcgacccacttgcttggtattcttatcaagagtgggaacgggcatactgccccaagacgcacgtgtgggtaagtgaggtcatttagtcacgggtatagaaggtgaggtcttttccatcacaacctcgccgcttctcgatggctaggaggaggccagccacgcccgtcgcccccgcggccgctatgcgctcaacagagaagtagttttcatcattgaaacgttaacgataacagtgtgttgtagatcgttatagagatctttcaatggtgggatgtaatatttgtgggctggtggagaacgaaagctatttctcggcgcaacgagcgaagggaggagagtgatagagcgggcaccacgagatgtctgtgcagtgtgcctaccctgcccgatagacaggggcttcatactacattgtgaatattttttcttcataaaaagtatcatctctaagtatgtgctcggttcggtcgatcctgccctccattgtctcaccacttccctgcttctttccttaatctgctcaatcgtttgcccttacttttctcagtaggaagaatg

SEQ ID NO: 141 - DNA, 703 bp, Nannochloropsis_gaditana
attggcgattaataaaaacttcaggcgtggcgtagatccactccgtcttcttgagttgggcagaccaaaaccactttttgaatgtcgcattccccagcgcggcgcccatgtgactctgtacgagcatcctcttgggtcgtgtcacgttcgcacgcgtccatccctctcgactgacgctacaggtggcgcttacgatatgtcttgccactctacacgttccagcctacggtgacatctcaaacgcatcgccacgatgcataacaccatttgtacttgtgagcgtgcaattatgttgccacttcgattttcgacacacattgtggggccactcccgttcgacctcctcaccccccaaagcactggaaagagcatctacttcgtaccgaacaactggactaccagtccacaaagtgtttaccaatttgatacctgatttctttttcggtatgctgatctgtctgctcttacctacatgatagaggcaatgcatccgcttgcggaatcttcacatgcctcgccgtccgcggcagcaccacctccaaggaacactcaccgcatcgcactcctcctgctcaccttcctttctttcatctgttcaagcacctccttcttcactgccttcccggcatctttcacgaggccgtccccctggtcggtcactcggcgccatgccgccccattgttccggggagtccttaccatg

SEQ ID NO: 142 - DNA, 703 bp, Nannochloropsis_gaditana
cgcgaggcgtgcgtgggagaggaggagggaggaggaaggagaggacgggaaggagggaaggagggagggagggaaagggaggggaacacttgtcggttgcatgcccgctaagcttacccctactcatcaccggatgccatggcctaccactctccctccctccctcccttcccccctccctccctcccgccaggacgcaccggcccgaatccaggacttggtaaagtgagggaggatgtgggtggcggtgagggcgtcgtggcaagccttgtgcacggcgaattcaaagagggaaaactggaacttggtcaggcggtagagccggtctcgagcctggtaggcccgggagaggtgggcgagcacggggaggacgaggaagggggaggaggcgtgggtggcctgcaggaaagcgaggaaagcctggtcgggaagaggttgcgccgcctgttccaccagctcccggaactgcatgaagtgcgtgtaggcacgttggaggtaggccgtggaacgcatgacccgcaggacgccttcttggccgcggtgggagagggggatggccttgtcgtagcattcgatcgcgcggtccacctcattcttgtctagatgagcgttcccctggaagttgagcttgaggcagtccgccgacgactggttgatgcggatgccgagctggctggtgaatacgtcgtatacctgttgaatg

SEQ ID NO: 143 - DNA, 703 bp, Nannochloropsis_gaditana
catgcaccaccggctggtgcatataaaaacttgctgtacggtcaccggatctccacgcaccccgctggaagctggtagggggggcgtcgaactccctcccctggtcccagacgtaccagggtaggccgtggagctgacttcgacgtagatattgccccggacgcgccttaatgcacgtccaggagggggaggtgaggaggctgacggggacccgggcgaggcacgttgcccgcggatgacagaccctggcgaaaatccatgcgcaaccagagacaggtgcaaaagtaaccacaagactgaaaccacgaaggaggccttacgcgcggggtaagggaatgatctcggactcgaccgcattggtgacataatgggttgttgaagctcgtgacgcgaggcgaccgaatgtggcgaggagcaccgtgcggctccgctaagaccaaaatatcctggacacccggaacgtacaactaaccaacgcaaccttgtggcccttcacgaagacatgacaccggtcctgtcaggtgtaaacgaatagtttgttcccgtgcgggtgagagcgtgatgaaaagggtgatagaggcttcaaggctcgccagccctcgctcaagcctgttttcatacgcccttcccatccaacctgtttctaacatacaatccacccacattcgccaaacttggatcgaaatggcattgaaggtctatg

SEQ ID NO: 144 - DNA, 703 bp, Nannochloropsis_gaditana
ggatggaaggaaaatgagtcctttacaaaaagaacgtgaggtttgctggaaggattttcggtcctaaaagagctcgatgaacagagaagtatgatcatacaccatttataactgtgtcatcgtaaaggattgcttaagtgtcttatttggttctgtagaaagcattttctctcaatgctttcaagtcaaattttgctgcgttcgaggaagagcttgttttgcaagctgtgcgagcaaccgcgaaagctaattccaaagtcgcggttttgactcaggctagtctctcactattcagaattgtgagtatgatgacagggagtgaagccttcactgccactgtcaaggcctgtattaatgccggagagccataattagaatatccagcgtcctgaccgatccgatccgtccgctgcttgcgttgaggactgcggtgataccatccatctctatttctgtttgtatacaaatcccaagtttccaggctcggtcaatatttgagcagatacccagtttttttgttatttaacgcctgtcgtagcttccaaaatcatagccgcctgatcactacaccagcgattcgagggaaggtccaagcgaggaggaggaccttctagctccattaactaagctgtctcgttcacataccaacaggagattgcatttgtttctaccatctgtacttcctgtactattgataaccatg

SEQ ID NO: 145 - DNA, 703 bp, Nannochloropsis_gaditana
accatgaaagtagaaatagataggaaaaagaacgagaatcatgagcatcgcctaagtcagcatttcactttttttttaaaaaaaagggcatctcctgtagtaaaccgccagggtcaagccatacccaaatcccaagggtgtttgtcgcacggcggaagtagtatgtctcgagctagtgagaagatcggatctgtcgtcagtgagaagatcggatctatcgtggaacacaaccacgtatgacctgcgagcatgcaacgtgggcttgaaaaataccgtgggctggcctattggttcccgtgtgcgcgtttccatcccagaaacattagtgtgatcatatgtattctacggtaatcacattcgagtattgctgaggactgatttcgagcgttcatgtttcggcaaaaatgttttcttgtcatgcagtctcacgctgggtcgaaccaaacatctatttcgacagaaaatgaccacacacacgagaagagacgctcatttgttgaggatggcggccgtccttcttctactctttggcggcagccaggcgtttttcacgcctgctcgtcagagtttgcgtcctgtgattcgacgatcaagtcgcagtcggggagcgctgtcggctgtggacgcgaacgacctttttcaaggctacatggggcttatccacacacaccctttgattacgaaatgtgcaacaagtgctatg

SEQ ID NO: 146 - DNA, 703 bp, Nannochloropsis_gaditana
cttgaatatttttcctgcatccatcaatactctccatcataaacattcacaactatgacgatgaccttcagcttgtgcccaccttttatccagcaaggtttcctttatgtcaacaagagaaaacagcatccgtccttcctcatcatgccagcaattgcatccaacacatttgatatatcgcatcactggcgctgcggcgcaagcgcggattgttcccttgctgcaggagagggctgaagtgcactggtgagcatcgcgaaggagggaggttggtgcatcgcgaaatgtttcctttataacccgagcaaatcacgaattccatctttcccaaaacgagaaatgactcaaacgttttcgttcgtttcgttttcgacatcgcaggattgctggtagatgtcaaaatgcatgtaatcaggctgatcctcctgtcccccttgatttcgtctgggagacccatgtcgcgcgtcgggataagccccttcatgattgtgcccgtgttctcaatcgtctttccaacactgttatcctggaaaataaggcatacttctctcacattctagcgcttgtatccagccaaaatcaggacatacccgttctggagaccgcagtagttcgagccatggatgcccaagcctggcttgatgcacgccgaagacaattacggacagtacaaaacgcaaattacaccgtatttacagattgc

SEQ ID NO: 147 - DNA, 703 bp, Nannochloropsis_gaditana
gcgtgatgcctttcttgtcggggacgggggcgaaaaacgaccacgaatcgaagcaaggtggatggagtgaggttgtaattaaagacgttgacgaaaatatgttcgtagacttggcgagccccggtgataaagaaatccaccacaacgtccttcgatgggctatgcatatgcgagcgtgtcgaaattctgttaaaacagccatttgtgaaaaatgaaggaaaagatggaacataacccggaagatcgaccattctggtttcttcctgttgtcgtttgtcaccagcggtaggattggcctgtgatcacatctcttatatagacacaataccatcaaaagtctcccaaaaacagaacaagcaaaggttaaaaaccacgagatgtgaataatgatttttgaagatcggatcgctagaagtgcgtcagcatcggaggcgaggacggcccttcaaacaaccgggccaagtcaagtgcaacccgcgcgaaaccttgggtaatatgggaagaaacattcactgcattgttggtaatgagtaaattgtggacattcactatgtttctgtgcgacgtgaataagtggacacgaagaattttccgtgcccgctttctgaccaacgatgcctttcttgctttgcttccttccaccttcgcgaatccttctaattccacccctccgcaatcgtggcaaaggcaaaacagggcgatg

SEQ ID NO: 148 - DNA, 703 bp, Nannochloropsis_gaditana
ggcggctactgttgcttcgttaccagcttcactctgtagtagtagaatttaaaaatccatcgcaatctattacgtcttccagtgaagtgtgacaacgagttgatagctttatgatttatcatatccgacacatgaaacgtcgatttcatgacagatattagcatgtaagcgagatgggcctattgacgcaatctaattactcgtaggactttttgatactttaaagtgcaacataattactttgccctaaaaagaggttgttgatcctgtttcttaaattatgatatgaagcatgtgtcactctgacgcagcaggagcacttgaaatggattttaatcacaagtgcttcacctgtcccacagcagtctggaacgagtaagggtacatacacaccagccacaaactttttaaaataagatattgggtgaagttttgcagtctatggaatgcactggtacttgtgacgtgcttagtctcgttatatgtttaacaatgtaccagcacactcgcgcgtcagcacccctttttgagaaaactcatgcgtttcataatttttattgctgaatttgaatgccaagaataaaaatctatagatcaggaaaatggaagagttccgtcttcctgccacaccaacagctcgagattactgttcacttgagacacaggggcaccttaaggagcttggtttacacaacgcccgatg

SEQ ID NO: 149 - DNA, 703 bp, Nannochloropsis_gaditana
gaaggtaaaggaagacaagtgctgggtcctatgctgctgctccggctgagatggtgaagtccgggcgtcacagggacaacaaatgcccgcacagcccctaggcacaaacaaaacaccgccaacactcccacgtccaggcctcgtcctcgcatgctttaaacctgtgaatgccgtgaaagtgtggtcgtttcgacgtgattagatgtgacttcaaacacctccaaagaaatgaccatgccaccccagcctcgctgacttggcggggatcaagatcggggctccacaatgtgcccacgggcgggcaacaaaccaaaaacgtgctgtgcccctgagcaggttgtgtcctcggatgcaggcacgacccgcggtggggacaccatgtcaaaacgagggcatctttccacggcggcaataaaaatcatgcctgtcctggtacgcaacgcgaacagcccgacggactgtctcgtaatttcctcccgaaaaagaacatatcgctacgcgttctagtcgaaaaacgcggcaagctgcccatggccctgtgcccttgacgaaccgaggtgcgccttgttgttggaatggacgaatgtttgttacgagatctttttctaatttgagtccatattcacgcacaacacggtaccaggctctgccgcatcaattttacctccccgtaccgtcaggagccacttcctcaggctccatg

SEQ ID NO: 150 - DNA, 703 bp, Nannochloropsis_gaditana
cgtctaatctgctcccgctgaggcgcgccctcgatattcgttccaatgaggtgcatccatagccttttgctgtatcctatatgaattcgagatacttctggatatcagctttgtcgtgaaacctgggtcgagaatgattcggggtatttcgaccagggtaatagcggtgtaaacggtctttcaatttcaaactaagtcgccccgagggttgtccgagcgagaaatgactttccttccgcccgcatgttagtcaactttgtcttttccttgccaagattttggtgagcggtacaaagcccaggataaacttaatgcgcgacgagagagtgcgagtgtacacgaacttatccaggcgccacccttctttgtagcgcgaggtttttgtgtcgcactctgggaggaacagtcagacgcacgtaatctttccgttggcccatgcacggtttctatcctgattagacgatcacgtgctaagttctttcccgatatatctctcacaatcatgtatgttataataatgttgtaaactgtcgtaatttggagcatgcatgagagtagctaccatcgacacaatgcaactcattacgcattagttttagttgagtaaactacactataactgcatgaaatacgtaaagtagggaattaatgacacaagctcaatctttaaaccttaaggacaggatttgtcactattacaatg

SEQ ID NO: 151 - DNA, 703 bp, Nannochloropsis_gaditana
attgttaccttcacaactacccccgtattctacaagtgctgcttctgcgcctgctagccttgagttggactacatccacacttcgacacataatgcatcgttgcccagccaagcgacggctttgggctcgctggaccgtgttgccttttgagatgccattgcgtcctcctttttcgggcagcccagacttctcgtgacacgtgaagtgcaccacttgggaagaaggtttcacccggtgtgtttttcagtcgttgccattgctaccgcgccattacatttttgcacactgtggtgctaacaggcggtcggtctgaaagaaggatacaccccctgccctgagtaggctgcgtgccctcatttggctactttttgcacgcgctgtacagctgcatttgccgtactgcattgcacaacagatagtatgagggtcacaatgcggtattctgttttcagtggacacgggcggcgtcggcctgtagcatggagacgttttatgtgaaagagcagctagcctcccctcgtttagttgaccacgttgacaatattttactctcacatttttcattcaaaagcggtaaattcgtcaagtatgcgtcattgtgatatagaaaaatgatcgtgatcaatgacggcgtatgtaagcatagttttggtgctcatccactccctcgtgtcctctcgtttcacatgacatgccagcatg

SEQ ID NO: 152 - DNA, 703 bp, Nannochloropsis_gaditana
ggcagtcacccgatttttagcaacgacatacattgctttgtttacgctgcttggtgtcgtgaccttcggcgggagaaggttgagacaactcttcgcacccaacgggacagcgaaaaccatgggccgttccatgatgcaagaggaacactcttattgtcattcgatccttcccttccagatcctttgcctttgcatgaggccccattcgcgcacaaagtctcagagcctcgattacacccacggttcattatcacctcgggaaatgcatagattgcgacttcagcgctgactaaaggaatcctatcgggcacatcatccgatgggctccttcctcatgggcaagtctagagacagaaatgcagagggcatgattcagacagggaatggcgagatgcaacaggctcacggaggacgtgcccacggcgtgaccaccgagagaggtaccccagtctctacatgcgagaaagaggcctcgcaattgatccagtcgaacgcaaccgaaatctgttgtgggaagattaataagcggggatacgagggcttcaactaggagtgcaaggagagtcgtagggctggccgacggcggggtggcgccacagatcagagccccagggtgctccagtccgttcccttccacgttgagctcccttggaaagaggacatctgcgaagagccacatccaagcacaggcaccattcctccc

SEQ ID NO: 153 - DNA, 703 bp, Nannochloropsis_gaditana
tgtcctgggcgtcaaaggcctcaaaatcgagcgttcatgacagtcagttgcactggtaccgcgttgagccactgcaagcagcagtagaaggagcgacagataattgcgtgcaagcccgcgggcatggctgggaaaaactcctgggggcttccttcttcttatcatgggatgttcaatgctgtacaagtgggtgtacacgtgggcgtgtcaggtatttaagggcatgggaaactaaagacaggcgaccagcgagattcccggcgacggctgctagcagaaacgtacttactcccagctcccaactccactggaaatgactttcattccaggttttgtcggtcgattatcagaaaacccggcgccgtgtattctcactgtaggtcctgcgatcgactttctcccgtgcttgactccatctttctggacgatgcagcgctttgtatggccgtgcatgctgtgttggtgccggtgcttctggccgagtcatctaaagcgtcacttccgtgcattccctttacctaatgtcacaccactttagattcacgtcatttgccttgcctagaaggtaacgtgacgtaaggcgagtgacgactcgtaaaactgcacgcgcttggggcatagcgtctccggatattaatttatagccaaccccctgacccgggcacattagaaataatacaccctcctgcacagtttgctcatg

SEQ ID NO: 154 - DNA, 703 bp, Nannochloropsis_gaditana
tgatgcgttgcattgatattggaggccggctcgactcgagcgtacttgtcagaagtttggacaatgtacctcaggcgcataggcgtgagcggaatagatctgggggtgacgtgtcgccatcgtcggagctatggtgtcgcaaagaaactgatttccacgacgaatatctcacaattgaccgctgcaaaatttgccacaacatagtattggagacgtctacaagttcaaatcatttgaggcacgacacgcttaacagtggattacaaaaatcatgagaccctccacgtacgacggagtgcaacgccacagcatacgttcctcagtctcgaaggccactcccagcatcactgccctcgtcttgaaactttcgctctcactaggccttttggtgtcgggcaccgatgcatttgtctcggcggcgtccttatcttcggtgccccccgcagggagagcgacaacctcgactggattaataattcgaacccgaggcggggacagcaccggcaagagaaatgttggaccgctcttcttccaaaagcgagtgggaggtgccgtggatgtgcaagatccacccgttcttgacgtgcaagaatcccttgacaaacaggaaaaagagcaaaggcgggcacccacgttcatccgggcagtgtcggagaggttaacgcgtctcaatcctgcatcctccgatcgaagtgacgccatg

SEQ ID NO: 155 - DNA, 703 bp, Nannochloropsis_gaditana
agatgaaggtgcacaaaagcagatcaaaccattcaagccgatctccgcaccccgggtactatttacgcacgggaaccaaaactgaagaatagtgagcttgaacaacaatctcgattgaacattgtagtgagaaagacttacggcactcgatgcatcgtcgcctttttctttacctgacgcatttccctcaccccgttttctcagtgccttgaccacacttaccgtttgtcagtctcgatcaaaaccgtcaatccctccgtcccggtgcttccctcttctaccactggtcctcctagtgtggaagcacggcgcatcaacgccgtgaagaaacctgcaacattgggatctgcaacccctcccgcttgaacgcagaggcccctggcatcggcgcacaaagtcccttgtactccctcgtcctcgggcgcgtcacaaacggtgggttgatacaacatggaaatttataaggatatgcctgtgctgtgtatttggggtcgtaaatgcttgcgatcgttcgtgcatcagtcttgttggacgctttgcagtacatgccacatgatccaacctccccactcagctggtatacccccctaagacaaaaccctccatatctcagccacaagcttggagtcggagaactgatccacctctataactacttaaacatgttttgaatttagtcagagcccagtcgctcactgaaatg

SEQ ID NO: 156 - DNA, 703 bp, Nannochloropsis_gaditana
acagattttggcggttcaagaaaagccagcttgtaatttttcaaattgttcacaccatcatttgagaagcatcgtcttttttcccagcgtaccttgttcggcccacctcgagtgttgggggctcaggctcgcccgttgcgccgcctacattgccaaccacgctccgaatcagaccacccagtggttgtgtggtcgtcataaactctctgtgtataaattagttcttgtttgtcaaagatgtggtcgaaatagccccccaatgccgtctgcccattttctcttttttgtttcaactgccgtttcgctagctgtctcttggcgagacgcgagtaccaacagaccacattgacgcacatgcttcctttccgcgcagtgacagcccgacatcgtttttttttcgtctacagctccacaatctgctgtgcttctgtacagtgtaccaggcaggcaaataatgccggcgcttgacttccaaaccttgcttaggcaggaacgaaatagggtgcgtcacgagatggatcaaacaaacaataaaacgcatagcgggagtccacgcgcggaagaatcggaggaaggccatcaacatcatgatgatgataaggaggacacgacatgctttaattttgctgcacgcatggatgctttgttggactctgtaatggcaagccatgtccaatcagccgctcccgaagacggagacatg

SEQ ID NO: 157 - DNA, 703 bp, Nannochloropsis_gaditana
tgactttttcattttctaacaaacgcatacagataacatttgtgtgttgaattgcacacatatatctgtgcaattcatatgtgtgcagtggtagaaacctacgggaggttggttgtctattggcaaatgattttattcctttcgcccctgaacaagacacaagcccacgtagctcgtgtccgatttcacactctaggcacaattcaccggtcgctctctctccggtacaaggatgccacatgccgcagatgcgctgcctacaaagggaagtgtctgttggcccatatgtaaacgttccggcgggatgaccggtatgccacctcagtcaccatctgcatcccgggagaagagagaagtccataatcctgatcataacccatccgtggcggacacagaagccaggtgcgacatacttcgtagtctttccccttgcgattggcagccccatgggtacgtgcatgccacggctatgggatttgctacctggtcaaatggcttggagaaacgagtgccgacgctctctagcgaaggctgatgactcattccgcgcccgccaaaacttaattatcccggccgacccgtcgcattcggacgacacgctgtgggtttggggctggagtgctcggcaatcgtatgcgtgtcttgtcatgttgtgctgtgaccaatgggttggtactaaacgccgcctgtttctttttttcaa

SEQ ID NO: 158 - DNA, 703 bp, Nannochloropsis_gaditana
aaacgagttgcttgcgggaggcgcacccttttccaacgtccccgccacccaaaaagacctgacttgcaattcaaagtgaggattttgcccatgacgacgttgttttgcgtgcatatccacacaaaattccctcaaggcgggggaaacgtcagattgtccaaacccgtcgaatcccgtggcagtatgtcccgtatcatacaagggttcactggtccctccccccccgctgttccggggctttcgacaacgtcaagtgggaaaggaaaggcgagtcctgggcgatcgcacatacgccagctcgcaactctggtggacaggttgcgcggaagatactgtcaggtggatggggtatggttggcatacgagttgcgcgttggttgccaccgggaccaaaacagcagtgggaatgggtggcagagagctcgtgtcggtgattagccattgggtcaataaaacactgtcgtaggcaaggttggccattggttgtcgctcacgtgtggttggctacttgctgtctcgggccagcgtggtcactgcccaaggctacgtcttgtaagccctctaggcaatttcatgccataagaactgtattacatatcttctcatggcttgcaccccacctcctcaaaactaatcgagccagtggcatctaatcaccagtctttttcacattgtcatccatatttcaaacaaaatagtcatg

SEQ ID NO: 159 - DNA, 703 bp, Nannochloropsis_gaditana
ccaagggtcccagacggtcaacaagggcctcaccgtagcaaagcaccttaggaggctccatccccgttgacatgggcaggcggaggcagcgggagggggaggaactcgcagcatgtgaggatgaagacgctagaaggtgcgaggacgtgaaagcctggagggccagtaagcaacagggattatataaatgagcacacgtcatgctagccctcgtataactcgatactgtgcttcaaaacgaacctgtaggtggaagggcatgggtaggaggagtgccactaggaaagctgttgaccacagtggaaaaactctaaagctttttggtcctttaactttgaactccattccgctagaatctacagtggattcacgctcctcaatacacctgtcgtttggaaaaagcagttcaagaatggatgagacggcacaataagttgtcgttgatgcacatgcttgagtgtgacgccatcatttaatgctcgctcatgccttgttccaagcagtcccgacttttcaagatgcaaatatgacgatttaaatgtttcgtacctgactcgatgtactttcttacaggcaaaaaactagcagaagggaaaaataccgctcgatttgttggctcactactcacttgcggctcttcttctcgctctgattcgagcttgttttcatattcgtgccgtccaaaacacggggggcagcaatg

SEQ ID NO: 160 - DNA, 703 bp, Nannochloropsis_gaditana
ttgatgtattctgttccgacttcttgggtcgcagggtcaatccttacatttgtgtcctggatgatatttctttttaacaggctctgaggatgtgttgccaacaaaatatcacatagctaattcatttagtcttttaagtgtacaaatcttgtgtctatctttggtctaagtttaaggtaatgctgggtcttcaagttctaggcaatgtttcctcttgcgtctcttttagcaccagctctggtgtgaagtaattaatggttttttatcttacgcttacgcaacagggatgttcttgcagcatgattatcggagatggaaagtggtgcttctaaaattcatcggtctagtgcaattcgttagatcgcgacaactcctgcgaactaatgacactgctactccgcgtatcaacaatagctttatcgtcactcacagcaaagaacgaaaattttcagattccccacatgttcttcatatttcgagcgtcgctggaccaggactagaaaacaggcttcttggcgtaccattgggtggtgagagtatctcattcttccctctcgtacaaatcgtccttgatccacgaagggtgcaagatcgatctcccagcagacacaagctattcccttcttgtggattcgcagagcctattattgatgccccagggtattgccctctggtgcgcatacttgagagaggcgcagatatg

SEQ ID NO: 161 - DNA, 703 bp, Nannochloropsis_gaditana
atatccgagatgagttcctaaatgctctgctctggccttgatacgtgccacagcttccagtcgaaaaggttcctcttccacgtttattctttgatccttctcagatcccttttccttttttgtgatcgactttccgtatgcgttcattgtgaaaatatcacagaaattagagccaagatctagcatagcgttcaagtcataggttgcagcagacaaagaaatgatatcgccaattatatgcgcgagacaaaacatttaaaaaaatcgaaaaaaaaataccaataggctcggaaaaagtagaaaccgactgctttcgtgtacaaatcgctgcagtgtccacaatttagagcccgaattcatattgtcatgagaactagtattattactcaccgttaattgatctgggctgcgcggatgctcttgatttcccccattttccacttctctcagctcaccggacgcgacacaaacacaggactagcactcgcccgttggcggcgactcgggaggcacttgtgttcttttttcatccatagcgtttgggacgtcacccgtctcggcagtgtgcttgtctagatgaccctgaggctcaaataggagagcatacgaggtgtcgcggcccacagagccaccacatcgatcccctccttgaatatatttatcgcccacaatttattccttccccggtctttccaacacaatg

SEQ ID NO: 162 - DNA, 703 bp, Nannochloropsis_gaditana
gggatactggaggcggacgagaagcgggaagagaggtaaaagcgaggcaattgaatcgacgagagggttgtttggcgtttgcggagatgcggcctaggtcctgcctcgcgcctgtaggatggcgtcagttgaacatggaattatgagaaggttctgtttcttccccgttccggcacaaaaggggtatacgcaagagcagacgggacccaaaaacgtgccaacgtactgcaatgatggagaggacgacagaagacggttataaagatgccgggctgcattgtgattatgccagggtgcgcggcacgctgcaggagcgaagcggaccatggttgacgctctggttgtgagagtgattttagtttaagcaacgaaaagcagccacgtcctagggcgcgagagccaccaacttcctatcgtgggccctgtactacgttgggtgtacatgaatcagagatggaatgccgttgttaaaggacgcttctcctcaatcgttcattgtgtccgtctcgccttaaagccaagtgccgcgtcgaagactcgctcagccaggcagccgccgccacccaccccctcaacctatccacgcccccacgttatctctgttcaaagccacactatgccggctcaggcgtccaccataactcagccgcctccatacctggtttttgacatagaccggagatctcgtcccactcgacaaatg

SEQ ID NO: 163 - DNA, 703 bp, Nannochloropsis_gaditana
tgtctttttgtcctggtcagtagagttgccattatcgcgggataatgaccgcagagggcccgtcccctggatggctgagagcccgggccgcgcctctccttcctcccgtggaaatcgggtctttggccagtttgtggcggggcccaacggcatctaaacgcagaatgggctgatatgtagtctctggacggtcataggagggacagatggtgctgcaccatataatttttccaggatgcttccagggctcgctttgccgttcatcactccttcgctcgtgtcatctcactccaatagtgtttgaattacagcaggtgctttttgccaaaaaagcttgggtctggacgcacgacaatatcttgtcgtccttaatttgattcaaggtacgaagttggacggcgggagaattcgagggctcacgagtgagggaagatggggacactggatttagtggggtcgaaagccccctgtagcaatttagtggctgagctttgcacagtcctgtctgggaatcggccgtgtttatgtgtgcggtctttgttagatattgaacatttatctaccttgagcgaagaggcttggacgttcatgcaggcgacgtctttccatccttctcatcttgttctgccctgctccatcgtaatttctgatttgtttgcagaaaaaaaagcctctttctctcaactactccttctcaagtatg

SEQ ID NO: 164 - DNA, 703 bp, Nannochloropsis_gaditana
gaaaataaactacctgcaggtctctctaggatggacaaggggattttgaaattataaaatcgacgtacgagagccaccgcccccgacgtatatacccttattgagtagtcaagatcttttgggaaggaactccgtatatccgataagagataaacatgaacgcaccacgcatagttcccatcgataaccattcgatcggaagaacgcatgccttcgtggctccctccactgcaagagtccgaccttttgcggcctgcgtgggcatggccttcctggtggataaccggcgcctcgggttgcgacactctctcctcggtggttgcgtctccccacatcctatcttgaacgcccttctgcatgaatattgccgttccagctcgacagtctcgtgcggaccaatctaactgacgtccccctacgtatcttccaacttggagggagttgcaaaggcttcgtgcctttgtgtgtattagagaatgggcttttattcatctcatccgctcaatttccgagcttcgcatgtggtcataatgtaatgatgcgtgttgaatattgcgatacggtatcactgtctatgtgggatgcgaaggctactctcacccatgatactaactttgatgccgaagacccttattcgggatcattcaagaataaacctgtataatttcattgctttattcatacccagtgttttgtagccatg

SEQ ID NO: 165 - DNA, 703 bp, Nannochloropsis_gaditana
ggaggagggtatgctcgagttgggcaaattagttaccgatgaggcaagaagtgatgacatggacggaggcgacacgaatgtaggaaagatggttacaaagcttaatactccaaccaaagcgacaatggaagacgcggctaatatgtacaggcaacgaccatgaccacaaaaactgcgaggacacgtcaatttgttggggagcattggacctaggacacaaggcatctcaggaagcactttgcatctcagaacaatgcggcaaatatacacgcatacctctcaaccacatggaagaaagggtgctgaaaatcgtgaatgcgacgtggcctgtcgatgggtgtatagagaagtttggtacgaatatatcaatatgggccgagagtccgttcccacccggggcgagtgagtggtgagaagaaggctggccatattttatggcggatcacggttggcggtgctcgcgtgcgtggcgctcgcattttggcacgataaacttctcacatgctgtctcgcttgtccttgtatcccttcctgtcgccattctttacaggaaaagagcattttaattgattggacgcagaggaggcagaggatcacgtatccgaagaagaggtagaaggccgcctccaacttacacgcgcggccgctactccacgcaggaactcatcgttaggcagaatcacacatacatttataaaacatg

SEQ ID NO: 166 - DNA, 703 bp, Nannochloropsis_gaditana
ccgtaatggtttaaatccattgagaatatattccacagcaatgaggccgagcggagtagtcttttttgggatcaacttttcgtcacctggccgtgtactcccatatattaaatctctgtacacatcaatgtctcaataatgctttctcatacacgaatttcgagttactttttcggatggggaggcattagttgtccctaattgagttcaaggttcctgatatggccggaattctattattccagtgataatgccggttgttgcttcatggttcaaaatacgaagatcgcgcatttcaagttgtaaacgttgcttaatttcagttgttgacagagcgttgtctggtactagaccgttcgctagtagtcctccatcccatcggcgacatgttatcctcgcacatatttcaagcacatgaaacggcgtggtcgtggactgacgcactccgagacagaaattcctgtcacacactgggttctgtgtactcgcgcaggtcctgccggagaaatgcgagagcagccaactgtgcttcccgtgctgccacttttcttgttgcagtacgtggcgttctcccacgaatgaacacatacgtgtgcgtgtccgatggcgaggcattcgagtcaaatcacccgtacacttgcttacattcgctctcgtgcgtatcctatttgcaaacagaagaaaggagttgcgataaatcatg

SEQ ID NO: 167 - DNA, 703 bp, Nannochloropsis_gaditana
gcttatacctccctgcagcccgcagcttgcacccatctgtggtccactcgagatggggagcacagcaagagaagaaaggccaccatcctggcagcggccaagagcttatatttccctgcgtacgtgctgctggcgggccttctgggcgtgacgcggccccagctgtacgccggcttgagcgagggttttatcacacgcgccctctcggctgtgatggtcctgatgggcatgacactctccatggacgattttgcacgcatcggaagaagcaaacgagccgttgtcctgggatggtgcgcccaattttcaatcatgcccggtatggccttgataatgtcgcgcgtcttcaggctccccccccatctggctgcaggagtcatcctcgttggtgagttcgacggggactgagcgagggggcattccatcacgcacctcttactcttgcccatcaatcctgacacgctgattgtactgtgcccccccaggctgctgtcccggcggcactgcgtccaacctggtgaccctcttggccgaggccgacgtggctctcagcattagcatgacggcggtctccacgctcacggcgggcgcgatgacgccgctactgacctctctcctcctgggctccctcgtccctgtggacaccgccgccctgctccgcaccaccctgcaagtcgtgctcctccccgtcgccctcggactc

SEQ ID NO: 168 - DNA, 703 bp, Nannochloropsis_gaditana
gcattctcttgagcatctccgcatgcatggagccgtctgtggcccccgccacgttgcgctctatcagccattctcgaatcatgtccaccagcaagtagaccatggccatcccctcattttcggtagctttctggtccatgagacgctccaattcttgacactgggaggtggagaggcccttcactgcagccacgctcacgtccgccttggtgtccgggtagcctggggggatgctgaaggtggctttcacagccacgtagttttccccttccccattcacgtacgggaccactcggactcgatactgcctgggaacagatgcagagaggacctcaaggtcgtccattaggatgcactccagcgactccgcctccaaggcctgctcctcctcacactgcgtgggatccatcactctcacgccctccgacagcccacgcctgccctacctggcttccctgtggcatgagaggtggcattaggctaccttgaggctttagcttgccgcaaaaaaggacagggacggggcgcaaagtggccagaaagcgaagggtgggagggtatcgccgtcagggtgaaccctcgttctcactgctggtactgagcacgatcacagagatcagcgagaagagagccatgacaaaatgggaagcacgcacactggcctcacagagtgcacacacacctgatacagccccttcgaatg

SEQ ID NO: 169 - DNA, 703 bp, Nannochloropsis_gaditana
ttccttttgtttcctgggcgacgccccaaatccttgcgtcgtgcgagggaacaagagcaacaggagcagcacacaatagaccatgccattgcttcctaccctggataccatccccgtgctaatgtatctttgaaaggaagaaaatatgtgagcgtccacgatcgcacagcgatttcatacctgcctgatcactggggcaacgcgtctgttgagacctgagactgtaattttttcctattaccagggcctgaaatgaacccgggtgctcgcatgccccgccgagtcgctgagaaacttgaacgagtgctcgcgctgccgagtcctgtgcttgcttttccaatttgccgcgagccccaacaaaaaccatttcccacagtagtgcaaatagtagacagtgtatataatcctttctgaccatgtcgttctccccttaaacacatgccacagatttcgttccgcccatgcgcgagcgataagcaacgcgctcaggttggcagctccaaatgtctgccatataactacaaaaattgtgcagagctcaccaaacaaacttcacacggtgcagcacacctatagatttacagaggtatgaggaaaatggatcatgtaacacagcgatgcacgtttcgaaggcctttgaatatataacatattttcgttcattccttcgcaacctgtgctcatagcgaccccgtccaggatg

SEQ ID NO: 170 - DNA, 703 bp, Nannochloropsis_gaditana
gcaaatagtagacagtgtatataatcctttctgaccatgtcgttctccccttaaacacatgccacagatttcgttccgcccatgcgcgagcgataagcaacgcgctcaggttggcagctccaaatgtctgccatataactacaaaaattgtgcagagctcaccaaacaaacttcacacggtgcagcacacctatagatttacagaggtatgaggaaaatggatcatgtaacacagcgatgcacgtttcgaaggcctttgaatatataacatattttcgttcattccttcgcaacctgtgctcatagcgaccccgtccaggatggagaggcaggaaggcaagcatgatccgatggttgtagacgcgctgcattcagtggaagagctctaccgactgttggctcacaacgaaaagacctcgcttgcatcgggggaaacggacgcgcccgatgctctactgcccctacaagacttatgccacgacacactacgcgtcgtaaatgctgtgccgggatacagcggagcttcatcgaccctgccgacggtcagcgacgaggatcatcatgaagccaatgtccgcgaggcctgtgcaggctctaccatgacaccagggtatgccccgctgtcgcctcagtcttgcgaccagggtggaaccgcctttttggatgacaacgagcatcacgaacgaagtccactgaaagccgg

SEQ ID NO: 171 - DNA, 703 bp, Nannochloropsis_gaditana
ggcattaggctaccttgaggctttagcttgccgcaaaaaaggacagggacggggcgcaaagtggccagaaagcgaagggtgggagggtatcgccgtcagggtgaaccctcgttctcactgctggtactgagcacgatcacagagatcagcgagaagagagccatgacaaaatgggaagcacgcacactggcctcacagagtgcacacacacctgatacagccccttcgaatgccgcggttgcttcaggttgtgttgatgctgatgttctgctctcgcattgccggcttctgtaaacctcgcatggtaagtccaaggcagtgtagaggtagggcggtcactgtagacgccagttgacggaacaaatgctggctgtggccctttcaaaagtatggcagcgccagggaatgtcatagatatgcgaaggcagtgtgtgctttacagcaacgtaaggtgtgcctgtgtaaagacgtgctgcatgacaacatggaaggtatccttgacgtgacaactgctcgtcgcgacacataatcttgacggcaagtgaacaagctcggcagtgtgtagcataagacgtgcatgcggacgagtgagcaaagtaattttcaaaaatgtcagactgacgcaatcatcgcattcttcacgcagggaacgcttcccgttcgtcttccctcacgtgctgctgctcaccgagggcttaaaatg

SEQ ID NO: 172 - DNA, 703 bp, Nannochloropsis_gaditana
gtggaagagctctaccgactgttggctcacaacgaaaagacctcgcttgcatcgggggaaacggacgcgcccgatgctctactgcccctacaagacttatgccacgacacactacgcgtcgtaaatgctgtgccgggatacagcggagcttcatcgaccctgccgacggtcagcgacgaggatcatcatgaagccaatgtccgcgaggcctgtgcaggctctaccatgacaccagggtatgccccgctgtcgcctcagtcttgcgaccagggtggaaccgcctttttggatgacaacgagcatcacgaacgaagtccactgaaagccggaaatggtcacagtagcagggcgcctttatcgggtcgacggcgcttctcaaaaaccccaccaattcctgctcgtcgacctccctcttggctcagtgcccttctcgtcttctcgcatggaaatcgtcagcggaaaacgtcggtcgaacaggaaagtgcatcgcctggagcgcccttggtggagatccaagcagtctttggaagcgacgccgttccagagggtttcaagcgcgtgagcaatactccctgtgggcgcaaggcggacttgaatgccggcgccggtgggcactacatctacctggcggttagaaaggacaaccctggcaggcgtcggccacccgtggtggcgctggcggtgattttccccgaccgacaag

SEQ ID NO: 173 - DNA, 703 bp, Nannochloropsis_gaditana
ggctgacggacacagacagagagagaggagcgcctgtccgctccaagccttcgtcatcgagtccttgtgtttcttcgtccatcgcgtgcaagtggagcactttgacaccgtggtccagtaccttcgtcacgtaatccaagcggcctccgtgggggacgtcgacctttcctcccaatcgttgcagcagatatttaccacttgcgtctttttgtgcaattttgaggcattcagagcgttggaaaatgaacgtcacgctcgatatgctgcagtgtctgcctcaaaaggtaatagtaaggcgatgttagacgccatgggggttaccacgggggcgatagcgacgaaggtgtcaagccactggggcttcggaagagagatgcccgttctcggggtagattgcagcgcctttcttacccttaggctcctgattgagtgcatcctgcgtcgagtggaggtcagagcttgcggtatggagggcctggtgggtcgccgcgcggttggagtggcggggagtgctggcactgtgaagcgcactcctgttcccgccgagacaatcgcgaggtccctcgtcttggacgtggtggccgcagccattcagtttgttgagctcactaaagctacgcagcgcgcagtggattgcatcaaaagggggtcggcctcgtcgcacgagtccttttggaaggagctgctgactgtctcggccatg

SEQ ID NO: 174 - DNA, 703 bp, Nannochloropsis_gaditana
acacaaagctatgcagtcgacgcatcggttgcaggacaagttattccgcgagatgtataccttctttcagtccaatcgggcgaaacatctacaatttcctgaaaacggaggagatggatacctgtactactccagacggtcccgagggcacaatttccccgtctattaccgacgtcgtcacggccagccagatggagacgacaggttcgagaccgtcctgctggaccaaaatatcatgccagatttctttcaacgccagcttctgggggacctgaaagtggtttcactcggaggagacggaggctcgtgcctggtggccttcaccctgctctctccagacgccatgaatcggggggggaatctatatatcagggtggttgacaccgacaccagagtccgaccctctggtccccccttctccttctactcatcgccttcgacctcgtcctggtggactgccaatggggaggcgtggacgggtatcgggggcttcgagtggggccctcgggaaggagggggagatcgagcaagacgcacactatactataccaaagtagattcttacggtcgaccgcaccaggtgtgggcagtgcaattaaccgaggagggtgacaagcttcacggcgcgccacgtttgctgcactcgttgaggagggaacaaaaggctgtcttcttatctttggcggcgacgaaggataaaatg

SEQ ID NO: 175 - DNA, 703 bp, Nannochloropsis_gaditana
ggcgcagctgacaaggtccttgatgaacgcctccgggcacgcccacctgatctctctggatgccaagatccgagagatctcactaagcaaccagccaggccaaggagggggaggatgggagcatgacgtgatggtgctgccgagtgcgtacggtgaagtgttccgcggaaagcaaaaaactgggtctcttccctttccttccgatccggctcccggggcgggccctcccatcccgctcccactctctcccccactgacattgcctgccatgccgccgcccgccctcgtcatccccccttctcagcctcttgccgcgttcacggggaaaagcagtgccggtgtcgagagggaagaagggccgaggccaattgaaagctgggacaaggacacagaagagcatatatggaagggtcggccgcaggtctctgggcacgtcggaggcaacgggaccgacagcccccgagcccagagccctggcaagcagacgggtcagaaggcgacaaaaacccgcacagaagaagcgttggaagggtcgccgagacgttctgcgggtggttttcggtctatgacccctacgggtcggggcacacgacgcactactcttctatcaaggctcggctcagatgtctcggcagcgacgccagcggcacccgctccttctctttcgtgttctcactcctccccttccttgcccctggccatg

SEQ ID NO: 176 - DNA, 703 bp, Nannochloropsis_gaditana
cgagttgatgagcttcctgatccattggggtttatggtttcttctttcaccaaagaattcccgggaattgtgttgagaccgaatggtttgttcacgattataatgctatgatccacgtaaagtatttgcaattctgtcttggccgaaagggccaagaggtagtcatccgaaggtgggttttctggacgctccatgttagcgggctcaatcctccgatttctcgttaatacgagcgaatgtcatttaaaatcatgtccatggagaatctaggagtgtatgtgtgtgtgcacgctgtaacgcatgaggctggcttcatgttttgtcaaggccggatcattggtccaaaacttgcgcgaaaggctggatttcaaaaccctaacggtcaaccagccgttgaggtgtgctgtgttatctctgaagtgcaccacgcttctccttatatttgtcagctcgctaagaatatcctttctttttaggctacatgcaagccatcaataacggatggacttattccgcgacttgtatgtcaaactgtgcgtgtggtacaagcgaataactttgttgtcatcgatacgcctctcctccaccctgggagcccctttctctactaggacgcgatcccagctagtctgcgacagattcaacgcactctgccacaccatttcccttcttccaatttttaatacagtccaaggatagaatg

SEQ ID NO: 177 - DNA, 703 bp, Nannochloropsis_gaditana
gggaagaggtagccgaccgtccctactttatccaattgaaccttggcagctttcttccgaccctgcagatagctgacaaaatcactcacacgtctgtaatccttctctttcgaataagccacgagtccaaaaaagctgagggaggtaacgaggggaaggttcttctcgtactcattgcggcatatgagatgattgaggattgactgacttggagggccttgagtgtcatccagaaacgtcccaatcaaggttgcattactgctgtcgtcaaccacagagaatttgtgcaacatcgctcccttctgtatgagagaatgtaccggtggggcctcgggcggaaggggagttgccataactcgagtcactacgctctgcgtgagggaacgttgaatgtgagaaatgacccattgtggcgagcataacaagcgaaagctggcacgtggacacttatttcaagatactgatgtcagggcgaccagtacagcatgaaagaacacggcgttttcatcaggaggcagtacttctttacccttgccaagtagtacaaccctatcgccatgatcgcctcttgtgcctcagccctcccccgcttacaaatgtgcgtctcacacaggcatcaccgtgcaagggcgaacacagggattggatcgacaaaatgacatttcttccgtttcatcacctagtaacacggcgcctggggatg

SEQ ID NO: 178 - DNA, 703 bp, Nannochloropsis_gaditana
tcctgttgtgattgtccaggaacaatttttgcaaaccacatatgcttgagcaccttcatatcggtcccaaaagttgaaggtggacaataatccacgattggcacttttatttgaggagcgttactacttgacattatcgtcggcttggagacctgtttgcgtcaatcgggatcgagaatctcgtgtaagataccaaggcaagaaagtctagatcgcgtgttttatggaatctgaaactcaaaataattaaaaagtacgtgcactgaacacattggtgctaaaatgaagagatgttgggcgcctggacaagttatttaaattgaagatggtaagaagttgctgaggttgtggtcgaagtaagccgtggagggacgcagtggggaggttaatattgtccggtaagtcatgttgcatccccgctgctgggatttcaccctcagatgacctttcaaatggtgaaatatatcgtccatctaccctttcaagttgccagagcgtgtagcacaccgtattaagttgcttggggcttcgtcttgtaagccctcactgagacgatttccgtcgccaaatatcatgacttcccgcacatacgcggaggcacactccgttgtttcatattaaaaataacaacaaatacactgcgtccaggaaaattttgggacttaggtacattcggctccgcgcattgcgaggatcgggcatg

SEQ ID NO: 179 - DNA, 703 bp, Nannochloropsis_gaditana
tgtggtgcgattcattgatcatcaccacctacgcatcatcacaggcgtcaagatatttccttttttagccaccgcgaggtggtccgtcgcagtttcgtttcctggccgtctgtattaacgacgtgtaattatcctaacctgttgttcgctcctctcgatctggaggcatgccacggttggaaagaacgccctgaatccaaaacaagccacgcagtcatttgtgcttgcacattttgtttgaactaagcttggtagcatgtcctctgcatctggcgcggcgggtgcggcggctatggttgctcagcacgatggaggccgccggcgcgtgatattgctgggatgcgctgcttcgttttttgtaacatacctcctccgtcgatcccgctcgaaagcagtaggctcggggaagggtggcggtgtctttaagtctacgtccgaaagaacctttcggagatatcctcaaaactcgcctagtgttgggccgcgcaatggcgcccctggcgaagagggacggcacgccggcaccgcagcagcagcaggagggagggtgggaccattgacctcgtccggtttgaacaataccttagacttttcgcacccggacggccccaacatcggcccggcgtcggaccccgggtggttggagaaccacgaccaagagggtctcccggtcaagacggacctcctgcacacggggcacatg

SEQ ID NO: 180 - DNA, 703 bp, Nannochloropsis_gaditana
atgccggcccggatctctgttgctacactagactgccgtttgtcgatctcaaaaaattcgcaaagggcgccatgaagccgacccttccttgaccccatcacaagctgtcaaatttatcgacgaagcaagtcgaggtgaaggaactaccgcccgctgtccgaccaggcaacggatgtttcaaaccgcgcctcaaatccctgtaaggtgatatattattccagtacagagtgattcgatgtttgtgaccggcggaagatggcagcttttttggcatgccggggcctccggggcaagacgagcgggtctctgggaggaggctctcgccgcctgtcgttctctcaggcgaccgttacgaaccgttacctatcattcgtcgttggacccttcttttacaccttgcgttgtgtcgacggagacacgaaagcagacgtttcccatctattgattatgatgagaaaccaaaaatctcattggagtccttcatcctgctagtttgcatcgtttgaatgcctgatgactgttctttgtctcgccgaaagaagccaaaatggcaggtcctaactcccttgttctcttataacttcagaacttataggcttctgattgggtaaaaagtgtccgtcgcactcgattctgagaaagtgtcttgaacgctatcaccgagatcaaaaggggtgtatttgcctactttaatgcggcgatg

SEQ ID NO: 181 - DNA, 703 bp, Nannochloropsis_gaditana
agccggtccgcgagcgcgaggactgacaggcagcaggggactgagggaacaagcatattgtccccatgttgggccaatgaccctagcaagttgcctcttccgatcccggacgagtatgaggggggttttgcagaggtttgcgagaggctggagcacctagactcgggggaggactgggtagccgggctagaggatggggtgtccccccgaggcatgtatgcgacttgtactacattcggatccccacttcaggagccggagaataaggcgtacaagagcttatccgaggacgagcaagtggtggacttctccgaattggagcgcctagaaaaatccatttttgtaaaggcggccttacagcttcttctcgacaaaatcagcgcggccggttgcggagccagcaatatagccaatatggagaacactagcgtggggttcgggaataattccggtggtggtacgccggtatcgggcaggccggcgcggacttccttgtcgatggcagctgctgatgacgccctgccgaccactctgctgcccttctccccgtcatttccggtgctcaaagcagggctcttacgcaaagccaaccatcatgctatgggcgcgatctggaacaataagctagtggaggtgcataagggactttttgtctacgagggcgatgagaaaagtcccaagggtcggcgcaggaaatcactgc

SEQ ID NO: 182 - DNA, 703 bp, Nannochloropsis_gaditana
cctgccgaccactctgctgcccttctccccgtcatttccggtgctcaaagcagggctcttacgcaaagccaaccatcatgctatgggcgcgatctggaacaataagctagtggaggtgcataagggactttttgtctacgagggcgatgagaaaagtcccaagggtcggcgcaggaaatcactgcccctccacgcctcgatctgtacctgccaacccgccacctccaagagcacagtttttgagctcgctcttaagaaaggggcaaagaggctatggatgtgctcgaatgaggacgaacgaaacgactgggtgcacgtcatcaacagcgccatgatagtgctcccggcccagggaggaagaggcaccggcgggtcaatcggaggggcacaagccatcgatccaagctctccgcatgcctcggacatgctgcgctacagggatatgcggttggcgatggaagtggcggacgatcgggacaactacctgcatgcagtcgcgatccttcttgagaatggagagctctgtgttcctttcccgtggattcggaggcaaatcttcccctcccaacccgagcaggccacaacgaatgcaatatcttccttccttccattttatttaaaatacgcccgaaaaagggcgcgtcaagcccaacaacacaaccacggcggagcgtgtgttgcgagtcctcactctcagtcgcag

SEQ ID NO: 183 - DNA, 703 bp, Nannochloropsis_gaditana
ggctccggcctggaaagtttatggccaattcattacatgcccatatacctcctcaggctttttggcagtaaattcgtcggcacatgatggcagaacgcctatgtgctaaccatctggtattcttttgttttcgtcgaattgtgcaaagaaatcggagaagctcgttcgtcagtgacgggatcgctttggtaatcttcggtggtttccgagggtaggaacactcgacattcacggacattttgagatcctatgcgccgtgggacgtcggtacatgctcagatgagatctttgtaccttgcaagcacgcgggacgcgttttatgaggcgtcggtggcgcgcttcctggcaagcgcgtaggtgcaagctggtccttcgctggctcgccgccttccgtcgacgaatcgagacaggattcttccgtacgcaactagtacctagtgagactatttaccgctagtccatacctgagtcttgcgacagtcgatgcatttatacgccactgaatgaagtgatgtgacttgaaatgatgggggaggttgtcttgcccaacggaggtgacttggtccgacaactatcttccgtccaatattgtgcccggcctgtcacgggtaatcgacgttaaagatatgccctcttcatcacgaaatgaagtcccggaggaaggtacagcttttacgagtttgatgatcacgcaacaactatg

SEQ ID NO: 184 - DNA, 703 bp, Nannochloropsis_gaditana
aaatgcttgttttgtttcgaagtaacgaataatatgaaggttcggggtactgtcgcttctatgtctcgtcactgatgaagtgctcgtcagacagataacaacgattaaagctccacgacaatgaaagcaagcttggaacggatatatgtgcttccaaaaaatatttcgaaagggtcatcacgatgaatttgctcggtttactcctgaacaaggactatattatacaatagactggcgcactctattccatgcagaacgttgccctgcacgacttctttgtttctgatttcccgcgtccagaaatctaatgggaatattttccagggttccagggtggacgtgaatcttgacagaagaaacaatgcagtaagtgcagttgctgatcgaaaccatcatcaggacggctcattccttggcacctccccttgagtctgcttcggcgagacggttctgctcctcgcaaggatcttgtcgagcataatgtatttgactgtatcacagttattaaatgctcctatctcgacttccacggaacaagagtaaattctatattcataaaatgctcctgcgattgacaattcctcaagctatctcacatcgtacacagggttgtctacgacgtgcacacgcagcggttgggcatacagctgcatataccatcaactcgggctcttttaaactcgttttcatttccacgatcatg

SEQ ID NO: 185 - DNA, 703 bp, Nannochloropsis_gaditana
accatgaagagaatacctctagctcctcccagcccgacggaaatatttcctctcgatccgagcgatcccgctggcgtatggaatcacgctatgccgatcttgcgattgcaagcagtgaatacccattctgtgcctgggacgcgaccacggatgaaagcatctacacgcccctacttctcgaccccaatgcagtatatcaacctcagttgttatctttcgcagcacatccccacagggtttacaaggttgtaagcttcaaaagctcgtcgagaaaaaagaatgcgggcagtagttttcaaaggtcgctccatgctgtccttaccacgctcttccccccactctatgcgaacacagatctcagcttccttccctcgagtcgtgtacttctcctacgaaacctactctttgcggggtcatccgctaacctccctccccgaccttcgcatcgatccttcgtggggcaagaacccatacagggaggagacgacagaagagggggccgggacgtacgaaatctacgtgacaagagatggtaatcgaagagaggcaagagcagaagctcgaatgcccatatcaagtaaatgccaaccccaatctttgcccgaatgtgctctcaccagggaacaagggttggccaaacgaagttcggggtctaagtgaggatcacaccaacgcgacgcaggcggctttttcccgcgtaatg

SEQ ID NO: 186 - DNA, 703 bp, Nannochloropsis_gaditana
agacatcaagccctggttctgccttgtgtagtgaatattatgatattttggagtcatacaacgaagggactttaatgagaggtggtaatacgatgtcatccgagcacagacgagcgtttgtttcgagccttcgaaaagggatgatgattcagagcgatacatagctgctccacataacggccttatacagatgtccctctatctaagtagctttcacgttgatattcactgtttcatactttctttcgatcccctcctctttcaaaccgtagctacagggagaagcaataggaggaaacacagacatctaggtcaatggacaccgcaccaacggtgacctcgcttcagctagattcatctacaagctccactttgccgtcttcctcagacctgacattatcatcttcttccgcttttacgactcctccctccttaccgatgtgcaccgccgtgcatccctcgatcgcaaccacgctttctccctcgctctcctcttcctcagccttcctttcttcatccacgcattctctcagcggtggattaagtctcccaagtactactgcggaccaattactcccgagcctgcaaagcagcactgaaagtcttgggggcgacagcactacgagttcgagcagcaaaacgacctctggcaaagcgaagggagcaggaggaaagaagaaggagggagaatctcaaggaaatg

SEQ ID NO: 187 - DNA, 703 bp, Nannochloropsis_gaditana
accctttccgcctgtactagctataagaaagaattttgactccaacggcgcttcgtcgatttttgcggctgctatcggagttggaaaaacgggaagaataacaccataggtgagaggtaagtgttcggtggcctcgtcgtagggaaggctcgcagagggaagcgagcggggagtcagtaagctttcgagacgcgtaagaggcaagtcaggtctgacagagtcgcggttgatcgtcacctagtacagagtctccacagatggagaaagaaactcccctcgcggcgccaacctagattctcctgacgacggcatcgacgtcgtgtaggacggcgagagaggaggatggcttgggggaccggcgactgctctcttgtcgccccatgttgcgtatgtgccgctaatttctgatgattgaaagcaatacagcttacaaaggggcttcaaaggggcttcaaaagtgcggcatgcgttttgtgacgcgagcgtcgtccaggctcaagatttttccttttgggttctccatccatttaagtaggatgaggcggcgcgggcacgagcacgctctgatgattcgagaaatgttaaaaaaatttggacatacgatgacagacaatgacgtctgtttcgaaacacccaggcatgtttgcatgcaatgagttctttttttagaaaatctggatctgacgttcgcatctgctccagg

SEQ ID NO: 188 - DNA, 703 bp, Nannochloropsis_gaditana
aaggcgccgcaccctgtctagtgggcgggcgttctgtctgcgttgtatgactgtacaagctcctcaacgaatcgtgccacggtctcgatgcggccctcttcgcacgttgagaagacgtggaactcgatggaaaccacaatttctcgaagagtgtcccttaaagagcgcaaaaggagcacgtattcgaaggacgacgatgtgttccaccccctgcccggcttgcttcttccctacgcgtcaggagggagtgtgaaagtgcatgcaaagggtaaggtttccgacgagcaatcaatgatctttgctacgcagccgaagcatgtctcaatgtgtgcctaggactccgtgcctgccatcttttcgtgcaggtaaacccctcgctcactcccctccttgtcgaggggagtgagcgagcagggtaagcgccggggccgaaaaggggatgaccgtccttgattccatccctcgtccatggaccgcgtcagacacgtgttcacggcatgcaaagggctgtttcacatcgttcaccaagggattgtgacagtggtctgcacctgtgctgtttaaagtcgcgattgcgggatcagggaggccctgccgtttctatctactcgttgactcgacctcgcagcaccttcgacatgtttctaatccttccccctggctcctttgtcccctctgcagcgtggctgttgaacgaaagatg

SEQ ID NO: 189 - DNA, 703 bp, Nannochloropsis_gaditana
tcatgaaaacttacatcatctaaggcctcctcctcgttcttagaggtctcctccaccgctgtactcgcaacagcctcctcagcgtcactcattggcttgctcttgggaatccctttgaatcccgacaaggatccctgacggcgcatgaaaggatgtcaaagatggtgccatgagtgaacgaagagccagagccacagtgctggacggcgttccgctcccgtcgtcctaccccccgaggtccaccaccgaaaaccagacaagtgtccaaccgagccccctcattcgacctcttccggtcatttagaacaggattgcgaactatcgcatgacggacccgcggggcacgcgcgccgaggccatggtcaacctggggttccggcgtaaggcccgcgatttccacgcagatgtcatcgcccgtttttggctcgaacggatcggaacgattctaaatcggtgggtatgtttttatgctgatagcaccgtcttgacgaccaaaaacgtgtcacagggcaactccatacatgttaggcggccgtcaggcactgaatctttctcagaggtacctcgcgtccatcgggacgcatctacttctcctcttcttcgtccggccgcattttccgactgccatcatctcctttggagtatgtgatgccttcgtatcgcagttttcacccaatgtacaatacgacgtctcaaattcatg

SEQ ID NO: 190 - DNA, 703 bp, Nannochloropsis_gaditana
ttccgactgccatcatctcctttggagtatgtgatgccttcgtatcgcagttttcacccaatgtacaatacgacgtctcaaattcatggatatcgctgtcgcggcgactgcaccagcgtggcagggacttggttccattctcatcaggggtcgcccctgacctgcaggcggctagtcgcagcatcgatgtcccagacctaccgggacttgtgaccactgaatggctggcagaccatgtagacgatgaagacttagccattctcgacgtccgcggagaagttgctaaggcccctgtcacgaatggcacgcaagaatccgaatatattgctttgaagggcgattatgtcgatgcgcatattccaaatgcggccttcgtagattggatcgaggacatcgcttacacggacgatgccggagttcccgttcaaatactaccacttgatgactttcgcgtgtgcatggaatcaagaggcgtgggtttgaggaagcgggtcgtcatttatgacaacggtaattcctttttgccacaaggctgtggtgggctttgcgcattgcagggcatcaagcggtggctatccttgatggtgggtggaacaagtggcttgcagaagactggcctgtgactgccgacgcgccgtgccccttgaaaataaatgaagcatgggagagtgagtttatagccacatctgtcgacggcgcaatg

SEQ ID NO: 191 - DNA, 703 bp, Nannochloropsis_gaditana
aagttggatcactgtgtgcaacaagtgagcatgtgcttgaccataatcttgccgccgtttgccgcgacgcacaggttttccccgggccaggccaaggtctgggatttgtttgcttcggtctatagtgtttgatgcgtctgttccgtgcctcaacaaggcagtcccataaagcccgtcacgcgtgagtcctcctggcccttatgtcgacgagacacttcttttcacttacctgtggcacccacgacgcctttgcggacatttcacaaaggagacaacctgagatgacaacttgtccttcacctgtgtggtcatgttcgttcacaaccagcataaagcgcgcagccattcgcaaagaagggtctgatctttctgtcgggcgacaagacaactctaatactgacttacgaacgtcttttctttcgcgtcccagagcttcaattttcgccccacttcgatgtcctgtctttcatgaaagcgacaaacacgctcagcttaccacgtttccaccctacaattttgcgaactatcttagaacaaaaacgggtcgtctaagcagtcgccacccatgctcagtgcgagtcccgccgcatcctggccgcctgatggcgcgcgccctcagcaagatccacctccttcctgccatccaagcacgctcactggaagcagagacgtgccaagtcagccattgactttctcgaccatg

SEQ ID NO: 192 - DNA, 703 bp, Nannochloropsis_gaditana
gggccgtggattccttcgtctcccccaccttttcctggcttgtcatgcctgagcttcgccttctttaccatccaagatactgcccccaagcgcaaattaatagctttacgacctgctctttccgtgccagcgtcgaagatctgcgtggttgagtgatttttttccttgatcttttggtcgatacatgaatatggttaggagatcgtgaaattcgcacggttttttatttggttgtggcagttcctctgatccccggctggcgggcctcaccaacaagaaaaaggagcacaattgatcgtacaagacaaattcttgacaacacctggcgaatgaaggtcatacatgtcaatgctggtctttacatctcaaacacgctcaggtactcaacaaataattctgtcaatttgtccagagggctgtaggatgccagcatcgtttcgggctatcaagagtcttagcgctgtgaggtacttcgagtacgttcccatcgaatttagtacgtgccatcttcattcactcaatcaaaacacaccacgcgtcatcaacattggaattctacaggcaaacacgtactgaaagcattgggacagccgtttgtactttttttctttccgtccagcgaatgacagtgttttgaacatgagcttatcttcctcctcatgcactctcatatcaagttgtttcaacaaagctacattcagta

SEQ ID NO: 193 - DNA, 703 bp, Nannochloropsis_gaditana
catcgattctccattccttcaaaaacttgcccacatttacgctggccggggggaggctggggtcatgcagcaaatattccgccacgtcaaacccaatgccaccggcgcctataatggccacgcgcttccccacctcctttctgcccctcaacacgtccacgtacgaaagaaccttgggatgttcacatccgggtattttgaccgggcgggggaggacccccgtggccatcacgacccggtcgaacccctcggccgccaagtcctccgcggtagcaggcgagttcagacgcacatcgacttgaagaagcttcagtcgatgggaaaagtaacgtatcgtctcgtgaaattcctccttgccggggatgactttcgccatattgaactgcccgccgatctcatctgctttctcaaacagcgtcaccgcgtggcccctctccgccgccgccgtcgcgcaggccaatcctgccggccccgcccccaccacagccaccctcatcttactcccaggagatacgggaagtaggtgcagttccgtctcgtaccccgcccgagggttgaccagacagctggcacgctgtcccttgaacgtgtggtcaaggcaagcctggttgcaggcaatgcacgtgttgatttcctccacgcgcccctctgcggctttactcaagatggcggggtccgccaaaaagggtcgtgccatggagac

SEQ ID NO: 194 - DNA, 703 bp, Nannochloropsis_gaditana
caggcgtcgaggggggaggggaaaggtgtggaaagggatcgattgtctcggccgaagcaaaataagatacacttacccatgacaatacgattacgaagtgtggccccagacttgagctttaaaggctgaaaaacgtgggcaaattgctgcgccatgatcgggtgaaatgacggcgtactccttcgttccggacgtcaaggtcgcgggagccacttattcgcttgccctgcacttgtaaagagacgtgcctgtcgtactggaacaaaagaacaaaagaaagcatttcaatatggtatagctacattggagcgtgaattcctgcgaagaagcgcctttagtcagcaagttggacttgctgccactgcgaatgcttcaactcacaacaggtaacggcctgcgtctttctatcgaccatcaacatgacaaaaaaccatctcaggtcttaataattcttaccatttccacgcgacacacatgacagtacatatcattggctacgaccatcattctctgggttacaaaattggcatcatgggatttttattttcccagcgccggcgctatgtgctactcgcagccgggttgctcacttttctggctagtgcttacgtcgcgatgaaaaaaaacagcaaaaagaaaaagtatttagaatattgcgccttgaagctacgcccgcaagagtcagagaaggaagaggaaccgc

SEQ ID NO: 195 - DNA, 703 bp, Nannochloropsis_gaditana
gcatcggtagactcgtgaatctccgcaagtttcaagcatcgttcaatgatttgcaagccttgccggaggaaatggggaacatgcgctctttggaactctttcgtgccgctgggaatccgaagttgctctctatccctgtctccctcgctcgagcaccgtccctcacatggctctcactgggcggctctaaattctgcgacgcgttttcccgcaacactttaggccctgcagaaaaggatggagcacagtggtgggccatggaaggtcatcgcggcggcagaggtgcttgcgcaagagggaggagcatcgatcatgacacaagcaataccacgactgagtgtaccggcggccgctacatcgaggttcccccctcgataccgcgaaaaactttgcaacttgagcgaaaactgggtgatggagcgtcgggagaagtgttcttgtcggagtgggagaccggtaccgccgccgctctttccgcttcctccgcgtcctggaaaaggaggcttacccctcaaaaaaagaagaaagccaaggagcaggtggccgtgaagatcttccgtcatgacgtctcgccggatgggcgggcgatcgatgaattggaagtcctgtgccttctggagcacccaaacttaagcaaagcgcgggctctagtggtggaagacgaaggggaggctgggcggggggggctaaggagcggcacgga

SEQ ID NO: 196 - DNA, 703 bp, Nannochloropsis_gaditana
ttcttttcgccctcggacaagcggtaggagtcagctctgtacaaggcgtgtatgtttgtgagtggtgcatcggcggtgagtgtcgcaaattcgtaatgacgccgcgcaacatgagggaatagaaaggtatacgtagactagggtccaataactacgtgccacaggccattcaatgcgctgttgcgggtcctctaaacaccacgatgtccgtcctccatcgaacacggggtaagacctcgctttccagttcgcgtaccgtttgggctcattcatgctgtaacactggttgtattctcaaggcctggatggtggagaaagcgctttggaatgctgcaggagcctctctaccccaaggtggtgagaaccagactaacgctgctactcactaggagctgtagttgccaagaaggaaaaggatggacgtgaagaaaaaagcaaccctaattagcctggtcaactttgcatgtcgaacagattgtgacggtattcagggaaatgacattgcaaatgctgatgtgtttattaaaaattccggtcgtccccccaaacggcctctggctgtcatggtgtgtcgcttctttcgaagggacatttgcacggtggctgcgcccgcgtgcttttttgtctttctagaccgcgtcgaaccaccctttacccacatggtgctctcacttttcatttttttccttcttgtaatgtacaa

SEQ ID NO: 197 - DNA, 703 bp, Nannochloropsis_gaditana
acctgacggcagataaggcggctgagaatgtggtcatagtaggatcaggccctgcagggtacaccgccgcaatttattgcgctcgagcaaatttaaaacccgtgatcttcgagggcgcgtcctccaccgggggacaattgatggccaccacggacgtggagaatttcccgggctttccggacgggatattgggaccagacttgatgatgaatatgaggtaacggggggcttcggtgtccagggagggcgaaggcgggctggtggagcgtggagcagcggtgggggaaggatgggtgaaggagaagctggaggaaaggagggaggaagggagggagagggggagggaggaagggagagagggagggagggaggaagggagagagggagggagggagaagagaatcgaacccaggacctcttttttgctcccgccgtaatccctgcttattcaccgctcgattgccctttctggacaggaaacaagcggccagatgggggcggagctggagagtgacgacgtggtaagcgtggacctgtcttctcgccctttttccgtgacggggcgaacggacggtgcgtgacggcgcattccgtcattatcgccacgggggccgtggccaaacgcctccggctcccgaacgaggagaggtattggtcaaaggggatcacggcgtgcgccatctgcgacggcgccgcccccatg

SEQ ID NO: 198 - DNA, 703 bp, Nannochloropsis_gaditana
cctattagcggtttcagtacggtagaggacgcggtgcttagtttgcctcgattgctttcgtattgcgtaccccccgcgtatgcccccgaaggaaaacttcaagtgacgaataccgccgtggcaccacaactctcacctcccatccacgcaacttatacgttcatcatctagtacctaatcaccatggaggatgtaaagcgtgcttatgatcttttgaagcttctcattgctgtttcggggctagcagtcatggtaagtgattgaacgtgtagttatacatgaaggactgcacctccgttctacatggcgagatagaaattgattcacccaagtgtatatccatacattcttttagaattatttcctgataaaaaagtgtttgaagtgcttacgactttgtgtctatttctcggcgctgcatcattcgctgatattcagtgtttctgatgatcccatttccctccctacggtgcctcccttttgtttcacttgctttctttcgctctctttttctctttctgtattctctcgctttcgctgttgtgccccatcacatggccgtgacgatctgtaaccctatacctcacatatctatacccgtctaatgcttacacgtcgggctctacttctacagcgtgattctatctactaccagtggctccggggccattttttcctgcctatagttggttttgccgcaatg

SEQ ID NO: 199 - DNA, 703 bp, Nannochloropsis_gaditana
ggctcacaaattaccatttgctgctcgtcagtgtactcaagagccatcgcagctccctccaatgaggcagtgtgccttacgccttacactggccgcgagctatcttaggaaacgaggcccaatctgtgtattgagagaggtatgagtcagatgtgattagaaagcatgtcaaaatgtgcgggacgtagtgattgaaggaaagttcacatcccagtgagaaatcaacgctcgggggttactgcaagccaagacggggagcaggaacgcccgccatgtttttagtgaagtcctcctcggacgcggcttttcgctcatttaaccatttttacggcttatctgattcttggcagccgtatttaaattgcctgcctttggcacgtacatctcttgggtcgaggtctgcgcacttttattccgtggtggttggatactaaagcactgcagacacgagccctagagtacaacacgaacgagcgcttctgaggacccgactggtgcccacaaaacaagaaaacgcggtggatcgatgcatctgccttggactggagtacggcagatatttgtgctgcttcattttgcgtgtctgtggagtagcacctggtctttttgggcgaaacccgtgctacgacgaaatctcgaccatcgggccataggagctgcttttgctccttgctctccgcttcgactgccttttactcgtatg

SEQ ID NO: 200 - DNA, 703 bp, Nannochloropsis_gaditana
tgcacctgcactactgccagcccgtccccggggaaaaccctgcgatgtaagggcacgactgaaacatgcatgcacacaaggtgtggcctaatacggctccggcggtcgactccgtggtactcgcgccgttaacctccgtgaagagggagcgagctgccctccctccctcctcctccctcaagcctttccggccaaaccaccatgcccaaatccacctgtttccttccgtccgacccgaaaatgcatggatgacaccacgaagaggtgcgcatcctttcccatgcacccaggcgtggtgtcgcatcgcagtggtcgtgtctacacggcgacttgtgttgaggatgacatcacgaccctcccatcttgaaaggttctgtcgccccggcggcaggactctccaaaagacataagggccgtatttatcggcctcctgcacacatgctggttgcgaaagccaccaatttttattcaactgtcagacctgtcattctgtttgcacgccagacaccggaattctcggactcctgactgagaaaggggacattcacaaggccggcgcggccggaaacctcccctgatcctcgtatcgtacactttacgcgttcattgcaagcatttacaaatgtcgccccgtcataatgtcatactaaatattttaggtgtaggaagaggtggataaggcacgtatacgtcattccgtatg

SEQ ID NO: 201 - DNA, 703 bp, Nannochloropsis_gaditana
ccctggagaaggctccgcctcctccaagatgtgcagcggtccaccacgctcgtccagtccttgctcggtgccggcgagttttcttggggctctggatgtcttggaggatggccagggtctggtacgggaaggggggctggcgacggtgaggtgcacgcgcaggctagcccggcagctgggcgagtacatggagctggtgtcggacctgcttgcctcctccttcatcggcctcgcgctttcttttcaaggtacgttctcgggactggatggccttgctcggaaagcatggcggggctaactcatgactgtcttgtgaggcggaggccatgtctgtacgtttaagcaggggcttccgtctcgatcctcctgacctccctctttcgaacagcggacccggacgcttgtgtaccggacacgcgctcctccctgccctcgccctctttgttgcagagcgaacattcttgtgtgcgcttgccccttcagcaaccggagttggacgaggcgttgaaagcgcagctcgtgccccgggtgcgggggctggtgcgcctctgtcggctgtccaaggcgcttgagcggtaccggggacggttgacggcctccttgaaggaggtggtgaagaccgtgctcacggaatacctgggtgttgcggaatatcagcgaggggaagataaggttggagcagacggggctgtgaacacgcctg

SEQ ID NO: 202 - DNA, 703 bp, Nannochloropsis_gaditana
aaatttgcacaaattgtggcgacgctctcttacttgcgcaaaaggcgctttcccaaatccaggccctttcccccttttccgtcttctctcctcctacctcgctcgagggcctcgctaaagaagtctgaagatgacgccctctcttccagtgtgggcgtgccctcttatttgtgacctttgcatggagtctgcaaaggttggattaccttcccacctaccactttcatcttccttacttctgatgattaataggcattccgcactttcgattttgattctgcgaggccgtaggcattcgtgttcgcattcgaacacggaggggggaaattttggagcgctacgtgacgggacgattccttcacataagaatttttcctcgttaaaaatgaaaccttcgtcgccatatagatttaatattgacggcaatgagatgtatacattttctgtcattcgtgtatgaagatcgtggcaagtggcgaccgctgcacgcttataagtctgcaaaacggtcgggtcaatcgcttccatcacttagctttgccggcgcccgtcgcctacctcgctccttgcacaatgaatgtctcatcagcactcatgtgaagtgacgtctgtgtacaccatgcgcatacctttgtgcccgtcacgtacttgtaaggtcattttgctgccggatgtgtgctcttctcacttcaccccacaaatg

SEQ ID NO: 203 - DNA, 703 bp, Nannochloropsis_gaditana
gcacctctgccaagcaagaggcgaacccttgacgcgctgcttcagtggaagatgacaagccccggaccaagcgctttatggcgtactcaacttctgaaggcaaaggagatggacgcctatttccttccttgggacgaaaactcttggacaaagactcgacaagctcatagcccgcttggatgcgcttgtctgagtcggtcgacaccagcttccagtagcattccagcgacatcgtctgttgtgggtggatgggaggggggtgaggaggtcgatggtgagcggagccccgcggatgctcagccaaatgaggagtcaagaacgacgcaacgtagtctatgcctgtgaagtctatcgtaaatgcgagtggctgtcagaagatgtctttactactccacgtcagatacgtggtacgcgcctctatgcccgcaagatacgaccccgcagcgccggaaaggagcgaataagaagctccgtgcttgacatcgcgttttacgctttattatggcttgacccttgccacgcatcaccaccatgtctttttgttcaaccgcagtaactatattttactaggatgcccacgtatgttcacatctaatgagcaggttttatatccattcgcggttattacactttagctccatctccagaagcagcccccaggatttcttcgtgaggttctgccctccctacaagaaacaatatg

SEQ ID NO: 204 - DNA, 703 bp, Nannochloropsis_gaditana
tgtaaaaaatcgagtgtcaagaaggcggtctaccttcgtgtccttgctcgaaccctctgggcgaggggaggagacggtgtgtcttcacgctctggcgtcagcatgctgctgctgattcctatgctccactaagctgatgctttcgttcctcccagatgcatcggcgcaagacccgtgcgtgagtacgggtgagacgagatttgcccgaaagacgcctggaggggaacattatgatagaaatgtcatccataagggtgtggactgtatctgcagggtaatgcgacagcagtgcttgaactcaggcgcacacaaaaccttagtccccgtgatcatggcaaccccggcagcagcggtctcatgctgtgaactagcgtgagataaatatcaccggcgaccgggggggaaagggctcgctgcttgctccgcgtctccacctcgacccgccccttgattgcattcatggtgcacccacacgcgtgaagctctcatcatgcttctacaatacctttccatgtgattttacaggcatcagtgcttcttccaggtcgttttcaccattggatctcggcctttgagtcgtgctcaagctgctaggaacgttgcagtgaatcgcctgctcttccactgttgcttacgaaaagcacgaccgaaagacgtgtgaaaaggccgccctgaagaacgcatacctgatttctctatcatg

SEQ ID NO: 205 - DNA, 703 bp, Nannochloropsis_gaditana
gatttgcacgattgcggcggtctgcgtcggccggcaagcaagccttgggccacgcacgcgcgaggagagcgcaacacaattctacgcctgcctacgagcgaccacagctcagtgaccgggctttcaaaacacaccgccgcacttgctatttcttcggtatacccacaacgagcaacctgtcacactctcctctacagacacagctttgttggacatagcaccgatttatttcgactgaggtggcctgtgaaagtgagagcactgactcgtattccgcgcattcttgcctcgcaccgccggcttccttgtaacatactgctcgtggccatacaccggcagtcaactaagtagaagtatggtcacacgacaactattatgcaccagaagcacaaaaagcggccaagggcgcgacgagaggaaatacaaggcgggcgatcgcatgtcaagcactggccacgtcttgacctggggctcctgcttcttgttaacaggaagcttgctgctcgccacgactgcggaggccttcttcttccgctcgtcgtgttcgaggactccctctctatcagctttttcgaaaggggggcgcggccggacggcggcatcccctatcgtcctccccaccctacccgtgtccagggttaatgcaggactgacggtgcgtcagagcacggggtcctcaagcaccagcagcggcaataccatg

SEQ ID NO: 206 - DNA, 703 bp, Nannochloropsis_gaditana
tagtgtaagtcccggtgacccacattttgagccgccactttaatgcctcgtgacagcttcccagcacaaggtggaggcagcattcatccgtctgcgtctaaaccacgattgcggcgtgcagggcgcgaacatttgtctccctcgtcggcgaggcggcgatggtctcgaagaggacgttcagaggtagcccctgccggtgcacaactagcgcgaccggggaatgtcgcgctcacgtaggccgagtggaggcctggcgtcgagtgcagggcgtccgaatgccgagtacgcttaaatcaatctcaaatcaatttgggggcgtgtaagatccacaagaggatcctggtgtattcataaaggtaaaagcagagtgagggagagcccctgccggtccacaactagcgagacgagaccggcaggcccgtccctttaagccgtagctacgagaacctggggcaaccgcgaacaaaaagcagaccattgctgcttttttcttgtgttggagttagagctgatgtggtatgcttgtcgcattttgtcttgagcggctgaggtacatatgcgtgctcagcttttttgatgacgcaacgccgctctccaagcacagtgctcatgtacgcgctggaatgctctcaccaatgtcctcttcaaacgcatttagcaagcttacgaaggaacacacaaaattacagctttttcaatcatg

SEQ ID NO: 207 - DNA, 703 bp, Nannochloropsis_gaditana
actaaaaaaatcgccagaggtataacgatgacaccgaatagccagacataaacgagagaggccaataggaggcccccgattagccgctccttgaagcctggctacggtgtaggtgaggtggaaggggcaacggagtcaaacataccagcaaaaggatagagtgttagtcagagacgatgttaatcgccttcttaaagaacgaaagcctcttgcatgaatacatagtggcgaaaaacgtagctgaggctcggggatcatgtcgacaatgggccacgaccctcggggcttgacattagatgcacttaccggaggacgactggagacccgagccctggaaaccatcaacacaagtgtagctttgtacttcgcctgaagaaaggtaaacaaattttcgtggaaacttatcttttgcaaactgccccatgtacctggggagtatttggctggaggaggcgggaggtcggcgagggcccctaatcaaacccttctcacatgtttcacggggacttaagcaatgatcgaacccccatcaaagatcaatcgtccattcaatgataaaaccctgttgtaggactcgtgtgcaccctgcttgcccggatttggggacacactgcgggccttaattattaggaatcgtatccatccaggttggccccagtaacttgactggtccccatacatatcccatttttcaacgacaatg

SEQ ID NO: 208 - DNA, 703 bp, Nannochloropsis_gaditana
aatccctgcacgtgatctgcccatttgtgtctttttacctttctgccaatgcccccaaaaaatggtcgctccgagacctgctagaatcaccatggtgaactccatgctcccccattgtcgtcggtttgattgcgacggtattggtggttttggcatgcctgcggcgagttgcgatgggaaatgatatatggacaggttgaggagtcctcagtaaggacccttcaactttacgataaaagcgaaataaaacaaaaaaggccaatttcgcagccgacgccctgaatcctagctttctttcaaaccgcaggtaggccttttgggtgcgtagtacaaagcgctccaaatcttgcctgtacttgtccattagcggggtcggacagggccccggtggcaaggacggcgctgagggcctctcgcccacggggcttggcgacttgggagcttgcactccgtgcaaccaggggttttgacgctcgggacactcgtgggtggcatattcggtcggtaacttctcgatggattttggagagactggcgggttcgattctctggctcgcttttctacaaaagtcagctttgcacccatcctctttcattcaagtgatggtcccatctcccatttccgctccctcctgttctcattcatgattcttttcctactctttctctcaccgcatatgttttatccttacataaaccgaaa

SEQ ID NO: 209 - DNA, 703 bp, Nannochloropsis_gaditana
acgacttgctcgcccaggtcgccaccaacacggagacggccaagaacgccggcaacgccatcctctaccagtgcgtgcagaccatcatgagcgttgagtccgaggcgggcctgcgcgtcttgggcatcaatatccttggccgtttcctcctgaatcgggacaacaacatccggtacgtggcgctcaacaccctgagcaaggtggtcggcagggacgcggcctccgtgcagcggcaccgcaacaccatcgtggagtgcctgaaagacccagacgtgtcgatccgccagcgggcccttgaattgatctgtcagcttgtcaacccgcaaaacgtccaagagctcacgcgggagatgcttaactacctggtggtggctttgcccgagcacaaggcgagcctctgcagcaagatcatgcacgtggtggagacctacgcaccctcgctcctctggcgcctcgacacattgatcaccatgctggccatcgcgggggacgcctgtgacccgagcatcccgcacgccctcgtctactacctgtccacggccgaagacctgcagcgttacgcggtccacaagctctttttgctcctgacagatgatgcctcccagcttggtctggtgctggcggcggtgtgggcaatcggggagttcggagacttgctcctgcaggctcagcctgccctggacgaggacacgtcggccatgga

SEQ ID NO: 210 - DNA, 703 bp, Nannochloropsis_gaditana
ttgtgtttatggcataacatggaatgcacatgcgataggtccgcgcgaaaatggacgcgctcagaacatctctttgaccaggcgtgtgccggagttattcttactttaaaacgcctgcaatccataaaccaccgtcaggtcctttcgagaccacagcaacgcgtaatcgacgtcctttaactacactgaaccttcttaactcccatttgaccttctatttattgtctttcaccttgttatttgagacgcttgtgcgataatttccacgatgcacatggagcacgcaggacgcataccgtcgtcacaagaagtcgcctaactgacacacacgtcaatttttcatcctaatttgccaccctttctgacgatgatgtcgtggaaattcgcctggacgtatacctaaaggtctcgccggatttttccttttgtgatatttcttccctgatgggcgagcgtgctggtggctgcaatacaattctaccggcttgtcactgggctggacaagatatttacgcgcttgtccaccttctacttaaaattgggatgagcattttttgctgtcaaaccctgaggacattgtcttggctgcgttcgacggtctgtctcgtgtgctttcttcttggcggccccatcatccgaggagtccctcgcctcgctcactgcctcatttccgaatcacatcgcagagtcttaagggatcatg

SEQ ID NO: 211 - DNA, 703 bp, Nannochloropsis_gaditana
cccgccatggattcaggcctgggagggcgggagggaggatgaccggtcagactcgccctccctccctccctcgctaagtctggctagggcgctcgagcgaggtcgtgacactcgggaacgggacacctgacctgtcccacccactggactgaatgggatgggcatcgacttgtggcggaggagtgctggttttccgagagtggggcaggacaagcgcgggcatggtagtgcctaaagcgagagctcgtgctgacagtgagttagatagccgaaagcccgatctcgggaactcggggccaagcccggacgaggtggctgattttttcctgttgccacagcctgtaaatatccactcacaatcatccttcaatacaggagggctgtagggggaaaaggtgcctattgggcacacgttggacggagaaaggctagcctaggcgcggagtggctcggttggactgctttttgccggggcgggtggtgctgggaaactgaacagagaaggaacaatagacgaggtgtgcgacgaccctgtctcagagatcgagtccccaaacagagcgggagaagcgctgccaaatgcacaaatacatggtatgctaagaaagactacatttctgtggtgtgagagtccgctggaagtccgggaggtgtcggattacgtgaaagcagcagtcagagagtaggaaggaggaagaaaatg

SEQ ID NO: 212 - DNA, 703 bp, Nannochloropsis_gaditana
ctctcgttttcaccgcccgactgctattggtcagcaccacagtcagcatcgcattcctccgtcctccgttcccatgcaccaccttcccatccatttgcgaggcagcaagcgtcattttgacagaggtggacctccacacggaatgccgcactcgggcacaggtgcccctgtcattcccacctacaatcctccaccaggtatgctacagcacggttttagccagcttccatccgtaccgcccatgctgcatcagcagcattcgtacccctcgcttgttcgggcatcccccggggtagcactccctcctcgtcaccagccgcacgcccactacctcctcgaggccgctggtgcgtcctctagtctaccagatatggcttgcgtccctaccaacttaatcatctccaaaatggacgccatggcaatcaagagggcggagctcgccgaatcgccgacgactcgtatgcaattcaaagacttttaccggcaatttcgtattaaggagcgtttatcttttgaagccgcaaaagattacgccatagcttgctttgaattgctcccgttgagggttcactggaaaattctcctggagttggcagatctagcgaaacgggagaacaggatcgccgaagcccggcgcctctaccgccgcgtctgccgtttgcaacctcacgccgcgcaggcttggttagtgtacagtaggatg

SEQ ID NO: 213 - DNA, 703 bp, Nannochloropsis_gaditana
cgcttttgcgggggaacgccacgggccagatattctgcccatgctttggatgtcgacatgttgtggtgcttgctgtctccgtaagcgtgttgaagaggaaaggagtagaagtgaaatgtaagatctttttggccatgaacatgacattcccagcaagccgtgggttagggtcgatgttgtcacaagtacatccaaatttgtagtcatcgagacggcagcgggcaaaaatcggacccctaaagcgtttggaccacatgcctgacctatctttacttcgttcttgcatctgccctacacgccggagctggatccaccacgtttgctgaggaacttcgggggttgtggtcaatgcacccgcacgtgaaccacttgctagcctttgcatccttatcgtgtaccctgtgagcattcctgacccctaggtgccctcgtactttgcgcggcggctttcagtcagaccactcagaagactttccctcctcgcgtcgccggcattttctctctcccgcttcctccctaacgctttcgcttccgcgtgctcgcatacacggactcgagggagggcatgcacattcacatgagctttattaaccggtggtctcgtccatacgacgtcagtaagcacacagggatggccgcgcgcccctatcggacccgcgccgtctcctagcaccctctcatccccccacatcaactcggcatg

SEQ ID NO: 214 - DNA, 703 bp, Nannochloropsis_gaditana
tctatacgtactgcgctgaattgtattcacactgcatctctaccacgtccatcggcatatttaacaggaattctcgcgaaaatagctgattggaaggctttaagacgggaattgcgtcttgtattcagcgccaatgaaggggtggatgaggacgctgtctgtctttctcttcgcgctgtttggattgaaatgggcaatacatgcgcacccagtgcaagggaataatgattgtgaagcatgggagtcgtcggcatgcttagcatcccataatttcggacgcaatcatggatttgagccgcctttcatagctgccaactcattttcaaaccataccctgcccgcgggggagtgggccaaggcgttcggcgctacggccgtgataagcatcttcccaaccttgatcttgccctttatccctctggtaagctttgtggatggtgtcccctctttgcatgaagatttacacaggctgctgctcagctttgccacgggaggtctgcttggggaggtctttttgcattctttgccgcatttgctcgagcggcacgaccacttcggcagtagtcatggccaccaccaccattccgtgggcaccgcctgcacgttggatacaactaaagctgagtgctgccgagaggagcaagagcaccacgaaaaggacggcgtgcgaggagatgaaggggaggccctgcgggtaagcatg

SEQ ID NO: 215 - DNA, 703 bp, Nannochloropsis_gaditana
catgtgtcggccacttcaggcacggagtcccggacgaaggtctccaggaccggcacggcctcaacctcgccaatagcacccaaggcctcagcggcctcgtgccggaccatagagtcatcattttcgtccgatagaacagcaatcaggttgggacacgccttgcggtcaccaatctgaccaaggacatatgccagctcatggcgaagtaaggctgagtcttgtttattccgtagagcctctccgatcgcagacacggcttcagattctccgtctgttcgcaggacgaatgctgcatgagtacgcttctgaataggctgactaacgtccaggaggcacttccttaacacagccacgtctggagccatacgcacgagccctgaatcgagatgtaggggaggtaagtgagtggaggcgaaggtcatagtacaactacagaattgcatcgacgacatatgtgacaagtccaggcgtaaccatggtgcattgcattctttaagagctatagagatagctggacgaaccaaaaagcacccagaggcgctaggccattgcgccttgtcttatccaggccataacctggtgccaactccacgggcagcacggccgctcgctgtcgtctcagagaagcctacaacggcaggcaagagatgcagccgcgaggactcagcctaatcatctcgtgcctccaacacagcacgacatg

SEQ ID NO: 216 - DNA, 703 bp, Nannochloropsis_gaditana
taaccatttgtttttttaattagttttcgcaatgtcgtcggaggcacaacgaggagaagcatgcgtgacaagcacttcacgtgttcgggaggttgcctgtggcccagcctccggtggccacgtcgagcctccccggcaccgttgcttttctcttgtctttttcccccttaattccgcattaagtcctttaaaatctaatgatgtacgatgcaaaacgagtgttgaagaccttgagattgaaaattcctctttgatgccatcatttctataacttatggatttggtcgcatacatcggaccatggatacgtccgcagtacaactcaaggcgaacgtcacacgaggagcctcacatcgcgattgtttcctttcccccggcgccccatctaaaacgaacaaaccacagttgcccttgacgtgcgcatcagaagggcagttccctgggcggaaagacagctcctggtcgggagcttggaagtagcgcctggctcagactcccagccacccaccgtacgtgccctagcctgactttcacagcgccagccatccttggctccacctgaagcaatatgccggacagaagaataggagatacaactcggtggtgtgtttacaaatttgggggcacgagtgtggcaagtgcagaatgctatcaaactgtgcgggacatcatcttgacggcccaagaaagcacgcccaggatg

SEQ ID NO: 217 - DNA, 703 bp, Nannochloropsis_gaditana
ttctccacggtgcgggattttggatccggtagctcaccaatgcgcgtagaggagccgtacaaagcaagagccgcggctaagctgtcttccacgtactgattgaaagccttgattgtctcgggattgtccaaggtctcgcctaaagcctgaaatttggccacgcccttgcgcacccggggcagatatcgctttttagcggtctgtttggtgctgtatttgccagtggagtcggccaaagccagtggaggatttgctgccagcaggagagcgccaagccctccgagggctacttggctgcggatgtggtcacgacgatcggcagttcccttgaaagcacacagtgtcagcgcctccttcctcctgcaaaagctctgcttcaccgcaataaacgatggccaaaaggcctgtacggctgtagccatggcaagtaaaaggacggcatgcgctctcatcctcgtctgtgccgtgcatgcgatgaaattaagagaggatgagagggtcaagcacctttctcgtgaaaaccggcgacccctccctcggcgagcagagttacattatttataattcaagctttaaatttaacaatgacaccatcagatgccctggcagtcagtcaaatttagcaaggcggccacattcaccgcctaatccctcctttaacctcccccacgacctgtctccttttcccggtgcttatctcaca

SEQ ID NO: 218 - DNA, 703 bp, Nannochloropsis_gaditana
ctgatacttgcattgatcaatttgtgtatacaatagtttcctacatacaagaaatcaacgaacaaaaatacgatttgttgatagcaccaccattttgcttagatggacgaggttcttgttcgcactgttaaaaagaaatatcgatcacgccgctttgaaatctcaactctccctatgacttctcattacagcatgacgaatccggccattgcctgtggaatgcaatcgctttcgaaggcctacaggaagagagaaaccgtcggccgggctacctagatatggaaagagaaagttatgggagttcgagttcaaatgaggatcctcgcgtgtccgcaacccgttgaaaattcaggggttaagcgacttcatcttctccgagtacacaaagctttaattacaaatgcgcccaaaccaaggttgctaaatgtggcattctaacctcccccccccaaaggatcggatcggtccagccgacgaccgagcacggagaccgtctgcgacgcagtgctgcgtacacggggaaatcactggactcgtagttctcacgctcgaattctgttgaatcaaattctcatgtaggtttcgcctgagcctcgtatacttgcatcgaacgcgtctttgagaggcaggctccgattttgacccaagccatcggacaccaacccttaccgcgtgtaatgggcctctccgtttgtcaatcatg

SEQ ID NO: 219 - DNA, 703 bp, Nannochloropsis_gaditana
tcctcacaagcaccgcatgatgggcagcaagtgtattatccgctaccggggagcgttggggtcgccggcgacccgagtcagaccgagcagcacccgcatcagtattacggacgaaatgaaatctatgtgaatagagaaatgtaatatcggttgaccaacgacgattgcccggcatgatatgaagttaaatgcgagaagaccctgtttaaaacagaaaacttagcagaatacgattttgaagaaaatttgttacggacgcacgaagctgacacctgcctcgaattgttccttttgtgtggagtgtacctgaagaaatggaagggacggctaccggaactgataaacaaagtaacctgttccagtgcatctcacaactacgtgttgcctcgagccaggaggttacttgatgtccaagcgagcccacgctttttgtgcacgcctgtgttgcagcactctccaagtgccgatccatttcgagggtatgtaatcattaaaaggggagatatggtggtgtcgaacgcatcgtaggggaaaagacacacaagttgtgaggactccaggaagcaagcctgaggtgcgagcgacaagatctagattccaccagcttgtcacttccctgtattcctcccttatccatactccttcaaaaattttctgacaagtacagcaagtatacattaccattggcaagctaaacatcatg

SEQ ID NO: 220 - DNA, 703 bp, Nannochloropsis_gaditana
cgaggaaagcaacgatatgcaaagacggcactccctcgcttcccacgtctacgcgacggccgaacctttctgctcaggggtggatggaagtcttctctttcttacagcaacaccgccagagctcgtctggcttttctcgttgcccatcaccgccaaatcttgcgtcggaaatggccctcgctacatgtcttgatgagaccctggagttgcttatggacgaaagccaccacaatcatgcagatgcattgcgggcgatcgccacgcagacgcctcgcctcctagaagggctcactgcccctctcgccgtgccctctgctcttccttcggccttcaactccctttcgtacacactgtacgcgaattctggccacctgtcatcgcccttactgactgatattgcctgcttgtcgacattctcttcagtcttgcggcgggagggagaagatggctcggaaatcattagcagccgtcgtcccccaactgcattctcttggcttctctcatcacctcatgctgtcacatcctcctctgatctttcctcctccccttcatactccttcgtcttcccatcctcgacggttgcggaagactgccggtgtgataatgtgagcggtgattcctggctgcatctgcaccgaacagcgctcgtcctaaaagcggtcacgcgccttcatgagcaaggtctctcagctggttcatctgc

SEQ ID NO: 221 - DNA, 703 bp, Nannochloropsis_gaditana
cgatgtccctgacacggaaagagagcatccatcccccgccgcattgggggctttgaggaaagttcaagccaagatagaggggcgttcagtgggcagcaacgccgatgatcctcgaaaagcgttagaaattaggcagcaagtggacaaatggatacgggaggccaccgatcctgatcgcttatgcgtgctctttgaagggtggatgccttttgtctgaggatgtcgtgtaactatcaggataaaagaagtatagaccagaaagatgcgtcatgaaaggtttcagttgaccccaaaaatgacatgttgtcccctttttaacaatgtgcactcgagttttggggcgtcttagaaccaagaaatagattatttgcccccgcgaatgcaatcgacctcccccccccttaaacaacttgtattcaaggccgttggcgaaaacaagaacaacgattgccgcctatcctgcggccctccgtgttttggagtgaaatgctgggctgcacacaacgccatcgagcggtgtcgtcgttctaccttgacttagcctcgtcgcccccattttgtcttcacattttagatttattgtgttcgcagtctcgccgaaggcgcacaacaacctcaaaagtctctttgaaacctgctgagctcgccggcctcgctctttctgagcacttctaaagaccaaaaggcccatcagaaccccatg

SEQ ID NO: 222 - DNA, 703 bp, Nannochloropsis_gaditana
ggatagtagtgtccagtcatccaatatttttttcgcaaaggggagcttatgcttgaatctgttttccgttcgaaatccatcaggaagcggaaggaggggttggatttgacctttctattcctgccttgagattcgtgacaaactcgatcgcgccatcccggacgtcggaggaggggggcactttgttcctcccctcctaggcgctgtttagtccccaaaaaagagcccggtccgagtatgacaagatgcacctttgatggggtgtgtcattggtaagtgcgttcatttcgcgaattctttccgtcgttcatagcaagcgccgtttccctttccttgcttgagggccgcggctttgcctcgggtgggggcttgccaaatattgtatccccccggcctcggacaaagccagccaggactgagaacagtcacagtcctaccggacatcatatatcatgcttacatacttgtcaccttttgtaatgcgaacgtatgcttattattggtattgcgcgcacatgggatcggcaagaggggggactgacttgttcttctaccctttgttatcgatgatgatcatcatgatgctgatgcgatcactcactctatgctcactcactctatgctcgtggggtaaaaaatattatcaaatgcttactaactcatgctcctacttcttgcgattgcttaagcggcatttaaaatg

SEQ ID NO: 223 - DNA, 703 bp, Nannochloropsis_gaditana
cgtagtaataatgacccacgtcgccgtggtagaaatatgacacgcgctttttggacgacatgtcctgcgatttgtgtcctggcgtggttggaacgcgaacgtgggggggatcgtgagggacggaagagggagaacaagggacgttgccgtccttggccatccacgtagttgacctttccccaaaatacgtagtccttctctttttcatgtaatgtcaaatcaagaacacctcttttcaggcttttgtcgactaaaaatacatgctcttttggggttgtcgggacaacgagggcgatgtgaacagttgttacggatcatttatagagtaaaattgctttggaaaacgacacaaagccatgcacaagctagcctaggtcactttcgttgtatttgtaccgctttgcagtaaatattgtcgagcgctgcgagctaaaaggcccgaagcaaaccgcagaaggaggacatggggcagcgagcatcatgtgatggaaattatagtcaggaagccgttgtcgttcgtatggctttcccgccccggtccttgaggacttactttccttccaggttttgggtgtatctcctcacacaaccaaaagggcttcccacatttttttcttggaagccgactgcgctccgatttttcttcctcacacgctcgcacatttatctacctcctcccccaccccccttttttgctgtgaca

SEQ ID NO: 224 - DNA, 703 bp, Nannochloropsis_gaditana
agtccaggtagaagataatatcacgcacaacacatggccaaatgctcgaactttataaagcaatgacgtgcagtgatccgcctaagcatacatggtcatttacttttttgaaaatttagcctaaaggaaaattgcgaacaaaaaaaggaagagcatgcttgaaattgaacatttttttcactaggcatcctgtcgcacattgagaggaaagcagccttatttttcggggacaaggagaggaaagcaggaggagcggcagtaagtgctgaatgagtgtgctcgaggcctatggtatcctataccacataggaaccccgcatattgcctgacatccatcattgcaaacaggtaatgagatagagcgagccttgaaaagagaaggataaggatacataattttcaggattattatctacgtgccacaaaaaagggaaataaagtaaagtgtaatctgcatagttctctacattaatttaaagctaaagggccaatgttgtggtaagtcgtcctagccatttctgctgtcttgccttattgcgccccacacgcttaggtgtggcagtcgtcgctgacaaagtttagcgaaagcctcgcgctgaccggagagacttccatgcttccatgatctgccaaccgtgcccgctgcatttgaatgacaaggttctcaaaacaatctgcttacgtgttgtcactctacagcatg

SEQ ID NO: 225 - DNA, 703 bp, Nannochloropsis_gaditana
tccggtgctgaaatgtccaaatctacacgatcaaaccatacattgctcagcgcaccgcttgcgtaggtgtatcttcgaggtttggctgtagggcagtgcactgatatgccgagagcgttcattcgctgagtgaaacccgtcgcacgcaaggcatacgccatgttgccgccatcatctccgctaccatgaaggaaaattaaagcgcctttttcagtatgcgacatacgatggtcactgctgtttgcactggatgctgttggcttggcacgtactggctgggaagatggtcgcgaactccagcacgtagtcgaggaagagaagagcgccgcggcggtcacagccgcccaacgggtgggcctgagccaacgtaggaacagagtaggcgtcaaaacctgcggcacaatttttccctgagacaaggcgagctctccatggtgagtagtcgttcatccgacgggcgtgacgacacagacacaaggagtaaggtttcgatccgatcttctggtcggggcgaacgcgtggccagcaggttggggaaagggtgacgcaccccccccaggacccctgtaccctcccgcgctggattttcgtccttgtcaagccgatctttgggtcttatagcatctcacatggtcatattatttgcgttcatagacagggatcttttcgggattcacaggtcgaattttagcaccagagcatg

SEQ ID NO: 226 - DNA, 703 bp, Nannochloropsis_gaditana
cggtagaaccttgccgggcaaattcacgtgcaggcaaaatcgtacaagccgtggatgtttcaatcgtagacgtaggtgtgtgatgctgaaggcaaaggctcgaatagttggggagataaggaagcaatatctcactgtctgcgaaagcttgttgctcttccgcctttacaagacgacgcaaatgaagacatgaagggcaacaccatgcagagaagggggagatgatggaaagggacgaagagacgacatgtttatggggtggagcgtgatcattgttgtgaagcgaagggaaggagggtgaagagtagagcaggaggaaggacgcagacgaggatgcagtgcagatatggagatgatctcggcggggaggaggaaggagagagcgcagagtggaaagtgggagccgaagggcaggcgtcggcatcttcacgaattccgtgcgagcgcaccaaagtagtgagggcaaggcagtggcgtggcacaagcccgagagtgggatagatagcggggacgaaagacagccatcaagaaggaagagctgggggcaggcgcctcaaggggggggaggttactccttcggcgtggggacaaaaaggagttttcacgcacggaccggcgaataaaatgacttgaacgcatccctatttacaacgatagaagagtcagactttttggagaagaatttcctgcagcttttgctatg

SEQ ID NO: 227 - DNA, 703 bp, Nannochloropsis_gaditana
ccccgtgagtcctaagaaaatgtagatcataggtatagaaaatgtatctgaggcatattacgcgcatatggcttgcatgaaggccgcttgggtgcctaggtccctccctcagcccctccaaagagcgagtgaaagacggaaagaatttcgagtcatcaacatcgtcctgagggcgcgcgcagttcgtgtggtcaaagaatgccgtgccagctctcttaaagtgtttcatgcttccagagtattggacacaattatttctcacataaaaagaccgacaaatttgtctgatagctgagtttatttttcctgataggctgctcctccaccctcctattgatcccagtggtagatttctcgtaccacttgccgagaagctgcactgaatgtcattatcatcagcgtgagacccctcgaactaagttcatacgtttgcaaatgagcaaaagtcagggaaatgattgtttcggaggaaaaaaagagaacgtctcgagtgcctcgccaacctcatctttgtgaggtctagggttaggcgatggcctcgtctcgagtattccttctttgatgccctatgaacatgcagactgcccttggtttgataatgcttaatccctacaatgccaactgtattatcatgcagggcgcgcgtgaccctcttagattctcactggcatcctttccttctaggcaaccgaaaaaggccatg

SEQ ID NO: 228 - DNA, 703 bp, Nannochloropsis_gaditana
ccatttgctctgtactcccttaaaacaacaggtgcaggaacaaagggaagcctgaagtggtcagtcgttgttttttctgttgtatcctaccacgccattctcgtcgaagtcatgggtaagtcagaggtcaggttgacggaagagggggaacaatagagaagggataaaatacaagcgcgattggactttaatgagcttcgaaacgcagttaaatgaaacgcttgtagcgttgtggcgcatagcggacaagaagttccttcacaatatcaatcgtataccattgagcggagcacgaattggcttccataacaccgagacttgccgcagtacacagcacagtgtcgcctgattgggcaatttctccctggagttgatcacgatttgaaattttaagttttcctttctcgtgtttataccctgttcttaaatctacgcaggatgcactagctcgaagggctgttgtttgtgctgtgttccagatgcagccctgaaatcgtgcggccccgccgtgcccatagcgaaagaaataacaaacgggtatcctgcgccgccaggacatggcacacatacacctacgcactcccaggggcttggagaggccatccaaacccgcacccgctgtatttctgcctgtgcagttcggtgcattcatgaccatcttccaggacatcgccacgatcatcaacgagcccccgcgaagatg

SEQ ID NO: 229 - DNA, 703 bp, Nannochloropsis_gaditana
ctcacgttctctacagaagcaaaaagacgcgaaagattcagcgatactatcatactttccagacggacgtaaggtcgccaccatccactgtgggcacaaacatcttcgaagaattgccaattatcacttctgtggtctttattcttttttggttgaggcatttttacgtattttagcaagtgtaacagtacacagctatctatcccacttctgccgcattcaccttcgctgcaccaagtggttgtaaaaattggataaagcggtatcataatcgggcatggggaaaaaggtttgaaaatcggttgccgcggtccgagaaacgccgaagtactacgtagtacgtggtcgtcttccgctccccggccaagcattaattgacaacgagggaacacgaagcacctctatggtgcattatttgtttaatgagcaatttatacgtatcgtggtctgaaaatgacttcttgaagaccagggcggtcttcttggtggaaagtaaacgcctcggacgaccatgtgactcctggatggagacgacgagcatagtcggctgttaaactcgtcgcactatttcaagtatatgcaataacctggtgggcgcgacctttcttgtcaagatataactatgaatacgagattgtaatttaagtacccgtaggagacaatcttactcagatacgttaccgctctcatcaccacagatatg

SEQ ID NO: 230 - DNA, 703 bp, Nannochloropsis_gaditana
cgggaggcgtcaggaccggccccagcctcggcctggacagagtcgggaacgcccccgttggcacttccttgactctcgctgggaagaacagcttcgtctacctccattggagcggggaactctgcctccacggcggatgacatctcaggcgagggggcgctggccgtggaacccgtttcttctcccggcgcgtcaggagtccctctggcagcgtcaccgggcgacatagcgatattttccgctgttggttccacgtcgaggtcctttacatcgctatttccctcgttcttggcggcggcggctcgacctgcaccatcgggcatgctaatttgcctctggggtggggggggaaagggggcgtattgaccgcgaggaaagttactgtctgcacagcgtaaggcgcaacaacatgcaattcagacatcctcttaagaagggtgcaacgaaaaagtcaaatatcaccatttcaggtctacatctggagcattccttctacttcgtacatggcaaagtcggactcggatgttcaaagccattccagtaacctcctgtcctgctcctcccaccgccccgatgccatgtaatccaaccatgctctctaatgctgatgccgtaccaccacatccacgcagacaatgttggcgatgcttaaaaaaacacttccggtcgatcgcttgccggcgtgcacgctgcaaggtatcaa

SEQ ID NO: 231 - DNA, 703 bp, Nannochloropsis_gaditana
ttacgcccctcaccattacatttgaatgcccgtccaccatcccgtcccgcctcttccgacgcaaaagcctgggcagacctgaacccgccacattccccccaagcgtcttcatcagtcacaccaaccgatatttctcgttttcaagccattctgacatcgacaaatcccagtcacgtctctgcaaggatgggcaatgaccaagccagcacaatgaagccctcgtgcgatgcctcctctgcaggcggtgctagcgctattcctcgctctccctcctccgctgccggcaaactcctcttggccccctcaggcccggacgacgaaaatttgctcgccccctacacacaagactggactcacaagtggaaagctccccagtgcccagcggtccttcaaccccgcacgaccgagcaggtggcggggctcctgcggcattgctatgagagagacctccacgtggtccctcagggcggaaacacgggtctggtcgggggcgggatccccctcgcaaacgaagtgatcctttcccttgcgaacatgaatcaaattatcagctttgacgccgccagcggcatcctggtctgcgaggcaggctgtgtcctcgaggagctcgacgcgtggttgcgcccccatggctacatcatgccgctcgatttaggcgccaaaggcagctgtcaaatcggcggcaacgtgtccaccaatgcgg

SEQ ID NO: 232 - DNA, 703 bp, Nannochloropsis_gaditana
ggtcagtcttccgggtgacgggaggtttttcagcgacatccacacgcctagaatgacaccaataagaaaaaactgcgcgacactgcgtacctgcgcgcgttgatgaggcatgagaaaatggtcatgatatgtacaagatgaggtattgatgaactcatttcccccgaatttcagatttaagacatagaatatacctgctggtgggcaagaatagggtgtgtggtccgtgcggctttgggaggtgctgacctgcaaccgtcgaaaacctgcatctgagtcttaagagattcgactacacggcagcaatatttaagcatgaagtacacaaacaaattgttctttttgtctgcgcgcggggattggttcaagaggacttgcgggaccacacgactgccgagtcgtctcctaactgctccaagcaactgtaacaccaccaggaaaattgtcaaatctaccgaggccacttcatcaccattcctctcaccctgggctatctatagccgctggttgaaagaccatccagtgaaaacaaagctcctcacctcctctttcatcatgggcgcgggcgacgtggcgtgccagtttctcacccgatatgaaaagcagcaagaacgtgctacagacctcccgaatgtggcacgttcgtctcccactcccactcttccttacgactggtaccgcaccgctaaatttttcctgctgg

SEQ ID NO: 233 - DNA, 703 bp, Nannochloropsis_gaditana
caatgctacgccttcttcacatttctgtaacaactgccctattgcgaatcactgtcgatgtgaagatccatcatgcccgggcctttttggcccttaaagattgcgtcaaattgatatcgtccgcttttattgcttaatgtaatgatcatcattatcacaaggctctgggactctagtccggtcgcaccggcaacgcttggctggcgcaaaatgtgtgcttttgtctggtcgaagcctctgcggtcaccgttgtccctcggaaaatctcatgcttcagtgacttgaagaccgtcaagaacgtgggtcgaaaagttgtaacgaaatgcctttggataggccatcttgcatggaacagcgacagaagaagacttttttcctaatttgtagcaccgaactgctttgttgtccacagcgcaggtcggggcaaagatactaaagaacaaggaccagccttttctcccccaccccttgaccattggatgaacggtcttgcgcacacaaaaatgaagtgagaacgatgataaataaaattaatatgccaatcaacgaacgttgctcacttcatcatttactatgtctaagtgcacgtgagaaattaaccgtgctggggcagcattgtccgtatcgggtacccccgaaaaatgcctcatcaaacggccaattaaacataacatggaacagtgccagccaagagtccaccatg

SEQ ID NO: 234 - DNA, 703 bp, Nannochloropsis_gaditana
ctgcgatgtgaacaggcaccagttttttgcaaccggaggcctacgtagacagaaaccttcgtttcaaggggtgacacctttattgcaacgttcaacaatttaacaaacccaaagcattatggacaaatgctgtgctaccttgtttgctcacggagggtactcccatagcgttatatttccttcaccgatttgggaagggatacacgcaaataacttatccccttatgtacgtttctgataattcgctctttataaatgtgtggcatcgatttgtggagaaagccttgaaagcatgcattatccgcctgaatcctttttttagacactgcgctgcaaattgtgtttcttcttgactagctcctccaggtccagatttcaatgagggatcgggagaatgacttttgaaaacctagaataccccagctctgtgtacgatagaaatactaaggggggaatccccacctttggaattgatgaagcctcgaataagagatagagactgtcatggccttgccttcgccgcagatagacgaagatcaacttggaactttccgatctcgctaaagccaaacacgcgagacatcctgtcttgaaattgaaagtcagcgacctctgtccattttttccattttcccccctatcttgattgctaacgcgtaagacaattgtcatacctttttcctgtcatcagcacatcaatatg

SEQ ID NO: 235 - DNA, 703 bp, Nannochloropsis_gaditana
ctcctgactccaggcttacaaaatggtacacgcataacatgcaaaagtacacgaattttcggtaccgagtaaattactcatcgcatatctcagcaatgtacaccacgcagataaaaaaatacttcaaggatcttgcgtgcacatctcattagcggatataagactgaacacgcttttgcacgcaagccatcctacctaccctgttttaagaaagttgcgatttttgtttgacaatatcagtagaaatgatgctaaggcctcataaataacccttgtatctccgttcacagcacagacgaggccattgaaagcctcaaagccatcctggtgcccgcgcccatggaatctcctgtaacacattcccatcagcacatgcgacactacgggatggacaccattgaaactatgaattatgatagagctcatcaaggagagcattattttcataaaacacactttggaagcaaccaaaatcacgtacagaagggggccatgtcatcatcggaaatgagccccaccaggaccgcgttgcccgctggaggcatttccggacagggcatgaaaaccattcagcaaacgccaactcatcatcaagactcatttgaggatgatatatcgagtaaattgaatcggcgaggatggtctactgaagaagatgcatgcattttgaagctggtccgcgcgcacgggaccaagaattgga

SEQ ID NO: 236 - DNA, 703 bp, Nannochloropsis_gaditana
aaagagacgcagcgtttccaaagtgaccgggaatcgtcgatcttttaaaaccttcggatacggaaagataaaggaggatgaaccaatggaaatatggtgtaggacagaagtagaggggggagccatggaaaaggaaggcagataaggcacgacaagcgaggaattactatgacggggtattgtttctgtccagagagtcaatattgtcatcctccatcagatattttgaaagaggtttcgggattatatcaatttctcagacgcaccttgatcatctctgccccgacggcccctgtggctcccaccacccccactttttgcatggcatggtgagaggaggaactggacatacttgctcagctgtcggctaagtggaagaatggccgcgcggagattcgtgtgaaaaagggggggaaagggaaacgtgagagggatagatcagggttgtaagatctaagctgagctattgaggaggctgggtgcctaaattgaagcacgtctgtcgaagcccacgaccacccgcaggcgcggacagacggtggttcaccgagcctacatccacagcacatgattgaaaattgaaaggcatattttcccgggactgcggggtgtgttacttgaccctcgcgtgacatagcctacgggcttcagcgaggaggcgaacagggcaaggagggaggggaggaaaaggagaaggaagatg

SEQ ID NO: 237 - DNA, 703 bp, Nannochloropsis_gaditana
atgtgacaaacacataatgttcattttacagcatgaaatgtcattttaaatagcacggtacaaacatagctcagtgatctttttttccccctttttaaaaacgccttatcacaagaaaaagggctgccgtgcccaacgttcctcatcctggtttcggctctccatggttgcgttgcataactttaatttcaagaaattcgtccgacaacaacaccacataggtcacatgttcatgtttgcacttttctgtggcgctgaatgagttcgcctgctccttcacatggattttggtcttcacctagtagtcctcctgacggcgacgcctcggttcccccttctctccctgcagcaagtgccaccccctcgaagaagaccctcttgcgggaggccctcattgccttttatgaagtgcacaacccgtctcagcttgtcgacgttttacttgatgagattgtcgctaaatatttgggacaggagtctcagctccttgccaggctccatcgccgttacggagagatgccccgcgtgccgtacctccctcgcaacgggggaaaactctgcatgggctgtgatgacactcttccatacaaatcaatggacgactcagctctaaatcatgggtcttccatcggcattcactcggaagcagaaaaagcgtcggatgaagcacgtgccaacctcctctcccctcactttgacgcca

SEQ ID NO: 238 - DNA, 703 bp, Nannochloropsis_gaditana
tccctccccagtcgttgcctcgcacacaacctaggacttcacctttccatggaaaattgagaagtgaatattggttttcttacggcatatcagatgaaatcatgacccctaaacatgaagagctgcaggcaaaacacctgctctggacgagcacgatgaaatctcgagaacccgccgtacttcagttgatcccgcatgatgacggccgccattgaaataagccacctcactttattctagcaccgatttccaccgttgtgagggccgaacgaggacaatttcgtgcgaaacaagcacgaacgcgcacacgattagtaggacagacgagcagatcgatggcatgcggcacggtctcgcgttctcggcgaccaggacaacggagcagagggaggcctgccgagttccgaggggcattttagtcccaaaattgtgttgacacgtgaacaagtggcttgaaaagaggaaggaaatgcctgggtttcccttcgagagcgggaactcgcttgtgcgtcatcctagctacccatggtccctttgtgggggaggctgtttcgtcctaccgaatgtgtggcgctccatgcatcttctgcctcccaaaccaccaacatgagcacgcgaaggaaggagaaaaaagtggccgcaacgttctcttctcatatttattgtctcatcacaaacataggtacataatacaacaatcatg

SEQ ID NO: 239 - DNA, 703 bp, Nannochloropsis_gaditana
aagataagctttcggtcacgtcggccttgccacaattattgtagtacaatcagtgctagaggctttcgtgagtgaggaggcgagtatgcgagaagtggagagtaaatgaagccggaaatgccctttctgcaaccaaattcacaaaatccatgaaccggaatgcgtatgtcaaagctcagcacactttatgtgttttccgccatgattgcttgtgtatcgggagcgcgggtatgggttccaaacgctgatctaagaaagcgagtgggcgagtcgttggagagacgcgataccgtgaaagctgaacactgagcgaagtggtcgaacagaaacatgtcaagcgtttccgctttcacacgcataaagccgggcatttcatgcgtcctagtgcaaatgctacatcacggtctgctggcaaggccggcaactcgacccatttagcacccttataggcctttacttagactcttttgagcaacgcaacaacaaaaaggcaaccacatatctcaccaatctctccacctggcacacgttcgcatcaaatcattgcttcctacatagtgaccagttggcttgtgcaaggattagccatcacggtgcgctggctggttagctgcgtccatatcaaagcggctagcagcaagcatcggggatcatttcctttttcccgaaggccctgcatttccaaaccagaacctagaatatg

SEQ ID NO: 240 - DNA, 703 bp, Nannochloropsis_gaditana
gccacggccccgcgtcactgccggcatttgggggggtaatcacgcccatgccaagtgaccgtacggcgagcccgatagtttcgtcgtatgcagagctaaagcctcaaagttcaaggggagggaaatgtccggctctgggagagcagcaatacactctgacgcgggcaataaccgggccgcctgcaccaaaccagacgtggtgccccaaatctcccgcgtgcaccatatgaacttcgtacatggagcgaccggattcgtgagacggcccggccacacgtcatgtggataggagaatggaccacggaacggcacggatggccacgtgtatttatccgcggagatttaaccttgttcttcctttctcattggccttccgctcgctgaggacacagcgagcggaggggatgccgagcaattcaattccccgtggtgctggctatgtgaagacaacttagagaatcatgtgggcagcgtcactcttacgattgtgtggaggcaaggcggtgtcagagaacccggacggtgcgccaaacagtggcattaaacgtatatcatgtctgccgccagcctaacacctcgaaagcctgatgctttcttcgcgccttattcctacaagtggtattcatgtcttagagcaagataaaagcgattggcttctcgatcatcacaacaaaatgcgctttgaagacactgtctaggtatg

SEQ ID NO: 241 - DNA, 703 bp, Nannochloropsis_gaditana
tctctcccatgctccttaaatagcaggagtaaagtcacatgcggcgaatggttttcatggtgtgaaaaccgacactcggagctttgtgtcgtgtatttgtgttgagcaaaggcaaggagggatcagaaatcgcgagaactcggggcagaatctatcctgcccttccaattgcaagttattgtatcattctacgtggtgaagatgcattgacgaggctcttgagcgcaatgtctgtgcatgtcggcatatatcgcgttttttcccaaaagggttgactgaagcggatcgaatagaacaattaccatttcctcaaccgcagcggcacatggattgaatcccaaaaacgtcttttgcacaaaaaacgggatgagccatgatttgtggcaccctgtgtcaaccccccaccgtccacacggatatgatggacagggggctgcttttcaatgggcaatcctcctatttagttttccgcctctggcagcaagctaaccctcgctccctccaaacctcaagcgatgtgctcgtgcaaacccttacgccatgagcaaagcacaagaacgaggatttccgttcttgccccatgtgatcacgccgtgacattcctggcatgcacaccacaggtttacgattgcttgtcgtcgtcaagtcatccacgtttctgctgccttcttggaaaaggcggctgggctaggtgaccggcatg

SEQ ID NO: 242 - DNA, 703 bp, Nannochloropsis_gaditana
ttttcacgtcttgacattgctcttgggataccatgggcataagcctgctttctgcttatttcgtgagggacagacgagacagggcggaagagaaagtaagaggacgagaaatcgacaatccttagacgggtcaataatacatcaaatgcttcacaaaagcatgtggtaagaaaatcagcccaacaaaaggacacggctcagatgatctccgtggtgagcccccccaaaaaagggcagctctgcgcttctattttgcttccaaaatccgtgcagaggatgagggtagctttgttactgtcatttatgcattcttttttgggataccttttggaaagggaggcatgaagtctggtgaaaatggaaaagtcgtcgtctaccggtgtccgtcaaccccacaaaatcctatccttttaaagctaaaaatccaatcaatgagcgcaattacacataaggtaacttgactgtatatcaacacctatatgaaaatcgctctcgctcgtgcgtggacgatgtacgctcagtaaacgagggttattaatttcctttacctcctccccggtaactttcagtctcgtatgggcgagtgcgtgaagctcgcccacagagaattcttcgaatccttttgtggcctttttcagcaggtgcagctcaatatgctcacacgttcattaaatgaacaatacaccaggtagagacgagcatg

SEQ ID NO: 243 - DNA, 703 bp, Nannochloropsis_gaditana
gtttgcggcgctatttggacgggtggtggagaaaagaaaaaaaagccggaagggccagccattcaggccaaatcagccttttccagaccgacgagaccgtaccttgtgaatgcgggggtcatataaagcttcaatcaaggtcttgcagatagccctactgtcgtgtaagccaggcacgccatttcgcatcacgactttatcccataattcctgcggtaattctctccatagtcgctcctcccattctacaccgtcttcgtctgagtcggattgtttgggggcggggtctggcggcggcgagacagggctcccatcttgcaatgaatccagaagggcttgctccagcatttctctcgaatattggtctaagtctgacatgatcctgtttttcaaaatgagaacgctggtgagctaggcaggcaaatgagaggctttcacacctgttgccagggttgcagagagtgcgtaacggtttcatccgcaagctctgtgcctcataattacaccgccttttgaccgaagaatggggttacccggcgtatacgcccacggattgtactgtcacattgccacacccattggaaacaaaccttcaagagtatgtcatacacttgacgttgcgattcccatacaggagtgccccacccattcaacttcggtcaaccacctcctccagaacggccccggcggcccatccccaatg

SEQ ID NO: 244 - DNA, 703 bp, Nannochloropsis_gaditana
gagactttgttaaattggatcacggtgagcctccaaaaaatatgcggacgcatttcttctcacatgttgggtatttaagggcacagtaggctccatcgagtgtggcggacgccgtgaacacccctgctaggcagaagcctacaggcaggaaaccccaccaccacaatgtcgccgggcaatgtccatgtcctctgcgcacaaaagttgcgatcgatgagcttacctgattttccatccctctttccgcgatcaccaggtggagtctcacgattacatcaacattctacgcctcgctgtgaagtaccggatccacagtctgcatttggaggatgtgctccgcttggagacgcagaagccgaaaatgaccctccagggaggaaattatttcatcgttgtctccactctgcgcctggcacgggagacggaaagggccctggaagcctggctggcggagaatcacgacgtggtaggggtgagcaccgaccgattagggcgacggaaacggcctttccctatcatgctggaggagtccacggggggaatcttcaccaccgccccgcccaagaacgacaacgcggtgatcaacatccgcaccccttggcgagccgtcaacaacaaaactggcacccgcatgtcgatgcggaggacggcgtcggtgctggggggcacgacaccatctacgccgtccacacgtgccttacgc

SEQ ID NO: 245 - DNA, 703 bp, Nannochloropsis_gaditana
atcatcacgagcattttcaccccggctagcttcctggccggagtcttcgggatgaattttcaaaccagtcagggggaccccagcatgcctgaattgtcgtgggagtatgggtacctgtggttttggctttggagttttattttgtctggtggtgtcttggcttgtgtgagatataaagtcgggaataggattaaatggtgttaaaattactgatgatttgtgtgagtgcatatcagtggaaacgatcctttccatgtttaaagaacagaagcacaatttgactagaaatcacaacatcaaagcgtagccaggctctctttcaagtatttttcttgctcgaattaagattatgtctgcttcttatcagctttccggtgaacggcgcgagttcctgtcgttgccgagtattattacccggaagagagacagaaaaagtgtgcaagaaggaaaaagcagaaatgttaagacactgccggccgccgaatggtcagtcatgctcagtcgaaccttgataaaaagactgggagctggtattgcgtcttccagttttacgcccgtcacattttgagaacttttcgataagtatttgcatcggtgttttcgacaacgacttgttccaacaacctgcattgacttgctctcactcacaaaggcaaaggtaaaactcgtctcggtgaccgagaagtcgacaatctgcgaaatg

SEQ ID NO: 246 - DNA, 703 bp, Nannochloropsis_gaditana
ctgtcgttggaatcgggcccatctcttaaaccgtcacttgaaccccttggttcgtgcgctaatacccctgacaaccttcctcccctcccttcaactccttccttacggaacgctcttgcctgtgcagaccaagcacgcccacggctaccctctccctctttccaccttgacgggcatcaggcaatattgggaaaccacgctcctccctccttctttgtctctcgtagccactccggggcccatggcgtcccccctgcggttcctcttctattgcccggcctcaagttcggagcaatccttggccttcatggatgatgtagaggaaggcctgcggggaaccagcaacgcctcctcccaccacgcggtctccaccggcttggagattcccgggtgggggggcgccttggtcctacccgcccaaaacctgtcctcttcccccccttccgcccatggtccccatgctcccacctgttttcttacagaagcaacctaccaccacatcctttctttcctccagcccatcctgcggacgtctcttggcttccccccctcccccccgccctccctccccctcccccggccccagctcctccacccgctggaagtggacagcctggccactcacaccctctctatccggcaccaggacaccctccgttctctctccatcctccgcgaccttcgtcgcgcccaccccgggatg

SEQ ID NO: 247 - DNA, 703 bp, Nannochloropsis_gaditana
acgattaatttgcgcgcttggtttgcatcttttgcggatgtgatatgtggtccaggagaggaggcgaaattagaagaagaaaaatgcggggagggtgccgacgagggcgagaacggcaaacatgtggggaaaaagcgggcgagaacgacggagacctctgtggggcagaatttaaaacccctgtgggctaggttcctccacgctgtggacgagcttgagcatttgggattcacacggccttatgggaagaggacgggagatcgcgcgaagctgatttttgcctacacgctgttgggcggaaagcaggagcggccacaggaggagatgacgcaagagactgagtaggccttacggcaagaccttgtgcaaaagtacgcaaggtcagcacaataaatatagaaacgctataggaagcggacaaaagcataataactctttaaattacctcggtttccacgaaaagcaacttagcatgcgagacctgtaacctcctggcttctcgctccgatgttgacgggccaccatacccggctgggccgaccgctttccaatcgcggcatgagcaattttgtccgcgcttaaaacatatacagttcatgaaaattacatcatcacgttcacagggagtgtatagatctacggtcatacgtggattaggttgcttggctatgtctccttttcttggaaagaacatttttgtgtt

SEQ ID NO: 248 - DNA, 703 bp, Nannochloropsis_gaditana
atcctctctagtgacctaatgagtgcttcattgcatatattaccttgtcgaatgcctccatggtatctgctaccacattttcgggcaggtcttgtgtttctgagaactcttgcaagccttcagccagcgcttgtgccacggatgtctttcggtacaggaacgacagatcttcggccgcttgtgttggttgctcaagtgctgccagggctgcagcatgctggtgtttccatttcattgactcgctctgctcgtgaagctcttcattgcccttccgactgtcacgcatctcttgccctcagcgacgtcgcgaggtcgaccgagatggtgatgtccttcaaaatgaacagcagtggcttgcggaaaccatacataggatgcctgatagattgggaaaggaaaggggcttatccaacgttttgtgcgccagagatgcatgtgattgcctttttgcgccgtccgcctcctctacatctcaggtctctgtggccgctagggtttccgcgctatcttcgatggcctcggaatttgttctttgtggtctctccggggagacctttgccagatttatgcaggaaacttgttataatctctaccatacactacttaccatgtagctcgtagctatagcattggattttgcctccacggtcgaggagagagcacgaacgcgacaagcaaagcttctcgagcgctgaagcaaatg

SEQ ID NO: 249 - DNA, 703 bp, Nannochloropsis_gaditana
cgcccgcaaaggccttggcggtggcgcccgatcaccatgactgttcgttggctgtttgcgtggtcatagccgaagcttagcctcccgttgctcgggtaaatcccgtcgctttttgctcttacgtcgccttccctcggtcctgtatgcgtttaatagtgcttttccacacattctgtgtctcagttgtttgcccttgcctgtctagagtggtctcttttatggttgcacatcagtcgcgcattcgtggcctttttccacgaacgaggcgttccctgccatgatcgcgcgacgcaatcaagtgcttggtagtctgcaacctcttcacgtccatcttcggagcgcatattgatacccccgatccccccccccttgccacgacagtatgaatggtatgactcattcactcatattttttccacacttgttccctctgcaggacgaaaacctgcccatgcgtggtgagcgtcgtactcctgttttttttttcaaagtcaacgctgccgcaacacttcttattattgtctgctgcatgctccgacccactcacagctacacccgccgagcacttgcgttccttgcgctgccaaaccgctcccatttttgtaccgcaagcctctcgcgctccttcacgtcgagatcaatgtcatcggtggcagacttacgtaaggaatactcggcctcgggcttggtggaggaaaacatg

SEQ ID NO: 250 - DNA, 703 bp, Nannochloropsis_gaditana
ggaagaggggaaagagaactgcacaggatcgggaaaagaaaaagataggcctgtccactgcggcgctgcggcacgttgcgagcgagtgttccgctcttgaaccatacatacgtggagaagttgcctgggacctacaagcagcaacacgctattgtacctgtggtacaccgggggttgtttttcacgtggcgtcaagagcgacagagctcgcagcgattgaatccccatccggctgccctgatacgacagcgacgcgtgaggcttggcgccgtggctaggcgcgccacatgggcacgtgtgtggtgaaacttggaaaaagttaaaaactcgtacgcgcgcattggttcaggcctttatgcatgagtccattggcaccgtggcagtctctcaaaagccgagctgccgcagctcgtgtcgtcgactcgagttcgtacgcttgcctgctgctcgaagatagggcgccatatcctcttgatccgtcgggctgaaaaacagcacgaactgcagcattaatcacatagatatgaactgcttaacgatttggaaagctgacgcatgattttctcttccgttttttcgtaaaaacagtctcgtgatcaaggttgcctggccgcgcctctccttcagctagcttcggggcctcaaaaatcataaaagcgtcgcgagctttcttcagcatcaacacggttcaggttttagtatg

SEQ ID NO: 251 - DNA, 703 bp, Nannochloropsis_gaditana
ttagaacaccctttgtagtaaggcagaacgactcaaactgacgaaataccgaccctagctcagttggtagagcgcctgactgtagatgatgaagttccgtatcgggcggtcactggttcaaatccggtgggtcggaagccaactttttcgggtctaagaccctgactggcggcgctatgcgtgagggatgctgaggttcaggaccttgcacggcggtttgggggagggattgtagtgtgcccgttctacatttttaatcttcacaacgtaatttatgatgtcctgtgcgcaagcttcccgtgcgcctcgctcgttcgtcatccctctcaacactccggaaagaaagatacctttctcccccagtacgaaggctggacccgttctagcgctcacagccaaagcgggagaggacgaatgtatgtataccgggtaaggcctgcacgtgtattccttctacgcgtcatgtaaattaaagaacttagataatcattggattcatcgccgaggatcgctgccagaaaaaagtcccggggtacgaatattcaatgtggttcacttcagtgttccctccgcaacccttaccacatcgcacaccactaatttcctctaaaatgtcttcttatctctccatgaaggcaaaatctgccgcatttttataggtactttgcagcgcttttttgacttcgagaaagaactgaaaatg

SEQ ID NO: 252 - DNA, 703 bp, Nannochloropsis_gaditana
gattacctcgctctaaccaccgcggctgccaacattcaggcttcggtgtagcacagcaatatttttaaacgttgcagaggacgtcctagcacaccattctattgggatgaaagacatgacagaaagcaggcaccgaaatcgttccaatttttacaccttgtcttcattaagacgtagcggcattctcatgtcagcattggcacgcacgattcctagtcaacacatggcactttttcctgcagcccctccatgcgtcttgaacaaaggcgataagaaagggtttaactgagcatttaaaccgtcgtcagagcctcacacacacatgtatttcgatacgcgcgcaggcctttccccttgggccaatgcaagcggaacacaagcccctacgcgacctggattcagggagagaaattgtaagggttcagatcattcacttggcccttgcggcctggggattgtcctcatggattttatttaacggtatgtattcggggacggatgcgtgcgtggtgtgggaagtgagctgaaagcccggtagagggaaggaatggcatggccacgcgtacacgatcccaggctcgagacctccccgcattcggccaagtgtattctgtatgttactgccccctgttccgcacattctgctcgcatgaacacgttctcactaagtctctgccccttctgtgccgggagcaggtctatg

SEQ ID NO: 253 - DNA, 703 bp, Nannochloropsis_gaditana
cgagatcaacctgatggatgagctgacccctcaggggtattactcaatattatgcctttgtggaggagcgtcagaaggtccactgcctcaacacccctcttctcccaaggtactccccctccctccctccctccctccctccctccctccctcccttctgggggtcctgttcgtaggggaccagatgtgcggcctcgcattatattcctctcgccgacttgattcgttcctacctcgcgtcgttcctcccttccctcatgcagctcgagatcaatcagtccatcatcttttgtaactctgtcaatcgcgtcgagcttcttgccaagaagattaccgagctcggctactcttgtttctatatccatgcgaaaatgcaacaggtgcggttcctggcagggtcttccttgcgtcaccccttccctccgtcctccctccctccctcacttcctctctttctagtgtgaaataatggcatggcttgtgtccctgatgcagcaccctcattgctctttatcgctttgtttctcccgttgtgacgcccctttctccggacttcctccccttcagtcccaccgcaaccgcgtcttccacgaattccggaacgggggcacgcgccaccttgtctcttcaggtagggaaggagggagggacagaaggcagggtcttggggaaacgacccgcgtccggtttggtactatattcc

SEQ ID NO: 254 - DNA, 703 bp, Nannochloropsis_gaditana
ggagagggacctggaaacctaagtgctaggagctgcctgtagcagagggaccatagtgattgtagactataagtataaaaacgcacaggcaatgaagcaagaaagagtcattcgagctatgcccttgagctgtagccgcacatcacactaacaaagtgacgcgtctgattttcccacaagtgcaggtcttcccttcgtttaatcttgagcacgcactattcgagtgtttgagcagcaggtaaaagcatctggcgcgaatgaaaggccagtcttaagtagatctatcgagaggtctttaccaagtccaagtccgagagaaatacaatggccataggatatcatttagactcttccgtaagcgtatcccaagtctaacagtagcgtaaaccctgttaatgttatcctttagactcgtcctcctatagctccttttccatttcctcaaatgaagcttccgctccgatccacccgtatggaaatgaactgcccactctattacacccgtgtggaagagcagagaggaggcgacgtctacatgatccaaacagttggacttgggaataggaggcacagcgaacgacgcaggaagaatggccagtttctcgtcctgttaacaacttcctcctcctcctccttctctatcaggactttttatcaaccctgaaactaaccgtcctctgtcctttccagagaatgacggatg

SEQ ID NO: 255 - DNA, 703 bp, Nannochloropsis_gaditana
ctagcgctccttcagcggtcctgcctgcgtttcgtgtggacaaccaggggtagatcccaggaatggtgcgtcgttcatttcacaatgctcgtcttctttttcaagcacaagcctgttgacctggaggcggtaacgggtgagacctaggcaggaggttacggccgtggccctcaaaactcggccatcaaaactacacgagtctccagccttcctgcccgcccctacccactgggccttgcacgtaattctattgtagggggcccggtagtgcccgtggaagacgtgggtctatgtgcggtgaaagtgttcattcttcctccgcttgaaggtccttatacggctgaggtaccagtgtcattgcatgtatattgaatgcgggggactcatcggctccccgtacatcactgaaacgtcaacaaaaattggttatgcttcaaatgtagcagaagaagaatgaagcgcagttcacggcagcattcgttggacccgtcattctctcaccctctcccaagcatcatactgttggagatttgatggtaaaaccacacttcatggaccagaagaatccctatggtcgaattgtagcgttactagaccccgatatcctgtgtaccgttataccctttcccttctcatccacattttctctcctctcttttctttgctcccgacttccctatacctcctccagagtggcaccatg

SEQ ID NO: 256 - DNA, 703 bp, Nannochloropsis_gaditana
catttccgaagaacaagacaatttctaacagcctgccatggtaggccccctctattccttttcagggtcctcggcaacgacccgtcgtccggtgctttccatgtttgcggacggccatgcaaattaaacatgagcagtatacgttctataccgacatacagatatcctcctaaaagtaaagtgtacgcatacaggatctaagtgcactccctttttttaaatcgctcgaaagctcaaggataagctgtggatacccgggtaaggcaacatgaccatggccgcaggacgccttcctattctcgggaaaagtccgcattttgtgccccactgcggatggttgaaggaaatgccaccttgggaagggcttggattcctgaggcatgtcttattagttctctgtgttcatggaaaatcactgcgatttagatcacgggtcaggaatcacttgggagcccccctctccataatccaggaataacctttatgccggcactcgaatgcgcttaccttcgacatgtctagtatcttttaggcacaaacactcgttacaaaaatctatttgaacatttgaattctctgattcctcctcttggcaggaggaagccagacttttaaaaggaaacctcccaatgttcgcaaactttgctgccaagacaccataaacaagtacgagcgatcaagcgagcagcaggccgttagaatg

SEQ ID NO: 257 - DNA, 703 bp, Nannochloropsis_gaditana
atatttccccgggacaatagcctccattaagaagcattgtcatgacaaaaatcgtggcattgtacaacgtccttcatcagccaaggatcatagtttctccaagtaaaagtttaagattaaacgagaggggttgttaccacttttgtgccgcgaaagtcctctaacccgacgaataagcagagatgcagtaatcagcctgtagcatatcgttcaccaccagttgattatgggcatacaaaatacacacatagagatgtaagaaacatggcttagaaagacacgtcatataaaatgtcaaataaagcaggagaagacctcgctggatggatggacgaatgtttgaccgggacaagaatggaaaaaaaagtacaaggatggatgtgctcgtgcggtcagcaaagcgtcggcgcctctctggcttggcccatctcgcctaggccgagactgcacgtgcgtaaaaacgtggtcaacgggtgaccgaggctttttaagacatagggcaatcaaattctgtattgcgtggctacagaagatgtggaatttgtgctaataactgaaattgcatagtaccggcaagaaacatgaacgaggcccgtgcctgattccgatttataacatattacaggaatccacatggacacataatctacgagacaagccagactttcatctcaaaaagtagtttgtggcaagggcagccatg

SEQ ID NO: 258 - DNA, 703 bp, Nannochloropsis_gaditana
gggtgggttcctcttcggcgcgtattccactgtcgagaaactcacgaacggaggtaagtaggagggagggagggagggagggagggagggaaggcgaccgggagaagagagccgagggacgcattgcccaccgtgggggcagttaggcggtgtgaacgtctgcgtggaggcgtgaggtctcagggggcggcaaggaacgggcagggagggccgggggggggtaggacggtgggaagcccaagtacctaacccactctcctcacgcaccttccccgtcttcttcgcccctctcttcccccagccctcatcctatccatccaggcttggaagcaaacgtcctgcccgcccacgtcgcttcccactgccgcctcttcttcctgcgggctcctcctccggcgagtccttgtcttcctccccccgaccgccgtcctggtcgccatcgccgcctgctacgccctcgccccgtcgtcttccggccttgaagatgctccacaccgcgaccgtgccgggccctacaagtacatccgggtcaagagtcgtgtggggggggacgtggtggaggacgggatgatatgatggaatgcgacccctcgcctttttgttgcatcccctcccccgtggaaccagactggcgcgcggagtgtcccagtagattaagagggatgcttggttgttatccgttgcctcttgcagagagggtaga

SEQ ID NO: 259 - DNA, 703 bp, Nannochloropsis_gaditana
agcgctatatacaagcataaagtaactcaactcttcaaaaaatggattgtccattggaaaaagggagaaaggctggaggaggtggaggccctcgatcgagagagagggcaacagggatggaactactttgtatgctcgagcaacggccattacgaaggcacgcacacgctgcgacattcgcaacattcatgagaccaccacccctgcccttcccgtgcatttttatgacggcatgtagggaggtttcttggcactgcgagtcaaagccagccccccccagggtcttgtcgtcatgcgggggtagggcgttcatattctcccttcaaattcccctccagtacgggcaaaaatgctcgcgctacacgaggaccaaacccccttaacatctctcacatctgtcactgtcaccagttggaatcctctgtcgggtggtggcaggttgcagagtttttggcggggacgacgttcacacgacccgcgacggaagcgttcaacatgggaggcatactacccatggcctgtactttaactctcacgctcctcaatacccctcagtatgtatgcccaccctcacatgtataaaacctacacacacacacacacacacacacacatgtgtgcgtcacccttcgacagcgagcgcgacgttcctgagtagcggccggaagcgggcgggcgaagagacaagcaggacggagggatg

SEQ ID NO: 260 - DNA, 703 bp, Nannochloropsis_gaditana
ctaataaagtttagatataaattgcacaccttcaagtcaagcgcaacaaaagcagaaaggtatcccgaaacatccgcgagggatgggagtctagtaatcgccgcgggcattccttcaagagattcccgttttcgggcttcaaaaaggcaggttaacaactatccttcccgatatgatatcatgtaattatcattgatttgtattacagcacacttcatgtaagttaagctttttttcctcttccaagccgaacagacagggacggaggtaaagcacggaaatcttgaaatttcaaatttccgtttcatcacacgccatgacgtatgacgtctcggctacactcgtccctcccctactcatttcccggtcacttttcgtgcgctcgcacacctccttccacgtccttacaagcttatctgcgtttacttgccaatttgtgttatgaatatgtttcgcaggtggatcgatcccagtattccacctccttaccattttctttatttcaatttttctatagaagtactttatgcaaccacaaaaataccacgtcgttccctcctacggttcaatttcaagttttacgactcattgctctacacattgttttcttcgtggctcacacaggaagcctcgtgacttctgtgtactctcatattgtacaatctgagctgccctttggtcacaagggaggagaggaaccatg

SEQ ID NO: 261 - DNA, 703 bp, Nannochloropsis_gaditana
acatctcagtgttataccacgaagttgacacatttcaggcgagagtcttgacgtaccataaagaatcaggtcagccgccggacctcattaaaaaaagaaattaaggacggaaaaatacaatagaagcgcctcacatcgttgtggaagatacgatgtttctgatgaaacattacgtttcgtatccgccgcttttgtccaagaacagatcatgcgaaatgaaaatgaggtgtgtgccaaggtcttctgcctcccgccgacctgttcttcccacacatgtcttctaaataagggaaaagcaggaaagagtaccaaatggtaaaattcatgatgtaatctagtgctatttcgtcaaatttcgagttcaagaggtgcactactcgttggctcaccaacggatttttgaaatttgaaaagaatggcgtccaacatggcaaccaactcattcgatacccgaatcgaaatgctttactattagagttatcaaaccaaatgaatctcgttcatcatgaaattaagacttagattatctacgccaataagaaaaagaaagctgagataggcagtggtttgaaaagtttacggagcacccgaaaaaggttacgtaaagacgcgcacggcaagttccgtgccagtatttgatcctctgtaaggtccccgtccggactttagtaattgcttgtcaataatcacatattcacacaga

SEQ ID NO: 262 - DNA, 703 bp, Nannochloropsis_gaditana
tccctctccttctcagcgccatgaaggagccagtgcggggagaaattgccccaaaaaagataagccacatccaatttgggttgctatctgcgaatcaaattgagcgcatttcggaatttcaggtgtaccgctcagacctctttaccatgccacaccgtgcacccgcccccaatagccccctcgacccccgcctcggcgtttcggacaagacctcttcgtgcgccacctgcaagcgcaagttgaccgattgcgcgggccatttcggccacgttaagttagccctgcccgtcttccacataggtttcttcaagcactgccagacgctgctcgcctgcatatgcaagacctgcgggcgcgtcctcctacccgaggcggagcgccgctctttcttgcgacaaatgcggtggcccagcgcggatgccctccgcaaagccggcatctttaaaagggtggtagaaaagtgcaagaaggcctcgtactgcttcgagtgcaaggcagtgaacgggaagatcaagaagatcgcgggcgccgccaccctcaagctcgtgcacgagaggtacagtgggcggaacggaggggtggagcaccaggcgctggctcgggccatgaagacggccctcgcccacaaccgggagatcgcgaaccacctggacaaggcccaggaggacatgagccccctccgtgtgtaccagctcttccagaa

SEQ ID NO: 263 - DNA, 703 bp, Nannochloropsis_gaditana
gatgctctccgggacaacacacggaaacgaggcgcacatttgaagacactaggcgttgtgtgcaaagaacgaacaaaccccacagaggcgatggtgacgcttggacgcgaacttgcgagacattgttgcatcgataagaatgcaagcggcaggaggcgacgattatgtgtcgttagcatggtggtggtgcttgtttgactcgaggtcgctgggtgcttttcattgagaaggaagggacatgtcacgatccggcagtgaggactgcagattcagtaggaattatcacgcaacaattgctcacttgctctagagtatgcgtgattactgttgtcgacggtttttgaaacatgtttaaccggcaaaaaaagaaacacatgccactcgtacgctgaaggaagagcgtgaacctgaaccagagggagataaacgaagaacacatggcccttggaagatcaacttgtgacgccatacgtttgctaggccaagatctaataattacctgcattaccaccagacttattaccaccgcattgtcaaattggttttaatcaatccaaatcaagttttataattgctcaatcaccatcctggatcactttccgggtctcaaaggctaacttttaacctcctccctcctccaacggccctcgctgcttgccgccccataaaatgcagccactcgccgtctccccgcccggccatg

SEQ ID NO: 264 - DNA, 703 bp, Nannochloropsis_gaditana
tgccaagccataactgtttctagtaggacctaatgcatcggggcattcttgaagctgccacttttctcccgctagtcgttcataatgagttcacacccctgtctaattcaggcacgcatacactggaagcaaatataggcaggaagtcggcaatttcgttaacctccccctatgaccatgacggaagctagccatgaaaatgtcttaccacgagccccaacttgctttcacgctggtgtcttacaccaggtatgtattttttccgctaatctttatccttgcaagacaccactctggctgcttcatttgatcagaggtcgcgatttcattccttacatttccgtgcgacgtccctttctgttggttggagcagcgacaaacatcactcaccgttactccgactcacactgcggacacaaaaatatcactcagcgtcacacggaccaaaaaaccttacattgcgggcacgaccgcaacaaccctaaccctcaccaccactggcttcccatttctccctgtctgatcgcgggtctctgggtgggtggactttgcggtgcctgaaaggacgggcggccccaaaatttatcatgtatgtaattcgcgctgtttgtacaatggacagactctccatcctccctttccttcgcgttttcatgcccgcttgttgaatacccctacagcaaatttcaggcccaaaagcatg

SEQ ID NO: 265 - DNA, 703 bp, Nannochloropsis_gaditana
tccttcgggagggcaatgggccgctaacaagggtacaatgtttttgccctgataaaccttgaacctggagctttgtaagtacacaaatcaatttgagaaatgaattttattttttcatattatacataagagccgcgacatgtgtgagaaggtattctttgtgtgacaggattgatcgaaaccggacaagcgaaacgcttggctcgtctcgcgtcatctgttcgccgacactccctctggggtcaggtagtggcgttatgcattgggaaaaaactttttgtatccgcggggttttgaaaataagaagatttctcttctggccggggccgaatgctagttgaccgtgcagtaatgcactaaaaaaccttgccacttgtagcgagtgcatggtctccatgtcgaagcccgatgcgtgttgttgcttcgttttcgcaagctattgtgacaatcgtcagggtggacggcacaaatgacgatgatagcgtgtatggacacctggaccagcaagccttcaagggtatgcttgtgcaggttggtttcctcaatgagcctttggcagaaaaatcggcaacaagagatcggctgtgcatgggagaagaggcatctttttcccgtagacttgccccccagacacaggaaaataatctcgagctgctctcagtccaacacataccgtccttatataattttgatctttacaagg

SEQ ID NO: 266 - DNA, 703 bp, Nannochloropsis_gaditana
gactctccacatcagcatgcattggcaccgctgagacattcgtactgaatgtacaagacaaatgcaagtcaaaaacgctgctggcattcgacctccccggaaaaaatggcttttcgccccctctctgtccgagcaccccgagacccggtccctccttacaagcagcgaatgatcgcgcttcacattccattaatgcctgcttaacgggccccaggcctgaaagatgaggcatttaacccgctttttgaacctttggcgagcgtgcgggcagcgctctttcgtagcgttcgtaggaacactcctgtggtactttaaggaatattatgccggaagacgtggaggtttcctgtaagtgtgttgcagccaccgcatggtttgatgcattggggctagttagtcgtgcgcgacctcaaatttcagccgtcccgtcatgagaaagaatagttgggggatgcttcacgtccttttttcctctgcccatcttgctaagggtacgaggacatgttcgattgggcaaacgtggtaccttgcattgccatggatggtgttgctacaggtttgtgcccttatgcggttgcacgcctgccttgggacatataggcctcattccccttcgtggccaccggccccaagtcacagggatcgcctcgtcctccctcgtgcctcttcaacaggtggctggttgctttctcgggaaagtatg

SEQ ID NO: 267 - DNA, 703 bp, Nannochloropsis_gaditana
ggcatgtgtcgagaacggccaaggctaatctccatctttccgtaaatgccccaaatcttctccggccaatcgtcgaaggcttcagagggccttttcccctatttgtcgtctcctgcgtactccggacgcggaggcacgactcggtgccatgtcgtcgaccaccttcaacacatccgttccccctcctcgcagggctgctcggagccactcctcagcctgcacgtgctcaagaaaagcgaggctgtcatccacgactctcaacatgtcttggatcgtggatgatgggtattgacggcatatatctttaatattggagaccactaaacgaatcccaaggcatgcattcagcggactttgttcagccatggacctcattggagcacataccgtggcatccatgcatttccaggtctatgaaggaaatggcaataagcatacttcacgttagaagaacgtaatttgcggggccatcggccccgtgagcgcggaaatcaaattcaccacaccacactcgtcctcgctgggcttcgcctgcctcgccttcgatcatgatactagccatgccgatcccgttcttgcgcacgatctcaggccctgctaacaccacgcgcacggcgcatcattaaaatggtgtcatacccatctgttactcgcttgtccactcttttgcgcgtcggagggagcacaggcgttcttcatcatg

SEQ ID NO: 268 - DNA, 703 bp, Nannochloropsis_gaditana
caaatatctgaagactcctcaagtttttgactcattatagcctcgcgacaggcttggcaactaaaaaggggcaagggaacgttggggtgtaggcattcgccgcttgtcgctcaggaactgcttctctgttccttcacatccgcggcgttcagcaccacaaccgctcgacgcgcgactcagtcacgtgcttcccagttctctgagctttaaacttaaagagctatgacaacaccattgagtagtggacgagggagcgtgatttcatgtttatttgcgtccaaacacgaccttcaccacttcccgcctcgcccctgccgcttcctcttctcggcgaggcccggcgtaggggaaaataatcaaaagaaagacaacaacttaaactctttggacgccttcgacggtcagtccgacctcagacagtaattaagaatgctcattggtgcagggtgttggataaaaaattcaatgtctgtggacgcggctggcgcagggcgtagtctcacccatctcgaagaacaagaggggttacttcttttctgtgcctcggggggcggagaccctcatgacggcaaccgatatagaccatttttctcagccaccatcaacaaagaacccctgataattagctctcgcatctttccttttttgtgggacttcaatttttgtccgtaattttcaaaatatacctcagagcggaagaatg

SEQ ID NO: 269 - DNA, 703 bp, Nannochloropsis_gaditana
cctgtgctgtttttggacgtgatgagattgttcggggcgcgtgctttttgtggacgcggaatactgcggagtctggggatggcgagggctgctagcgacacgcccgggaagtgcgattgtgccctcaaagggcccccttgggtgcggcgtgtcgcagcatttcatgtttgggataccttgacgctcgcacctctttctctcatggatgaagtgatccggggccggatgcggcgcatgattgccatgtttggtggtgtcaatccgttcgtgtcttgcttgatttccggtttcaggaggaagcgcccgagagagacagacgcacatggttttctcccctgaggggccactggtcatgtgccacccgcttgtacgcgcttcacatactaaggctgtgggcaacggcgtcgatccttcacacatataagcatcgcattcgtcttgttctgaaattgttccggttcctaaaccccccccacaggacgcccctcgtcgttcctcactcggagcctatcatggcgccgcgcggaatctgagcatgccccgtgaaagagagtggcattgttaagatttctgatatattccgtccacaattctggtcttctggagcgatagcgtgctccaagtgggggaggaagacgtggaccttcaacgtcaagaagggaaaaaaccaaaataaggagtggaaaaaagtcacgggagtatg

SEQ ID NO: 270 - DNA, 703 bp, Nannochloropsis_gaditana
gctgttctacgcaatagtacaaggcacacacgatagcatgctggcggaaatccgtgcaagcggcttcgagtggaaggacaatgaaatcatgcattttttgggggctatctctgcactacattgtacaccgcctcttgcacgcatcgatgaactctttagacaactgtacgttttgcctgtggcgcgtgctacacagatataatgtataatgcacacatttgccgagttccgcgcaacacctccacttcatcgctctccgtctccccttctacaccctacacagggatggaaagcctccaccgccctgccgagagtcatcgatgggggggtaagaggggtaaagggcccttccataaaggggcaggaggtcgtacccggagatctcgccgaggccggtttgaaacggctcaaagggctctgctatgctccaacatgacaaacccaaggtgttgggggcactgagcgcttgcgagggcggtgtctgctgaaggaacatccagtcgggctttttttggtgactgtacggagtatgcagtaggcaattctgagaaggtctgcgccctggaatgctgaaaatggtcgaagcgaaagccgacatccttcgtacatgtcagccctttttttccattctcacgctctcactcccgtaagcagataaaaattgattacgatctcctgggatattttctaaagcctgtgcatg

SEQ ID NO: 271 - DNA, 703 bp, Nannochloropsis_gaditana
gcccaagatgtcaaacgtaattatggtacgtgcgtatcaaaatatcgtcacgttgtcttcgttaagaattttatttgctttttagtgtaccgaattgcctctcgtttgactattaactttggcgtatcgcaacaccaaaagtgcagagtcagcacatcgggagttgcaaaaaagcgaagccatgcataagcccttaatgaaatgaaatggtagcccaagtgcccgtttattgaagtacagtccgtttttttctagggggcatccgagccacccttaggcccatctcaggtccgcctttgattcacgaaatgatggcagtttattaaaaagttagattttgatcatgaagtgcggggaccaagttttattctgtagcctttttccactctttcatgagtatcctctggcatgctaaggttccttgcaacaaagtcgcgtcccggagggttagagagatcatatgatgcctgaggacacggtatgatactctgctccttgacttgagggagacagggcgaccggcgagctttccgagcccgacaaaatcgaaggattggaacgagaagtattgtgttggtatttgcgcgtacattcgtgcctctacagaccaagtttattcttctttaccgtgaataggaatagcgcgacagcatgggaaacgatgttagctccagcatcacaagcatacgatcagaggaggacc

SEQ ID NO: 272 - DNA, 703 bp, Nannochloropsis_gaditana
gcgacagcatgggaaacgatgttagctccagcatcacaagcatacgatcagaggaggaccgacgacaggcgattcgacgcatggatggggcccttcaaaagaaattgggcaagggggtcgcacacaatttgaagattattatcagaggagaacgcggcagcggtaaaagtgctttgctcagtagacttaaaggtcaaccttttacatcttcagtatatgagccaacgcctgagatcgagacggcgaccattaattggagcgccaaagaagatggtgctgtggtcaaggtagagatttgggacgtcgttgacaaggggttgggccgacgcggtagtttgatcggaaataatgtgagggggacgggcactgtcgcgcacgacggcggcggtgaccctgatgctctggcagggcttccgctcgacgtaccagtgcacgcccagcgcgggcaccatgcaggtgcttctgggagtcatgcatttggtgtattggatgccaccattgtagacgtttggaaagggtcgcatggaggtatattcatgatgaatcctttctcctcgacggcgctgcaatacgtccaaaagcaactcgccgaggtaccacggggcattcctgtccttttgctggcgaactttcgagatttacttcttgacgacacgcaggagggaaggaagcttgaagaggacaccaaacatgagggtgaatc

SEQ ID NO: 273 - DNA, 703 bp, Nannochloropsis_gaditana
agccgggaggtgaagagggagagctcggacaggcatgctgcgctcttctgatgtcgacagggcgccgagggccatctcgtaacctctttctgctccgtgagttacctaacgcgcgtgagggcaagagtcgacgctgcattgcattgactagtgagcgtgctgttttgtttgaagtggtggtgtgagcgtgaggctttgcgaaacacgctggggtgctccagaggcgctctaagccccccaacccccctgtggcaggcaaatgggagagcggtttacttgccaacatccaaaagcatgtatgcaaccgtgaggatgtgcaccacagcgtgtggttttgatccgatctgatttccggaaaggaaggcctcaaggatgggaatgggaagtcacgattgcgactcggaagtatatgcctcgaggctgtcgcgcacaccataaattgatgatcgatggggagggtggcggaggggtgcgggaatggggccgttgagtttcattgcgttcgtaacaagcgaagacacataattactcatgaccaaatggccgtgaattctcttcctgaacaagttgttgtgtctagcatgcctgatatctcatgtcgcagggacaaagtcaaaaggctagcgtcccctaccatgttctgttccttctcaatccgtcgacaaattcctaatgcatcaatcacccatagaggagaaatatg

SEQ ID NO: 274 - DNA, 703 bp, Nannochloropsis_gaditana
cttttccaagttctatgcatttattatccctctcaacgataagaatgcagtgctcagatgttgtagccagtaaagttgtgtttccctccgagacgcgatcgctcacaccgcaccaccgtgacagaacggcgacttgcctcggaggaagataggcatgaacgcccctcacgcagtcgcactccttgcatttcctagtctctcatttgcgacacgctggcatgtgagggattatgctcaagtacaacttcttgtatgctgattaggtgaccattcctccgtttgaggagcagtttttcgagttgttctctatccgaattaaactggtggtgcactaggggaagtctgttctcctcatcatggccgaaagggtcgtgctcttccatgtatttgaccatatcctacttctacgttgttgtaacaaggatattctgcctgacgtagtatttttattctgggctttcaccgtacacgtactcagatcgccgaggcgacattcacctggagtgcgccacctctgcgccgttgacttcgcttcgatcacatcattcgggcgcgaagcagtggcagttcaggtggcatcggtgggggatacatcagtggtaagaagtattgtgaaggtgatacatccttacgcgagtcccccccagcatccaccgccaccgcaacatctcctgcagaccattacctcgcaaatttctcgatg

SEQ ID NO: 275 - DNA, 703 bp, Nannochloropsis_gaditana
atgacacacagcgaaccccgcgaacatatgatatcatctcatgtctttagcttcgtgatgtcaattttcgatgttgtatattgtattttgcacgtgtggcgggtcagctctcagactcgccgcctcgccgagtctcgccgtcgcccgatgaccccgacgcctgggacagaggaagttatttcaagggcccaccagccaagagaatgcgcagtaccgcagcatattatcttatgggtggctgctgtactacttgtggtgatcctgctcctacgtgcgtcgcttctttaccttcattttctcctccttgtgtcttcgtgctacgaaagcaaagagctagagcgatgggtagacttgctttggaaaggctttgcttgctcgttccaagtactttcatcagtgcattactaatttccaacccgtgtttcagaatctttctattttttctactgcattcaacaactcacgctgctgcacgttgttcttccacaagtcgttggtttgcgccgattttcttgactcaccttttaagcatcgttgccttacgatatgatagtcgcacaagtgctatccgagcagcatcctatgtcgcagtgctatggtcgagctagctattgggatagccgttacaccacgtaagtcccagtgccaagaatgcctcgtcgatgcgcgccttcactcctttttcatgcacacaccctgtagg

SEQ ID NO: 276 - DNA, 703 bp, Nannochloropsis_gaditana
acgcgaagcaggacaaaggctcgcgaacatcatcgattggatgatggattaataaccatgggaggtgatttggccttcgctgcagcctcagaaatcgtcaatgaggactatcatcttacagaagatgagaatgaggtgcgagctgaaagaaagaaggatgcggagtaccaggcgcatatgaaaaacggtatatgggaattaacccctttaccgaagggagaacgttgtatctcaagtggctgggtggaaattgataagcgagatcagaatggtgttattgtgaggagaaaggcgagatttatcgccaaaggttatggtcaagaatttggctgactacctccacacttatgcacctgttgcatcgataaccacgattcgtttggtattggccctagcatgcatattggatcttgagctggataacatggatgttggaacagcttaccttcaatcagaccttgaggaaaaggtatatgttaaacagccaattggatatatgagcaatatggaccgaatggagaggagctagtttgtcgattgcgtaagtcgctatacggacttaaacaatctggacgtaactggcataagaagattgatggatggttccgaggatatggtttccattcttcttctgtggatccatgcttatatgtgaagtttggatctagtggtgagatgttggttgtcgtcttatatgtagacg

SEQ ID NO: 277 - DNA, 703 bp, Nannochloropsis_gaditana
cgaatggagaggagctagtttgtcgattgcgtaagtcgctatacggacttaaacaatctggacgtaactggcataagaagattgatggatggttccgaggatatggtttccattcttcttctgtggatccatgcttatatgtgaagtttggatctagtggtgagatgttggttgtcgtcttatatgtagacgatttaattattgctagtaattctaggacaatggccgataaattcaagcaagctatttcaaggaaatttagcatgaaggacttgaaggaacttgattggatactgggtatggcaatcaaacgtaatagagagaatagaaccatggaaatctctcaaacggcatacattgatatggtactcaagaagtttggaatggctggttgcaaaccagttttaacaccaatggaagggactctgacgaaaatggatggcaaggacgtcaaaccagatagtgaatacatgaagctagtgggtagcttattgtatgcagcactggtcacgcgtccagacattgtatttgcggtgcagtcgttgggaaacacttgcaaggatctaatgaagagcattggattgctgcaaagcgtgtattgagatacctgaagggtactagtgaggttggactcaaagacacaggtaattctatgggatcgtttactctggtgggattcgcggacgcggattacgctggtgat

SEQ ID NO: 278 - DNA, 703 bp, Nannochloropsis_gaditana
tatccaactctcagagcgaacgttaatcaagtcagagaaggtgaggctgagggcagctgaacgctttaccgtgctcatatcggaaaggcatgttatgatatcttgtcagcgtgatagccatcggaattcctcaacccgacactagagtcccacatgtttttcctttaaaaaccacggttccattttgagaaagtataaaagtcggtatacatgcacgactcaagaacactgttcgcagacatagcgcatcatcatgaagatcaccgcgttttaacggctggaagagtctaagtaccaggggatattccgacttgcataatcaaagtggaatcgaaagcgcgagtggagacatcgcagtgcaaataaagtgtaaatgagatgcaatcggaatagattcatttcaaggctgtctaagggtcacagaaggctcctaatatgtttctaaaggctaaattagcaagtactctcaaagtcccccttggtatgtgaaacggtaccgcagctttcttctatcgcactcttcgcgtgccatcgagcttttaccttattatcgatgccattaatatttatcttatatcgacaatacacgcatcacctgcgactatatctcctaatttcttcctgctgtgaaatctacagtataagcccctcacgtagagcatatttatctttgtctgaccttgaatataaatctcaccttagc

SEQ ID NO: 279 - DNA, 703 bp, Nannochloropsis_gaditana
ggaaatagacaaactcacgaaaactccaatcgtcagcgctgcgagacgacagtcgcggatcaggaagcccacgagcttgacagtgtccactgcctgcgtttcggccaagtaagggtctgtgtcggtcatcttgcgctgcaccgtggcagtatcgacgtacaatagaagggtttcttccacaacctatggatctttcgcttgcacatagataggggtattaaggaacatttgtttatcctgtttccgggataatcctcctccgcgcgaagggcctctccatcctctgagtcagctgagactgttgaggccatggccaaaggagaaagttccggtttgaaatgacattctgtggacgcatagaggtaaataacatatgattgatggtgaatatatggacaataaataaagggcaaaaaaggtgcgcactgacgcgaatataaggatgacatgatcttcgcaccatttcgaaggtgcgagccttccctggctatatcgttgcagccgttttacacgttactactgggtgttagcgaaggtgtagaacgactcgcagcagatcaccacagtgaaatgttatgatttgcttccgcctaatcattttgaataataattcattattataccacaacaggacttgcgtcgcccagtgaattggtaagagattcttgattaaatcttttgtgaatattctcagggaggcatg

SEQ ID NO: 280 - DNA, 703 bp, Nannochloropsis_gaditana
ggggactaaagtggagggagttgcggcctaaaccatcacatcataaggaaggggactaaaggggagggagttgcggcctaaaccatcacatcgaccagccaagacaagaggaacttcacgtacctgcgtgggccgcacagcgtcgacacgaaagccaccagagcattgcttgcgtcctggaatattaagaagctcaaaattttactgtttttcaaacaggtgttccttgacactggacatggcgcctccaggacgttatcaaaagacttgtgatcgtcgacggataccatcccacaggcttctcttgttcgtccattctgtcgtcgtagtagttcttttgtccaacagatcagccgcgttccaacacgtaaatccaccaagatctatttttgagaggagaaagacaactttcccggacggtagcggcagatttcaagcaatgtcggacgacaaaacagacttcttcaacacatcaagttgtctacacgactccagctccggcccacgcgccgcttccttgcggagctctcaccataactcatttgctagaataaagggatcacaaagcactcgcggcgattttttgcggcagggcttattgacagcgggtggggctgcaatgggtgccttcttttcacctgatcccgacttcccccggcgacctcgtcatgctcatgcagcagccaatcgtgtgcaagacatg

SEQ ID NO: 281 - DNA, 703 bp, Nannochloropsis_gaditana
cggcaatgattgacacaaccgtggcagcaataaactttcacatgagagtgtcatgaagatttctcttgtctctcgtgatacttatgtctttttctccgcgcaatgctcggttaaaactctcaaaacccagaagatgcgatgttttccaattcaaattgcttgggattcagtctcgcttcctgttttcctcgttgcttttcgctaacttcgccggttttaaagggcccaagcatcaaggaagaacgcacttaacaccacgcacactcagccaagcgaccatctatctgcacgtgggcatctctttcttccttcgatgtggcattgatatgggtgcatttaaaagtaggtcaagaagcctgtgtgcaaccaaggctgtcttgaacggggaatccgacggtggagagaggggaagagggtgagcgtgatcacctaaaccgaggagatgacccgcacgtggtttaaagctcgcggtgtggcaccacaagcagggcaggaagggcgttttgggtgacttcggactaccaacatcataacgcactgtgctttatctcaattctacttttaaagttggggcataagcgttattgtcgtgtcagcccccttgaccgcaacacgcgtctcatgggtcgctcagagaagaacaaaatcaaaatctagcccacacgaaacaactcccccattgcgccctttcgtcccacaaatg

SEQ ID NO: 282 - DNA, 703 bp, Nannochloropsis_gaditana
cctcgaggcctttatccaaagcccccctccaccacgcgatacccgaagttcctacctttgccatgacagatgacttgacgacaggagacccgcctttcctgtgaaacgcaaagcagatacagatatggaagaggggtcattaggcttcgaagagtacatttgcttcatggcaaagaagcatcgcaccgagtcacagctccaacgcccaccatcagtgtgggcgactcagaggcagagaattccagccactcagcacagtcgttccacgctatcgaccacaagccacacgagaccgcccacccaaggcagggcacggtgcgcatgaatcgaagggctggcacgagggtgagtggaggcggcaagcggctgaagagtgtctatcgcgttctagtttttttccgcggtgggagaagcgcagaaggtgacatggaggaaaacatcatactgtgaggcaacgacgtttgctccccaccacactaccatcttgtagcaaatatgctcgcccatgcttgcttgcagatttctatagcttccttgtatactggccatgaaaaatccaatttctcaagggaaggttgttttgatgcttcttgtcggctgtctagagatattctcgcttattccgccctgctctcgacctccccgaatacctttaaattcaacaaaaaaatatcaccaacacgcacccacaactgtagtcatg

SEQ ID NO: 283 - DNA, 703 bp, Nannochloropsis_gaditana
ttaggggtggacgtaccatatttctcaacgatgggagagagtgtgacctgtaaaaatgtggatgaaggggggcaaagggaggcagcgacaagggatgtagttaagacgctgaccgtacaaaagaacgtcttcactatgcacccatacataaatatcacacactaagaagtacgtctcgattttgtgcctgacttcatctcaccaaagtcctacatgcagagggagtccccatctatggaaaagaaaggaaagacactaaggagcgagtggtggatggtggtcgactctactgcttctatgtgtgatgatttaggcaccgaaccgtcattgctaaccgccggagaatgacgctttaggtaccttgatcgcctcgccaaatcagagggcgtcagctgtcagtctgggcctctgggaaagcgacacgaatcgcgcgccgatgcttgacggagacaacgcttatgggcccgaccgtggtcagggcacaacctatccacggcgtccggacaacccgcttttggacgccagaaacggtagctggtctgtcattcataaaaacaccgttttcatatactctcaagaggtccctttctttgcttgggctgcttgcgcgcagcctcaacaagaagacaaagcctctcgctacgcgaattccatacaaattaagacccccttccttaacggccaggtacgaaaactaaccatg

SEQ ID NO: 284 - DNA, 703 bp, Nannochloropsis_gaditana
ctctcccacagtattcaggcaggaatgcatccgttgcgagcaggcaatccgtggacgtaccctatctgatccgtacaagcggatgttttcaacgctctgacctaatatctccccaacctgtgctttgacgctttgcactgtttcgtttggttctacgtggaggaatattgtctgatgattgcgcttgactcgaacatacctacgcagtaaggggtgaaacagagaagaagcagtaagagatgaaccgcgaggaacccacagaccgtcgatccttgtacgtacatagacatggtaaaacctggcctcttaaagattagtgtgctatctctggtcgtcgagttgtaactgcaggcgctaggagtagcactgtgggaattgcttgagcaagtcctgttaatcggcaatcgtgcattaaatgtgtaaaatgatgggcacggagacagaaagcatcagcctgcgaattcaaggatacccatcgagtcaaaatggagacataaccaacattcacactccctgcacagccacagtgtgctcgaaaggagtgtcatctatcaggttgcttcaagtgctcggcgctcggcgacgaccttccccaactagaaagacacagtcgtctggccctcccctgttcccgctcaggcaaaacgccgtatatcgtacgcacaccaacgctcgtaagacgatattcggccacaaattaatg

SEQ ID NO: 285 - DNA, 703 bp, Nannochloropsis_gaditana
aacgggtcaggggagcggtgagcggaagctgctttaagggagtggtttgctgtttagccccgggtgctgccaagtggaaggggagagggatcgtatcttgcttctctccctccttgctacgaagtgcacaatgggcaatgcggggagcaacgggaatgtgtctttgggcgtggagacagaaaaaatggcctacatggctggtgaaaccgtcaaggggaccgtctctgttttgatagctgtcgagacacaggtaatttaatgtgcagggcccatctcttctccttctcccgctctcttacccacgacgatcatggggataatatcggtttatgtacccatgcatgtatttgacaactttaacaattttcacttctttcaagtatcaaacccaatgtataccctgcgctgacttacataacgtattgccaatccatttcctctctattatcgcctgtccccgtcttttccagactacgggggttttccttcgagtgaaaggcctcgaaaaagtatattttacggaacgccgctcaggaagggacatggaggatcgggacaggacattgcaggacgaagtcagttttttcgacgtgaaaatgcccttgctcacagctcaagccggcgtccttggccccgggcaataccaaattcccttctccttcgcgctccctgactccctgccaggcacccttccagaagagga

SEQ ID NO: 286 - DNA, 703 bp, Nannochloropsis_gaditana
atgcatgcagaatgctgtcgcctgttgaaggaggaggggatgtgggaaatgttgcggaacaaaagtgcaatgacgtgggaaagccaacgacttgttggaaagttaaaaggtgcatatcgaccattatttgtgaagccggaagggttggaatggaccttcctgacccctaagcaggacaatgtgcatgtccctcatgtccatgcggtggcggataatcaaaggagcagcatgcaagggtcaattgacatggaactaagatttcggttgccgccagggagttttgccacggtgttgatacgagaggtgctgggaaaggaacccgtctcctggtagccattcacgatacgcgacaggtacctcggacacgagtgcctgcactcgtctgtatagtcatgtataggttcctcgccacggaaggcagctgcaaactcctggcaagccaccgtgaagcacaaacattaaaagacaattttgagactgagagattgtttgaaatgaactaagccctttgaaaaaagtctctacttcttgcgcatattgcattcttttacccatcgcaatgtcgttcctttgaaggcccatcccaggcgcatgacagaaagcaggaggagaaagcgacccggatattgccgaggtagaacttaagcaggcagagtcttcaaaattaaatcccactcactattccttgtgttcccaatctagg

SEQ ID NO: 287 - DNA, 703 bp, Nannochloropsis_gaditana
ctcgaaacacaacttcctcctcccacgtggcaacgccgcctcgaagacctgatgtttccactgcttcgtctggcgtggcagccactgccgtgcccagtgcagtccgtccccctacttcctcctcctctggaataagcacgcagaccgtagaacagggtcggtcggtgaaggcccctggagagagaccttccgcctctggaacaagcacgcagaccgtagaacagggtcggtcggtgaaggcccctagagagagaccttccgagagacaaggcagacgccaggcaggcgggaaggtaggggcacccccgggaagcaccgcggccagcggcgatgacctggatcgtttcttgtacggcagcaccggcagcgacacccctgcttccccctcaagctcgccaagcagccggccacagtctcgacccaccccgcacgccgtccaggggggcctccctcgggtccactcctcgcctccgcccgtcgggactgccgcctcccccccccgccccgcgctcactccgccagcccgggtccccgcccaggcccccctctgtccgcgggcatggccggcctggacattgacgaagacgactctccccctcccccgtcctccttccccccctccagcagcggccggggcggccccactcccccccccaagggcccttcccccccacctgccacaccggaggagctttttttcatg

SEQ ID NO: 288 - DNA, 703 bp, Nannochloropsis_gaditana
tcaattgatatgggggatgtctggtgaggttaagcgcatcctcttatggtgccggccggggggggaatcggtcgatggttatgatcgatgtcgtcactcacgccgtccggtgttccagccagggacggcaaaacaaccacagaaattcaactatctccccactcttgtgcgtaaatcttatgtggtgctgagtatcgcataaaccaatgtccactacgcatcgtgagggttacattcaaatgtgttgaacaggcacgccaccggacaccagcccttgagtaatgagacgtcactcctctccgttgactgagaacgttcgagggatccatggctagacacagcgcgagcgcaagaatgcgtgacagatgcaagcacttgactccatagacctccgtgcaactcgctgccttgcatttctgccagcgggtctgcccagcggaacgggcatcgaaccgtgccagtgcacgacagcgacgaaccaccagcgagttctccggcagggggaaacgagaaccgaaaatatcaacaccgcaagagtcctcgtggagggcatcgaatgaccatgcaacccttgattttcgcgtgcgtagtttagcacgtgcgtcgctcctcatgatttactgacatttttttcctcttcttcccggcactgcgaaggaagaaggatatcaacaattacttcaacttcacttgaaaaggcatg

SEQ ID NO: 289 - DNA, 703 bp, Nannochloropsis_gaditana
acggcgaagagacatggctgttcagaggccacgggagaaatggtcatttatggtcaatgttcgcaggtcgtggggagaaaaaaagaaataggagacgaacctcaagtgaagaattggctgccgtggagttcactgtcgggatatagttatttcacgacgagaatttgtcgaagaagaaataagcgagagcctcttagcacacaaccttcgcgaggggcgagtcgaaacttgcgacatgaaaggaaataaacctgcacgcgtcgcgataaatccactcggaacagagtttccccccaagaaacatgtttcctcacaatcgtatgcttacctttgtacaaagctggcgtggctggggtggttttattgtcgggcgagggaggggagggatggaaaggacgaatttgggtgacgccatcccccggccacttccttccttaggcttaatgcgccaccaccaccgagtcatcgcgacgtgcgtgcgtgcgggggtcatgcccgtgcatgggggtgttatgtgtcgtgtgcccatggctctggtgcgcttgcgtggtcaatgtgatccttcacgtcgcctcttgcatctccacatcaactcggcccggcctgtcctgagcgtacccctcctacaagttgtctcaccatcataatcggcacacgcacacacatacacagacggtacagacctccctgtcgagaaaatatg

SEQ ID NO: 290 - DNA, 703 bp, Nannochloropsis_gaditana
cttgtagtttgggctttttgggtgtgtgggcaggatgtgacggcgcgcgtaatgcacaaaaatgtgcggcgagaatgggccacacaccagcagaagtaagcatatgggaatgaaatatgatactttcatcgaagagtcacacttgaccgctacagagttcatatcgtcttagccttctgcgtgttcagctgaaaatcctaaattgtacccgcaatgggttaaatattgagcaaactgtctcaagtcaccattcccaatcttgtcatcctctgttcccggatcatgatcgacacatgcgaatgtcaactccacaggcgaggcgcccggtggctggcattgatgttcagcacccattcccgattttgcatagaaaatacatatcctgatggaaactaaagagcgcttatttaaactcgttattgtacgtggttgcgacttgacgtctgcatttctttgtcttttggcctcgatgggaagcaaggggggaggaggttaatgctccgctccgcttgagcacaggggacaaggagagggttctcaacacaaaacaatatgtttagtgacagaattgatatctctctctggtagtctcgaagtaaggcgctcgcctctgtcatatcaggggagaccatgacttttagtttccgtgtacatacacaggctgaattcctatgaccgacaaacagcaagaacaagagtgaca

SEQ ID NO: 291 - DNA, 703 bp, Nannochloropsis_gaditana
catcttccatttctctttgattttattgctctgtcgaaagctttccatgaattcctgttggaggcgtacgctatgttccaggtctttgattgcccggcgattttcgcgtgcataatcccgtcttggccgtcctttatcttccctgtcactcgaataaaatgccttgatatacataagaagcccttgccataaagatctcgtctcatttacccacctgcaacttccgaatgactgtctattgtttgtcggtaaaaatggtgccgctaaccccattgtcaatgggccatgcgctttgacttttggcgaactgcaggggtcctctttcacgctatatcgtgccacgcactattttttgcctgttgcgagacttccaattgatttggaaacgcggcagtagattgaagggacgaaaatttacatgaaagtcacagcaaattttactgtaaagtttcgtcggaaaaggagaaaaagacgaccatgcagatgacgacgtatcgcaaatgtaccttattctatcatttcattactattttcgccatccacacgcattggtttgacatgaatgtcggcagcatgtcaaagaatatttcgttttccataaaggtgtccatgggtgtcctgatggcactcaggcgacaggggcgcccagatactctggtagggggacgacggcaccgactttttcccatgcgcccgtaccatg

SEQ ID NO: 292 - DNA, 703 bp, Nannochloropsis_gaditana
tgtggcgatggcccgacaaactgtgcgtctggcagacaccttgcgttaatcatacatctgaattcaacaaatgtatagttaaatgctacggggatacatttctagccatcgtataaagagtgctaaattaccattattaattaaccatagctgctctctttttactttgtcatgcctacggtagcgattaatagggtgggtcttctcaaaaaagggcacgcttcgatcaaaattcatttcattgccctggttcagacacatctgtacaactccggtaccctcaccacacgcgtcgcggcacacaacatacgtgcctagtgctatttacattatgatggacggcaatccgaggccgccagacgcgccagcgccgacggtctccaggaatgggacgggcgggcatcgtacactgccctttgcgcgcgctccagcaactcagtggaagaaatgttcatgcttaccgtgtaggagtgtatcgggggcgtgagacgtggtaggcgtggcaggaggaggtcacaatcaccgatttcatcactctttcccccgcgaatgaagacttccaaattaactcgctcaaaaacgttcagacacaacccccacggaaccttttccatgtacgcgtgaacgactcccctctttttccatgccacacgttcataaatacaggcgtgctcacccccccccacgtattcaaaccatcatg

SEQ ID NO: 293 - DNA, 703 bp, Nannochloropsis_gaditana
gtcttccattcatcactgaggttggcggcgcctcccgcagtagtcccagcgtcttttacatgtccaggatagcccaaaccaacaaccttcactttcccccaatctacgccggcttgtgtcaataacttgctggatgcttcgaagagcaaggggacgatgttttctggcgttcgcccgtcacgtgcttcaggcaaaggaattcgacaaaaaaaaggcggaggggagcttgggcagggaggatggcaagggcccgtcgaggctgtggctgatggcaagggggctgccagaattgcgaaaggtataaggccagctttaaccgcggttccccctagatcgatgcctagaacaaaagccactttttacctacgatgtgaatgggaatatcgtgtctagtgagcgcggatgggggggcgtcaaatgcaggacttgagggaaagtctcgccagaccgaccttggcgatccgtgcgccctcaagtcggctccgacagtatcgtgctgcagtcgaggagtgctcaggcccaaaaaccagtcttcgccgtctttcaagccaccttcttgcatgggaaactggtaatctccctctgattccaagtcaattttttcctatgcagcgagagtgcaacaaagagcgcgacccgaagccattccccccgatcgacccaggcccacgcgtgggagggagccaactcgcctacctgaatg

SEQ ID NO: 294 - DNA, 703 bp, Nannochloropsis_gaditana
tcgcgttactgttgggaagttgccgctcgtactctgagaagaaatgtgaagagccaataagagagagtgaacacgacactgccgaaaagcctacaatctctcaacgcctcaccgtgaactctgcaagtacagttttgccccgtgcgacgagcgcgtaaagaatggccatggttgtgacgagaaggaaacacttcaagtggcgtgaagactccctgctcgcgctgtttgaattccccgctcactatactttggagcggtaccgggcaatgtttgcttccacttgacacctgacctataggaaaaagcacttgaaccaatacggaatgaaaatattgagaaaggatgattagaggcgggttggaaatgctgcgcgttttcccggaacatgcgtcgcgggttcgcctctccccactcgagactcccaacgaggaagtgtgtcatgatcgctccaggcagccgaccctcggatcactgggcaataaaggcccgccggcgtcgcagtcacgggcaggtcggggtggcagattttggactgtgcgccggctgttatccataagccggggtatcgaccaaaatgtgacgcttgatggccaccaaggcggtacttgtggcactgctcgctctgacgctgtcggggggattgccccaccatcaccgtgacttttcatgcttatggctgtcatacgtccaccacgcacagggc

SEQ ID NO: 295 - DNA, 703 bp, Nannochloropsis_gaditana
ccacgcttgggtagtatgattaatagaaataggtgacccgaggacaaagaaatcacggtactgtcaggaagaagaagcgatgacattgtcgtgatgatcatgcgtaaaataaacatggaatgttccctgtatggccttaaaggagaagcaggtaagtgtgctaacgcgccatgggcccgaggcctctcattcgaatgccaccttcggaagtggactctgtttgaggcacatttaaagtaacacctcccttggtagcactgagtcaggccaaacgctccaatttctccacgccaatagcagaccgattgccgatgcacccgatggactcttgatggtgccaaatttcaggcaagcaaagcgaccgcgggcgaagaagggcgaaggcgacactttctttacagcccccgccaaaaatgttggtcaaatcggaccacagacacacatcctcgtgtcgtgcagacataaagataatgttgtggagttcaatgccatcgatcgaaaatatgcccccaaggattttagggctgggagacgattttttgttaactttcactttttcaagtgcaacttgttctttgttggcgccataagtccttacgtctcgaatgacacctaatttccgtgatggatcccatgcatccaacctaccaactccacagcggcaaataagcccgttttaaacacacagtttgaaaggagcatg

SEQ ID NO: 296 - DNA, 703 bp, Nannochloropsis_gaditana
tggaccggtgtcgtcaaagtaccctttcgacagaaaaatgtctggtgttagaagccacaaacggcaacctctcggagaaaatgtactacacgcggtataagtcaaacccatcaacaggggacatacaaatagtgatggaggtcggaaaagcactcaagaaatgagttgtttcaacgcgtgcatgaaaacggattaaaatgtacaataattgaccttatcacgtccttctggactagaacttggtttgccaatgacgagggacattttgcaaacactagaatgcttttcctttcccatccctccggtcctgcgcccaatagctcgggatgctcgccaagaaaaacatctcctgtcgcgcattttttcccctccctttaaacgaacatgaaatctacgtttagacacgtaaaaggtagcgagcacactacctgggaataaaaagaaaaatgatcgcaccagccctccattgattgctctccaacaatgcggagtggagtccctggaccccgcaggaggttatcgtatgctcgacaaacggtcacagccccgggcttccaagcactgagggtgtacgttgccggaaaggcattacgtaacaagatcagtgatagagatgatagaggtgcatcgggtttcgaagagatgctgtcttttgattttgtagaggttttcgctcaaactgcccagctcttccatatacata

SEQ ID NO: 297 - DNA, 703 bp, Nannochloropsis_gaditana
ttgtaaggggcgacggcgacaggtggcggcgggatcactgtaatcgtagtaaaattcctgtctccaattgtgcggtaagagctgtccctccaggagcagcatgcaaggatccaaccagaccaacaacagagcggggtgaaagcgccaccacagcatgctaggcatgctgccgagcaacacagtatgagggaaatgacgataagcaggcctccaagggagatagagaagatctccaggtcgtccaaatcggccattgggtccagaagcccaacttaagcgcaataagaaatatgagcacgagaacgcggctaggctattcaggacatgtaaagggtattcactctgtgatgttaaaggttcggaggtgagcattgtgatcgtgctcgtttgtaaagttaacacctcgggaagcgcgggccttcccaggggaggtcgaaccgttgcccacgccaggcgcacgtctctgaacgagcgaggagtctggaggattctggagcccgaggaaaaatgcaacttacgcgtgttcgtgtcacacacatgcgcacatagccgatactttggaagactatttggtggtgccctggccttaccattggattgaagcgttcggcggcctcggcagtcgacatccgggcacaatcgggagccagacctgtgccccttcctgggcctggaaagacaatatcaaataccgcgcaaaatg

SEQ ID NO: 298 - DNA, 703 bp, Nannochloropsis_gaditana
aaaggagaggaaggcaggagagagcagccaccacggtagcgctatcatctcgtgcgcatgagcgatgggaagaaggaggaggagagggtaggagaaggcacgagagggaaggcagcgcgcagggcccagacagcgcaacgtatcccccgacgctcgacgtacagattttagatgagattgtgctattgttaacaaacaatctgtcgcttttagctatgctcttagtaggggtggtgacatgctgcgttttgctcggggcagtagcgctcttgagaccgaatgcctgaagtgcttggagataatagagaacataggaaaagaaactagcaccaggtgttccatccagccacagaaacagcaaaaacaaaggagaggaaaggaaggccggaattgtacaggcactggccatcgcggtagaaagcaggcagcagtccgtcgtgagaatcgtcgccgggggcaggaggttgggaagagataaatgtcctcaaaaaccgtcgacaccaggcagggaaatgaacgtgcttccatttcgtactcgtccgagtgtcgatgcaaatgcgagactggtcttatccataaatacttatccgcgaaagtaaaaattcgaacactcagccctcccgttgcgcctgcgcgactgcagacttgcgtctcatcaacagatgatgtttacctcgcataactaattgccaaacccacgacc

SEQ ID NO: 299 - DNA, 703 bp, Nannochloropsis_gaditana
ccttgtccttcgatcttgcggtacaagcagtgggacggggcgttctccaacccgaacgggtgcatggccctccacaccctccgctggctgtgtgcgcgggccgacgccgtcctgcaaagaggcgatgcccctcgtggcgtgcaggcgacggggggggaggccgatgagaggggaagggaaagacaaatggaggacggggaccgggagcagcaaggggacacggaaggtcgtggagggcctggaggctgcgaggggtgtgtggacgttgcatcggggggagagggacgggtgtgccgcgagaggcagggcttgcgtccccgcgtctgccgcccccccccaagcggagacaagccgcctgctttcgatttgttggagctcttttgcggcggaggaaatcacacggtcgctttgagccggaaatttcgtcgggtggtaggcgtggaaattgaccggcggctggtggccgcagccaaggagaacctggccctgaacggtgtgaagaacgcctcggtcatccagatccccagcgagaggttccatccagagcgcttgggccattatcggcggcagcaagagcaggaggaggagcacgacggcgagggagcgagggcaagaacgatgctcgggccggggaagcgggtagctagtgccggcggggaggccgggctgaccgcacgggcgcagggcatggggcagagtccac

SEQ ID NO: 300 - DNA, 703 bp, Nannochloropsis_gaditana
cctgcagaatctttgttgatatgaagagcaatcggacgtcaatcggttgggttgggttcaaggggaggcaaccgacggccctgttcaggacgtgcaggaggacatcccacgcaccctctacgtgcacgaaagatgtcagccatcggtccgcttctcgctgtgtgggagagccgggaatgctatcgtacagctctttaactcggtgtagtagctccaacaacagagcttccatttgaccctcccttcgtgataggattgaagaggttacaaggaacggaaagctgtaagagcctttcaccgaagggagaggctacatgttcgcaatagcaagtagccttataatggcaagcgatgcataaaaacgtaccgatgacgagaacgggtctcaatcagatgtgtcgggagcgttccagggtcctccaatagcaagcttcatccggaaacaccaaggacttcccctcccaaccagggcttttcggcctagtgagtaaatgttgatttttggtgttgtaggtgcgtgaatggcctgacggactgggtcgtctggcaccaaaatgggtggaatgcgcaggccagggggttgttccataccgacctcgcttcgctcctacgaagcgtcgcccacaagcctgattgcactgccaagcccaccgcgacccgacaccctttgtcacctccacgtccgcaccataccaacaggatg

SEQ ID NO: 301 - DNA, 703 bp, Nannochloropsis_gaditana
ataaggcgtccttttcctgtgctcttttgagttcagttctgcgttcttcttctagctgtcttcgaaatttgcacaactcttctaatgcgttatcgaggccggccacgctctgttggcaggtcgactcggtcatgggaaacaggaattaggaccaggcggcagacaggccgcgggagggtaaaggaaaacgtcagggcttgatcccgtgttttcgcgcttaggtagttcgttaattgcttcctgtccgtgtgtagatgtggcagcagcgatgacgtgtggaaatgggcgctgggtacgacctaaacgaaccgcaactcagtggcaacgcggtgggatgtctgtctccttgagctcgtgcttagcgagtgagagcgagcaggagggggaggggaaggaaagaaaatggcgctgggaaccaggagcacttggggattcgcccctatcaacacatgcgtgtttttatgtgaaagtgtgttaatagtatggaatgcagagtcatggcatgacagggacatcttagggtgccacacgggctgatagttgccaccctgaaaagaacatacgcgccttggcagagcgaaactcgagccctcatgctcataattcccaccaccaaaacttccaacagcatggcagatatacccgctaccatggtggcaccgaccgccatagaaggagaaatttcggagcagcagctggtgca

SEQ ID NO: 302 - DNA, 703 bp, Nannochloropsis_gaditana
gggggcttcagatggcgcgcgggggaggacaagggacggggagctagagggtggctacaaggaagaaagacctgcctgaaaacttctcggtggtcgtccactttcgtgtaacccattcttttcccaatttattcgtttacatgtcaggactctaccactgaacgaggagaggaggacgatgtgggagttgcccgcgccgggcctgacggggctgaagaggaggaggaagaggagggggacgaggaggaggaagggagccaaggggatgggggggtctcatacgggttggaggaagaggaggaggaaggggaggaagacgagggggaaggtggagaaggggggggggggtgatggatacagcgaactagagatctaagcgagaagttagtgctcggcaaagaatgttacagtatggctggttgaatgaaaaaggggctctgcctgtgtctgtcgctggttggagtatcttttaccgaccttgaccgttacgttgcttctaccgttgcgggcacccggcaactaaagttggcaaaatcgagctgaacgggaaagcatgggcggccgcaagggccgcaagagccgccgaaagaagttatttatggccgcattgttagtcacgaggcgaccccgcgtccgctttgccttctctccccgcctccacattctcaagcgctcctttcctttcttcccccaccccgcccag

SEQ ID NO: 303 - DNA, 703 bp, Nannochloropsis_gaditana
tgtagtactgcttttttttcagtttctcgttcattttggtccggccctagctacgagggtacgaaaaaccgcgacatgggccgtcctcggttgggccggttgcaagggagctgcccatagacaagcagcaatttacgcaagctgattccctctatatgctactgtctgaaaatatatttgacttcaagacaagagaccacgcctacatgtggaaatcacttttccacgccgtgagtaggaggcaggctgtgtgggtggcggcgacgatgagtacctcccggctacgcaccatgcttcccgcacagcgcaactttcccatccggatactaacgacataaatatcatacaccccccgaaaaagcggcagggttggcatcgtcaacatttcatcgtctggcagaccgcttgttgcatgctggtgcctcgtctcctctctcgtcgtatcgcgttattctcttctgccactcacgcaaacaacctccccaccaccgtctgctgctggcatcgagactctaagtgccgtattttctcctctgtggccatggaaaaacccgtaagcagcaacacagctacaaacgtacctgaggaaattcccgaaggatttatgctaatcaaagaaggacaagcgagtatgcttttcccaagtggaaacgaagtattttataacaaagtccaagtcttgaatcgtgatttgtcaataatg

SEQ ID NO: 304 - DNA, 703 bp, Nannochloropsis_gaditana
cggtagcatcgacggaaacctacctccactcgggacagacagggttcgagcagtggatgctccccacggggcacttccactcgcgttggtcttcaaaatgctgcatgcgaaggctaaaatgaatggcaaaacgcgccgcaaaacaaatttaaggcaactggccatcccaggatgcgccgggcgggcacggatagacatggctgcagtgggagaccgacggcgcaggagacgagggcttggtcttgtggccaaacaggtcgagctgacccaaggacgtacacgcgggcttcaggtcgacgacattgacagggcgcagtaccagtattcgcagactcctgtccatgtggatgaaacggcaaaatgagccttcttgcgtgcacgtagacacacaaacactccacacaggacatattacttggcgacgtgaatgggaatgatcgtgatggcgtcatcgagtctcccttgactcaagtgacttccgaatcaatggcacgtggcgtgcacgatgggtagaaaatctgccaaaacgatgctacagcaatgacatttatacgcgatgtctaactgattgtcttcacacaataatttgtcctggcgcgggcctgatggcagctgttgggcaacagcatggaatggaaggccttatcaacacttgggacggcaaaaaggggccgacacacagaaggcggacggacaggaaatg

SEQ ID NO: 305 - DNA, 703 bp, Nannochloropsis_gaditana
ggtggaggcgggaggttatcagggggaaaacatcccattttccttgaatccaggattaaacagaggttttggttcctaatggaggacattttagtaatattttattactaaggtactcgggagtctcgaacgagcgccttcgcttgcggctgtccgttggctgttttgatgaaaaactgccaatcccctactttcagttcacaacgcaacaatcgacaacaacttatactgtaaagctctggaagacatacttgttttaaaaggtatactctgtgcttgaatatcgcgaatccgagcgattgtatcccgacagttgactacacatgtatcacgagcctctacactgatatttttcatagtgtacgagaacgaggaagccttcacatcatatacagcgcggccccaccccttgttgcacacaggtacaacttcaacatgcacacataggcatgacactactcctttgtaattattgttaggcatctgtgcaaaaaattctgtctttcatgctcctgactttaattcacaaaccgtctcggtgagtttccgtcgacgtctaaatcgtgccccactcacaggcttgaatggttgagtaggctcgtcccccaggggctggctcccgcgagatccgccagtagtattccggcatcgaaaacccggtctgtgcacgtgaaacgcccaaaacaagcgataagaacatatg

SEQ ID NO: 306 - DNA, 703 bp, Nannochloropsis_gaditana
attctcatgtacggtttcctgctgctcaaccgaatatgcttccattgcggaagcgcgttttttgggatcattcgtacgaacagaccgttcgtaatcccgagtcttagtatcttctcgtggcctcaatgccttcatgctttttaaaatacgacttgcaaagtcacgcgagcttacccaattaaatgcatggaggtgttcgaacaggctcgaaagattctgatcatggcgcataaagacgcccgtagccccattgcctgcacatttgtcgcaatcttgcaggtctacagctgtgatttttagtaacaactagcgcacctaaagattgggtgtgaagactactgctcttttttacgtgtagagaagtgtgtcaatcgtttgtcctttgcgcagttcaagtatgctttggcgtgattgcagcgttcgctgcggtatcattccatactttgtcacaccagcacacttaccgcgctatgcttgactttgccctctaatcatcatttttggatcatctctggtttctataatcagcctgacacaagaagaaagaaagaaaaagggcaaggtatagcttctgcttgcgagggaagcaattgacgagcctggcagcaacatggcgatcgactctatcgcagaggaaggggggagaaaaaaaaagacgacgtgagacacgcaggagaggaggttgccggcgcggaaagtaatg

SEQ ID NO: 307 - DNA, 703 bp, Nannochloropsis_gaditana
acgaatgtgggagcgcacttggggtaatccgtccaacccaacctgcgccactccttttccattagatcgaaggtatgtcgagcacgtgccaatggtgagataaaaattctgtcgaagcgctgtttacgtgcagccaatgcccttcccagttcaagagcttgagactcgcctttcgatgtcaggcgtgacacatcctccattccctgacaacgcccttcagcattatggcaagtttccccgtgtcgacataaaatgacatcaatatacgagaaagcactactgtcgccgtcgcgagatattttgacgccagcggcagctacacctgacattttacttcttttctggcttgatacgctagaaaaagcggcacttcgacagatattcacaaaaagtaataatccccgaactgccaaagcccgcatgtcttgtgatctgttacaaatggaaaagaattttatgtgcacaagagcgtggtgagatcaaaagagactacatttatcttttaaaatgtcgtctgacacgtccaaccagactcggtgcgacgtaacctcccggctcccgatgcagatgaatggcccacttacttcctcctaagcgttttgcgatgctttacgatgctttattctgactatcctccgtttgtccatcgaacacagaatatttcatgcaggggagtggcagcatggggagtcctgataccatg

SEQ ID NO: 308 - DNA, 703 bp, Nannochloropsis_gaditana
gggtgtggttttgtcgaccatttcctgtcggtggctttacgctttggggtattttccatgcccttcacgtctggggcattccgcgttttgcctcctccgcctctacgccggcctctgtgatgcaccccacccgtccgtgccataacacatcgataacgctcaatccccagtccattcatcgtcttagaccttgaaggggcacagattcacatatgcatgtcgtcgtcgtgaccgagggggggtggaggccgaataagggcagggcctctttaggaggcgtaagctcgaatccaaatcgatgccctttcacgctttcgacacgtggcatcttgatggtttcccttggaggcctgtcgacattttacggcgtgacaaggagtctaatgaggcttgaaagtggcagcgtatcgtcacgcctgcgacagtgttgccctcccttgacggagacagagcaagaaaggcttgtctcttctccatcgaagaagcttttatttaccgtaaattttgctcacagctacatattctcacctcaatcaaacgcccagagaaagcagtggagtgaaaggatgagtcctccgtgcatggaaagtgctctaaggaagactggagctgtttgaggacgcgcgttcgctgtcacaaagtcaggcattttagctgcctttgacgtcgcgaaagtttgataatggaaaatgttggcaacatg

SEQ ID NO: 309 - DNA, 703 bp, Nannochloropsis_gaditana
ccaaattgctcagaggctcgtgcagggccggcttagcggcgatggtggtctgaatgtactcggtcatctgtcaccggctcccacgcgctaaaataagcccaggttcgagatctatgcctgcctacgggtaaatcaggaggatatgggagagcgggagtagtcagtaagcatagaaggccccctgcatggtgctgagggaggaagcctgaatgaagaagagaggcgaagtcgcttgtctcttttccggcaagtttgagcgagggtcgatacatcggacaacaccaagctcccagttgcggctttgcctgaaagcatgctaagaatacccaactgagcctagacggcgtctggtgcttggatttttgctgatcgaactcaaaggctatcgcgagacgatacgggaacaaaggattaacagagctcgggctgaggcaaggaattaatgcttctggtaattcgcctgatgcgcccgagacgcaaactgcgatcatgccattcgaaggacagacagaccccccactacttttttgtgattttgacagtcgcaagcacgaacatcaccacatgactgggacactggaagacgctatgtgtggccatcacccacaggtcgggggtactcgcacgggctcgcgacctcccccccttttcttgcctcaaccttttgcaaccatgaaaacacattataccgcatatatttagc

SEQ ID NO: 310 - DNA, 703 bp, Nannochloropsis_gaditana
ttccggcaagtttgagcgagggtcgatacatcggacaacaccaagctcccagttgcggctttgcctgaaagcatgctaagaatacccaactgagcctagacggcgtctggtgcttggatttttgctgatcgaactcaaaggctatcgcgagacgatacgggaacaaaggattaacagagctcgggctgaggcaaggaattaatgcttctggtaattcgcctgatgcgcccgagacgcaaactgcgatcatgccattcgaaggacagacagaccccccactacttttttgtgattttgacagtcgcaagcacgaacatcaccacatgactgggacactggaagacgctatgtgtggccatcacccacaggtcgggggtactcgcacgggctcgcgacctcccccccttttcttgcctcaaccttttgcaaccatgaaaacacattataccgcatatatttagcacagacgtcatgcaaaaaagttagagcctttgcacgatttaccccccattctgttgccgcccgccatgaacgcctctccctttttacctcccgtcccaccggcctttcctctccttcctatcacctccgacgccacgcttcggaaatgcaagtcatttccctgcaaatcttgcgacatcttcatcgcgtcatatcccaaaagcgggacgacgtggacacaaaatattgtataccagcttct

SEQ ID NO: 311 - DNA, 703 bp, Nannochloropsis_gaditana
atcgcgccgtatgagggttttaaacgatgagatccggagtgaaagttgggcgaagaatgaaaagaacgcatggcccacaactatgaaaggttcaatgtccaacatcgggttgacatcaaaaactaaacgtacaggcaaagctatataggacaccactttagcatagatccatgccatgggcacgtcgtttttctgatgaaagcttgtcgaaaagtctggtcctctcacggagcggcaggacgaccatcgtggccagtgttgaggagaggaagcgcttgaaaaagaaagagggcacatttcatgggcgcatattcatagagggactcaagcgttggtcaatcgacggggtgataccctgtaccgcactgttctcgttaggacgtgccagtcccatgcgcccggcttgaaaacaagggggcactttgcatcacatgcatgacgccatcacccatcaggcactaagcaaccccctccgagaacaccctttcatgcattgggctcacggggatatttttcgtgtgagaacattacgtttccacgttagatacggtgtgtcaatcaaattcgacagcagcgtgtttccagatgttgtgtcacatcaagtctatctctacaagtttctgacggcagctctttccaatgccctttgaacggatccacgatgatctctcacttactttcaaatctccatacaatttgtatc

SEQ ID NO: 312 - DNA, 703 bp, Nannochloropsis_gaditana
caagcgttggtcaatcgacggggtgataccctgtaccgcactgttctcgttaggacgtgccagtcccatgcgcccggcttgaaaacaagggggcactttgcatcacatgcatgacgccatcacccatcaggcactaagcaaccccctccgagaacaccctttcatgcattgggctcacggggatatttttcgtgtgagaacattacgtttccacgttagatacggtgtgtcaatcaaattcgacagcagcgtgtttccagatgttgtgtcacatcaagtctatctctacaagtttctgacggcagctctttccaatgccctttgaacggatccacgatgatctctcacttactttcaaatctccatacaatttgtatcagctgcacaacagctaagttacgtcgtgtttccaccaaacccatgccaaaagcagcggctggtacccccaaggctatcgccaataaagccaaagccaagggcctacaacgcctgcgatggtattgccagatgtgcgagaagcaatgccgggatgagaacggatttaagtgccatactatgtctgagagtcacttgcggcaaatgcgggtgtacgcagaaaatcctacacaggcaagctccggctttcgggttctgttatcacactgtctcactgccccttctgttcagtcgtgcccgttcttttcgtctcacatcccttctatga

SEQ ID NO: 313 - DNA, 703 bp, Nannochloropsis_gaditana
tgttgcaagggaagacgcccttttatgtgcccgagggggagaacaggggggctgtgtcgatggataggggcgagggacgggaaggagggggcggtggcaaaggggtcggtgtggcagcagcagcggcagtggcagcagctaccgaggacagagatatgaagaaaggacgagaggaggtatatgcccggatcgctgcttatgagggtgcattgacgttcccacatcctgtctcggtggaggcgcgctcctttgtcaacgccttgctggttcctgacccgcaagaccgcgtgagtctggacgcggcgttgcggcacccctggctaatggtggaggaagacgtgtaggaaagggggagatagacggggagggatgactagagatgtaaagtagtagcaatttaaacatttaaaaaaagcagaaattcatgcaagtatcgcacatctgtttgcgttgcgagaccccccgaatctggcatctactcctatcctcacccaggtctctcggctcggctcgtcttcattcccaccaccctgacgtcgtgatgacgcccagaaacggattcagagcgcagggcttagacaggggaaggcctggtaggcatggctagccatgaaggagaggcagccgccttgccgaggggactgtgacggcgcgggataacagatacagataaaagcaagcgtggcagaagctgggcgagtgc

SEQ ID NO: 314 - DNA, 703 bp, Nannochloropsis_gaditana
catgcctccacagcgaccatacagtctgtttgatcatatcctttatagaagattcctgctctgtcccatgacttaagacccccgcattatggagcatctggtcgcaaccggcgccattgcaaggcaggaacacagcgagcgctggttccacagccttgtcccgcaggctcggtatattacgatataggctccctgagataggctcccactgtcatctagcacgttcacttaagtacttttcctgtctcctaaatcctcacaagcgcagcattgcctcagcttcttcccttggaccggctttgttcctaccagcgaggcagagtagttggctcgacgcttcctctctcagaaaaatgcctaagttaacgaagcgagagcaagagagggccctggcacaggccgttgccgctgataacaatggagatggagcttcctctccgccatccgcggctcccactgcctcccagtctcatttcacgggcagatccctgcacctccctgcggcctcgcacctctcagcccaggtcacgggggcttcttcgcccttcgacaaccagttttcgacggaagaaattgccagcttgatggctgacacggcttccttcgatgtgaacgcgggaggcgaaacctccacccctgtccttcctacctccagggcaggggcaggaggaaggaggttgggatggccgggtccgggggagga

SEQ ID NO: 315 - DNA, 703 bp, Nannochloropsis_gaditana
ctcccacggcttgagcggtgaagcccgcgacaaatgtgatgtggaagggttcaagatggttggcccgttggtattgggcgcttgcccgcgtggggtgagtgtcgatacactgtcactccttgcagagggagggggctgtcgaaggctcgaaggaagcggcgccatcttcctgtcctctagcccctatactagcacacacacgtggtcaaataatccgtacgtgtgcaagtggtgggtacctgtgtcaacgaggcagagagccaccggggcgtgagttttggattggaaggatggaggtcatcgagacaagcgctttctcccttgctcggtccacaaggaggagaaggcgccttgctcctcgcccatgatgggacagaaggacagaggaacacaaaaagggaacaagacgacgcgggtagccaagccgtgtatcgaagtctgcgggatgatcggtgcgagtctttccgcagggtaccgtccatgtcacgtggaggtcataaaaggtgttttgtttgcttgggtggggtgtcgaaacccgatgctcacgatgcgactctctttcccaatggtattttgtactttaaattttagttttgcaagacattaagcttaatagcataataacgtggcttacctttttcatttttttctcggatttctggacaggttgtcacattgtggggttagttttcctccagacatg

SEQ ID NO: 316 - DNA, 703 bp, Nannochloropsis_gaditana
gtcaggccacgacagaagacccgggagggcggacgggaggacgcgcggacaatctctgctgctgcttgcgtggcttctttccgggaggctataaaaacacgtgcgcctttacgatgaggtatgcccagcaggacaggcacaacgtgcagagcgtatgagtgaggagtgaaacgctacttccagctttctagagaaattgtcactgtgctcgacaaaatttaccgttatccacaaagccttgagctatcattcggccgatgcccgtcccacctccagtaattaaaacgtttttgtctcgtacgtcgaaaagtttatcaacagaaagtgagggcgagagggaggaggtagacagactgggagcgtccatggccatggcagcagagttacggtccaaaatcgtgattgtggactcctgatttgtatgaatttacttttaatcgtgaaaaaggtgtggattggatgtacttggagtaataaaaaccgctttagtacggtagcgacagactttcggaattgaagttgccccgccgcgtcgagacagagtacctcgctcgagttagctacctttttgttgaccccgccgacaaattaccctaaccctaactcgtgcggggacggattacgttttcagctgacttaaactcgccggtgacactcgaactgtggaagacaggccctagggatcatcacacgtcaagagatg

SEQ ID NO: 317 - DNA, 703 bp, Nannochloropsis_gaditana
cccgttcagtcgggcttaaagctgcaaagcggtaactaccaaattggagcctgccactcacgtcttctttcctttccaagtgaaatcttgtgattaaattcgtatgagtggtcggctctgtcgctttggatatttttttctcggatatgttctctctataggggcatagtcgactgttccagccgccggaagtgctcttgcgctgacgcttgtgatacactgcgtgtccttctgtggacgccggtcgtctcggcagccgaatgggaagcgcttaacttgtgggcatgcttacacgagtcgtggagccttcatttagaataaaagtccataaaatcgctaattgctttgtgggtgtccgttctttcggagtaaccaacgggaattctgtcttgccctcaacaaggacacctcgcgttttttcccccgatacccgggagacatgtccacatcccagagccacataaatcattcttgtgctcagtttatgcatagctgtaggtttgattcacgaatgtctcacatattatacatcttcatgggtaaatttagttcttttcgggaaatttcgtgtgggttgtttcgcccttgggagaccatccggctcatgtgttcacgtatatgtatgttaactaatatgtctcaccctgtaactcaccgtcaacatccatgttatcatcccttaccctctgccccctttagtatg

SEQ ID NO: 318 - DNA, 703 bp, Nannochloropsis_gaditana
tcactgattggacacttgctgcttcatttgccactcccactacgaccacgatgaccaaatggttcctggcgtgggtgaaccctgacaatagggccacggtctttttccttggcggatttgccttcggccgggcaatggaaagagtgtctctgggaggctttcggcaagttctcttccgagaaaaccttgacatgcttttctcatacaggtggagcatgtaaccaacacgcacgtgtttctctgaagcactttcttctctgtgcgacaggtgtggggcatgtaggcaacctaatatcctaccctaggcggatatctcgcatttccagcgtttttcactcctccttaccatattgagcgacaaagcaaagcactcgctgcctcgcctgcctcgatttttgatatgcaatggccctcaacactcgttcgcacgcgtgcgcggccttccctttctttcgttggggggttgccggcgtaccttgttagattttgacacccaattccctacaaatgaccaccataatgctttttatgtgaacgtaaccgttgggcacattttatgcgtgaggttgcaatgtctcctggagtgtacgtcccaaaactcaggtcctttcccccccggttaccctgtaactcaacacacgcactcatccttctgtatattcaccttttcattttacagaaacccaacaaagataaaaaaatg

SEQ ID NO: 319 - DNA, 703 bp, Nannochloropsis_gaditana
cacatagggcgagacttgaacgcatgactgcggctggctacagaaaaggtaaaaccttcccttgtggttgcctgtaatgtccagtgtacggttggggaatatcatggaacagatctgcgacaatcgcgtgcaggaaacccccacaaccgggaggagcaactcggaacgatgtatatccagtggcagcaaggaagcaagaaatcgtcggattttccatgtggtgcatttatataagctttgagccatcgaccggcgcaaaacgaggacagcggtgatatgccgcgaccaaagggcaacgtctcttgatccagggccactctaggcccgcgggagggactcgtcggggaatatttttgacgctcgacgtcgactttgggtacgggaggcaacaaaaaaagcgactagcgggcggcgttcgcgccaaaacggagggtaccccgccctatggccacatcgaagggcgggcagtaacaccttggaccccaaaatgtgagtgcgcgtatgtatttgtgttttaattgcacgttgcctgcacgtcgtggaggtgtgtgtccaaaatgccttttaatcaccacgatagagatgcccccaaaacaaagcaacgcatgcgtcattccttcctttttctgcctgcagctagtatagacgaatgtcaaatgacacaactcgcccacaattcttaaaacagctagggcaggacatg

SEQ ID NO: 320 - DNA, 703 bp, Nannochloropsis_gaditana
gctgtaacagtcgacgcgctgctgtgggggactccagcacgggcgcggaccaaaatatgacagaccagggttgtgagtgctgcagatcgaggcagcaacggaaacatgcagcgaccaaagcctgtgtgtacaaaagacaaaggttgtaaatgttgataagagaggctacattaacggatgtattatgcaaagccaatctgtacctggcagcattgaaaaaggcttgttgtatgccagcgatgtcaagactacgttgatgagtctcacaaagcggggcagcgaaagatggaaacatggggtaccaacccccactgcataataaattatgtccacttcttcctctgaagcttatgtcctacacgagctcaaaaataaggacgacaccaacattttacgccgcctgtatgctcgcgtttggccgcctttcccgcttgccacgtatgcgtatatccgttaaagcccgaaacatgcaattgttccaaccacctcaggtttctacgctcctgtcaaaacaagtcgggggccgacacggacgccccttttcaatgtgttagctcatggctgtggtcaagacgtgtattgagtaatcttacgtaccttttctcacattttttcccgctaagccacaagcagtgctattctgagtgtggtccgctgggactgccccattccttgagaaaacacgcacgtccctggctagatg

SEQ ID NO: 321 - DNA, 703 bp, Nannochloropsis_gaditana
tttttctccgaaacgtataaattaataatgtttggctgcagcgttgtgtcctcacccgttgtttttttgggatggaaaaccaaaattgtattctccaagataacatgtatcgatgtccggcaaagcgaagtaaaaaagaccaaggctactagtcgcatattgaaaatactttccgaggtagcagaacaaatacctgacccttctcatcattgttttcccgcgtgcggtgtctttttgttgagatggatatgtcatatccctatcctagaccaacataaatatgtgcttactttattcaaacctcttttttctcgtaactttgacatgtacaagcttttaagaaatggacgcttgagtccaggggagtgagcagatcggatcggcgactgcgtcgaagcccgtcaagagagagatcctcgatcttggctaagaaataccgtacatgcacgcccgtcaagtaggacacttgtcccgctaggggcgcacaacacgagctttcatggcattattatctttgcgagcctcacgtgctgggagagtgccggacagggcttttcagatgcgcctggaatccctgttcgtagcggaacaacatgaacgcaggagtcctgactcacgcttgcaaacaccccttgcccaccactgccccatttttctcactgccactttctacctatattacaatggtacagcagctgtcatg

SEQ ID NO: 322 - DNA, 703 bp, Nannochloropsis_gaditana
aaaagtgaggaccatccagactacggcgagacgaacgaagagggcggggtcacgagagggcataaagatgctgaccgcccaaaagagaagacctttaagcgcctcaatgccgtggcgtgtgtaagctttagaagacatgttcgaggatgcagcgtccattgcgacgagaaggaaggtcagcatgacgtgcacgcgaaggagcattaataggagcagtggaagacatggaggctggagccgggaggctaaaggtgacgcggtgtgggaatcgtggtgattgccgagagaatgggcatgtaaaagccgtgtagcccgcaagcgtaccatgaactggtgtctcggtccctgtcgtggtagttgtagaaggtgagagcgtggacgtgccgctacatgtgagtaatgcttcctgtcggcggcgatgaagcagcagcaagcttccgagccgcttcaaatcaattgccgcaccgagtaaaaaattcggcatggcccctattttgacatccagacgttcattttcccatcaaatcctttagtttttgcccgctgtatcaatatatattatcccgccgtactgcgtctaaagaggacaaacgggaacgtcaacgacgaacgacctcctccccccggtcctcccgctctcacaagactgagtgaagacaattcaaaaagcatcgtgcgagagtctgggtaaacttcagacatg

SEQ ID NO: 323 - DNA, 703 bp, Nannochloropsis_gaditana
ttaaggaaatgagtacgtcctgaggggacaaccccgtaagaggaagaaaggcgatctcagaaatggtgtctgccacatccatgtacagccgtctgagacagggacaagacgccagcaatatacgcacttacacgcttgtcagatcatcatactcttcggacgggggagcaatgatacgcaaacctcgtccaatttccctcatactggtgtgacttgaaagcactatagcatcaaaatgtcctcacctcatctgattttctgctgccgcctccgccatctccacgccgccgatggtgcatagcaggtatatctgtcctgatgcgcggtcagtggcgttaaagtaagtctcgagtgccggaaggaaacgttggtcatcttagtattgcaatcttggcgagggagtgactcgccgcaccgactcccgtgataacagtgtccagactgattatggcataattgcaggcaacggtcagagtgtttggtccatgccgtaggttgatgtctatattcatggctatatccacggcatgcatgcgtaggactcagcgtccaggtagcagcattgtgagctgcgacagatcgttcacccccgtgttgcatcaagcgacgctttctcctactactagtaggattctaacaactcttcgatctgccacacacacgctcggacacacgtcccttagtccctcctccactcatcatg

SEQ ID NO: 324 - DNA, 703 bp, Nannochloropsis_gaditana
ctggggcaaggggggatgtcacataagccaggcgacaactataacagcagcacaagagcgtcagccatgccaaaaggctccccacgtgcatggcctaagaatgcggaagggaatggatcgagcagaagggagttgattgctagctaagtggatgaactcatagtctcgttgctttaacaagtggagggcggctctgcgtgcactgacgggcatgcgtgcttccacacgagaaacgagacgcttcgaattttagaagccccaggcgtgtgcaaggcctggcaatcctcggcggaggcaaggatcgagtgccccgttcgacttggccactgtgtgtcggtttggtgacatgaacttgaaatcgccgaagggggggggtaggggggaaaacccgggttccgctctctgtcctgccattgcgtgtctgacccccaatatctatcaagtacacagacctggtcgacagtgggacggtaactcgtgcgctctgggagtctttgtgatggtcgtgactcaacaatgatgtttcacaagaaccttttccactgccggcacatcgtggaacaggttctggtgtcaagtcttgggcgtacatagggcaccaaaaatgtactgtcgcccgctacggtacattttaagccagcatgcatttgccatacagtcacagagggggctgcgtaggctgaatttatcagccgcagggatg

SEQ ID NO: 325 - DNA, 703 bp, Nannochloropsis_gaditana
tcaaaccatacctaacggcaggacgacaaaggatggagcgggccagcatactgtgggtagatgtgtgcaaggtgaaaagaaaaagaaattgtatgaacaagatacgacgaacaggactggaaatgatggccgagcaataggcgagtacatcatacaacgcacctcctctccttctgatacgcactctcttaaagacatggtggccttggacatggccggcatgttgcaccgaatatgtcatgcgttcagcgacgtctccccatgcagcagtgcaggaacagcgagggcattcaaacggaatattgagccatgtgcaatgcccctacctcttcttgccttttcctccttcgcaaggaggcggacatcaggtccccacgaatcggggaggtttcaattgtctcgccacgctggttggaagtctttttcccccttggtgtgctgacgattataaagtgtccagagtagcagtaaagccggcaggcctggccttcgcctgagttcctagctctcgcccgtggtcctggcccctccctttcccggcgcccccccttccttattgccactttacttaaaggcgctctcactgcaatcacgacacagcaagccttccctatcgagcgtcatgggcgattccacgggttcaaaagatcgccaacgcccaactttgaggtcgacatgcccgcctttcataccttcaaggatg

SEQ ID NO: 326 - DNA, 703 bp, Nannochloropsis_gaditana
atattacatgtcgtttacatcgtcagcatcgagacgtggtctccaatttcattcagatgtcttagaagcgctgcaacatgcaaatgctgaaatccggcaagttgcagataaatgtgtggaactccttttcaagaacgagtcctacgagacaatcggaaaggtctcagaaccaccaagccgatctcaagagttgttgcaattgggcagggcacgtttccaagcgcagaaccccaggtggtgtagagatgtgggctttgatgcgacttaggacacgcagaaaaagaaaattaaaaatgaaaaatctcatggttctgttgttaaacactttctatgactgtgtaagcgaaaacgctgaggcgtaaaaatctctttacctctggatcttcttcgattatttggcgcggggaaagcgacccggaagagggcgataaatagttcctcccttaaatatttatcacatgcatcattttcacatcgttcaatccgagtcgctcaatatggaggaatgcgataatgctcaaagaaccatttaaagactgatgcatctcataaggcaatatttccactcacttttccagacatgccgggaggtagaaacgcctggtcggcggccctaattgttgcagtcagttgcatgtatcctatgacggagtcatttttctattctaccagagtgatgacaaggagtgcaacaatatcaatg

SEQ ID NO: 327 - DNA, 703 bp, Nannochloropsis_gaditana
cagtcgcgaggactgcaaaaaggcgacatcgaacctcccaaaaaatttacagacttacttcgccacgtctccattttgccggctgaacccacccgccaagggcacaagggtcgcgtgattgtggtcgcacttcgtgcctgtatatccatacaactgatgtcctgcctcatcgaagccttcacgtattaccacggattacgtgccgacggcttctgtctcctcggattgaatgtcatcccccgacccttgcgtggcaaaaggtgcctttggtgcataaacgataatataaagcttaaggtactgttgatgtgtaaattttggagataggaggcacatgacatattcggatgggggttgcgccccgttgcaggcaacagcctcgcctacattccgcggacacattccgcggagctcagtgggagtactggaaggtaatgttgctttttaaaaaagaaatgtgtcaatcaaattcttgacaatgtcatattttttactgtcccttgcaaactttgaagattgggatgaaggatcatgagcaaagtctcatagaaagcgagaaaaaaataacggccacggagccgttaagtgcattcggtccttcatggatccgtcgtgacccgtcgtccctcttacaaaatcaccccgtgcgaccaacatgccacaacagccaaagtattgagtcctcttgaacagcgtgacaatg

SEQ ID NO: 328 - DNA, 703 bp, Nannochloropsis_gaditana
tcagacttgtcctcgtttttgctccccgtgcccacacctcgccctctgctgcgattgcatcgcacctttttcaccacgattctgattcccgcatactcctcaatcagttgtggccataaacatgccactcccacagtgagcgctgcccctcccactgctgccgcagtcaacagagcagcatatggggaggacactgaggagcttgctcgtcccgacccccttagtgcatttaccatagatgcgcccctgtgctgttggttgtggcaccgcaacggcatacgcatgagtatgtcagtcatttaatagcaacatcgagacatgtgtcacgagtccggtcgtttttgccctacatttccagaatcagaggtaagaatcacggggcgcgaaggtcatcatgacctccgcctgagcttattccacaaatcaaatgacgaccagcctgtcacctgacaggcaatcgtacctgaaccatccgtgccatacatgtgtgccgtcaaattaggattataacacgaaccgtgaccgtcggtgcttgctggtcgcggctattttaaagtgctgtgttcactcgctcgacgcgcctgctgcccctgcatgtttgttcttcctcccctggttgacctccctccaagcctctttctggccgtggccgtcatcgatttctcttcacacgttttatgtacacgcttttagggggacaatg

SEQ ID NO: 329 - DNA, 703 bp, Nannochloropsis_gaditana
cctccatgcccaagtcaggcagttcacggatagtgaaccggccttttttctcccctcccgtcttgcccgatttgctcagggaatccgtcaggtcagagaccgtactcatatccactgtccccatccggtgcgatgtatatggatgaggactactggacggggaagtatcatgtgtatgtacatgggaacgttctgaggctttgattcttccccccacgatgtctccctcagggtaggacgcctcctcgacctcgcccgcttccacctgttttacgcggaaacgccctttccgctccgccggcatgcctcctccttcccctggaagggtgctaccagtcggggcagtagtaatggaggaggaggagggcgagcaggactcggccataggaggaagaggtgaggtcgacgagaaactgggcgctctgttcctcctgcgtgggaatgcccagtgccgacacgcacctgtggaggaatgcaagacggtcgttgagtcaagtatcctgatggtgtacattggactcgatggcggcatattttttgcccctggtcgttgtgcgtgtacatgtaaactatccacgacagtgccctgaagaactcttccggtttcgctcgagaggaggcgaggagcacaccaaatgcacgcaatgcgtagaacgcagtaaacggcgctttaaacccttcaatgccacgcgaacgacagatg

SEQ ID NO: 330 - DNA, 703 bp, Nannochloropsis_gaditana
gtggttgcgtgagtcgaggaccgctgatctgggagataggggaagtctggtgatcgatcaccacgacaggcggctttcgtcagcttcacgcgcctgcgtccttggggccttgtcgtcgatgtcgagggaggataccaccttgccattgtcaaagagagcttggaaaggcatatttgcgagtgtggatgacacatgaagccgctaggcgcctctgtcaagcccgtggtcctgagcccgagcactcgtctcctgcttcttccatggagatatcgcacccctgacttttccccgtattcccgcctccccatcttctcacttacaaggcaaagcaacttctcatctaagttggaagagtataggcgtgcctagtgtaccttttgggaggagtgttgcgattgtcttgaacaggaaagcaggcgcgtcacggggagccgaggaaggaaacaaagcacgaaaaagtctttgaggtgttcgcggcccaggcagcatgtcggataatgagcatgaccataagctggaaaatggtcccgccaaaatcaacgggaaggcggcggggaagatctcgaaaaatcaaagaaggaggtgatgctaactgcctgtcattccctttccctcccactggacgatcgcgtcgcttctcacacgcatattttcctcccctcctcggacattcagagagaagaagaaggctgccaagagaatg

SEQ ID NO: 331 - DNA, 703 bp, Nannochloropsis_gaditana
ccacttaaattcagttcctcagctttgaagtctgcatcgaagctaaaggagaaccttgatcttcgagcttgtggcggttaggcaggcgtcaacttcactatcaaggaaggagaacggtcaactcctacataaatgctacggctaaaagcaccattacgctatgcggcccgtcaggctccgttatctctccttgttttctttgtacattccaccttgatatcttgcgcccgatcaaatgcagtgaggaccggcagcaacatcagatttgagatacacgactcttcaagtctacttcgtcctcaatatggtagactccttcatcacgggttccccctctcgttcatatctcctcctcaagcgcctgcaccaacgcactctccttcgtcaggagaaaatggcaacggccctttcgcgaggaggagaagaagaaaagcaaaaagtgatctcgaaagcgtcggccgtaatcagaacgtgaaaacaaaacggagcagtaaggtacagcctttctcgcctatcaatgagttggccatttccactgctaccacttcatcctcctcgtctaaacattttttcttcgatttttcagtgccgaaaggtcataatggcatggctttccccgcgcatccagcaaagatgacggaacaaggccctgccgctcctgcccgctctcctaacacccttttggaacctccctccagccatg

SEQ ID NO: 332 - DNA, 703 bp, Nannochloropsis_gaditana
tttttctgtccccaaagcctggtagccttggctgtgatcacggcctgccaaggcctgcttttgtggcaaaggaagggcaaagaaggccctgcattgtcgaagcgccgcctgtaaaagggagggcttcacaccatggccctttatataaaaaaatccatacgtcttacaggcttcccgcaaattcgagagggagggctgggtgagatcgatgaccgggaaggaggaggaggttatgccgccggcaagaggaacctggggtgatgatgccatgaccactctgacacctcagcctcgcagacttgtaagctcttctcagtcgataataaggcccttgtgaacctagtgagtgggaattttgacgagggtggcgagttacagacggcttggacacgtactagtagtaggacgggccttggatcgatggcgttcagcgcaatttttatgcctcactacccagaaatgtcaagctccacagacgaattcaagaatactcgtgggacatggcttgattctgatttgcgcctgctagagggcaagctgagctgtccccctcccagcacaatttcttttttttaaaaaacagggtcgatatgtcatgctactctttcctatcgctgcttttgatagaagcattacatgcagtctcacgcgctagtcgaacacatgctacagagccccccaaaaggtaccacacaacacaatg

SEQ ID NO: 333 - DNA, 703 bp, Nannochloropsis_gaditana
agtggcccgattaccgcgccacaagcccagacgttgcccctggaggggccaaaggggggacgagaaacatcgcctctctccctccccctcctcctccctcctccctcctccaccccgggcatcttggctatgtgcacgccaacgcgcggcatggaagtacaccatgttcgcgagttgattcaaatgtcagggattttcacttgtggatttcaagcccgcggacctcgcagcaatctcgtccctgacctcctcacccatccactcacgccgctttcccttccatcctctttccctcctctttgtttttaaaaacctgcaacatgcacaggcgcgctagctttcaaattttgcttgcctcccgcttcctttcgactatcgcgtgagaatggcaccgaaacgaaaggtaggtaaaagtaactcgggtccctttcgatggtatgcccccgttccttccccttacaatcctcgtcttttgatctcctgcacaattcccgttcccgcactgcagccgcctgtgaagaggaagcgaacaggtgatggggatgaaaaagagcaggaagggaagaaagacgtggactctggtaaaggaggggcgcctccttcgtcgaggccgtctagagctaagaaagagcatgttcctccttcaacgggattagcatcagatacaattcccactcctccctctagcgctcctgtgaaaatg

SEQ ID NO: 334 - DNA, 703 bp, Nannochloropsis_gaditana
agaacggcaacgaaggagtgaggacgtttcacatggttgagaacgaacgaaagaaattatcaatcggaaaggacatgcgcaggcatgcactcttccaccctttcaaatgcccttgttgattccttctgaggagaagcaagcacacgggagggcgcacggatttatcgactggtggaaaggagggtttctatttccgagggccaagcttatggaatgagtcacgacgcatgatttgacgttcccacaaccgtgccctttgttgcttcgttttgtttgtccggtcaagcgtctgtccccgcgctacgtcacaagtcttccaacacgaaatattccttttcctgaactagcgcatcgatgccacaaagaaagagcccttccattacacaaaactgtaaatggagaaagaaagagttgggcaacggccgaatattcgcgttttggtgccccgtatcgattttgttctatgggcgatacacgaggttttatgttctgtctgtgattcccttccttcggcaagaatatgtgccatgattatggcattttttggcgtaaagttgccgcttctacaccttgttagcttcctaaagctcggcttgtccatgtttgaccagttgaacacatttctcccattttttcttcctttcgcaacataagttccatccaacgcggccttttggcagcattttcactctcaggacgcatg

SEQ ID NO: 335 - DNA, 703 bp, Nannochloropsis_gaditana
tgtgtcgatcagattaatgcctgctttgagagcacgaaggacaacctcgacagcttcgtcttcgtcctcgaccgctgcaaacatgccgcccagcgaggaagcacccagagacagggaagacaccttcatgtctgtgcgacccaaagaattgtaagacattcgccgaagagcgtccagatcctggtggaaatcttggacataagtaccgggtagggtcgaaagatggggttcagtggagacagagcccactgaggagggtgatggcatgttgcggtttgtcgttatgaggtcaccagaggacagcaaagaggaggcgaagaatacgggtgggatgtcaacctacgaattttgacaacgtcatagagaaagaaaaagcactgagctgtaattatgttgccatccgatccaatctttagacgctggaaaaaaaagcatgagaggtattggcacatgaagagacgagagcctggagggaggcatataacctcccaaacgtgccaccaagggacaacatgccaaagctggcagtaagtgggacatcagggagcaaaattttaagtcctttgcgaaaagcatgttctgtgcgagtgtacatgtggccacgttcagacgcaagtgacaggatgggccgtgaagttgccttagcgaggcccctcgcgatctgcagccaggacacaagcacgctcccggcatgcaacgatta

SEQ ID NO: 336 - DNA, 703 bp, Nannochloropsis_gaditana
ctggcagtaagtgggacatcagggagcaaaattttaagtcctttgcgaaaagcatgttctgtgcgagtgtacatgtggccacgttcagacgcaagtgacaggatgggccgtgaagttgccttagcgaggcccctcgcgatctgcagccaggacacaagcacgctcccggcatgcaacgattaataattaccagtcattcagttctttatgtacgtgcacgtatcagtttactcgctgccaaagcggtgcttttcaaagctacttcaatttttttacgcctccccctgtgcttgtgtagccagcgtgcacgaagcgcctcctcttcaacgcccctaccccgtcagccacgggtgtctaatcacctcctccatcttcgcccgctcctccggcactgccttgagcaggctttccagcaagtgtttcgcctcccgcgaaatccgcatctcccatacgtccatcaactctcccaacttccccgcctgaatcatccggtacctagggtccgtcaaagctggcagctccaacggcggcacccctgccaggaggatgaatagaatgaccccgcaggcccacatgtccaccgcaaagccgtcgaagtccttgtcctccagaaccacgggatccatgtacgtgatcttcccgcactggccctgcttgcgtaggagtacccgcggggtttccgggtcgtcaggatgggagggag

SEQ ID NO: 337 - DNA, 703 bp, Nannochloropsis_gaditana
tcgccccgtcccccccgtccggccacaggcactcaggccccaagactctccgcctccctccgtccaggtcggcaacccccatccgacgcccccatcggtccctcctttccgcccacagtcctgccggggcatccacccggcggccgtggcccctctcgttccctgcccatgcgcgcatgcaggtaggcaggcacccgcgtggacgcacacgcaacacttcttcactccgtgaatatctggctcgtcccaagccacattcagagttggtcgtcccattattgtcgcttgctttaaatttgttcattttttctctcgggggtagttgcgtgatcctaatttctaatttcctccccccctacaagttatctagatagtcactgaggcagcactgcctctcctgtacacttttacacacatctagtgctttgccctccctcccccctccccctcgaccctatcgctggggtactcgcctccatgccgcccatcaggcttctctaagcaggcgtctccccccctcccctcctttttccttcctatccccctcgatggcccacctccctcctcccccccttgcccccccgtcctccctcccccgccaatgccgccgccaccggcccccccacccaggggtgccctcggatctcctccagggtcaggcgggcgcggggatcgacctgcaggaggccgaccagcaggtccc

SEQ ID NO: 338 - DNA, 703 bp, Nannochloropsis_gaditana
tcaagacagagtagcggagatagaagggggggattgcgcgcgtgtaaaggacttaaaggcggcgtatttctttttgggggggtgcctcagttgcgcagacgtggtcccttcggaagggaggaggttgtatggaatggaatgcggatggccgataaaaaaatgcgtgcacgcacaccagggaaagcagagccactggaaatcgtcgacctgtgcaaggaaataagaatgcaggcggtggaaggtgaaatgtcgttcaggaattggctgttgctttccagtaggccgggaatcgagttcgcacaatttcaattcttccttcttgttgatcttgaaggaattctgccttcacaacaataactcatgtcgtccgcagtccctttttagccctctttttgtttacacttccctatcggaaagctctgctttgtgcatctatggttttgatggtctttttgcgtcgactcgctacatgaacagacgagaggtcacgtcctcggtaaccttccaagaaggtggaagataaaatgcccccaaaaacagtccaaggaatggtaaaagctatctaaaagttgatgaacatataaacaccccacattcattggattggtggaattaaaggctgtgatcatcatgaatgcgcttgtgctatcaatctttccccaagcacgttaccattgctacctcatgtcccgtcctttagcgt

SEQ ID NO: 339 - DNA, 703 bp, Nannochloropsis_gaditana
gactttgtgtcaaagggtcaagaggagaggtggtgtttcgacgccctcgcggggacttacggcagaagaattgcgctgttatatggtatgtttttaatgactggggttttaacattgtttcaaggttgggtgtcttcttccaatcaccatataacttattgccttgatattgctttgtacgtctgagtggaccatccatcgcctcctcttcttctatcgcgtgccatgcttacgcttcaatcccctcacatttgtaatgccgcttacaatcctgaatggatgagaagttgtttgaaagtcttgctgtagttttgtgcttgtttacaaaaaaatcgaggtgaaaagtattcagtaagatggcatgggaccttgtaatagcgagtctcgggcgatagaagctacccggtgaacgaggcaaccgcgtatttatgcatgatgataagaagctcgggagtcatttggtgcactttaataatcacacgaattattaaacggctgaagagactaacgaggactcaagggtcgctttcattgaaccatcattcttttcccgaggacaaagttagggagacctgtcctcatatgaggggaggttagaaggaccaataggaccgtggcctagaaaatgtcacaagtgactcgcacacaccacgaaacagatcgagcagatacagacgtctgaaacgtcgttgactgaccgatg

SEQ ID NO: 340 - DNA, 703 bp, Nannochloropsis_gaditana
tgtaagatggatatgagcgagcatgaggacgaggcagcgacgcaaacaagcgatttgttgcgtcggcggtgttgtcgtggtaggagccgtcagacttctccatgtctgtagagggaaggacaccagaaatttctaaagcacctcgtattgcttttgctgactatatgggatacgtcatgcgatactctttcttttccacgagcagtttacatcttactcccccccacccagcatcatccatggcttcccctcctgccggtcacgtcctccgcgaatccaacatcactcttgatcacgtgttgcgagagaataatgcaattcgcaagagtaagattgtctgcacgctggggccggcttgctggtccgtggaaggcctgggaaagctcatcgacgcgggtacgtcaccaatacggagggagccgcggagccgggaatgggggtgaaagtaacaggtctttacccctacggtaattcctccgcttgcatggtcagctagatataatattgcaaacaggaaggcataaaacgaaacattaaagtgcgagcatcccgagggctccttctaatttatagaagcggatgcatcttcccgatccggcaacatgtcgcaccattcaaactctctcattgaattccagccagtgcctgtctgaccaaaagcctcccctctcttctgccatgaccctctgtacgcccaggtatg

SEQ ID NO: 341 - DNA, 703 bp, Nannochloropsis_gaditana
cgattgcgacatctcttattgataaagatgtcttaaaatccgtcctaccgctccctttctcatcggtgccgctgtgaaagagacgacccgataaaagtgtttccgtggtcgatgcagtgctgacggggacggcgtttgctcgggacgagaagcacaagtcaacgtccaatggacactggataagcgtgccgagaatgagtggcaaaagtgatattaatgaggcaggtggacgccagggcgacttcaggagtgaaaaatgctgcgagggtggccagacgaaggcgggaggtgacggcaacatgaacgtaagaggaggcggagcgcgtgaagagagtctccgggcagcattctctctttctggccccattcgcactgcggagttgtccactacgccgctacatgtcctcttctgtcacggctggctgtttgtggtcagaaatgtgtaaatgcacgggtgcgcggtgtggtggtgtacgcccttgggacacgaagcggggaaagcatcgctttgtcgctggcacttttggtagggggttctgcgactcgtacactaaaatgacctttctttccaagctaccgacattaaaatgttgtttccccatgatcgcaacgcctttttccatgaccgcaacttacatacatgcaatccaacgcttgacaggaaagatagtctggattgccctcttgccctcgtgcagtcatg

SEQ ID NO: 342 - DNA, 703 bp, Nannochloropsis_gaditana
attatatacagatgcatgtttgaattcgacccagtacccctttgaacacgcctgggaaaggtcctgttcggaagcacctgctttcgcctcgcttacgcccaggcatttacaaacatgaatggaagttggagccgaacaaaagaccccaactaccctccatagtctgtgtgtgatggttggtgtgccaaaggatccgaaaatgtcaaatgccatgtaaacagatgggaccgtacttccacctcgtcatggctggcttcaagtcaagggagggcgagcgcaacggcaagtgagggagatcctccaggtcaaaaggggtactctttttaatgggcgcacgcccgcggcacaacgtgtggacaggtatcgataaagatgacagtggaatgtggaggaggaagtgcgggtgaagtggtgataggcatcgatggccgtggctttcgcggcaagtactttgaaataccaggacgtgtcgtacttcgtgcttgcgcgtactttctttggggacaaatcttaatgccccagaatcgaaattccctctttctacatccgacatatattcctgtacacattgacacacaggccgcggcgctgagcgcctcggattctgttgcgcgtgcagacaaggcggctagcctgtcttatagctggcacgtcatctctcggggtttcagtttgcacaaagagtaggagaacgcttttcatg

SEQ ID NO: 343 - DNA, 703 bp, Nannochloropsis_gaditana
tccggcagacgaccctttatcagcatctacacccggtttgacgcacgataatagcaccagcacgtcggaagacagtggaggacgggagcacaaacccaaatcgacgagcacggcgggtatggcggcagcgacggcagcttcccttttcaggggtcttcacggcgggaatggccttaaaaacaatagccacggcaccaatctgacgacttcaccactccgcaacaaaggcatagaggctctttcctcattttccaaaggcattttgaaaatttcacagcaccatcaatacgcatcctcactcgggaagacttcaacttcgaccactcctgatagtccgtgtcaggatgaacagcgggtgattggtcccgacatttccatggaggacttgatgttggcgtgcacgaaattaaagagacgcgtgaaggttatggaaacccagacacgtgaattgaaggaagcaaacggcaggaccgaagtagagcgggacgagatgatagatttcctgtaccgtgacgtgcttcaaagggaggatgtgccgccccatggaacgcaagcctctctgcctgccctccgacgtgaatgggctcaacaagaagaggaacgacacctgaccttgcaggcaatgcaacaacagcatcgggagtacgtcctggcaaataaagcagcaccggcctccaccctcgccatagccctgccatccatc

SEQ ID NO: 344 - DNA, 703 bp, Nannochloropsis_gaditana
ctgcaggagaaggactcggcgattgatgctttgcatcgtgccatgtcccaggatcaaagcgaacggctcacgctcgaatcctccttgcgggcagcccaatctaaggttgactcgcttacacaggagatagcttcgatctccggcttgctgcggggggctgagcaggagaaggagaatcttcgccaacgggacgcggagcagagagcggagctggacagaggctgtcagcaacttgccgagaaaacgggggtcttgctgcgggtgcgatcggatttggagaaaaccgaacaatcctgcgcattgaaaacggcccaaatggcgcagctggaaacaggtgtgcaagaaatggtgctggagatgaagcgcctccgggaaagcgtggaggagggggagatggcacgggctcgtttgtctcgcgaggtggaaagcaggcagcaggcctgcgtgaagctggaaaaggccttgatggagacaaaggagattttgcggaaagaaaaagaagcgtgggagtcaggcgctcaggcgcagagagacgaaagtcggcaacaggcagcaagtcagcagcaaacgttcgaggaagagttgatgctctaccataaagagtcccagaaaaaatcggcgttagcacgggagatcatcgccgacaaagaccgacagctcggcgagtgtgtccagaaaatcatggcgctggaagaggagatcg

SEQ ID NO: 345 - DNA, 703 bp, Nannochloropsis_gaditana
cctagaagcacctaccaagaatttaaagtcttcaggctcttgcgatagagccgaacgactatcgtcttgtgagaaagctgcggcgccgggttgatatactgcgctgcagcggctcgcatggatgcattggccatgatagccgcccagccgtgtacctgttcgcaacgatgttggttgagtggcgtgagggcaggattgggcagagagagggagacaaagcagcacgggtcaggtaactgagagagagaggaagggcgtggcttgctgaaagagagcttatctctcccgcaggtgaacaacttgccgaaggcatacacgtgcgttgcaaccaccacaaaacattccacatatgcctacaatggtgggccactgtcgctgttgtgggccaacgctggccttgtccacaacattgtgcttgcgattagtcatggtatccacgcccctccgagtcgctgtcgctagaaccggaggtagttgacgtgggaaggttttaaagaaagcattttacgagaggtaacgcatggaatgataaggttggttaaaacggaagcagaacctcatgctctccttttttttgggggggggacaggtttgcccgagcccagcttttagtacttcccaaaacgctgccttggtgacgtgtgaagagggaacaaacgggccgcttgctggggagtagaggatcccttatacgcgggggatg

SEQ ID NO: 346 - DNA, 703 bp, Nannochloropsis_gaditana
ttcctccctccgacggctcctactgctcggcatcgacggcgtctgaactggcacgagccgcgtaccaccgggcggtcgcactcgcggtgggaggggcggagggagggaaagacagcggggaggaaggcgggagggagggccaagtccgcgtgctgcgggaggggacattcgtgggggtcgcgtgcacagcctccgtggtgtcgagccaggcaaaaaggggggagcatcgtgctcacattgccacgtacagcctggacgtggaaggtcgggtcctcgcccgcggctactccctgtcgttgaccaagcaggcccggagccgcgtggaggaggacattgccgtcagtaaagccaccctggcggcactgatggaggctacccatccgctagggcccgatgcctcctctccgtctttctcgtggcgggaattcctgcccgtcggtgtcggggagggaggattagggggggaggatcgacttgtcgaaggagaggacgaggcagggcgggaggaaggggacgccttggatgcactgatggtccaccagacggtggatcgagtcgtctttattccatgcccccaggcgcccaacggcctccgcttgtacccgtcttccactaccgtcttccctgcctcaaccccgccctcccccccggctttctcccctctcatcgtctaccctggctccttcaatcctctgcacgaagg

SEQ ID NO: 347 - DNA, 703 bp, Nannochloropsis_gaditana
tgcttttctgtatttttgcgtgaccgaaaagagcaatggagggagggtagaagaaaaatggacagaatcaactttaaattttcgggtgcatgtatcctggcagaatgatcattctgatacgcctgtaagcagtcgtgcatgagctcgtggtgtgattggcttcttctggttgtcatactcttacagcagtccattctttaggaggtctaggttcctgtcgctcacacgcagtcgcggagactcgagcgagcgccgccatggccatcgacacactattccttcgcttaggatactggaaaatcgtaaggatgtcacgtttggaattgtcgaggggacatgtcattgtcagcttggatggattccaaattagagtttgtgaaagccacagcgggcggtcgtatatcaaggacgcatgacagcgaagtcgtttgtatgtaatcgtgcgtaggttatcatgtcacgaagccttcgattttctcgtcacattcggctcacgtccatgtataaaattgcctatctcatgcaacaggtttttgtctttctttgtcaaacgggggctctatgccgtgcggccgccaggccctgcccttcgctcgtagataggcaaccgtgacagcagtacatcccagtagcattcgcaaatccttccatcgatccacgcctttttaattagcatccatttactcgctcgcgtctagctatg

SEQ ID NO: 348 - DNA, 703 bp, Nannochloropsis_gaditana
acaccgaacgccaagggacgctgtgtcattgctggtgtcccgctagataccgcatgacatgcccaagaaggacattgagaagcgatgaacgacaacaatacgacaaatctaagccagcgcaaccgtatcagctgattccctgcttgagaacacggtgggaataatagcagtagacggtggctgcttctgttgcctcccatatatgaggctgctgcagtagccaccatcagcggcaattttcgaaacaatacctgtagtgtcaatgcgctgtcagtcaatgaacggtatgggtcaaaattcactttgcttgacgtggtcaaggcgacgtggaagatcgatgacgaccgaattgtcgacacgtacatctttttcatccctgcctcatctctgtaatgtttctcattcatcagatctccctctacgtagtagatgatgtctcaaactcagtatttgacgttgtatttgggggcttgtgcactcttttgttgtttttcaggggggacagcgatgctgctcgtatcgccagtcagcttcaatctcctctaccgtccgttctcacgcacgacccaaaaatacaactcaccttccttgcatgatgcgcaccccatccagggagcctagatgagaaggaaagaaagccatcgtcacccttcacagttaattcgttgtttcttgtcggcgtgctgtgtgccgcaactcgatg

SEQ ID NO: 349 - DNA, 703 bp, Nannochloropsis_gaditana
cctctcatgggcaaggtcgcgagccgaagatttgctgtcaacgcactttaatagtacgagcgatccacgcgcgttcaaatgcaaaaggaaagaaaaatgaagcaaccaaagcatgggaaaggagtggcttattgaatggaacaggagacaaccgcaccgatggttgcgtttgatgggctttaaatcagttgtagattgggatatgttacgccgggctcggaatattttgaccatccccatttgaagtgggaaggcggacaataaatctccacaccggggtgaaaccaaacagcgacccggcatgaattcataactcgttttccaatcgttctacatgtatggcaattgttttcgtgagttgcatggtatgccagtgtatatagaggccaatgcagggcacagacatctcaagaatgctttcctcgccgcggaactcggtaaatgcatgtctccggtcctacggtccaaaaggccgaccactgtgactcgttctgaatctctgctttggggagacggcgtgcaggccatcaactaggctcggaaaatcgaggtttcacattcttacttggtaatttttgtgttgcgtgacgcaggtctttgtttggaaaagccctttaatttcctattggctcttttctctcccaagtcagcaacgactgccgtaccggtgggctgatctcgccgcaggtacagcatcgccatg

SEQ ID NO: 350 - DNA, 703 bp, Nannochloropsis_gaditana
cggcaggaggcgacggtgcgcgcagcatctctgttgctagaacttggacagaaagctattgaacaggcatgaagttgaacttaagatgagatccttctgctcttgcccttctagacccgaggaaagttgtaagtgatgaggctagggatgtgcttatgtcatccgcttcaaagtcaattacaccacagtttgcttttaaaaaagcaagcaaccacctggatcaaccgcctctcagccagtttcgacattcctgctattgtggtatactgtctattccgccaaagcgcgcacgatcacatgcttcggacgcggagttaaacagaataacctcctcactcggttctcttactccttgagacctcactttgatagaaaggggtcgcggacactgacaggcaaacagagagatgatattggattcaacagcagtcatctgatgtcgcgcagtttcttgtttcctcacccacccccttgcttttctaacgactcttgaagcctcttcgcgaggtgggcacaggccttaaggaaatcacgtcgcgtctgccatgaaaagccatcctcaaggggagatatggagtgcagcagaaatttccgccgccgacaaagtctcatcgcccttcaagtatgtcaggtgcacctttggtcacctttgtttcgcccttggacgcttaaatctcgatctattcctttgtcccggcccctc

SEQ ID NO: 351 - DNA, 703 bp, Nannochloropsis_gaditana
cggtctcgtcttctttgagggccatggcgggatttctctttccaggaccgactgttcagaggctcataacactcctttccctcccttcgctttataggtgctgcgagtgcaacaggaggagatcaccattgaccagtacgtcagcgcactcgtcgagcgagtcaaacgagacaaggtatgtagctaccttcgtatctggtgctttttcctgcctcgctgctcttgtcctttccctttctatttttctttctgcatttcccgtcgaggaagctctcaatgtcgggttggaacggtatgatgaccaagccatatctatattccctatttaacagtccctgtttcttcgtcttttcctgtttgcttcatcctctttttcctacctgtatcgctctagctgcttgctctttactgcagccatcagcagaagaaagctttggcgtttcgggtcctgaggcgcgtcaagattatggaagaggagcttcggggtgtagaaggagaggcaatgtagaccttgtgaaaggagaaatcaatgcacactgagaggggatcaattgatgtcacgcttatgtttttgagaccgttcgtacagcaacccatgatgtcttttcggtgttagagaggcaaactttccattagaactagattgctagtacgaagacggctcggggatgaagcctttcggttcttccaagtcctctcaatg

SEQ ID NO: 352 - DNA, 703 bp, Nannochloropsis_gaditana
actttaatctttcaagtgtgatcctgatgctgccaacttcccggaagggatcttttgggaggaatttgtacggtgaacaatcgtggtattaatggtgaaatgtcgaaatgtatatttcatgtggtcgatgcgcaagactgcttccttaatcacatccaggaaattgtcgaacttgacagcaagctctttagatcactcacttcgcgtgggcaagtttgagctcgaatttgcattgccgagttcgaacgctttcatcgaatggctatttacaaacgtgagtgaccggattaagaggaaatgagaggaaagattccatcgaggtgccttgcaagagcaagagcaatgggacgatggtattattgaagctttgcttggatatggtggtggggaattcaggatcggcgagtcgccggaaggtcaggtctaggatcaggggtggaaaaagtgatcatgtagaaaattttcaaaatagcgtcagcaccccagattattggagccaataatatatttcgatcaaggaagtatatccgagaaaatcctaggaaaaccgcagttttaacgccgagatgaagaattaccttcttagagatgacgataaagttcttgtttagttcgggtgctgcaataacaaatgtagaaagggtggacgagccgagcctctattgctgtacccacatcattacaagatctaatcactaaggca

SEQ ID NO: 353 - DNA, 703 bp, Nannochloropsis_gaditana
gcttgaatccaaggtccataagtagttgacgaatataaactgcactttgtgtcgctgaacaagcagatatcaactccgattcagccgacgatagagccaccacatcttgttgcttggctttccaatcaatcgtgttgatatcatctccatgactcaacgtaaaagtataaccagacgtcgaacgtctattatccttatcaccagcataatctgcgtccgcgaatcctaccagggtaaacgatcccgtagaattatctgtgtatttgagtccaacctcactagtacccttcaggtacctcaatacacgctttgcagcaatccaatgttcttcatttgatccttgcaagtgttttcccaacgactgcaccgcaaatgcgatgtctggacgcgtgatcagtgctgcatataataagctacccacaagcttcatgtattcactatctggcttcatttccttgtcattcgttttcgtcagtgttccttccatcggtgttaatactggtttacaatcagccatcccaaacttattgagtaccatatcaatataagccgtttgagagatttccataattgtcttctccctatcacgtttgattgccataccatacgggtgacacatgcttaccgatgagaaaagtagataacatgtatatgttagactactatgataaaaaatgtgaggaggctaatgtagttagctcac

SEQ ID NO: 354 - DNA, 703 bp, Nannochloropsis_gaditana
ggggcagaagatcaaggtggtgatggccgcgtgcttctggcagaacccgcacatcatcgtcctggacgagcccaccaactacctggaccgggactccctcggcgccttggtgcaggccattcacgactacaagggcggcgtcatcatcatctcccacaaccgagagttcgcgggggcggtctgccaagagaagtggatcatggataagggccgcttgcgtcgggagggggagtcggtagccttgcacgaggaggaggagaaaaaggaggagcttggggacaaggtggtgatcgacgctctgggcaacgagatcaaggtgagtctccttgttttctgggcccggcggctctgtgatccttcacacggcatattcctgggtcgtcccaagtccctgcggtgtccgtctgcaaactttcgcctcacaatatcccctcctcccgcctaacccactctgctcgatacaggtgaacaagcaaacgaccctgtccgacaaggaaaagaagaaggaaatcaagcggctgcaaaaaatgataaccgacgggcggaaaaagaagactctgaatgaagatacgatcctggacctagagctgaagctggaggagctgaaggccgccccttgaccgggaatttagaggaggcgatgtcctattaaaaccaccatcaatataagaatatcaaaatgatgatatctagtagtataaca

SEQ ID NO: 355 - DNA, 703 bp, Nannochloropsis_gaditana
agttgatggtggatgacagccacgcgtactatcattcgtgcctgtatcatgtccacgactggcagacacgtggataccgtatgttaccacccgactcggtgttaattcataagcacacacgccaatacgccgtaaagaatgccggacacatgggccgtgacctcctggccgcgtgcgcgctatgacgccgacaagttcgctaatgcaggacaaattcaatttcaagagcgagcgggccggcttgcgtcctgtggcacgcttggtagggggcgcaccgtgcaccgatggcggtttgtcctttcgcgcgttttatgatatgactgctgaatgttaaaagtaattgtaaggggcttttgccggggttgcgaaaacttaaaaggacatagaatgcagagctttcccactcaagtgctgcgtctcgatcccacccttcctcatctatacatccatacgtcactcaaaataacgctcttaaaccaacgtcaggagggacttcggcagattatttgggcgctttcagtcggacagacagaggtgtaccacaattttcggcgcatctcgtctcctttcccccgtcccctctgttggagaattgagcctgagccccagccttgtgacgccctgagaccacgcctgcccggatttgattcttacattatttttaccggaaaacccgccatttagaagctggtgtttttgcatg

SEQ ID NO: 356 - DNA, 703 bp, Nannochloropsis_gaditana
cgcgagtcagtgactgggggccccgatcaaagtttaaatgagaccgcattcattgagtcacgcgcactacttcatgtgtgtgtgacaataatacaagaaatggtgccttgtccactcccaggttggcctggcgttcagtgtcctcctgagcccatgcgaatgttcttcgtatcgctgagacttaatagcgacgttttgcaattaatcgagtttaatcaagtcatggaagagaaccgatgggcttttgtctgcggcaattgaacggcgctcggaggaaacgaggccacgaaagtcctttcattgaatggctaagagcttcatattttgctaagggcttgattttattcgtcgtattcacaagattacattttgtgtgcaatatttacctctccttgcatgcatattaaggacctggcatggtgagaggcgagccgttgaagagacaagctaagaaattctgtggccggtagtgttgccggtcaattctttctttcacatcttttgtaatggaatatatatcctggcactttttggggagttttggcacagttgctgccgtttttcgaatggtttttaggacggaataagctggttcgaagagggcacgggatccatttttcctatcctctcaagtatacaaagatatagaatatggcatatctttgactattataacattttatggtgacacattgtaggaaaa

SEQ ID NO: 357 - DNA, 703 bp, Nannochloropsis_gaditana
gaggcgaggtgaggtattgcctgctgggagatgtgtcggtcgtatcatcgccgagttgtttgtgaacgaccctcgtacaagtccaggtgcatctcgcggcaccaaatacacgagaaacattgaagcagacgaggctaagcacgttttcctcttcttccaggtgaatcgtgtctgttctttcccatggacatgagcttttcattactcagccctccgcgctactaagcgtcccgatcctctcctaggcccatctcgggtccaactaagataaatatgccaaggagacacagagctgtaaagcccagaaaactgtacttattcaatcatcaatgcaatactgcaatattcttctggccatcaacttaattggctcttccgatactgtgaaatttctcgttcaaccctcgctgagaagcaacagaagaatgatagtaaagggcttcatttcactactcgagggacaaatctagtcagtcatagcatgcaaatggaccgcaccggatgacggcagtaattatgattgtccatctttagcgtggcgcagatacatggatatgttgctcatccctcgtgatgtcccgtaatttagctcacacaagacgcgggtctctgctagcccgacattcgatgacgagtatgatgtatgttctttgcggcctcctctgatttcttccactccatgaacgctctagttgcaaggatg

SEQ ID NO: 358 - DNA, 703 bp, Nannochloropsis_gaditana
tgtgaagaggaggactttgagtacgcacacatttattaattctggctgctgccagataaaggttgttgtcccgtgactccgttgatcttgttggaagccggcctcgggctgatgctgtaaggacgcgtgggcgtcgtcaaaactttgtcaaacggaaagagcgataccatacaggacaaatcaccatgaaagacaagcacgtgcaagaagatccgagtcaagagctggacgtgaacaatagccaaaccaaatttaaggacatagaaggaacatgcgtcttaggaccgctcccggcgacctccccgcccgtcctccatccaccccccttcttccctaggtcgggaataaacgcatgagccgccgcctccactcctatctttcaccaaactttccacgcaagatgcaagatgaaatcccaaatcgtttactacatgagctcgatgcgacagaaatccatgcatatttagggtagagctctttgttaggacgtatcgtaacgtcctcctgtgttcaacctgtccatcgccatcaaccctgccttttaatggctaatcctttttcctaatacgtccacacaggcaaaattggatttatcttttataaaagcagccttaggctcgtcttctagatcctttgttacctctgtttgagcccctttgctccatcatccgacctcgcagcagctcggctcgacttggtcatg

SEQ ID NO: 359 - DNA, 703 bp, Nannochloropsis_gaditana
ggtgtgctttcgaaaggagggagagggcgacgtccaggataaggggaataaatggtgccttcaaagtacttcaggtcgtccacctcggatgccaatgttttctttttcccaaacccaaagccaccgcccactcgggcaaggagcactgggacaactctgtgtgcgactagactctcgacggatctgcgcgatggtacagtgggcgaaacaaaggcatatagcgtacgtgctagtatcaggactgcaatggattgcagaaggagcgtattgcgttgacgagggggtccgtggggagcgtgcgcggacataagtacagcgaaagccacctgtttgattgagaggacaaaattagctcactgaagaccgacaattggggcgccaagccgatttgaaggaaattctagttccaactcggtaactcctgaggctgggctggactgggcgggaggtcacctagacagctgcaggctgctttccagaggagaaaaaaccttgtcgaagcctcgccttagcacatctacccacggcacacttgaatcgtggtttcgagagcatattcgagagcctcctggcgtcagtgcctctattattgaagcaaccagttcccctccgtcttcctcctcaggcccatcgagacgcttctccatttcaacatcgccgcacaatcggaagacttacctttacctgcactcttactcgcata

SEQ ID NO: 360 - DNA, 703 bp, Nannochloropsis_gaditana
aacctattgggcatttgtgtggttcgatcttcacttacttgcccaactgctttgattgtcggcgccattcgcttttcaactttggccctctcccacaagcatttaccccggtaactccgcgtctaagcgtgcgaatatattttgctcaaaaaattcattcaagacatctcatttttttcgctcatgcattacaggaatgacgccacaaggaaccgatcacggatcagatgtggtctgcgtccggcgccgtcgcataggtctcatagtctctgcagtgcttgtggcgggtattgtagctgtagtcgtcgcatttgctggaaaggtaaacatctacatcatgttctcggtggaaaaaggagatcgaaagtaagccgagtctgggatttcaggaagcacctatctcacatggtttccttgaatttcttcacattttcacatttttctattctcagactcatgaagagaaatcagtagaaactgccatcggaacgacccctctcagtgtgatgaacggtgacggaatgctagtcacagaaggggataaggtgtctcatccgcttttacaaaaggtaaaattaaagagagaacgtagcagtcgaatgcctctgattgttttcaccggtaacaggatacaaaaaatgaaacaatagccgactcctccgggctgacgttcaatccacatgaggtcttaccggtctcaatg

SEQ ID NO: 361 - DNA, 703 bp, Nannochloropsis_gaditana
acgttttcagcgcccgacagaagttggtcaaggtaggcgagcacggcggcatgggggggagagagcgggtcatggggggggacgggacgcgcctggggcttgctgccctgtcgccctctcgctcgccggctcccttctttgtcccccctcgttcccacctctcgggacaagcaccggtgtttgtcgcgaaagcctccctgggcgagaagggaggggaggagaggagcagcctgaagcccgttcctggcgatcgagagcgtgcctttccctctggcaaacacctgggatcgatggttacccgcaacagcagccatagcgtctctgtgccttcattcccccctgtaacggcggcgggcggagacatgggggaaggtcaaacccccttgtcgtttgactcgtttagcgaccaaccgttcggcacgcggcagtaccggcagttcaactctcccgacgatcttttgtcggcctcctcgctccttcttccctcccaagcggatccagggggatggttcacggggagaagcacgttttttttgggggggggcgacacgagggtggagaaaggagggaacggcggagaggaagagaaaggggacggatggggggcgggggacgtgatgatgatgatggctagggtaaaggagcaggagcgggagatgcgagagaacagcttcgcctgggatgccaaaggaagcgagagcgt

SEQ ID NO: 362 - DNA, 703 bp, Nannochloropsis_gaditana
tcgacggctccgaacacttttccatgccctagggagagtattgtgaaaaattatgttgttttaatcaatacagtactatttgtgatcttgcagctcagcaactgcaccctttgctaggggcaggtcgcgctaggagggtatcctatcgggtcctcccacgtaaagtctgagaattgaattactcgcaacgagtgttcgacacaatgttcatgtcaatttcgacgtatgttttggttatgattaatggcaagccttttcaaacaatattcgtgcacatagttgtcaaggtggacagctgtgggatttttacggcagaaactgcggctcagctaaacctcctaactttgcaacgtgattaaacgcactttgagctgccgtcgccatctcaatacacatgcttcctcaaagcccaagatgttataagcgtccagtaggaaaaatactacgcccgctcttcctactcgcgtccattgctggctgtaccctggcatggaggcccctcctgtccattgtctcgtccccctctctcgtcccccgccatctcctacaatgccttcagcccgcccacgggcccgcctatgcactcccacgaccatcgaggctcgtgtcacaagccttcttctcatcccagtcgtccgcagacgatcctattgtggacgcgagcgatggggtagggagagcggtcagggaggaggagcgcatg

SEQ ID NO: 363 - DNA, 703 bp, Nannochloropsis_gaditana
atccatgctctcgtcaactccaagtgcaacccgcgcaagactcacgggtgaagtgggtgttcttgcatccggatgggcctgggcttgcactgcaggcgacatatggtgtcttaaatgacttcaacacccgccgggagagggagctaacaggcaaccagatgccctcctaagtcaggcccgaaagtgtcgtgcgtgccctccccagaattcgacacgctgtaccgtgtgtacacagctactggtgttccatccggtggagtcatggggaacacctctccgggaccgggctgaattttgggggaataatatttgagcttgggaccatctgctctcttcgcgagcttctccagcgttttccttgcatttcaagcagcacttcaacagtcaattacaccaaacacagaaccctggcatacacgaagttacaggcagatttttgagatgttatgctttttgaggtgtgctgtgtgctcaccccccccacctcttgccttttctaccttttcccgacacagcatttcgcgttttcgatctgcggattgttctgctttcccccctgcagacgatgtcattacgctgctacatttcaagccggtcaagaagactacaatcaattatcgtctctctcctaccatgcctgttagtaacgagaagcgtgcaagcattagtgacagcgccatctcttcgaagaggtccaggcatg

SEQ ID NO: 364 - DNA, 703 bp, Nannochloropsis_gaditana
ttctccgagcaagtcgaccagttcgtacacctcattaggatcctgctgagagaaaattatgttgtgctcgtccatgtcgacgcttgctagtgaatcttgaagttagcagcaccctacataagaaagagagggtgagagaaggtacctgcgaatggcaacgcgtgaagagtgcgacttacaatagtaatggccttgacttctcagccgaaatgggcccccggcccaacgcttcttctgcccttgcctttccaggttagagccttgaaaccagcctgaaaaagatgcattgtcattttggaacgatgagagattggtcagagggtgccagcggcgtgactccgtgtaacttttacattactttaatttgtttgcgaggatctagcggcccacacccacttcaaggaagggaggacgagagggaaggcccgagacatgcggttgcatgacatgcaggaaatcccgcagtatgacaacagcatgaacctcggaggcacagggataaagaggctcacatggaggattggatgttgtttccagagcctcattcatctatttttcgcggccgtgtcggtcacgacatcccgacacatgctttactcgcccgaaaaccaggggaggcttcgttcggtttgtcttctcccctgcccccgatggcattttggccattatcaaaaaattgtacggactgtgacgcctcaacatg

SEQ ID NO: 365 - DNA, 703 bp, Nannochloropsis_gaditana
ccgaagcaatgcttgtgtgtcataagcgccgtcgtcacctaaagaagttatttgaccgtttcttcatcccacagggcaacagtgccatgaaaagaagcagggaaagtataatgtgcgccagtcaagaggatccactagtcatgcgctcgacctggagcataacattgtttcgatctgtcaactgctgtgtcgtgctttttgctggtttcattcttgctgcgttgagtaacatcgacaacattcgagggtcccgctcgtggtacacaactactctttccgacataagagcgcctatggttccagtggcttcaatcctcttgactgatcgggagtcattcaagtcggaggagctccacttttcgtggaaagtcgacaatcaacttgaaattgcagccactacagaagcgaatggggcgagaaacgtaacgggccctggagcaggtgtagccgcttgcacactggtcgttgacgggtatgacatgcaatcatttgaagatcggacagcagcgctttcctgcttgcgtaacaagagcattgttatggtgggggacagtctgaccaggtgaggttccatcgtgctcgaaattgtaattgccatccctttcccgccggttggggtactgggtacgatgtacttaattccttttgacaaaacattttgtcagatatcaatacctaaaccttgtcaacttcttggaaaatg

SEQ ID NO: 366 - DNA, 703 bp, Nannochloropsis_gaditana
ccgtccctcccttccctcttcccttcctccctctcttcaccttccttcccctcctccccgcttccagctctccgtcctcgtcaattacgtggagatggctcgtgtcacgggcgtgcccatggccttcctcctcacgcgcgggcagcagatcaaggtcttctccatgttgctcagaaagtgccgccagtccgccctgctcattcccaacctgccgaagaaccggtaggcggggggggtcgagggaggaagacgggaagggcgggaggcaggaagggagaaaggagtaagctcacgcgggggcccgggaagaggcgtcggatgcgggaggagagaggacacgatccagtgcctcacgtcctgcccccccccccttccctccttccccccccacaggcaagacgagggcacctacgagggcgccaccgtcatcgagcccaagaaagccttctaccaggaccccattgccaccctggacttcgcctctctgtacccctccatcatgcaggcctttaacctctgctactccaccctcctctcccgggaggagaaacaggcgcttcccccttcctcctacatcaccacgccttcccaagaatccttcgtcaagcccagcgtccgcaaaggcatcctgcccctcattctcgacgagctcctggcggcccggaagcgcgccaagagggacatggcggcggccacggacccg

SEQ ID NO: 367 - DNA, 703 bp, Nannochloropsis_gaditana
tgcgaatgcacgagtatcggcgaacagcaaattttccaagaaagtggtaattctaattgtatgtgtatcgtgataacactaatttcaaagaatattttccatttcaagcgctgtgtttatacgttatttatatgctttatcgtcctgtacaccgacactggagtactcctccaggtgcttagcgttaatacgtaggacttccaaaagcctttctaaaaaattaagaaacctaatacccagtgcagttaaatagatcagctcacagatattcaaagggccagcaaggggctattggacagagtatatatatttgttcgcattcatgccagcatggcggccaacctcccctcgtcgcagaatgacacctcggcgagcgcattcataacctttatttgtaagtcaaaatgggagaagttcagtcatacttgatgatactagctctattttggaccgtcatcactgaggcgtatttcgatttaggagatcgtcagtcttgttttacattacgcttcccttttttttctgtgaaaggaatcttgtgagccgataatctttcgtgtcaggcgctcataaatgcacacttaacaacagcatgctcctgaacagaaacaagaagttaaatgctgtatgatatttatttgagactgcgccgtacgccttcgtaaaatcgttatttcacatcgtccccctggtacagtaaatg

SEQ ID NO: 368 - DNA, 703 bp, Nannochloropsis_gaditana
gcctaatgaaaagctaggaatggatgggttataaaaaaatctgcaatacatatgggtaccaaatatcatgtaggcactgcagattgacatgatcctaagtgatcggcacgaaatttctgtgaatagtatctaatagtgtaacgttccgaaccttcttccgctgctacactcgcccgtcttgttattaagaaataaaattcacgatcaaatcactctccttatttcgaaatatcgtgttgctttgaacttactatgccgccttatctatgccctgcactctcctggcgaaatccactcaatgccacttctcgcctttcctaccaagcctttggcgactgacccatcctgccagccagatgccgtagggaatctcccattttcggaactagtgcccgtgtgacttcggtcgaatcacgcccatcacatgccttcatcgatgctacagtacctttggcatgctttctagtatggcccactgtaggctgggcatgtgttttcttcgctcagtactgagtccgggggtggcgggcgccgcgagaagcggaagacagatcgggagatccgtggcgactcgagaggaggaattacctttggagggctggcacctaccttacagtgttcacgtcaccattcacttacatacctcagcaggttcagctcgcatgacccacatatctaaccaataagtggcagtcgtggtatg

SEQ ID NO: 369 - DNA, 703 bp, Nannochloropsis_gaditana
gtagagaacaaagctagatcttctgtgtcttcctttcttaagatgaagttccttgtttatttcagtttgctggaaaaaggtgcggtagggataacgcgtggtgaaattttcgatgcctagaccgacgtttatggccacgtaagatactgcttctgccacaatgcaaatatgtaacgtatatgattggtaaaccaccgaggcgtggaacatcattttcgtcttgtagactcctatgcaagcatagtgtgctagtgacaggttggtagatcgttgcctgctagccctcgagcgcgtccgccgggcgactttacccgtcaactcagccgtttgtaagccaagacaacatcaatataccacatgttcttttgtgcgaagaaatacattactatccgaagttcagaaatgtatccatttcttcaacggatcccggaagacttatttaacctccccccccacactctcgcacagagcttagttggcccgcttgtcgaattgctcacacagaaaagcatgcagcctcgaaacgcacctcaaggcactaccttcaagacattttgtcttttatggtttttggctgggtccggggcatttcacgttcaaccaaatgcacgattttcagttgtccgagatgacagcggcattcttggcagcagcaggaggggcactctgacgaccaggaaggctactgaaaaatcagatcatg

SEQ ID NO: 370 - DNA, 703 bp, Nannochloropsis_gaditana
acgtctccgccgaaggactaacaaaacaacttctttcctagggaaaagaataacatcagatggtatgttgcgcacttccgtctgtcgatactctcatcaccttcagcagcaaagtcaactgtattgagtgggggacagaaaaagtaaatcatacgtcaaaagcgtggcactctgctccggcccctccctcgccgtctgcgacaagaaacgtaacgacaagatctgtcccagcactcattgcgtcaaagcccacgtttttgtcgtggagaccgcgtacggggcgtgcacacgcggtgcatgccttgtctcggaggagattcggagggtttggtgtcttcaagcattatactttggtggtaattgctgggaccgcgaggaccgtgcagccagatgcctcggttggttgaagccagtaacgggagccatcaatagacctgtcatgccggcgcacctgggaaatcatgcagaggccctgcgctcgtcggttgtggatgtcgaactgatcaaagctgtggtatcaggatgggcgttgccatgcggacaaatgttttttcagcgttctttccacgtacaaacaaaacaggtagcagtaacagcctagccccataccgagcttgtatagaagtgtcctcgcctagaaagtcttcaagcacgtcaagtaaccgacgatatacgacatagacgagtcacaagaagcacgatg

SEQ ID NO: 371 - DNA, 703 bp, Nannochloropsis_gaditana
agtcacggccactgcgatctcatgcacgcattatatatgataaaatggcaacatgtgccgtaaagagagctttgaaggacgcagtcccaagaaagatatgtttgcaaatgtcggtgtggaaaatattaaccttggagggagaattcctgtgcaggattcgttccttgtggggcccaagaatgtcaaagcacacgagggcggcgatgtcacacttgaagagaatcatggaaggtccctgctgatattatgtatatattttattctgtttgaagcttgtctatgcagaaatcatttctacatagttgcaggccctttacttcgtagaactgtataaaatatcaagggagcattatcttcacttaccaaggagttggaaatgggccactcttcctctgattcatctctggcacatgctctagaaatcataagttttcccacacgatagccaggaacctttgctgttctcagtaaaaatacattcgtaacttctatctgttaggattagaggtggcactattttccaggttggaaaaacacaaaagagaccttggtgccacgataatcccttgtccaaacccgctgacgacggcgatcatctcccgactaggaagctgctctgttcaagcaccacctcacttcgacttttggactcacgcgtactttcctgtctcacgcaatttataggagcggaagggcagtcatg

SEQ ID NO: 372 - DNA, 703 bp, Nannochloropsis_gaditana
cctttacctttccagtctgttttcgtgagtagaccgggtggtgatgcggaaaagggggccctggccgaagagattgatgataaggggggcttggagggcagcaggacggcgggcggaacccaggcttgactagagctaccatcaggatggtgccgccgcagcaaaagaggtccgtccaaatcaccagagagattcacgtgttcaacgatacttcttgctttcgagcccgccgaagaagaagtttcagtgccatgatcaggaacggatactcccacgaaggcagcgaggaggaaggaggacggtaaaagatcagtcataccgaaagcatccgcgagagcatttggaagaagtctgtcgaaggaataaaagcactagatgccagaaaaggttgggacgaagcgcagaaaagtcaaaagcagcaggggaagatgagagggtacagtttatgcgccgacgggagggcgagaagctgattctaacgaggcttgccgaacgagacccgtctttcatttttttctctttcacgtcgtaattccaccgactcctcacgctcacgtgtagcccaccatcgaattacagacgtgccccgcttggtagatagccgcgggcgcgtggaaagtgttgcggtcactgttttccggtatcgctgaagtctcactttgcttcacgtcgaggacgaactcgcttctacttagcaaccatg

SEQ ID NO: 373 - DNA, 703 bp, Nannochloropsis_gaditana
gttgaatttttcacaatcctttacccatacatccacccacagcagtggctttccgggcggctgttttgacattgaccagcacgagggattgggaaatcttcggctcctttattattgggctccaataattcaaaattatattcggatttcgagcttctccctttttttgcgcgaagttcgacccagcctattcatggagctgcccacttatacgactacccctccttccggaggcatacactatacatttcaagccgagtattttttatcactcaattttttgagtcacgttttggtggtttcgagtctcagcccgacgtttatccgtgatattcctgtcattcttaccctcatcatcaagcatgcactgtacttagactgctatattttgattgaatccctttcagcacggaatatccgcgtgcagaacgtaataaactggtgacggcattgatcttgcaccttgtctcatttcatgcgctttctcgcgcccagatacagtaagacaggaatcatgctcagcaccgcaaagttctcactgctcccgcagcggcgcatgtcttctatagttttggatctcaatattcgatctaaaagaatgcaggtaacattaaggaatgcgaattatctgcttcactcaaaaaaatcgggcctacaagaatcttgcacagcccgcctttcctgccatctacagtatgcatca

SEQ ID NO: 374 - DNA, 703 bp, Nannochloropsis_gaditana
tacaagacagattccaatttgtgaagttttggcgcgaaacatgcacaggcgttatcgcctacttgcgaccgcgtcgttccatcctattcaaattcgggagctacctaggtatgggccttcggaaccggcaacgaactaccactggtcaaatctaagttgggatactctttcggcatggtgcagtgaatttattttgtactccggaagcagagaagaaaggaaaaaaatggaaagtctactaatgcctcttctcgcttatggtctgtgtcgagtaggcatcactggtggctcacccatctcgtaggtcttcttctaagtccgatcttcccttgagtggctgttgcgttttcataaaattgtgcctgtgactggcattttgatggaaatactcctacagcttcacgctcagggggccatccggtttgatttcgacttcagtaaagagaaagagcagggcactgacttattcgatcatttctctattcagtgcttggacagattaaaacacaccatgaatgcaccctgcatttgcagccgacgaggttggctgctctgtttatgttgctgggtggtcgctgccacctccacgtgccctctggggtcggtaaccattggcggggtgaaactcggcgtacctagcacccctttggactggtgcctgggttacaacaccacagtgcggcccaatacggattttacaatg

SEQ ID NO: 375 - DNA, 703 bp, Nannochloropsis_gaditana
gagaaatacgaacgcttaaagcgggacaaagaggaagagcaagaccgacgggcgagcctcgaggagacaatggtaatcaagagggacgaagagaggagacgtgttggcctgtggtagagtcattgatccccgtgtgactcgtttccttgtggtgcattggcttcccccatgtctgccataatccgatttacatccctgctcgggcgcaccagtgctcgccattgcctccttcatttcacctccccttaaaaaggaaaccttttctacacatgtcctcgtttaggcccggctcaatctggacgacgcgcagaaggaacactaccggcaggagctggagcgaatggaggcagagtacaggactgagcaacagaggcggctaaccaccaacgattttgatcccttggtcatcatcggacgcggagcctttggagaagtacgtgccttgtgggacgagggacaggccaaggagggggaagaggaagcgaaggggtggaatagagtagaagcagtggctgtaatgcttgaggggggggggggagtcaagggagaaaagttgaaaggtccctgtcttctccggatttttcttagtagtgaacgtatggaacacctttccatcaaccctcacctcccccgcacttcccggtaccctctctggcaggtccgtcttgtccgaaaaagggcggacggagaaatctacgccatg

SEQ ID NO: 376 - DNA, 703 bp, Nannochloropsis_gaditana
ttcagcaacacctctgcgtggtggggcttgaacaccattgacagtaaccataccttccaatatttgcctaaatatcgagcaccacttcgtaatggagataggtggacgtttggcttcattcaagataccaaccgtgatacatttgcaaaggtggaaccattgtatgggcagacgggagatggcaggtttttcaatctgacatccattatcccctcgccccccaatcccgaagggacgaacgccactttggtgaaagagcaaatgaaggaatcttattggaaagacactcgctatgtggtctggagcggccgtgtcacgaacacgggcgagtatcctttgagtggcgtaggagtgtatatcgagaatattacctcgtcgacgggcacttggcacttggtatatgacccggccaccaacaacacctatctccctttgcggggcgggtttctgcatcccaaggaatcacaacatttcggttttatcatgccttctccttctgggtatcctaaagtgaacctcagctacgttagcacgcccaacgccctttatgataaaaccgcaccgaacgtgttcaacgacacgaaggcgcgggaagcgttgccccgagtaggggacaacgtgacgctagaggagtcgtccgacggcgcccggcagaaccgtctacgtgtccgtcctcgcggtccgcctggggagggccaacatg

SEQ ID NO: 377 - DNA, 703 bp, Nannochloropsis_gaditana
gggagggagggaggaagacattgatgctgaattttggtctgtgtgactctcatatcgcgtttgcatgaccttttcgccgcctcccctctttctcctattgtcgtctccctcatctactctccgcttcttggcccatcaggacttagccttaaggtagagaatcctacactaggagcagcgaaacacgaagaggaggatggagacgaggaagaagaggaggaagaagaggaaggcgcaagggggggaaagaagaagcgaagaggcacgcttggcagtcagacgaaagagaaagggaatgcgcggctcctagaattggacgtgataggtgaggagggaagggggaggaaggaataaaaggaaagacgcagggaggaagggagggagcaggcgatgacgagagggaaggaggtggagagatgtgtgaagattgatggtagcaatgccttgttgactagacaatgacctaagtctttctctcgcgcagctttcgcatcccctcctttcctcaagtccttcttctacccctccctctctctcatcttctctggaccaacccggtccgccccttcccccctgtaggcaagtatgcgatgcagtggaagtgtctgaagatggacgttcgggtcggcttccccaaggcctccatcctgcggaacgcgggtaagcaggcacgagggtgccagcggaaggaaagaaaggggag

SEQ ID NO: 378 - DNA, 703 bp, Nannochloropsis_gaditana
ggttcaaagagacgacccgcgcatgggccgaagtacagggctgtgacggtagtcatccaacaaagaccttaccatggtaatgaggcaaagttgagtacatatgttaatatgaagcctctttcatgtaattgagtaagtcatatccatcggtttgctcgtctatagctcgacaataatgaggccaagaggcgcgaatgacgatcaacgacatcaggcccatggcccatacctactacaagatcccaagcgtgatatgagccgaaccaccaacatgccagttccataatgtcaatatgttatcgaccgcgaccatttctgatcgtgagttgataagatgctggagatatttcgcaggatgataataatgggagctatcacccgtattaattttactcgtcccgcttttgcctatcgtcatcacgtagccttatcgactcttctttcttgtcatctcattctctatgcaggcggcttctatctatagccatatgacacatggtagcgatatctcgtagaaaccgatggcatcctcggcatggggggtttattcgaaaattaccgcatgtaagtagggtggttctggggtggtaagaatattttctttttgctaacccgccttgcacctgtctgatctgggacctcccaatgtaaagaatcttttgactttgggaaagtgcatcgtctgtatttcggctcttttatg

SEQ ID NO: 379 - DNA, 703 bp, Nannochloropsis_gaditana
cttgagcttactgcgggcgtcattgttctatttatacccagatgatcaacagagtgagtctgactcatgagttgattgtgatgatttagataggtcgcgttcagcaccaataatgacaggcttgccagaacgctaataagtagcaggagtgtgggtgctcgtacaccagctttccccccgatattttgtacataccagcgattagagcgctggaccatcttcacctatcgagattattgtgtcaaggaggatttttaagtattgaaaggataggatcacgcttcggactctaggcctcaatgtccgggcagtcaggtagtaacgggaagtttgtccgcgatgttccgacagggcaagcgttatgctcacacttgatctcttctttgacatgagttttccatagagaagtggtcttgtcaagaagtaatttgactttgacatatacattcttaatcattattagcaatcgcacgtctattatgacctgacaagccagggctctttcagctagtcatcatggtcctccgtttgagcatgacctgcgggattacgtcttgatataccgcataaaaacatgcgagagagagaacagggagggctacgatctaaatgcgcacgcaatgtacttaatctaatttctattcccttttcatcgcagcacaactggcttaaccataagtgaggattaatgcttcatcgcgcc

SEQ ID NO: 380 - DNA, 703 bp, Nannochloropsis_gaditana
ttttcgaagccatttatcttccccgaattgattttcttctcaaaatgagcgggaaaacattcgagaattggtggatcaggccgtcatctcaggaagtgactgcggacttctaagatctggtctaggtcacaggtggcacgcgtcatgagcttctatatttccgagttgtccaagcatgcattcatctgtggcgctatatgatagtcataaaggacttcgaaaacaattttaagcactttgtagcctattataacgaaatatctaggttggcattctcttgccatttgtgcatttactgcttttatgcttcactattacttgtgagtaagaaaaatgagcgacgagcaactggcaacgagaaacgagagcgacgagatggggtgatgtgtgggcatagctcagaatgatcttttccatttcctatgaccgcaatgaacggatctcgagaaattagataaaaaaaccataaatcaatcatagtcattttgcgggtgaatgctaattgaaattttcgaaaaaagcacatcacttctctacccgtctcgttgttgcccgtctcgtttttgttgtttgcgaaggtaaactttgaagagattaaagtgatatacaaacaggaaacaccgtaagcttttaatgttcaaaataaggtttctgattgtgtcatatactccgtttttaggatgtttcacttcgcacgacgagc

SEQ ID NO: 381 - DNA, 703 bp, Nannochloropsis_gaditana
cttcggggtgcaacgcatcgtttagacctccacaaaacaaagcgtctccacagtctttggacatactttgtgcatttaaatcaattaaattacgcgtcgggggcccagccatgcaccgtgttgccaccaacttgctatttttctttttcacgtccacgacttgaggcataaagcgatgaatcgaacagctcggaacggcttattgagccgcaaatcccgcatttatgtcctgtgatacacgagtagccaacactgagccctccatcactccatgccatgcacgtatatctaattaagacacctctgggaggtgggtggtcgcagggggagcgggcgcttatttatgttttttgaatggaatcaagcgcgtggaacgttattcgttccttgaggcggatccatttgcttgttgcctatcgcccgtaccgcttttttcttttttaagaacgctttgagctttccattggtttgtactccacaacttgaccatatcatgtgcggcatattatccattgataccaagtatctgcgttgtctgaatatgtgtgtattagatgtgaatagtgtcagtggccttgtaaaggtagccttccatgctccaggatcccgtctaccatcggtacgtgctttcctgatctattctaatccgttcctcacctgcgtctataacctcacacagatttgttctctaactaaaattatg

SEQ ID NO: 382 - DNA, 703 bp, Nannochloropsis_gaditana
ctacgcgctggatcgtgtaagatggccattccccccacccaccaaaataaacgcatgattcccttgcaagaggctactttccaaaccttatattcccctgtccaataccagaatagtagtcatgtgtctcgataccgcattttacgcaccaaaaatacgaggcaatgatactatcccctcttgtggttaattcctcgtcaccaatcttgcctcttgtagagctaaatttcacatcgcgaaaactagccatcttatcctcgatgccctgtgcttgtccgccgctcattcccagacacagccttgtcctccgcgtcggagcccacgacatcacattccaagaggacctcctcctcttccctttcttacgcccctcgtgaggccccagagggcttggcagagggactgaaattcattaccctcggagtaacagtgatgcactcagagcagtctgggcattcaccacagtccaatgcatcgagcgggaattattcaagcaatagaaaaggagacggtagtaatgtcgccagccttacctatcagccacatcccggacaggcaagtagacttgcgggcgcatgaggagacccttgcgactttcaactcacctccatcccatcctgtcacacattgacaggccccgcttgaagagcgacacaaccacgtggttttcaatgcggtgaaaggggaaaactaccaaaatatg

SEQ ID NO: 383 - DNA, 703 bp, Nannochloropsis_gaditana
ggagacccttgcgactttcaactcacctccatcccatcctgtcacacattgacaggccccgcttgaagagcgacacaaccacgtggttttcaatgcggtgaaaggggaaaactaccaaaatatgaagcggcttttccgtcgcttacggagagccggcctgaaagtcaccatgtgagatgttgggggatgggaaaaaagtaaaattgtgctgaggtcttcttggattggaaaatcaacgatatgtgtaggccagaaatgaataacttgtatggaactttcaagctcggtttctcattgtgcgtgttgtaccaagggcagcatttcgaagcggaggaatgcactcgtcatcttcttaccacaatcttattccacagcaacaagcactcagacctccaatccattctcgtccgggaagggcagcatgtcgggatacgaccagacgcctcgcatggggcttcagcactgtcactaccctccttggccgtctttgcgtgtcctcaatcggctttcaccactcacgaggtagctgggggggggacgctgtagacaaatttcccacggactgcattaagtccacggcgtgggggcacggctatgtggccgccatgctgtgggtcacgcgtttcagctgtccttccagcgggcagtaacttctacccccccccttcccccttgtgccttcctaaccccctccctgcaggaa

SEQ ID NO: 384 - DNA, 703 bp, Nannochloropsis_gaditana
cgtttccgtgactggacctcttctcgtcaccaaagttggaagggttgtctgacttgtgtagtacagacagaggagattatactatagaactgattctgttcgagtatagtcttacaccagcacaccaagctgtcaaggtatatacatcggcgagtccaagatcagagtgtgattcctggtttttccattacgattttcgttttggtgtgggtttttcagcttttaatgcgaagcaacatgaagggtggtatctcagtggctgaaatatgtctgcacttgtggccgttaggaccatggatgtgtgaccactcgtgatagtcgaatttctgaagcaggacctctacccagaacaagaacatgagtcctggtagcgatgatgtaaagtactcatgttctgaattgcttttttcagacagttttcataatctcacatcttgttgctgaagcatactttctattttgacctcctccctcagacgacttctccaggccgttctttacgcctcattttcgcttctttatcacatgtccgtggacaggcgtcatgaagagaagacggctacaggatgagaacatacagaataattgcatacacaagactagtaaaagaggcaataagagcttgaacacttttaggtttcttgcacaatctatcctgctgctcgctcttgccctaactcttcgcgtccatgcttttaagctt

SEQ ID NO: 385 - DNA, 703 bp, Nannochloropsis_gaditana
tagaaatgtatcaaaagtgtgggttcctctcaccacgagcatttacacgcgggagacgacgtgccttgaaggatgtcttttttggaaaagacggcttcaaagcattggtttaaaagtcatggcttccccgtcaaacttgatcatctttatttgcctttctcttaattcatgtctcataatttcagtcaaaagacttaagaaaacatccacgaaggtaaacgcctggccaggtgtatgtgcgagaccccggttcggcctttgaagatttgaaaaaccgttactcgggctgatggcagctttgtcagcttccctctgcgtcccttcgccgtctggctcaaatagggtgttgttgctcttcacgttttgcaaggggcagagaggccttccctcgctagacttcactacgcaaattctgcttgaacgattaatgtgggcttcctctcatcgtaacatcgtaagatgcacgaagcaaaacaaaaaggaaagttaggaatgcaagtaaacattctcggtggtccttagtttgtcgaattcccttacaagctttacatttcgcagcaccttcaatcgtttgttccttaaatgagatataatagttcaattcaccgtctgcaacacaatcacgtagtaggaagaggaggaggacactgtttcttgtgttgctcagtgatttcggcgccggcatcacacaaagcgtacaatg

SEQ ID NO: 386 - DNA, 703 bp, Nannochloropsis_gaditana
gggagtactaggaaaatattagaagacagcacatcgtgcgtcaatcgtgagttctcttgaggtagaaatcgatctgggcagtggaggcaccaaaaagagcacatttgagtattttgagcgcatggtgaggcgtcagatgtcagctatgtagatataaaaacgatagacaagttatgagtgagaatgatggatctaatgagctttggaacgcgtggagatgtcacctgcggacgcttttttttccagcttcaacaaagcctttacgctaccgtgaagcgtagcggcatgttttctgacaatggccgcggtactaaatgccagtgacttgcccaatctcgtaatacttcttgtaatacacatcaggatggatttgaatgcaaatgattttccaggtttggtccgttaatgtgtttctgggacaaatttttcccacgtccgccggggagttcaagcctcccacagcgagggcgggtctcgctgacaagctttttcccgcacgcattcaaacctttatccttggtgttcgtgcctcccgcgcaggccacacggtgtggcacaattacggctgtgtctttggaggtttctctcaccagcaggcgggcatgcccggattctcttgttgtctgactgtttttgcgccgcgcttccttcacttctcggaacagtttccacctacctcttacaggactgacaagtgctcatg

SEQ ID NO: 387 - DNA, 703 bp, Nannochloropsis_gaditana
catttgtattgtccgcacacctgcaagcgtcatcaaaggcgctcatacgcgctactagggaaaataactgtggtcgacgcaccttgaaagatcaagctaaaatcagttgaaaagatgtaggatgcttaaaccctgctttttttccccttcttgaggtgccatggaaatcaaattgaagggatataagtggcatttgcattactccatgaaaggtcttcaagtggaccacttcctgtatctgccctttagtacaaggagaagtaaaactcatcaagtctgttgcctcacctcaatgtcatacaggagtcgtgcaccacgccggacgaatagagtgaacattcaacataagtgcacaaatttgatcatttcatggatgccttcccatcgtggaaaatgacaggacatggcatgcaatagcacacgcataaggtcaagaggcagcctgagtatattcattcgtatgatggaaacacacacacccgtaagccgtcaaggttgacaactctccacctttctcgggaagtttacctcggtaagcataaagaaagaggtcattttcctccacatccaactgtcgttaagaattgcctatgtcttgttcgtcgtcggactcaacgtgctgccgtccatcccggtccactgggtctctgtcaaaaccgcacgccgactctcccctcccctccgcccatccgcacggctcctc

SEQ ID NO: 388 - DNA, 703 bp, Nannochloropsis_gaditana
cttttgcgagagatcgttcctcctttgggtatttagtggtcctaagcgctcatggcaataatctttcacgtactcacacaaccctcccttcccccccccaaccacgctattcctctcgcagtgaaccaaattttggaagtgcgcattccttccctccttcatgctatcaagaagcttgacagtctgatcgccgagcctcccctgtattcctggcaagtcaaactggcctgctacaccattgcctcgggatgtgtcgcccctcttttcttctcgggctcgttgattgatggtctattggcgggcttcctcggattctttgcgggatgtttgtgggtgctagcggacgtgtcctacattgtcggaaaagtaggtttggttgcttctgcatggctgtcgtcgttttgtgccacaatttcgacttcccacattccgaacctttgcccgctggccattcattttggacccgttgtatacctcctccccggctggagcatcacgtgtgctgtcattggtaagcttctgctcgctttcattcatgattacgtttaaagacgtaaggtggtgtgtatgatgttggattaattcggggtcgtgcgatcaaaattctctccgtcccgcgtgctgcccccgaaagaatcgtgaaactctactcgaatactctccccctacaatacatacaccagagctctcgacacaaaacatg

SEQ ID NO: 389 - DNA, 703 bp, Nannochloropsis_gaditana
agcattcgccacggctttttcgaagaagcccatacatgaaaacagcagttttaaaatgaaggcacataagtcaaaagatgaatgacgtaaaagacgtattttagctcaaattcggttgtacatccccttttcacactacaggaaggatataaaccacgaaatcagtattcctttgcgttcttactatcaaaccttgatgtcccgtaacaagtatatttgcaatgtcgaggtccttgcttcggcttgcaaaagcatgtattcattgaaaaaaacgaggaagaaaaacgtttaccttgggaaataacaagggcgttcccgccgtgggaacagcgacagctgactcgggaaaagcttggcaacatgtgctcctgtgagctacatttacagcgacagtctgcggaaagtagccatttctgtcccttgtgcacttttcgtttgatcattaaaaaaagagtatctgcaggtttcctcgaagcttttgcatttgataaggtgtcataagggaaaatgtaaagagcttgaacctcctggatgtgtctcccgcgggaaaacaatcataggacatataggcgaaaaaagtacgcctatacgccgtaaaaagccttgaaatctcattaaaagatcgagcggataactatcgaaagcatacaatatttaaacacattctttcatcctacgtcatacatcccatcgtaggatcatg

SEQ ID NO: 390 - DNA, 703 bp, Nannochloropsis_gaditana
tgtcctacaatgatatgtattgtctctgttatttgaattcatggaggtcaaaaagtgatggcctttcgcttttttccccaaatatgcctcaacccaaggctaaaaagcctgccctgaaaggagaaataattgacgtacacattgccaaaatcacaacaaaagcctcccatcacatgcattggaaccatccgcccgtttcaccgcgcacagatgtgcgaaattggtcgcacggaccgacgtgggaaggtagggtatttatttcacccaatttatggcgagggcaaatcgctccgggcggacgtctgaaaaactatatggaagtttggacccatgttgccacggatcctggcatgcgctttctcggatcgtgggacacttgtcgggtatgaatgattccgcgtgaggtggatcgtggccctctttttggatttcttctttgtggggttcatgtctcggtgcctgtgacgtgagcatccctcactctcgatactttttcatatgaaccgagccgggaacgcacgtgctggttccaaatgcctttcaattccaaggatatggtaacttggcgcgctacgtcttcatacatcttcttttgtacgttggggtgtgtaattcccctgatggacatggtccttggcaagagatatgttataaacgtggtccgctctgtatataccccttcacctccccacccaccagaatg

SEQ ID NO: 391 - DNA, 703 bp, Nannochloropsis_gaditana
ggcttgggatcgcctgtgccggtttacaaattttataaaccgcagtggacatagactttgtctaaatgacattgatttctgaaacgggcttcttgcgtcttgtccattggtccgtcgatgagctttgtcgagatttgcttgaatgctcttcgtgaatgtgtatgcgcgacctccgcaacatctttccctatgtcaaaaatccaccacacattgttctttaaaaggttggatgtagaaacgacgagcattctcacgatggcgcccgccatatgaagggattgtggaattttcatgcgcggacacctttttgcgatactcaggcgtttggataatgtttttacacgttccctgtcgcagcatgtatggcatgttaaaatccaattgaacagctaacatgctccatttaataattaaatgcattttataatgagttttcgggcctgttccgcgagatggaaccacatcgtgccgtccacatcgtttcccgcctccgaaataaaatcaaaattacgatacccggaagaccccaagatgcctgttgagaagtaaaagagcccctttgaaaccgaggagcccgatgcacacaaactatacgagacttgagacgtcacatcactgacgtaacttaacctatacaggccaatttattcatagcagctctgcgcagtcctgcttcttggttgtattggaggtgtgctgcatg

SEQ ID NO: 392 - DNA, 703 bp, Nannochloropsis_gaditana
gaaactgcctcacctcgcagtattcaaagaccaagaagacaccgtctctttttctccccactgctatctcttccaatcggacgcaatgagggtgacgacctatcaatttaagcgtacgaatttccctcaaggacgtcaaggggaatccatcttgcttctcgttatgtagaatcacacgctttaaggccaccatgcgtccgtttgctttatcgatgccacgatacacagtaccatacgctccttccccgatttgattaagcttttggaaactcttcacaggacggcaagcgccatataaatctgcctccccagcttcactgatttcatgcttggactgaactggggaggctgccatggtaaaaggcggatgacgacaatttatagcatcacgaggggggcgaaggtgggggggatggcgggcaggtggatgaagtatgcaagatgaagctatgctgctgggcaccccggcacgatcatttcaatccgcgtgatcagtgtatgctttccctgtgtctataatgtgcgcgggcgacgacgggatgcaaaacctatgaaacatgcgcaaatagtgcccgcaggcaggattatgcctcggtatatgacgacagctgtcgtttctctgtcccctgccccggtaagtcgccctcgatgttacccggtgccatttaaatcccatcatgacacatttttcgatgacaggatg

SEQ ID NO: 393 - DNA, 703 bp, Nannochloropsis_gaditana
cttcggtgcggagaaagccgtcgcaccgcagcgctttcccattcttcaggaatagacggaggtggccccacttcccgaagaccgaccaggaggcgcgtaaaatgtccttggcctgcactgtcttggcgttgctcgggccccgccattccaaccccttccccgtgaacgtcaatgttcccaccgactgccctgacaagcctatgttctcgaatttctctatggtagccatgaatgcgctggtgtggctctcctagattctaaagtcggcaggcgcgcttcgaaagtcgcgtgttgtgttgccgcgctcgccaggtcttctcagggctgggagtctgtgggaggtgaggggaaggaaatgggacatggacacacccgaaagaaagcggcaagattgacacgtgtcctcacacactggccatccccacactcgtccagtcggacacgtcgacaaagaagtcgggcgggtcccacccgggcaagtgagagcgccaaggaagaaagggcgcacagcttcttcttcttcggcgtctcggcgacggagagggagggcctgaccgaccacggggctatatttgctggctttgccaaaacagggggatcatgcgcactttgtgtgacgttgagatagggttaggacgacgtgaccactggtgtaacctctcactagactcttctctgtttttattccctctatcacctgcag

SEQ ID NO: 394 - DNA, 703 bp, Nannochloropsis_gaditana
gaaccggggccaggggatgtcgtcctcccggtgctttttccggaggataaagacgtggagtttttgatctcgcggaccgcccggtatgttgccaaggacggcgggcccctggaggaacgactgaaggtgacagaaagccaaaaacccacgcttccgcttcttgtgggaaggggactcgccggaggctctcttttaccggtggcgcgtcttcagctttttgatgggcgacacggagacgaggtggcgggtgcggccctttcaaatgaccgtcgacggtccattctgggcacctcccgccatcccgggggcttggcgcgaccggcgggaggtgaaagaagaggccaaggaggagaaaacgagcgactacggggagcgagggcgggaaaaaggccgggatagaggtcggagtcgaagcccagagaggaaaaaggaggcggggaagaggggccgaagccggagtcgagggagggatcgacggcagagtcggtcgagagagagggagaggggtggacgccatgagagcaggagtagaagcagggagaggagcaggagccgagaaaggggtcgacgtcgccgtagtcgaagccacagcgccagccgaagccgaagccgtagcccgggcgggagtcggagagggggaggtcgggggcgggtaggggcccctggggatgaggggcaagaagctgtcatgcccgcggctgct

SEQ ID NO: 395 - DNA, 703 bp, Nannochloropsis_gaditana
tggtcatcaatgaaaaaaaccagcatccttcacatcacatgcgttcgcaaatgccctaaattgacaagcagactggctcgacgatgtgtcactgcccactaagctctgttctcgtaatgcttcgatggtaaagagcaagcgccacccgcagggcacagctttacggccgcagtaatatcctcgtccggacagataataaatattgagtatacacgctgtttatgtctacgtgtgctttgtgccgggcgggcaaaggggctggttcagctgcaagtcaaggtcaaaaagaaggagaatcgcttggaccgtcattatcgctccggcttctctgttgcctttccgggcgataaggtctttcacgagtcctcttccccgccctatcggttcccaggttttcccatgcctcacgaccatgacgttgacgagcgtattgctcgcgtccgccttgctttgagagacgcgtgtcaagaccatgtcctcagttatgtcgacgctggcctcgccactccggaagagacagcgagcctcctcacacaaatcgaagcccttgatcttcctgaattaaatcgcatttttaacggactcggaatcgagccatcggcatccgttgctgcagctgcggggaatgacgaatatgcaccgctgtctgatttggcctcggtagataccacctcccctgccctcttgcgagagtgggaggaga

SEQ ID NO: 396 - DNA, 703 bp, Nannochloropsis_gaditana
cttcgatggtaaagagcaagcgccacccgcagggcacagctttacggccgcagtaatatcctcgtccggacagataataaatattgagtatacacgctgtttatgtctacgtgtgctttgtgccgggcgggcaaaggggctggttcagctgcaagtcaaggtcaaaaagaaggagaatcgcttggaccgtcattatcgctccggcttctctgttgcctttccgggcgataaggtctttcacgagtcctcttccccgccctatcggttcccaggttttcccatgcctcacgaccatgacgttgacgagcgtattgctcgcgtccgccttgctttgagagacgcgtgtcaagaccatgtcctcagttatgtcgacgctggcctcgccactccggaagagacagcgagcctcctcacacaaatcgaagcccttgatcttcctgaattaaatcgcatttttaacggactcggaatcgagccatcggcatccgttgctgcagctgcggggaatgacgaatatgcaccgctgtctgatttggcctcggtagataccacctcccctgccctcttgcgagagtgggaggagatgggcctagacgccattggccgcggaaaggttgcggccttggttttgagcggtgggcagggcacgcggctcggatttgacggacccaaaggaatgtatgacattggcttgccttctgga

SEQ ID NO: 397 - DNA, 703 bp, Nannochloropsis_gaditana
cgagtcctcttccccgccctatcggttcccaggttttcccatgcctcacgaccatgacgttgacgagcgtattgctcgcgtccgccttgctttgagagacgcgtgtcaagaccatgtcctcagttatgtcgacgctggcctcgccactccggaagagacagcgagcctcctcacacaaatcgaagcccttgatcttcctgaattaaatcgcatttttaacggactcggaatcgagccatcggcatccgttgctgcagctgcggggaatgacgaatatgcaccgctgtctgatttggcctcggtagataccacctcccctgccctcttgcgagagtgggaggagatgggcctagacgccattggccgcggaaaggttgcggccttggttttgagcggtgggcagggcacgcggctcggatttgacggacccaaaggaatgtatgacattggcttgccttctggaaagtccatctttcaattgctagcggaaagaatcttgcgagtgtcagcattggcagcggagaggttcctgcgtagtcccgaaggcaaggactgcccgaatgagggatcaacacggaagcacatccctttctacgttatgacgagccctttgaatcatgagaagactcaggacttcttcaaggaaaacaactactttggcttgtgccccgcagacgtctttttttttcggcagagcaccatg

SEQ ID NO: 398 - DNA, 703 bp, Nannochloropsis_gaditana
ggtcctgtgctggagtgtgcagaggggttgatcagacgacttaagagatcaactttttgcaatggaaacaaaagccccctgaaaatgcactccatgtggatgagacaccaccagcacattctccagacgtgagagccgcgtggcaagagacacacatgggggcctagactgttgtctaggcggccgccgggaggctgcttttgctcccccgatgttccggctcttcgggtggaaggcacggtccttggttggaaaggccccttcacagccacctttgtacccgctatccgcgccaacatgcgacggcacatgtcatgcacggtctacgtccatggtctatcgccctatgcaaggtcatgaggtcccgcgagaagagttgatgtctctttcgcactccagctagcgcaggagggcaggatggggagggaagaacgatctgtcaattcgcaggggccaaaaccttcacatatatgtgtaccattcacaccaatagcctcccctcatttcattctttgcagtgcacatccgagccaaggactggccggaaggatcaaggttcagaagcgcagccgtctgacaggcgacgcccccaagtcggcaatagtaacgtttccacactcagacacaaaggtccttacacaggcgaggaaaagtgtgtcttcccaattttcttaccttgacctataccaaagacgagcttatg

SEQ ID NO: 399 - DNA, 703 bp, Nannochloropsis_gaditana
agttttgattgcgatatttttctctaaaaactttgcctactagcccctaaattgtatgctcgcccgcgttgctgggtatgattgagcgcagtgagtgtatggactcctccggtgagtgtatggactcctccaacgagaagccctaggttcaatctgagcgaagtagacacctttcgatggtgcctctctctgttaagcaatatttagtgttatggcttcaaggggcttcaggaacttggtcactcgacagtcgggaaggactcttctcagcttttctcagcaaaaaatgcctggctattccgatgcttggcgagttgagaaatcagacagcggggaacacataataacacacaagtgcggccctgccgcgcaaaatggttgtacggcccgcgcgccctgcagcccaacgtgagggagctttagcgagctcacggcgagactcgcgacctgtatcatgacccaggcacgaggagacgcacgtatgtatgtattggaaggttgatgaggccatttcaagcccactttcgacctggatggctgtcacttgcctctacgtctggaaagagctattaggagcatcaataatataatacaccgggacaacaggatacgggaaaggggctgactcgacctcccttctgacttacaacacattccctgacgccttgtaccactctttgtccacacaataatccagagcatg

SEQ ID NO: 400 - DNA, 703 bp, Nannochloropsis_gaditana
acctccctcccggtcccccaacggggctgaggaaggagagagcgaggacggaaatgcggagggcccgataaaaaagtagacacttgaccgaggtattcaggcatcgttttatgtgcagtatattttcaatcttgatgttttgtttttttccttacttcctgccctcggagctccttatgcacctttcccccacagtgtgagccattaatctcataacaacacggtattgggtactttcagtagcgcagtgtattaatgagcgccctatcaaaatgaaacaagggtctatggcacgagaaaggggcgcggcggtctcgatacttaggagtcgtgcgccgtgctcgacctcgctcgtctttccttctgcctcgcttacgccctcgatttgagacccttaagcctttcatgcccgcactttcgaggctaattctgattttcccttctgttatcaatattttttgtgcacctattcagctatgggtgcgtttaacatccccgtgatgtttttggaggctttacaatgggattcctccacgcctcccttgctgctgtgcgtgcattatgccagcccttctcgtgcactgacgctctccgaatcaatttaacaggaggagtagaaggcctgttaaattggtgggccgcagagggtgactttgctttgcgaagtccgtgctcgcgaccttggccttgaacgtgcactatg

SEQ ID NO: 401 - DNA, 703 bp, Nannochloropsis_gaditana
caggcttcgcagatgttgtaccagcagaagtcatagccgccttccgtttctgtgtcgttctgaccatatttgagaccacaaacgacaccagcaaatccccttaaaaacttggatacctgtatatatgtgtacaccgacacctctgtgagaggtacgcaggcatggcaagtaacctgttgaatatctgccttcctgcttgccaacctccccgccacccgcccctcgcctggaggctctctcgcagcggccgggggcctttctttttcttcttgctagcgcagggcccacggcgggctctggaatgaaaacggacgggtcgatctcgcacgaggggagtggatgacgaggaggctgaggtgatagtgcgcgttgatgttgatggtttttggtggattggagtggacgcatttttttcctgcatcctggacttcagtatccaaggagtccgcccggcactacttttaaacctcgggggtggtccccctcgcagcctcttcttcttcgcccgatctgctatcttaccattaagagtactcattgtatgcgtatacttatgagccgtgtttttcgggggaaaagcaaggcagactccctcaagtcccacttcggcctcatgacgtcccttccttttccttgctcgcctctctccacaatcctcagctaactctaatcaactaaagccaaagcgccttttggaaatatg

SEQ ID NO: 402 - DNA, 703 bp, Nannochloropsis_gaditana
gttctctcgtgagcagcttttggccctccgccgcccctcacggctcccgacggacatggcggagattcccaccatcattagcgtggagcctttggagccgatggggggaggggggccgttggacagggaggagaccagcaggcattggtcgcgcatgcgggcggcagggcggggcaagggacgcggaggggggggggaagtgtgggtccgacctggatggggagggggaggggagcgtggacgggggagaagaaggaagaaaacgagcgcggaggagggcttggggcagggcgggggggaggcgggggctgggaaagggcggagcgtcggtcggcgtttggacggacgccgtggtgccggggagtcggagggcgggtcggtgtggccgcgggagaggaccctgccagtgaaggaagaggccatcctctgggacgacgtgggggatggggaaggggggggcggggcgggggcggggggcgcaggaggaagtggggaccaggatttcttcgagaccatggccgaaagcacgcgcaagttccacgcggagcgagaagccttcctggctcagcaacggaagatggagggaaaagaggcgggcgtggaggagagaggaatggagcaagagtcgcatgataatgctgagacgtttggggagggggcgagtgggaccaggggatggtggtggtgggggggttgggtgggg

SEQ ID NO: 403 - DNA, 703 bp, Nannochloropsis_gaditana
cctccctgcctccctccacagcggccgccctgcttgtggacgcgtgcacccatctccagcacctggcaggcttccttctccaacgtgcggtagaggtgcccgatgaccccttcctctccccctacttgacagaaaccatcctcagctttgtggccagatttgcccggacctacctcctgcccgacccctctctctaccgcaacggcatcctcgctcccaccttagtccaggcttttgggggggaggcaggggaaggccaagtggagcaaagtctcaggatagcctgggggttcctgacgcgctggccgtcgcaaagggaggtggccaaggctgccatagccgtggtgcgggcggtggtgctcacggggggggaaccgttggggcgcgccgccgtccgctctgaggcctggaaggtgatattacgggacatggaggcggagaaacactttttgaggcagcacggggagcaattggtgggcaatggacaggagggtcatggccatgccccttcgccatcgccgcaaattccgccggaacttggctatctccggctggcttcggatttacggggcgagctcttggaagtcgtggtgggaggaattttggcgcgggaaaacgacgcggaggccagccagggcatcgcacaggtggcaggacctgtggagacgcggttgcacttcctttacatggggttgaaaggctc

SEQ ID NO: 404 - DNA, 703 bp, Nannochloropsis_gaditana
cctccccctccccttccctccatctctctccctgcctccctctctgcctcccccttcccccgcccctttcccaccctcttccttccccgccaccactcctcgggcccggcacaaggaatggcgcatggccaagtatttcttctggtcgcgcaaggacacggagggagacactttcgcgaacgctgcctcaaaatgtcggtgcccgatcaccaacggctttccctcttcccaccctcctttcttacccccctccctgacctccctcaagacgttcacccctgcttcgcgaactaaggcggccatgtctgccccgctgtagccctctgccctgtgatccctcccaagggcttctagatccacctccgcagcatccaccgccatgtcccgagagaccgctttcagaatcgccgcccggtcctccggtcccggcaggggcacgtacaggagcttgtctagcctccctggacggagcatggcggggtcgatcagctccggtctgttcgtggccgcgatcacaaagacgtgccgacgcccttccaatccgtccatctccgtcaagagctggttcaccacccgctcgctcaccccactgcccccgcctccttccccccctccgcccatccctcgtttcggacataaggcgtccaattcgtcgaaaaacacaatgcaaggtgcggaggcccgcgcccgagtgaagacctgc

SEQ ID NO: 405 - DNA, 703 bp, Nannochloropsis_gaditana
tgcggaggcccgcgcccgagtgaagacctgccgcaccgcccgctccgactcgccgacgtatttgtccaagagctccggacctttgaccgagataaaattggccccgctctcatgggcgatggccttcgccagcagcgtcttcccgcacccgggaggcccaaagaggaggacgccggcagggacagtcaatcccagggagaggaagatttccggatgggcgatgggctccaagacggacatggacagctcctcgcgcacaggcgccagcgcccccacgtcctgccaactcacgtcggggacggcggcgaagccttcgcgtttggccgacggttggacctttttcagggccgagaagaagtccggcatggtgatggcgagggaggcaaggagggcgggcgggagggagggagggagggacggcggagccgtgggagcgggggaggcgggcagcgggagcgccacggggaccactttcgcagaggatagatcgctcgattccaggggatcagtgtccatggcaggtaaagcatacgcgtccgtcaatgtagtaaggcccgaggcattaggagggtaaggccgagtcaggggctccgaaggtatcgtgtcatatccttccttgtcgctgccctcccggacctccccctcctttcccttggtcttgcctcctcccgtgtccgccacgatgctgcggaaaatccggttg

SEQ ID NO: 406 - DNA, 703 bp, Nannochloropsis_gaditana
tccggcatggtgatggcgagggaggcaaggagggcgggcgggagggagggagggagggacggcggagccgtgggagcgggggaggcgggcagcgggagcgccacggggaccactttcgcagaggatagatcgctcgattccaggggatcagtgtccatggcaggtaaagcatacgcgtccgtcaatgtagtaaggcccgaggcattaggagggtaaggccgagtcaggggctccgaaggtatcgtgtcatatccttccttgtcgctgccctcccggacctccccctcctttcccttggtcttgcctcctcccgtgtccgccacgatgctgcggaaaatccggttgatggcaagcaccgccgcttccttcgtcaagctggctagatcggccccgacatatcccggtgtcctccgcgcaatttctcccaaatcaaagtccccgctcagccgcattttcttagtcatcacctccaaaatcctccgtcgggcctctaaatctggcactccgagggaaatctcccggtcgaaccggcccgcccgccgcaaagccgcgtcgagggcatccgggcggttcgtggcgccaatgaccaagacgggtttgccccccgtctcctccagggaaagggcatccatgcacgtcaaaagctgggccacaatccgacgttccatgccccgggacgccgtctccctcttgggggtgatcg

SEQ ID NO: 407 - DNA, 703 bp, Nannochloropsis_gaditana
tatcgggacaaaggttggaagtcggaagattgagttaaggtgaggtgacgtgtgaaaaaaggtttaaatgctggtcatgattctggaaggacagggaggtttaatatgatagggaagatcaaccatgaaggacttacttatccgacccccgttccaaaagcaggtttttgatgtaataaatgagcttcggatcccgagccattgctatttttataatgaaaatttgttcgtcatttagtattttttgaatgagagcttagaaaacagttggttagggtccagagcattgcgaggccacggtatcctcgaccccataagccacaagagatagggccttccgggcccgttatggtgacttatgatctttgtcacatttattcatatatatttcgtaaaaaaacataatgtacatgcgtgggaggcgcggaagcttgagacgggcaggattaaaaagtccgtgtgggccgttcattggcaatgaaacggaaggcgagacccgcggtactgctcccacgaatggaatgcgaatgaatgactctgacattgacgccaacaccctgtctcatacagaccttccttctgttttgacgacaaaataagctgcatgttgtgtcacataatataaagtcaagataaaggtgtgtgtaatgtcaacagcacaatcaacctccccaccccaccccatacacaggagcgacgatac

SEQ ID NO: 408 - DNA, 703 bp, Nannochloropsis_gaditana
cctaccagaaggcgactacgccccccgatgtgcgcgggtttcccattcgttattttttggaaccctctctccctccctccatcacttccttccaccccttcctaccttctctgcttccgaagtgttccctccctgcaacgcgcccctcctcccttcctctgcctccaggtccgaggcctagaggtttcgatccagcacatctatatcacggccggcactctactggccgggggcctgaacgtggactcgtagcactgggacgagggctgccacatctcctacggtggcaagggcttcttctccctccttctcatgctcctgatggtaggaagaggtattcacggcctgctctgtcaaagtgcgtaaggtagagcggacattcctggtttggtggcttctttcttctcccccttttgtctcctttgttgcaatttacggctctggccatcttcatcgtgtctatcaagatacacatcgttctctgctatgccttcttatcacccgccctatcattcctcatacaggagtcactattcatttctccttgttcttgtcctccctcgatggctttctctttcaagctcacattcactgacacgtaccaacgattccccttcttctctcttctttctgtacgtgccatactcaaccttagctgtgtctccctgagtcgcacccctggctggcggcgcaagttaaaatg

SEQ ID NO: 409 - DNA, 703 bp, Nannochloropsis_gaditana
ttggtttcggaacagtggaagtgttgccatcatttctgttcctgatttctgccaagatgcatgcgttgctttcgctggacaatcactcacgtttggttcacgttgtgcgttgcgtcgattgatacctccgtttcatgacatcttgggggcaaatttctcgtttgcttctcgcccagacaagggaagggtcgagttgaacctctttccctggctggtcacttgttgtcttgttcagaatattctacttcgtgaccggtcacatggatcaaatcacactcatgctggaaaaccatgctgttagccatatataacgcgaccttgtacccatttttggcgtatatggttatatttggtgtgtgtgtccttgtcgaccgacgcgaatcgtacgcttggctcctgcacctccttcgaagcaagggtgcacatccttttctgagcccactattgaatggacttttctgttttttctgtttcttatctttatcttcttggttttgcgtaaggaatgctttgtgctgatggtggcgtcttttgatcgcgatgcgcaaattttggtctcattactgttactatccgaccgtacagattatcaccgagcgctttctggatgaagtgcgtattttcgacttccaccttccttttaagctgcacactccttgtcgtatctcctcgcttcaatgatgcttccctccgtggtgagatg

SEQ ID NO: 410 - DNA, 703 bp, Nannochloropsis_gaditana
acccagttcagttgtatgtgatcagatcttagcacttgcgaaaaagtcaaaaaaaactctagtggttccgaagaggcccttcgtgcatgcatctgccacactcacatttccgcaaaaagcgctttcgatgcaaaacagccaccccattcgtaaagagtaagcctgatttataaaggctccaaattgtaaaggccatcagccgtggaggcgcgtctgtccagaagtcggggcgtagagtagtatataaggaggtcgagaggaagcaaggccaaaacgaatccaaggacagcaatcctttgtctcaaaaaaacttgtggccggagcacgtcaaagacaatgccagttggtttcctgccgtgtgtgggtgtaaggtgtgggcacgtgagacatgcttatgaggaatattatcgctcgatgccagaaagcgacgcaggcgttgctccctccgcgcctggttccttccatcgggagtcggccaatccacactcataaagacgacctagacgtcaaatgattcaccatgactactacacaaagcgcatagggtgcagtgttgttcataatggaggaataaccaggtttctatgcacgtttgtgtcatacatacatgcaaagcgttctcaccacccagtcaaccttgcctccccaccccatgtagtagacaaagacacttacttgttcagcactccaagtcagcctaatg

SEQ ID NO: 411 - DNA, 703 bp, Nannochloropsis_gaditana
tttgtgcgttgtgagatgtgtcgggtctaccttataacttaaattttttgggactatttaaactaaagttgggaggctgaccatagacacgtgctgcgcgtaagggatcaaatgcgcatgctagaggcttttgtaatgccagtgattttatggcgcaacgtgacatatgtgagcaagaatataatactgagcctcaaatcgagcaattgaaaggataaggaggctgtatggtggaattttgggaggaagccaagaatcatctcaaaagggtggagtcggcactcggcggatcaatgtcgcggatgcccgaaataaaatatttcgacatcttggccattcaccacttgatgtcatttcgatacatgtggggctttttgtgtctataaaactctttaacagcatgctcacagaataagtcgtatggtaaagttgatccttttaggcttctggcggaacaactcttgatatagtgatgtatctcctgcttggactttcttccaagtgacatgggtagaagattcaatcttttatctcgccatcgagcaaactcgcatatctaagcgtgtggacgaaataaattctcctaaacacatggagtcttgcccgcatattgacgctgtaatcattgatcgaagtaagggggaaaaaatacattttcgtaaatgacagttagtaaggctacattcgtcttcactttgtccta

SEQ ID NO: 412 - DNA, 703 bp, Nannochloropsis_gaditana
gcaagacacagtatttccactcgatcactttttcgccaataaacctaaccatcgtcataaccccagcctcgctgagcttctcggcgatgcatactacaaatggtaggaacgactcgttcatgcaagtgatgtgaacattaaggtctcccccgttgccgcgaccactcaagcacctgacctcgtacactttgcgtcgcgtgtgaagaaggccaagcataggtcgaggtagacgattcaattcgaaatggtttttcctcgtgtcctagggcgggttggggccctcctcgtcatcactcgtaccgcgggtgtaggcaaattccggctttcaagacccccaacgtgctctatatcctcatgttcatgcaagtgattaaacttttacagggattgcaggggccgcatcctttcagagagcataaggtctggaatagcaggcaagggaccctttgctcgtcaggaccgttgaagacaggataacaccacctcgatcttccatcagcgcccatcaccatgacatcgatggctctgccaacaagaagcacacctagcaatgttgccgggcacagagagggcggaggtagagggaagaacgagctacccaacaccccatcgatcttctatcgtcaattctatgaggcaagcacccggccatcgaaaggtcatgagtgcgagtcgtcaaccgcttggcataaagcttcacatg

SEQ ID NO: 413 - DNA, 703 bp, Nannochloropsis_gaditana
cccctcgtcgtaattcaccgccgtgcacggtgctgtgggtgaccattcgcgaggactccaccttgtgcacctgtggaggtgcagagcatgggtctgccgcgtgtgcgcgagttggtgggtgcgtgatgtgtcctttcatgcgagtcggggaacgggatgagcaaccctggggtaaaaaaagcaaccccgctgcagagatatgaacacttggcagtgccaaactgcttatactctatcatttcagagaaaatacggacctgaccgtggtttggggtgtgtccgcggtggcttgtccagcccggtggctgaagttgtagggggtcgttgcgtaagcaggcttaggctgtgcacacgttgtctgaatgttactgtttccggtcaagtgcatagaaaggaacggtgcaaagtttcgttttgggagcgaatgcaaagccagtgggcaggctgaatggaagctgatgtgttgttgttcaagacgcgcgttgtgatggaggctcctgctcctggacgtcacctctttgtgttttgggcaactgacaaaacaccggcaaattctgcgcatggactgggttttagggccccacttcccatcttatgtacactgtctcagtagttattggagcgccacgtgtttctcaacactttcccacgcctccacccaccccatcccggacaggctggggaaggactcgggaaggcaatg

SEQ ID NO: 414 - DNA, 703 bp, Nannochloropsis_gaditana
tggttgtgacggggatcacctcacccgttccctccgttcctgcctccgtctcgacctctgtggcaccgacgtcgcctgccttgcccgcgggaactccaggacgcacgctgagggagggggggagggcaggggagcccgtcggcagcaccagtagcagcgccacgccgaccgtgattttcccccgacccacgacctcctcgcccatccccatccaccccggagtcacaggagggagcggacgagggcgggagggagggggggggcacggcggaacgggcggggggctgtcccacgggatgattgtggaggaaaatggacgatcgaggcgggagggaggggagagggaatgggagcgagaagccccttcctcggccgcgacctctgtcccgtcctccgtggagagagatgtcgtggactcaccacgcgccattcggggaggaagcatcaacattccttctggtgagggaagcttgctctcccccctgcctccgtccctccctcggtggacggtggtttcgtgcccgcgcccggggaaacaagggagcaggagaaggcctggctggcccagcaccagctccagcaattgtttttttaccagcagcagcaatacatcctgagctaccagtatcactgtgccttgcagcagttgcaccactggtacgcccagcagatggtggagggagggagggtgggaggggcagaa

SEQ ID NO: 415 - DNA, 703 bp, Nannochloropsis_gaditana
cgaccccaagatgtgcgctcgaaaggcaatcgaaggaatcacgttttcggagatctcctggatgacggcaagtcaggaaagccatcgccctccgtcgggaggcaacttcagtttcgggtaaaaagtgaagtctgtggacgtaaaagggtcgcaatttgcctgcgaaagatgaatacttgatggaatatgtacattcggcctttcatgtcgttaatgagtgtccatatggaacctttcatcccccccaggtcggttgcctccacgtcttgtacgtctttcctcccttcaacacagatcccgcacttggtgcgaggggagattgaaatacggtagaggcgtgcttcgtcctaacattccatgatggcagaattttccgccactttgtctctagctaatgagatgtgcatttctaattatccattcctactgcaatatcaacctagatgaggaccagcaactgattgcacgcagcaaaaatagggcccggcgcgacagaacacaatgttgggcagaagagaagggcgtggccataaaaagcgaagtgcatcattggcggcttgccggtgcttcttgatggcattgcacttggtgccggggcaagcttttttcctccctgcctggcggtcgtggggccttctccctccagtacccacgtccatccccatcacacgttcacccgtcgtatttcatcagccctcaaatg

SEQ ID NO: 416 - DNA, 703 bp, Nannochloropsis_gaditana
ccgcaagtgtgatgagcgagaatatggagttgatgcaggtatggcctcgttctccgttttactcctgccctcccgcccccccttcctttctctgttcggatttccctcgtgtcagtatttcttatatatatatatatatttcatgttgtgctgtcagcctcaaagggtctcggtgcaggacgtctgtcatctattttgtccctcctgggtcttgtataggtctgtgtgcgtgagcataatttctttgctgcctatcttctcctacttccttcttcccagtgcgcgggtctcccgcaggcactcagcgctcgttgcctccccctcttgcccccctgttccgttcctgcggctcgcttgacccccttcgtcttgtctccaaaccctctacatcaccccccaccctccctatcatcatcaggcgcgggccgagaagctcagtcggatgacgaaccaaacggaagggatgcaacagcgggcgatggatttcgcagcggccgccaaggcgttggccgaacgggaaaaaagaaggaaatggtgggagctttgacgagaagatgctgcagcgcagtgagcctggtcttagatgattgaatcacagggaaaaggatgagccagcgcaaagaatgtagagttagttttatgaattcccgtgttgtctagtgcaaacagttgcctgattttttaaaaccatgttttggggatg

SEQ ID NO: 417 - DNA, 703 bp, Nannochloropsis_gaditana
acacgctctaaaccctaacgacctcggcatgctatatgcgagacatgcttatgatgcaaatcgcagagtaaaaattgtgttcgacgaaaatttggtgtaagcaataaatgagtgtcaagagcagcacttaattacaaaaaaattgacaaaatgcccagtgttccttttgcatcaggagagaacccaccttttcactcggctgcgttttccaaccgaggtgaatatcaaacattttgttccacttcatactttggtcgaagataaaaaccactttaacgggaaaaggttgtgtatcatcccatattaatgcacactgcacgccattggcacgcagtgtcttggcatggcatattaaaatcgaagcatgcagggttaaggaactagcacatttttacttgctgccattttgttcttagaatgccgggaatcgcctggcccaatcaatcaatggccacatactaccagaatgcacatacgtgcacctagaaagccggtcttcgtcatcaatgccgacaaagacatggtcctttcagtggcctcggcccatatttttgaggttgatcgccggtcaggaggtcgagttgcaggggggggatcgccgcacaacacgatagaatacaccatgagacaagacccccgaaggacagtcgccggcatgctcacactggtttgctgattacataaaaaccccaggagcaggatg

SEQ ID NO: 418 - DNA, 703 bp, Nannochloropsis_gaditana
ccggacctcaataactctaaccctcacacgcacatgtttacccaccaatgtcccttctgttcacataatttgtcacagaggctatgcctacatcccttccctcccgtccgcaatacgttcccgtgtctacctgccccctctcaacctcctccgcccacaccgtccgtcctaaggaaattgtttttgaattgttccttcccctcgctcctttgtctgcagcacgacgtgcttcagcgtcctcgtcttcctccccttcttcctccgtgacgggccgatggattttaggaaaacgctacgatcccgaagacctggatggatggactcagcattttcgctccatcccttggttcacctaccgccatacgttcccgacaatggcaccgtacccttacaccgatgatgccggatggggatgcatgcttcgttcggcccaaatgatgatgggggaagggttgttgaggtgcgaacggggatggaggggtgtgcatgtggagacatagcggtgatttttctattcaaggaggatgcatgacggcgtgaatcgctatgaggagggcaatatttgtagctggttgcttgtaatttgaccaacatacaaggaaagtcctgtagaccaaacgtctggtgacaacctctccctccctccctccctcccttcctccctcccttcctccgttccccgtcgctggctttcctccgcagg

SEQ ID NO: 419 - DNA, 703 bp, Nannochloropsis_gaditana
gcaccggcactcgagcctcccagggggacttgatcggtaatcaaacgcttttcccgaagcacagacgcgacacccaggtgataggggaaaagtaagcctgcaggactgaaggaaaagcctagctcagaggttggaaattccgaagggggggggaaaggagcattgatttcagttgcaggcaggctagtggtggtgggggtcgcggaggaaggggaagagagaggatgcaatccattgctgctgcctgcacgtcgtgcaaagaggcgaggaaggatggaaaacgacagggtggcccgggtcgcgtccgtgatgacggcagggcaggcagaaacgatgagaacgatagaggtagccaaacgtgtcaactgccggcgaccatctcgttgtgtccgtcttatttttgacatggctccaggcccccctcccagctgcttcaagaaactgtgtgattattttatggtgtatggatttatgggggcaattctttgagaacatttttgctggaagtacccctggggccatatttggtgacagtattgcgcgtgcacagtcggttcttcttcaagtagcgagagagaagaaaaatattttatgactcgaaataccaccggaaagaatagaacatacaactttgatccacattctcattttcatccgactcgtggacacagaatccttcgcgcttaaccctctcacgaccatg

SEQ ID NO: 420 - DNA, 703 bp, Nannochloropsis_gaditana
ccacaggaatagtcatcgtctcctccagtctcgccgcccccgttccgatcctttcccccttgtcctgatcaggatcaattatgctgccattaaaaacatggacggagagcgccaatgtgcgtctccgtgctgtatggggagaacgtgcaggtaccttttgcgttgtatgcatcgctttgtgcgctgtaccaagaagcacggagcttgtcctcatgaccggcaagagagaaactgttatctcgagctctgcgagttcccggagtctttgccttctagccccggtgttctgtgtcctatttcaagctagcgcgtacataaacaggtacactctcgtcattggtggcggcatggtggaggtcgatggcagggaagccgaaaatgcggggcaggaccgtcgcggccccctctccgaacaaagtgaagcccgagtcgcgaataacgaccgagcgcaaaacatgccgggacccgctaacaatctaggcggctggccgctattcgtcctctttcttgcctacgcgatgctcctctacgcgcgcgacggaacgtcggaacccagcaacggacggaaagatgcgacgaattccgcacctccccttggggactctggttcttcctctgtcgagattttaccggaggctccactccatgccgcacgcgcacaaacatcctcgcaagacacaaaatcctatgtcttttcgacatg

SEQ ID NO: 421 - DNA, 703 bp, Nannochloropsis_gaditana
cagggcaggatttatgtccgtctctcccgtcacatagaatgctgagaaagcgtgctcgtggcggcgtttcttcccaattcgtttacggtcgccccgtgctcgcatctttcttctcctcctcctcctcctcctcctcctcctcctcctcctcctcctctccttttcctcttcctcaaccccgcgaaatgcggcggacgaagccagacggacgttctttgcacagttgtgctttgggaacgtggtggcggcacgattgcaggcagaaaaagaggcgataaaggtgagtgatgaggagggcgatatcgaggaagggggggcagatggacggcacgcatctccctgaggcaggacagatggccccgtccgctgctcgcgtggaaggagggaggaaaaggctcaggcgggggcttgtgggtagcttggagggggatgatgtctggagacgctgtcgtgcgatccaatctcggggcagtttgtcattcgcgcatgcaaaggacgacagcgaggatggtccatgcaatttttctaaaaatataataataataattactactaatcattgcatttctacttgctatgactccctccctaactagcacggcctcggaccctctggtcccggctacgtgatcctgccccgcttcctctccccgccttcccccccccctcttccctgcctgaccggcgcctctgccgagacatg

SEQ ID NO: 422 - DNA, 703 bp, Nannochloropsis_gaditana
ggtgcgtggaaaaatagccgcatattatcttgaaggcaacgcgaaaggaaatctgatagtctccaacgctccttattttggatggagcgatcgacgtaaaatcccgaaagcgacccggatcttgcttttgtgggcattgtgatattgcacgctggtttcacgtttcacccacgatcaatactttccctaccgtcgctctcagtccagtatactcttataaagattcacagatctaagtcgatcgcaagtggtggttgtgacgtgtacaatcctgaaatgaagcgggcgcacgaataaaccaacgagaccgctgggaccatgcgctgttttggcgagccgatgcacaaaaatgacctccagctactgttgatcacgaagtgcaatgctgccggctgctttcattactcgtatgatgcaatgttgaatctttatttgtgcagggcgacgtaggcagtacttgagcttatctacttgtcacgctcccgtggttagggagctgaattgtaactctgaacaacactaccagacaagcgacgggtcataaagtccccgccactatcaccgcgttgttcctcccgtcccagcaacaagcgacatgagtttgactatttgctaaagcagagtgtagcgcctgcctgatgtgttcacacgttcccataccttcaaatctttctacactcctgtcacgacagcttgagccatg

SEQ ID NO: 423 - DNA, 703 bp, Nannochloropsis_gaditana
attataccctgttatcgtcccgagtgagaataacgtccatccatgcgtgataacgacagagacagacgcggctctccctcagcctcatccctccctttcccaccctacaacacactcgtcgccccgagctcatgtacctgtccttcctcgtatatccgcggccccgcactcgcaatactagctgcgattacacgcgatacttgatggcgtgggagccccgcgacgaagccaaggacacgaggaagaatggcagtgccgacgagcatcgtgagcacgacaccgaaaaatgaggtccctcttcgaatggatcccgccgcccttcccgcacgcatcgcctggaaggatggattggaaaggtaggagtacatttcagaaaataaggaataatgtggtagagggtcttctttactgggtgggagcacagcaacgggaaaagaggcaagaggaggtcaagttcccttacgtactgcttcagcgagcctgacaacttcacaacgaggacagcgtgctttacctcttgaatgacacgcgtttccatcccaatacatctttgtacagtatataaggcatgtcgcacctggccttgggcggcacaggggtggatagcagggagtttgtcgctctgcagtgtgagagggttgaagaggagagggcgcaatgcccggacgcgagtggcagcacaataccatctcttggcgaggca

SEQ ID NO: 424 - DNA, 703 bp, Nannochloropsis_gaditana
cgaacagctccgcccccaccacccaaagcgcctccggactctgccccgccccgtgctctctctcgcccggcgttggcgcaataaagtggcagtcccttccaccttcagtcctgacgaacagaagcggctggtggagctggcggtggcgtccaagggacatgggtgggaagaaattgcgcgaaagcttgggggggggcattcggcgattcagtgcctgagagcctaccagcgatggggagggaggggaggcagagagagaggggctcgaaggtgagtggggacgaggagacagaagagggagctcgggtggacgcagccgcggggggggggaggaggggaggaggaggaggcgcagcgaaaagtgggaacccctcttccctcccccacgctctggtcccttccaacctcatcaaccgggggccgtggacggcggaggaggacgagcggctcggaacgggcgtggctctctacgcggacaattggacgctcgtggccgagcacgtcgggacacgaagcgccagccaatgccggcaccggcagaacagccgggagctgaacaaggaagcgttcagccgggaggagcaaaagcgtttgattttggcgaccaaggcttacgcgcccgaagtttggagggaggtaaaggagggccgacaaaagctgacgggtggtagcctgaaggcggaggtcggggtggggggagggg

SEQ ID NO: 425 - DNA, 703 bp, Nannochloropsis_gaditana
tcatggatgagtaagcagtgagggggatacagaccgatatttgtttatttgaccctgtctaccggaagaagctgcttttggaaagataataatgtacagttttttcagatttaaaatgcattctagcaacaccttcaggccaagcggcagtcagatcagaatcaattctaagagaaaaaagactgatcccgggataaaatctgtttgtctatagagaaactaatatgtagccaatatagagaaaagctcgttaaagtattttttgcttcatattcctcttccgtcttgacggtcttgagttcttcggctaccactaatgcagtacttgcctcgccctcagtgcaagaatttctatagttttctttcattctcgctgcacactgcactccaaagtaaatccacgaggccatggcggtatgacgggccgtcttgcctcctcagagagagagtacttgccacgtacccctgtgcctcatcctgaagggagtccttcgcttgcactcgacgtacgcacttggcaatttctcatgcccagtcccttggcacaattggaacaccttcgcaactctgtatccccgcaccgtaagcatgacttatgacgagattttgcttctgctattatacacgggaaagtcagcacgttttggcttggaaagcttcaggccccccctcgccacatatcccgcctcctcttaccccgatg

SEQ ID NO: 426 - DNA, 703 bp, Nannochloropsis_gaditana
ctgaagcagcggttagcccacaagccgcggtagaaggcgttgaaatcgtcccaggtgctgtgacagagaagctacctggggtaccggtcccagccaaggatgattggaataaccagagggacaagcacgaagaggactggaaaggcaatgattgggatggcaaaggcaatgattggaaaggcaacgactgggatggcaaaggcaatgattggaaaggcaatgattggaaagggaatgattggaaaggcaatgattggaaaggcaacgattggaaaggcaacgattggagaggcaacgattggaaaggaaatgattggaaagggaatgattggaaaggcaacgattggaaaggcaacgattggaaaggcaatgattggaaaggcaatgattggaaaggcaacgattggaaagggaatgattggaacaacccgtggaataaccagtggaataaccagtggaacaaccagtggggcaataatcagtggaacaaccagtggggcaacaaccaatggaacaacccgtggaataaccaatggaacaaccaatggaacaatcagggcaactggaacaaccagtggaataatcaatggggcaacaaccagtgggataataaccagtggaacaaccaatggaacaatccgtggaataatcaatggaacaaccagtggggcaacaaccaatggaacaaccagtggggcaacaa

SEQ ID NO: 427 - DNA, 703 bp, Nannochloropsis_gaditana
ggctccttttccagtacccctccctcctgcaggtcctcctccgtcacaactaccaggggcatcaaggtactttgctgatcgtctacaagaacgtctccccccttccctcctccccgacctccgctgccccctcccttcagttccgcacattccaagccagcccgtcctccaccgtccccgggctgctccttcaagcttctccgctccaagtgtcggtcttgggaccgggagaagaagcctcgcagacggtgcgagtggtgtgtctggagccctttgatgcctcgggggggggcatcgaggtcctggttgagtttgggacggaagaggaggaggacgggacgaatgcggtccctgtgcggtatagcttacctctgcccttgcctgtctcggtcctgcattttgtgtggggcttgcccctgcgtaaagaggacttcctggcccagtgggaggcgatcacggttccccaagttcaagataccttcttgccgacgagggaggatgggaaaggggagggactggaggtgggacccttgattcgtctgttaacgaaacaattccatctgcaaacggtgccggaactgtgtcaacgctcgcgacaggcgcagacttggacgtttgcggggagcttggagacggggtccctgtccccccacggcaagcagttgcgcgtcctggttctggtccgactggagcagtacgagga

SEQ ID NO: 428 - DNA, 703 bp, Nannochloropsis_gaditana
agaggggggggaaggagctgggcccagacattcctgtcgacgcgtgagggcagtcaaaacctcacgaattcacgttttccacttagaggacactaaaaaggctacttttcgattaggatgcaagttttacatgatcaggacatcacaaccagatcagtaacgagaagggaaatagttgatgccagcggactggagggtgtggcgggcgtgcgaggcgatctgggctggagatccaaatgcaccattaatgccgcaacaccatcccttcctcctgagcttttcctaacgtgtcaagttacgtgcacaacggtcccaactgcgtacgcagcaggaaacctggagtggtgcgggtctcatttcccacgcccatccgcgtaccccaaaccccaccatggcgttagaatcgccgcgttcggccgcgagaatcgcaggttggccaccggaatgcattccaagcccagccacttcctctcacaccacaacgagtatgggctcagggtatgtaggacgcatgatatgacgatgctggcgcggtgagacccgacaaaaggctccgtttgccataatttagggggggtgggggtgacacgcttttctccttcgtttcgacaaggacagaagaggttcaacgcccaggctggaggaggctttttgtgtcctttttgacctctccctccaaatttctccccctgtttcttttcag

SEQ ID NO: 429 - DNA, 703 bp, Nannochloropsis_gaditana
gggcaaaactcggaacacagtcagaagcgacacagattcaacgactcggtcgtatcgcgctggagtccaggtggtgaaacacaaattatgtgcgcctgtctccaatcagctcgctatgggcatgttcaaaccagcactcacccatgcaggttgtgaaaggactgtttaccgttctcacgttgtgtccttctatcctgatagttaccacgacataaattgtcgcaccctgtgcccttccccggctcgggagacaagcaggcagctagccccatgtgttcccttgtagcgtgaggagagcacaccaccatccacgcgacgctttttctcaccccacgcgatttagcagcccccagacatttcaatgcttaatcggcggcaggcgtttcgtcgatgcaaaattcggaggagacgagtgccctgtgaaaccaatcggggcatcgggtactcggctcccaagctagattcagagcaaagcccatcgagctgcgagcaaagcccatcgagctgcgcgagtatcgacggcggtagcccctgcagagacagcgagagcagccattgcagcaacctttccgacggcagcaacaacgacagcaacagcagtggatgtacaagccctggcttcgacagtacctgttcccccccccctagcccctcttggaccgaagccttggaaggcacagacagctgtgagtctgccaccatg

SEQ ID NO: 430 - DNA, 703 bp, Nannochloropsis_gaditana
aaggaaagagggagggagggaggatgaggtattgggcctcaaaggacaagtacaggtaccaacgtactagtcttgctccctttggtcgtgctcccagtcgggttcaatgcatcactgctgcagcatacgcgcattcgcacaactactggccagttttatacatccatgtggtacgggggataggggtggtgctaaaggattagttatgtgaagttcatgggcaagatttgttgtccttgccgctttgcacgtcgagccgggcatggacacctcgtgctctcctgtcccgcattatcgaacctaacaaaaacgaggaaacatgttgactacatgagtagcacgccaaaattacattcagagtggcatagaatttaaaaagggggcataaacacgtattttcccgcttttaatgagccagatttgggacgggtacatcgacagagcgatggcaaggacatacgctaaaaaagcatgtggtacggccgtcaagcctgagtatctcacctgtttattctacaaactcaacaatccgtaaatataggaacgcttttcacaggatcgtccatcggctggacataaatttgcgaaaaagcaagtaggcattgcggcaaagcaatcccccttcccaaggcacgtcttccatgacacatttctgaagcagcacccatcgagaactctgtcgtcgtcgccaaacaggctgtat

SEQ ID NO: 431 - DNA, 703 bp, Nannochloropsis_gaditana
catcgccgcctgcgcccggggcggggcggtggaggaaggccggcggttgttggggcgaatgaaagcccaggatgtggaccgggacacctgtacctacaacaccttgatggacgggtacacgcgcgcggggtctttccccgacgtcttgcacgtcttggatcagatggggaaagaagggggtcgagcgcggccggatgtgatcagttacacccaggccttgagcgctgccgagaaggttggggactacgaagccgcggaccggctgttggcggccatgaaagtggcgggtatccgttggaaccaatatacctacgctgtggtcatggccctctgtgagaaaacgggccgctggccccaggccttgcacttgctccacagcatgcgccggcgcggcctgaccccggactcgacctgctacacagtggtcgtcaaagcgtgtgcgtcggcccagaagctaggacattgcttggcgctcttggaacggatgcagaatgatggggtggtgcctactatccatatctatactatcttggtcggagccgcgcttatgaagggcaaggcgcggacggcggtggggttgtaccacgatatgttggcgaggagggtacatcccaatggggtctttgtctccgcggtgatccacgcgctgttggaaggggggggaagtcaggtggtgggggggaagttggaggaggaagggaag

SEQ ID NO: 432 - DNA, 703 bp, Nannochloropsis_gaditana
tacgaaggcgaaaaagaagcggaagagatgttggtaccagacacgtgtgttgtctcaaagtttggccatgcatttcccgtttccatgattcttgatattgcggtctccaagcgcacaatcaagacgggagactccatccaaaactcccgtgcccactgttgggcttagttcacgccgtgcgcagtcacatagaagcctattgtaatgaacgctgacgaagcgcgtcacgcaagagggctagtgtgcatgtggtagcttcaagtcaactcggcccgcgttgtggcagggagggtaagacgaaaagcacgcgagacaggtcaaactcaaacttggacaagaggattacccatcccactgaaaagcactatgttgatgacaaagatgaggtgtggccacgggcaggatagcttggtgtgcgccccagcccgaccggtactggttttccctgcctccggagagagggctgctagccttgaagaaccggcaagaccgcaagcttttcgcccgtccctcccgcctgccacaagcctcaagctggcgccgtactgccgtcatgcattcaaaaaatgctgattttttcccactcactgacagacgagccggggaacgggcgttttggctccattttctccatgtgctgaagcgcgcctctcactgcacgctatccgcgctaccataatacctcccctacccccccaacatg

SEQ ID NO: 433 - DNA, 703 bp, Nannochloropsis_gaditana
ctggccgagctattggcgggtatgccatacctcacgttgctgtccttagcctactgtcggtttacgtaagccgttttgcatggtggcgggatgtaatattgaagtctcatacatatagtgtatggattatttggattatacaatttacagtctatcattgccagtatcttgggccattttcatggaattggcagtcctcttctccctcgccaaatgtaagaaggcacttaatttttactcggaggacaaataaagataaggcaacacaggaatttgactgcctccttttccatatatcgtttcccgcgccccctattcgaaaacacccttccacgctatcaggctggccagcaacatgaggaattttggggaaaggaaccgcttatggattgttcccattgttgtgctggtggttttacatgtcatgagtgtgaaccacggggcccgaccgcatttctcagtcaaggccctcttctcacacaacaattttccgttcgacgacgaaattcaagcggcgaggggcatggcggaagtaaaaggagcacacgggggacaagtattcatggcggctgctaagagaaggacctaccatggtcctcgcccctttagcagcaacggttcaacctcagctatttcatataagctatatcctcgtagttcagaggagcttatgtgcaagaaatgggccgtggtgacgacgatg

SEQ ID NO: 434 - DNA, 703 bp, Nannochloropsis_gaditana
aaaggaacaataagaggaaattgcatgtacatggagaagtaaggtgcagaaaggaggaaggccgccttcaaggagcaagaagcggatcagcacgctttaccttcacgtaagctggataagaagatcaattggccacatgcaagagaaaaatcattgaatgtaaaattttggtagatttctgactcaagctaggaccaatatgaaatacaaagcgggaaaatggagtcgagggagcgtagctttgtaacgcgctctgacaccgtgaataaccgtacgttccaacaaaagaagccacatcacaaggccagaattgaagctgcttcctcccccccttctccccacccgatgcctttcaatgtaacggagtcgatgaacgcacagtttgtcagggggggagagccagggctgtgcgatggcttgggaggttcgggcatgcgggtgaggaggagggagggccccgaacctcctcctgaagctgttgcagattatgcctatgccccttcaagggacatacacaaggcaggggtgcccagggaagtatgtccgagtgtctgtatgcctatttggggatttttttcgcaagtgtcgtgggaaattcgatttggatgtggacttggtactcgaacatgttcaattaagcacccgtcgatcattctttgactccctcccccccccgcccctaaacccccggctcaacaatatg

SEQ ID NO: 435 - DNA, 703 bp, Nannochloropsis_gaditana
ctagctgatgtatccaatccttgttatacgtaaaccaatcctgacgagatgatttccacggaaaggcagggaccggaaaaggttaggaggtggttaagacctatcaaagtcgattacattttctttgctcctgacctgcgcataatccagccagaaaaaggcaagcaagacaataatggcaacaacatcacccacatttacgtgcgtgatggatgctatcaagttttggcccatatgtgataaaagtcgggcttcggacgctagcttcgttccgtgacgcgggtgaaagctccgctggcgggtgggttcaaatttgcaatttctggcctattggagtgattcatataattgaatacacgtgaaaaattacactatggaagtggaggcgacaatcagttcctggtcattgccctttcggcgtgagggtttggaaaagggaagactcgactccaaagcgagggctctaaaccgtcgtaaacggtcgctaacggctaaaccaaagcaggtggcaaggcgtggtgcatcgtcaagacggggtcatagcgtgggacggttgagggtccattgatcgacttatgcatcttgtatgtagtttgaaaatttgggccgaaaatgacggcatgggcagcggtaggtacgcatgcaacattaatgcatccctttgtgttcctgcattcatccttggacaggccagtccaagatg

SEQ ID NO: 436 - DNA, 703 bp, Nannochloropsis_gaditana
aaaatattacaatttgtcttgaacatttttgccctcgaggccccaaaaaatgtcacaagtgtctttgtcttataagaaatgctacatacaagcgactgagaaaaaggcattacacttgttcaatatctgactcgtttcgttcacataaaatcttatattaattcttgaatgcagcttcatctgacattgtagtggaattttacgttatagcaaaatttttaatcatactagcaggaagggtataatgtgtagagaagacggaatgcaactgacacgcctatcgtacacataattccgagaattaggggaaatatagaatgaacatgcacttgatcggtgaaagcataaagcattcaaatcaggaaactgtcacattttccatttctccgcgaaggccgggcacaagacttttccacattttctgcttcgcacacgtagggaacaagcgagggcactacggcaacaaactcctatcgtctccaaagccgcggtgatgaatgtgctgacctaaactatgggagaaagttcagggtcatgggagatcgtgccggagcgtatcgtggatggcgtcacgatggatggacggccttgaaatagaacgatactctacatccattacgacacgtacgggatatcgcttatcacgaaatccacattcctctcaactatcttcatttatagcctgccgagtgctcaaaggatg

SEQ ID NO: 437 - DNA, 703 bp, Nannochloropsis_gaditana
gcttcttcttagcaatacgagatcggcactgatttgactttcgcttgtgaaatagatgctatcggtgtcccgggcaaagccacatcgcttgatacgacagcagagggtcaagagactgatacttaagtggattgaagctgccgcaccaaagaacacgaatggtactactgagtatatgaaagaaaataagaaagcgtatgcatgataaagtaattttcgctgtccgttttaattaggtcggataatttgcagtcttataagcgtgcatgcaggatcccgtctgaggtccatttgcggttttgaatgctccaggttgtagtcactattgacatacaagtttcttggggaacgcatgtcgctttcctggtgacaacttcaccttgagactgtccggccgtgccctcgatgagacacggcttgaccgaagttttgtggcggagcaactcaatgctcttgtccgaaagatagcgacgcatggggcactagggaagccactcatccttctaatgtcttatatgatttaaattatctctccatggatacattgcaccaattcaaaaaccataatgggccttaaagctgcaagatgccctctccctgcctctcccgaataacctacccggagctctcccttattgcaagtataagagcacccacaatttacactatgcctccacaggtgaggctttgaagaacacacatg

SEQ ID NO: 438 - DNA, 703 bp, Nannochloropsis_gaditana
cgagtgctgcacgtagccgccgtaaggagaaaaagtttccctccccccctggaggtgatgacggtattggtgggtttggggtcacgtgggagtcggaggaagaggtgaaggaagaagagaagaaggaggaagaagcgaaagaagatggagacgaagaagaggtcgggagggcacgggggaagagggaagggagtgagaaacgacggcaggaatgtttcagggggaggctagcgcggcgccatgacgactcgagcggaggcgcagaggggataaatgccaatacactggccatggggagcaaaagcaaagcagtacttgccctccaccatggcatagcttgctgtgtgggtgggcatgtgcgtggaaaagaaagaatacatcagaaaggccgcagatgcatctagctttaagttgctgttgtctcgcaggaaagtcaaccaagctcgacacctgtcaggctgaccccccagcactccgttgcatgatattaaggcggatcgaaaaagcgcattcagggcatagaaccgtgacccgtctctgcgtcgcccggtgagaggatgtcaggactgcgacactttttaggaggtgttttccatgtgtccggaccggaggtttgtgtgccttcagcgcggtgcttccagaaaggtgggaggatacttaagtagaatgtacgccccatcccgtcacacacacaggcagcatg

SEQ ID NO: 439 - DNA, 703 bp, Nannochloropsis_gaditana
gggaatgcattcaaatatcaggagtagtcctgcctcggaggaacgggaggaaacatcttacaaccattgccatagtaatggccgaaattgcttcaccggttgactttcacttaatattctcatttatatctcaccttcgagctcttccacgtcttctggtttgagttcaatgcgtgttggcgggcgtcgaagcatccctctgccgccgatgatgccgaaaaaggagaggctggttcccctcggcggctatctatcaactgtataatcctgcaagtgggcgttttgaggaaagtaggatatgagagagacgagcagctcttccccgcgtaataagcacgacgtctttgtgtaggctttggatgactttcagtcggaagagcatgaactcgggcgtgcgacgactactctttcccggggcgacatgcgagcacatgccacggaaaatcaatactgcatttttatcctccaagtatgccgcgctatcattttctttgtacgtgcatcaagctatcactcttttcgagggatatgtcatgctttatgtcttttttttgagacgaacaccgccggcgatggcgtccatcgttggcgagacctgtgggccaccgagactaccagcacttaaatcactcctgctcacttgtataatccggccttcccagcctgtaggttaaagtagcgtcaagaatctgcagctgccatg

SEQ ID NO: 440 - DNA, 703 bp, Nannochloropsis_gaditana
gtgggcaagcctgagccctctctctccctgcccctctccctcatcggctctcaccagcagacgaggatcgtctacattatccgccgctgccatccgcgtcactgttgacttgacttctgctctgatccccacctacgaagaccgagaaccaatggggcaggtggttggattaaaataccaggggcaggctcgaattcatgaacggatcgatctcccctctctcatggtctgggtaccttagtcatagcaggcccgacgaaggcgttgctgcttgcgagtcctgcaacaagaagaaatgtcttcaacatcttgaagaaaaaaatctgttgttttgcagaaagggtcgaggaaagaagaaaagaagggagggtaagccagaattctagtactactagtaggagaggtggatcggggtgctgtcgccatattattccagtcccgggggtgtaactgaaggacggaaatagaaaagcacaagaaaagacgctccagcgtacaaattgagacctctactctcgcatatcagtggtggtgtggaacacttgcacctaccagcgccggtaggaaaggaaaattgaagggatggaggagcggctgcgatgacgccggggccttgggaggggggggggaggttaaaatgtgggaaaggtgataccaccttccgtcccacacacacatatggccgtgcctccgcgcaatcatg

SEQ ID NO: 441 - DNA, 703 bp, Nannochloropsis_gaditana
tttcttttctttccctccctctcgcttgtccctcaaaacctttgttgatcaactctctcttcccttgcctcatcgcttcccgccatttttcctagaagtatctcatgcgtcaaaggaatggtcagtctgtcctctgcagtaagtattctcgttgctcagtcggacgcaaggagtcaggggacgcgagacaagatgtgcgttccttcaacactgacatcacttcaaagtccggtacttgaagaggaaggagaggtgagaggagacgaggaggggacaaaggagttggacaaaagcggccagtcgaaagcattgaatgatttatttgataatgtttcatttataactttgagttccttccttcttattcacgtttctctcactcttgctctctttttttcttccctttctcacttccttgacaactcgtaataggacacaaaaaatttgagtaatgagtgtgtccattctcccatccaatgcttttaggatttacttgccctcgaccaagttacgcagagcgccccgggatggcaactggcaaatggccgtttgcaccctccacaccgcgcgaatgacagcatgactgaagggcaggctccgtcttccaagcctgagaatatcctacgcatcggcattcagatccgcgtccgggatcgagcataccgcttctcatgccgatgatgtcctattcaaagattatatg

SEQ ID NO: 442 - DNA, 703 bp, Nannochloropsis_gaditana
agcgtgcaccgttgctgcgggccagaagtctcgtgcaagtcaacgggctctgtgtccttgtctgaaaaaggatgcggcagcgagatgctcctggggagcagagggcagcaccaaaatcttccatgtcatggtgcgtctcatccatcgcaggattattatcggacggaagaggatgcggaaagggttgggaacacatttgagaacgagaaaatggattgttcgcctgcttgagtgtggaaagcgggcgctctcaatgatgtacattggtgaatcgtatgtggttacatatgaatggatggcggattttatttaatgacgtctttgatttatgagaaatgagggccaaaattgaaagaaattatcagaattatgtttcaatgttatttagctaccttttaacgacacgatttctacaattctttacacgcctgagtcagtacttttccggaaatttccttgattaagaatgatgagcaagtcaagcaagccatgctacatcttatcgaatcatattatactgattgtgcatgagcaaaatctcgaacacccgatactctctttcctttctgacatttcacggggttgaagattaacttccatctctgctcgaattttaacggcttgcactgcttcgatcattttttttgcactccacgcctttattcattacacaccgatataaattgtacattataaacagatg

SEQ ID NO: 443 - DNA, 703 bp, Nannochloropsis_gaditana
aatagaggccgtggaggccgtaatggacgtggtcgtggcaaaggattgcaaggcggaaatggttgtcgctattgtggaagcgcagatcactggggcaatgaatgccctaagaataaaagggaacattcccatacttgcctgctagctaacaaaaggacgaatacaaacgtaaggcagatgaaatcgacctctataatggttgatagcggggcaacttcccacatgaaaagggataccgaagaattggttaatgtcggacaacactgtggtcacgtgtatgtagcaaatggtgataagctagaaatacattacattggagattggatcatgaaggtgaaatattgcgatgggactatcaaaggcgtcatgtttaaggatgtaattagagtacccaatctgagtcgcgaattattatccatggcaaaaacagataaggctggtggaagaattgttatccgtgaaggaaaaggtatgattcaaaagggtgacacatgcttgccgatgagaaaagtagataacatgtacctgttagactgctacggcgaaccatgtgaggaagctaatgtagttagctcacctgaattatggcataaaaggttcggacacatcaattatgaatacctgagacaaatgggtgaaattgatgataccggagtgccaaaagggatgaagaaacctggtatttgtgggacgtgtgaacgag

SEQ ID NO: 444 - DNA, 703 bp, Nannochloropsis_gaditana
tagaggcttctatatacctgctccttgacctgattgaaggcgctcttccaagtgggcgttggcttgagcgatctgaggtatgaaagcttgaatcctagatagcactttacattgaaacgaataaataatgaaaacttatatcgagaatgttaaagattacgacgcgcgttgcgtttttgtacctacaggaagcagtgttgctgcgcagtgaagtaggaggaggtggcaaccgagcagaagccgggggggaaagcttatcggaggaatcagcggaagaatactcggacatgattgtccggcgtcaaaaataagtctgtacacagaatgggtaagcgcaggttaataatcgtgcagtggtacgaaagcatggcgcgtgggacctaaagcacatcatgtacagatgagacagaggcgacatagcaactgggcttgatattcaaaattttaaaaagatcaacctccgctttttgggtccctctccgaaggatggagctttttttcttccttcctttcgttgtttttttttattaaaaacgtcgaatgcgtgcgtaatttatttgagactccactaggcatgcttcctcaatatctctttcttataagcaaaaaatagggggcgtgctcattgatcacaacggggattcgacacagatctttgccttaaccctccccccctaacccatatatattaggctctgctatg

SEQ ID NO: 445 - DNA, 703 bp, Nannochloropsis_gaditana
agcctcgcccatgtctttgtatcggtcaatggaggcggtgagtctggctttcgaaagacgtctcctacctagtgagagtgctggggccaaaaggtccggcttgcagtcatatgcagactttccaaatgcaacggcagacaaagaagagctgaacgccttcctcgactctccgctttgacgctctagtatatgtttatggggtggcgtcgtctcgtgagagaagatgaaatggcatgcgcagtgagactcgagcaccgccctctctgctcagtgcttgaggtctgttggttttttagcactacaacagttttccctccttgcccacaatcatgcctattttcggatttccctctatcagggttggtcattttcgactgagaacgggcgatggcgtgtcatagattctggaatagtatggaagagggtggagggtaaagatggagctgaagagagacgactccatggcagcgatatgctcaggcgcaccagccgcctttaatgcgaggtttctctaccacaataccgcgacgaactcaagggaaatagcatcttgtatagaaacttgaaagtgctttgatggcagacagcgatggctgccctttttgaggcgtttattgattctgctatctctcttctacctcctggcatacctccccccctccccatttttaaccgcatatcaaatacagtccgcttcggtatg

SEQ ID NO: 446 - DNA, 703 bp, Nannochloropsis_gaditana
gcgcgaaacctgcacaatggactgagcgacctcgagccactccgccgctacgagaaggctgcggaggtgcacactctgttgaatgcacatcatctataacagaagcagcatcatggtacaggttctcctgcccgccatagtgtgtacacagatataggccatattctctcagaatttttgtcgatcaacaggcactgtacattttaactttttgaaaatttaagccaagtacgacgaccgttaccgagttcagtcaacgcaacgttttttgctcgaacaggaccaaataacgttggctatcttaatgttatatcttaggacattataatgtcgatgagtgcaatgatattgtcaactgttgcttccaaagcgctgaaaagagcattgctttctagttaggacctgagcgatcgattcgccaataaccgcatcgtggactcatctactttctcacgtcttctcaagataaaacagtacacaaataaacaggacagtaatgaggaacaagaacagtctatgtgccgttttgaaatttttggggttgtactgttcgctctttctgctctgccttgttgacgtacccattggagttcttggggatgacgtagtggccaatgatattcaatacacgcacgaaactgagaaagctgatttcattattgattctggatatgaagcgccattagataaaaaaagcgacatg

SEQ ID NO: 447 - DNA, 703 bp, Nannochloropsis_gaditana
catagtgtaggctcatattatgcaggcttctcatctgagagcctcgtacgacatcgtttcaaaagatcttatccatagttgtgtcaaagctcgaaagtatcagaaaggagtagatttagctgtcaaggaaggtccttgccacagattaaagcgtaatttgccggaaaactgcaaaaagatgaaaaaggctttgtttcattccaggctgtattcgttgaacagaaattattagcttctagctactactacaaaagatacattgaacgacgaaggcaatgtgagcattttccccaaactatcttttccgagggcctagccaccttatcgacatatttttctcccctcaaacgctggataacaaccaaaaacctgtaaaccctttcggtccaagggctggcccatatgcccgcaccccgagcccgctggatcgtcgtgtcttttggcgaaggaaggggatactttggtacttcgggtcctccctccctcccgcacttcgtcgcccggttgagggaatacacagcatatacgcaggctaatacatggccgccgttgaaatgagttccctttcaacttgatgaccgtgatgcttgcactttcctgaacaacctttcctgcgtcgtctcttacattcgttaccaactttctcaccgcatcacccagcttggttttcaaagcaggtgtgatatcacaggccactgtcatg

SEQ ID NO: 448 - DNA, 703 bp, Nannochloropsis_gaditana
gagtatgcgccagtcgcacacgtcttgcttgtatcgctccacctccaccttccagaactgctcagacagcttccgctcgccctccacgcgcgcaacttcagcttacgcctgagcgatctgtatcgctgccttatcctcgatgcgcgcaacttcagctttcgcccgagtctcgtcaaaggtcgagacagcgtaagccgtggcactagcagctgccaccaccacgccaacagccgagtagtctatgatggactgctttctccaccactttctaccgctcaccttgtccgcacgtggacctacctcactctagaaaatctcttgtacggctgtggcaaatttgatccgatcagcagcaccgatatattgaaggaaaagaggtacggtatgagttgaggagagagcactatcgacttaaagtacaaccaccaatgcaatcgagaaatggagtgtatgataatatgtatcgtggacatttttccataaagtattcagaaattttcaaagtaatgcgaaaagaattttgtgaataatttgcgatggcgtcattccaccgcaccatgtaatattccgtcgcgtcttctgataattttctatttttccttgcacataaaattttacccaggagcctgataagtgtgatcaagccagcgtgattattggaaagggtaaacttggggaagcgctggttcagtgggggggtatg

SEQ ID NO: 449 - DNA, 703 bp, Nannochloropsis_gaditana
aaggactccctgacacttgtgcatgcttctcaattactcctttttgcaaatttccatacctgcaaacatctgtgcactgctgatgccttctttgctcgcttacttgcccattgtctgcaggtcaacccacgaaatcgtagcagtagcaccaagcgattcagacattcttgacatgcctttatctgtcatctatcagacctaggaaaaactaaattatttgaggattctcaattatgcacccacatggaaatggattctccttgattttcatgtgcctaagctgtcacttgaaatttggtttttgttttgaaacgaccatatggcacgtgcctatccttcgaaggatgggagcttcccttgtggaaagatgtttctgtactgcaaatccattactttctgacttgcttgccacattgtctgttgaggtctgcccacgaggtcgtagcaacagcacctaggttttgtggcacgtgaaagagatcttggcctaagtcctgtggacgttaacgtaactaagggatacagacattcttgacatggtttagtcatctatgagacctacagagtcttaatgagacattgcagatagctctatcccgtttgatgtatgtataatggggtgatggtcgcacactttcttacaggtcgacctgtcaatccgtacgcgcccatattcaagcacaaatctacacatccagaaatg

SEQ ID NO: 450 - DNA, 703 bp, Nannochloropsis_gaditana
cgtgaggataggcgacctccaagaggtcttcgggcgcgcaatctataagaaccaggaggatgtagtccctagccatgatacagggcagtcgggatggggaggactgggcgatatggaggaaggagggcagcaagggacagaagacggaagccggagaagaggaggaggaggaggaggaggagggggaggaggaggaggagaagaggacgcggtcgagggccggaaggaggaaaggaatcctgatcatagcgctctgactccccatgctctgaaggagccatgccccaaacaggacggtcgttcctgcaaaccctcttccctttccccaaacctgcgtcgaaaacgctgccgtctgtcccctttggccactcccctcgcgacttcgccctcgcgccacctcacccctggcatccccgcccccatgctcgacttgagggcctccacgggcggagccatggcgtacctggaaccttcccccccctcgctactcccacagccacacatgcaatctaagtctccgcccccgtgcagggcagtcccgccaccgtcacgccacgcacaggggggaacggccggtcgtgccgggcgaggacaggaggaagaaagtcggggaccaagagaaaggaaggaggggcaagaggaagaggaaggcgaaaggaaggtggaggggtttggggaggcggggggtcctgcgggggggcga

SEQ ID NO: 451 - DNA, 703 bp, Nannochloropsis_gaditana
acacgtccgtaatgcatttcatagaagtgctggaattaaacgtgcggagatgctggagcgacagacaacctgaaaatcctcctcttcgcgcgtcgcccccccccttgccctcttcccccctcctcacatcggcttccgtgaggacatctcccgccaaaaatcgctggtccgtcaagatcgcttccacgctctccaggccccggaagacgtctcggacgctccggtcgtaggcagcttgggaggtggcaaagccacagcggtagacaccgttgttgatgagcgggtacacccaggcgttgatctccaggatgcgaggccgcagggagggcgggaagagatccacgtcagggtgagtctgtcccggggggggagggaagaggttgaggaagcggaggaggtcgctgctttcgttgttgacgatccggcggcgtttaacgtccaccaggacgggcgccgtgcaccggccggtgtagcccggggcgcagaggtcgtacacctccctcaagtcgcggcacccaaagacggggtcggcgaatggagctcccgcctcccctccgccgccttctcccatcgtgtcgaaggcccagcccccccgggaggctctctcggggtcgtcgatcgcgtaggagtaggaaagttgggattgggagaggccgcgcagggcgtgggcgagggtgagtcggtggcaccaggggcaggcgtt

SEQ ID NO: 452 - DNA, 703 bp, Nannochloropsis_gaditana
cgagccgccgtcgccatagccccacgtgtacaggcgtctaaggtccgagggaggaaaaggaagggggaggagacacggaacgaagggccatgcgggcagctttacacgattcctcccgagccaaggcgggatagagagggttatgcccggtaagggacacgacggctagcctcaacgccctctctgagccgccgggtctcctttctacccccggcctcggctcgagaaacgaccactccttccccccctcaaatacaccagagcgctcgacccctgggctgtacggtagggtaagttccaatatggagctaactaggggagtaaaaggtggttttctagttctagcatgcgctttctcccgaccgatgacgtcgtgacgagattattgctgaaagaaaaagcacattacaacgaaatcagatcgttaccccacggcccctggtaacggatcggatcgagcccaaaagaagggactgagccgttgcgcgatgaggaacgagtacgtggtagtgcacttttcaagccacgcacgtgatattttacttcctgctctgggctctcggctgatgtggctgcaattttaagtcagttttgtgtggaaatagcgtatatctgtgccctggtatccttcaactctcttctgtgtacggctcaacattcaacttactctcatgcacataggcgcgcgcgaagaacaagcatg

SEQ ID NO: 453 - DNA, 703 bp, Nannochloropsis_gaditana
agctacactagcaccaagaaatggccatgcaactttagtcgccatgcaataatttcggacatgattctgccacgatagtttcctaatttatgccacggtgatttcctgatttcttacaaaaagcattctcccctccttccgcgaagtagatgtgactgctatttcctctgcttccatggcgaggcgcccgaggtggacaaagccgcagtccacccctgaatgcgtgatcctcccctgtgcatgtacaagctcgatgtaaggccgcatgctggcgagacgggacggggcatgtcacggtgcgtctgacctcggtgggcgattgactcgcctcacgttcacgcgtgcgtcacttggctgttccaaggcccatgtccccgaatccctcctgccccagccctctttctgccctttttgacgtcctctgtgagcatacgtgctttccagagtaaaatatcatatctttagatattttcgaagctccaggcaagaggaaggtggattgaaaggacagaattttgtctaattttgtgtgtgtcatatctacagataagcaaatcggaacaggtcgtctgctattccgagccacccttaagtccaatacaagggaccaaaaatgcgattgcagcaatctactgtagtattatgcctccttctgggctacatactctgttattttggttcacctaacacctctggtgtcatg

SEQ ID NO: 454 - DNA, 703 bp, Nannochloropsis_gaditana
aaaacgtttttgggctgaagcgttaaatactgcaacatgtatttggaacagatcgaggaattctactctaggtgcagatgaaacgccctactataaaatgttcgggaagcatgctagtgtaaagcattttagaatttttggatgcaaggcattcgtccataataacatctactggaagaggaaaatttgatgatcaagctttggaaggaatcatgattggctacgatgacatagggaataatcccaaatgttatcgaatctatataccctctataggaaaatacatcaaatctggtcatgtgacatttgatgaggagacattcccagcgaagcggaggcaacttgacaccagagttgaaacttatcataatgaggaagaagatgataagaattctatgaagacagtgggggctcatcaagaagatgagatactatcttctgatacaagtgaggataatgatggcatcgaagatgatttacatcaagacgaacgaccccatgatcgtgatgtcgatcatgtcagggaggatctgtcgcaagtaggggcgacaggatggaaagatacggataatattgttcggaacatgaataatatgggacgcacgcgaagcaggacaaaggctcgcgacatcatcgattggatgatggattaataaccatgggaggtgatttggccttcgctgcagcctcagaaattgtcaat

SEQ ID NO: 455 - DNA, 703 bp, Nannochloropsis_gaditana
acgaattatgagaaaaagcgatgggagcgggtacgtcataccttatgggggtatctgctggagaaaaggatctggcagtcctgccgcaccctcggtagatgcatccgctttcatggttgcttaccacccacttgtatgcgtacatcacaaattgggttgtggtatggtgtggtgcttcatcgtccgagtacactggatacagcagagcaatttagactacacaacatgacatcgagtttttgggcgcatgagcgcagccgtaggtccctttttgctcttactatatagaacgaattatgtagccaagaggtgttcttttatgaacttccatcatggacatgttgtaagttttcgaacaaaaatgttgtgatgtgtaagtgaagaaaataccacgcggccgtcccattcgcgataaacgcgtgcggtaccgcgtcataggatcgtaccatcacaccgccctattggccgaccgaccctaacagactgtctatgagtctattcttcggagacagtgcgcataagcgagcgcgttggctttgaaattcaaggcctcgtactcttgtttcctctttgagtcttgtagggatacagacgcgcgcggaaaagacctttaaatctcttttcgctcctctctttcacagtcaggaacgaaagcgttgtcgcacgattgatctggtcttgcctcacggaatgcatcgctatg

SEQ ID NO: 456 - DNA, 703 bp, Nannochloropsis_gaditana
ttggccctgagcaatgtggccggctttgtgcatgtaacgggtgaggagagggggggagggagggagagagggagggagggctggaggaagggcgggccgggacctgcgggcacacggagggagagggcagggacggattccctccctccctcccgccttcatgtgtcgcagggagtgggggaaggattttctggcaaggacctggagctcctcgctgggagggggcaagcaagagcctggatccgtcacggtccttagtccggaccctggctttcccctcggacggctgttgtcctgtttttcccccctccttcctgcctggcccgcgtccatgtctccgggtcgttttccccgggaggaatcccatacctgcccgcagtttttattttttccctgaacgatgtgtcaggggacgtccgtcctcgtctgtgtccttgtcgtctccccgtcatctctcccaggatgccctggatcacgcctcccgattctgacctttgcccacacactcatgtcctcttatgctttcctttctgtcattcctcggcatcacatacataggggtggatgtggaccggaagaaaattcgggtgttggcgccctgtccagggacgttgccgagccgttacctggtggtgggaagcatcgtttggatcgaggaagggagctgatttgtggaccgggatttggggtctcgtgagccatg

SEQ ID NO: 457 - DNA, 703 bp, Nannochloropsis_gaditana
tccgcgctttcccagactcgcatcaatggacattcaaccaaccggcaaccccgcttgtaaacgagaactcgacggtacttatcacaggcgtcgcgggattcattggattctccgtggcaaagttccttgctgagcacaccaaagcaaaggttgtggggatagataacttcaatgattactatgatgtcgcacttaaatataagagagcagacttgctgagtcactggaacacggtccaggtcttagatggcgacgtttgtgacgctcccttcttgcggagtattcttgaagatcaccatgtgactcatgtacttcatctagctgcgcaagcaggggtacggttttcattagagcagcccttaagctatgtccgaaacaacattcaatgttttgttacgctcctagaagagcttcgtcgattaaaaggaagctcgaacgatagtgtggttcctcgctttgtctacgcgtcctcttcgagtgtctatggcgggaatgtggaaatacctttcaaagagacagatcaggtggacaacccctctagtgtttacggcttctccaagcgagcgaacgagctcttagctcttgtgtatttcaaggtcttcggcattccatctgtcgggctcagattcttcactgtgtatggaccttgggggagacctgatatggcaccctacaagtttactgctagcatttccaaaggaga

SEQ ID NO: 458 - DNA, 703 bp, Nannochloropsis_gaditana
gaggaggaggaggaggaggaggtggagatggaggaggaggaggagaaaagcggttccgggccggtgtcggcggtggaggaggcggctttggaggaggtggtgatggacgtgggacctctagcggctctccccaggcgggggcgggagatgctcaggcccatcctgagggaattcgtgcgccacgtgacgcccgccctggtcccacggctcatgatccggctccgacactagggtgtggatcccgccctctccagtccatcgagagggtgggagggcctcggccgttccgggctggcccccgcaggactaggacggaggagggcagacggcgggggcgaggggagagcggaaagggaagtgccgggggagggagggattgaggggccggggtgtgggcgaatgcagaggagtggggacggcagaagggccggggaggggaaggttgtcgaggagggcgggaaatggggtgcggagggggaggcagggaaggaaaggtccccgactgcgagatggggtaggaagggaggtgcctaatgggtgcgcggggacctcgcaccgtgggcacgcctgtttgtctctctgccgacgtgggccgttaagcatgacacatacatagggcgacggttaaaatttaaataaaggtgtgcgaaaattcattaatcctcgtggagcggcgggtaagaggtttgaaggggggcggttg

SEQ ID NO: 459 - DNA, 703 bp, Nannochloropsis_gaditana
caccgtggtccatggacatgcttttcaccacaaaccactcgcatgtgggcttgtaaaacatacactgtggtgtgtccgcacggggtgatcaccaacgtagttcaccgtggaggtgcatttacagctaccacccccccatcaaagcctggtggagagaaagaaagaagcaaagggaagggctggacacgaccgcgcctgcggtggtcacctccgctgccgcagccacccactcttcggcatcacacactacattatttgccatcgtgtccgggtcaacacaacacgtgggcaccgcacgacacctccaacgcgtgacgggctcgatgaagggagggagtggtggatggcgagcgagcggcggggagcaggtcggaggatgaccacacgcacatgaccaaatggccaccggggggggggagatctcccatacaccccgtggccacggccaccagtctttttgtaaggcagaaagatggataccgggcaatgtcagggatggtttgtcgctaggtgcagcgggttattattttgtggcagacatggccgtgggcataatgtgccagccactcgctcctcgacgacgtactcctctacacgacgaaaaaccaggagtatcccgcctgccgatatccctcacaaccccctttttcctctcccgttccttgaccatcaccgtcatgcgcctaacgatacaccagctatg

SEQ ID NO: 460 - DNA, 703 bp, Nannochloropsis_gaditana
cgagtttcaattgaatctccccaagggcttgtcggtagagcgaacaatgatgcgtccgtccccgaagccctttacctctccagaaatcgttaaaaatgcggatggaacgactgcgatctactggctcaacattgcactcacaaaacgtaaagggggaaaacaccgcttgcgcgtcaaggtaaaagctgatgagtgtgcccctgagatgttggaggtggatgcctacgcttatgcagtaaatggtacagaggcgtcgtgcattacgccgctcgcccactcccaaatcgtaaaggtgcgctactcgaagtctaaaaaaaccgcgacgtgtgcgccgactccagctcctaccatcaatccggcgcagccatttgtactttttggtgagggacagcaattctctcaaggagcgcgccaggccccctttcaagaccgtcgtctttcggtgccctccccaatcgacatgcataaggatatcgcggccctgagccatcctcaagaccgacagctccagtcaatcgatacccccgatgcttgttatgaatattgctctctcaatgcgggagaagagacgcctttcttcttcagctggaataccgtgaccaaccagtgcttttgctgcgtggcggtgtgcacacccttcatcttcgatcctgattccagtgtgtatgaggtagtagtggcaaagacactgcaaccgacgatg

SEQ ID NO: 461 - DNA, 703 bp, Nannochloropsis_gaditana
catatagacttcggactattacgtctcagctatgagtctataccgcgagcgaacagcaaagttctacttggcgaaatcagtgaaacgattcaaaaaccctttcactcatgtgttgggtgctgtaatactggccctactaatatggcacctttatcgagggctgaaagtcaatatacttccagatcatgtccttccgagcaacagtgactggcaagtcgtcactctcaccgcaaaatcagagtcacagaataagtcatctcacatcttttgccatgggaactcgacgagctctgtacaatgcctccttgaaaatgttatattgagtaaaggtacaatttggcttttcggcgagaactcaacaatcaaggtaccttctatgctctgctcaacggtgaacaaagaatcttctcacgctgctacttgcaaggtgaatgtgatctcagacatcacttccgtcacaagcgaggagcttcaggaaaatgaaactgtctactttgattggggcatcaccttacatcgtttgaatccgacaaattcctaccataccctcttcgaggatatgattccaacgttggcaaggatgcatagaaatctgtatcctgataaagatgttactggtctaagcatagatactatgatgaagactgtaaaatggggggtgtttctaacagatacttttcctaatgacttgcttgacagcaaa

SEQ ID NO: 462 - DNA, 703 bp, Nannochloropsis_gaditana
gcccagggagccccccacggcattttgcacgcgcttcactgaggccgcgtccagaaaaactcccacaaagcccgccgtgtccttttcgcggtcgtctaatgcgtggtcaaaatatgtttgttgttgacttgatggtcgtcggagctgctgctggtgctgcgcggtctcacagcgcgtgggcttggagattgtggtgctgttgctgttgctgttgctcctcaccagagctgctacccccagccctaggccaacgcgggacgcaatccggaattggtgcgcgtacatcactccctcactgcctagagaggagggtttcaaatttcgttgacatgtacacaataagctggtgaagtggaaatagcctgtagacgacgggactgtccgcgtgcggtatatgcggcagggacgggggaaatcgtcctccccggcgaggggttgccttggtgaccgacatcccagcgagggacgccagcccttggcttaagtgcatgaattaacgggttatcagggtaaaggacacgcaaacgtgacaggcacaagaggacagtcctgcatcgcacttcttattaagtgggctgtgtatgccctcgccactccttcgtccccatccctttttacccaagaaacgctccccaacatcaccctggcgctctagcaagggagaaagcgtagccctcaagcaccattatccagcgtcgtcatg

SEQ ID NO: 463 - DNA, 703 bp, Nannochloropsis_gaditana
ggagggagggagggtggtttcaccggagatatggtggacgtgaccgtgacaactaccttacctctgtctccttcctcattccctcttgcccccccccctttaaattaatttaaattatttaactttacttttttaatgatgccaatcacagggagagatcgaccacgtcgcggaaatcctgcgcagccaccaggtcacctccctccctccctccctccctccccccccttcctccctccctccctcccttcctcctttcttgatgctccacctttttctcttgacaccttcattctaccgtctcctagggtgctgtcgactcgaacgaggtcgttgatctcctcctttcgttctgggcccgaatgggaggggaggggaggaagggagggagggaggggcgctggacaggtggagggagggatgggaggaagactggagggaggtcaagcaattgcttcgcgatatgcttttccgtctgaggcggatggaattgttggtttttgaattattaaaggtcaggacataatctccctcttttcctccctctttccctccctccctccctctttccctccctcccttctgccttgcttctctgtatgcccctgcgttgttcccatcccacccttgaactcctcctctttctcccattctttcctcaaatttcgtctattctttaggagggccgcctggtcgaggcatt

SEQ ID NO: 464 - DNA, 703 bp, Nannochloropsis_gaditana
tccctttgtatgtctctgctgatggactcgctttagcgcctttcatggtgcatgggtattagtccgtcgttgcctcttttttccagctctccgtttgaacggccttttaagatcattgtaacggctgtttgaccgtttcctaaggcaacgaaaaaacgggcttctcctcatgccgtcgcttggtgtggattgctctgtatagatcgtggtgtgacctgagcagtgtaaaaaggtgactcttgcctcccttggtgacgacgtttgcgttgaaagcctgacatgccatcggacgactgagagcatgtttgcaaaagctcggccgccatctgaaacaagtctttacgtaagctttggcgtgtatgattccgttgggggtcgccatacatacagaggagatgccgctaagtaagctcttgtcttacgaatcctttggcaactgtagtgctacctctgaacaagtatcaacctacgagtcgccacttaagtaggagccagcttgtcaaatgaattccagctttgtatccacacgacatcttggtaaaagtgtggcctcatatatatccatacagctactggatatgtgacagactgcccgtctttggagcttgcgcttgcttgctccggtacaagccgcacaaagaatcttccacatctaatcctgctctttcgattcgacaggaacttgaccaagcttaccatcatg

SEQ ID NO: 465 - DNA, 703 bp, Nannochloropsis_gaditana
atattggaaggtattgtcgtcaaccttactctaacggtcgatcagatttgcgaatttgcatcaaaatatcccgcgttgagcttttcatctacgctgcagcatgccggagctgcgttttcccctccttagaaaggcaacccggatgtaagcgtcatttcttccttgatgggatgcgtctgtctcccgagacacatttccatttgcgtttccattaccggactgcgatacgttgcaggtagacaggcgcagagtgtgtctcagcggttcttggacaggtcttggtgccattgcgcctgtccgtgtgtccgtcgcgtgattagtgattgaggcggcagcattaccatcagagtgccctgtggaatggaatggggggcttcatcgccccatccacaaagtccaacaacaaccttcacgacgctcactttcgtgccttacgcctcacaaaatcaggcatacatacatagatacataccgaatcctccataaagcgcgagtcaggggctcttaggcacaaggttgcttcacctaagtaagctttcctcatggccaataccatgttttttttaatctcttcaattcctgctttggtgtcttttgtccagaaaagaagaatgttcttgtatgatactctccgcgcctttaataccttcgcagcgttaattttcccttgcattgtccactcgcagtataagaaacgataatg

SEQ ID NO: 466 - DNA, 703 bp, Nannochloropsis_gaditana
tgcatgcattgacagtgatccttctccccgcatacaatgcgaaaatattttggcgagcagcccttcgcagagcaacgccccatgatgacgctggcaggcaatcacgagattgagtttgacaacacgactggcgtggccactggcttccaggcctacatcaaccggtaccgcatgccggaagtgcgtccgacagagatcaattgcccttttgaattcaccgatttctgcgcgccttccgtgtatttcagctgctatgattatggcaatgcttactactccttcgatgcggctacggtgcatgtcatcatgcttagcagctatacctacattaatgagtctacgccccagtacaactggctcgtcaaagacttggccagtgtcaatcgaaggaagacgccctgggtggtggtgatgacccactcccctatgtacaacagcaatcaggcccaccaaaatgaggtacgcattactaggggatgggtcgtctaagtgcttttcaagcaccttattgtgcgcatctctctcatatagaggattccaaccagcctttcttattttacgtcgccacccataggctcagtctatcgccatgaaagctgccatcgagcctttgttgatgcagtacaaggtgaacatcgtcatcgccggccacgtgcatgcctatgaacgcacctatccagtctaccagaacgttgttgattac

SEQ ID NO: 467 - DNA, 703 bp, Nannochloropsis_gaditana
attccactaatgtgtcgtctccatttgcttgctcgaatcgagtcatccttggagaaaaagctacaaattatgtgtaaatttcctttcttgtacattgtttgtaatatcatcagttgtgggacatggcacctgcgcgctcatgagaaaaaatgtggggaggcctatacgcacaaaagcaagtttgctcatgacgtgtcgatcgtgtagaagatccttttgcactttcggctcgctagttgcactagtctgagcgagatatgcctctccctaggctcttttgattaattgtaagcaatgatacaatggaggtaatgctttttgttggttaaaattttgaaaatgggccattcgcccatggttgcagataagtgaggtcctacacgtttgtttcataagcattccccccccaaaaaaataattttcgtcttcaaaaccagcaaaggtagaaattaagaagccaaatgtacatagtacatcttgaaagtcgaaccgcatcgtcaaagcacggaaaaagagactggatacggccttttttttttgtgtaggccgaccagcaggtcaacggcaacaacggcgcctgaaaccgttaccacacaggttctagctccatgcacactcttatatcgcgaggacgcaaaactatcgccctactaatcgatttctatatgcgtgctggttcattacatgtttattttgtagaccc

SEQ ID NO: 468 - DNA, 703 bp, Nannochloropsis_gaditana
gaaacatgctgtgaggaataggtttagtgaggaggtctccaacacttctcggccataaagcttttgtatctataagctgacatatgtactgagacaccatatcaccaatcgaaggggaaagcagaggtgtggtaacgccgagacaaaattaagagaaaatgtggtacgcgtctgtcctagctggcttccgggaaccttagatgcaaagatatcccccgagaatttccgaataccccgacgaccgaaccataaggtccatgtcacgaactcaataaagatgcacaccccgtgcagaagctatataaagcatcgcgcattcatgatactgaaccagtgcgaggtagtaaattgtccttttatttgccgatgtgctccttttcctttcgtgagtgaggcatgtttcttgctcaacattataggtcaaagcacctctttgcttgaaaagcgaagcaggagagtttctacttgcctctagaaaatctgcgctattcagtttttcgttgctgctctaatcatacaagatgtgtccttatccagatcctagagataatttctggcttctggtgtccgcatcggattcagtgacgtcacttggagtactacgggaagcatcattacttgaatcctcgatttgtgactttggatttcacagtcacgctacggacattgccaggtctctcctctccgttcttgatcttaaatg

SEQ ID NO: 469 - DNA, 703 bp, Nannochloropsis_gaditana
gtctacgacataaaagggacaagactgactaccccaccacatgcgtggttggtccaagcccgttgtaaaccaaaggcatgccaaccatcctttttcacagaaattcgacgctgccacactacctatttcacgtcctgccaaccgtcttgagcctttcgttcccctgcatcaccttcaaagggggaaggcaccatggtttttcgcttgaaatgtgtccaaggtctggtgtacggcaacgtcatggctcgctttttctgtttcgggttcgggggcaagcttcgcgccagaaagcatttggagataataaactcccccaaaacacgcaaggaaaccttaggccggcgtgtctagtgtggtcgatccgtccatatgtacgcatcattctcagaatgaggagaagtgacgtggatgagccttttgatggagattatatgcgcatgctttttttccttcacatgcacccccctcccgatttttccaaagtctttcttttttctcgaggccttttttcccctctctcaacgtcgatgctggacagaaggttcttaaatccttagatcttttcacacacaccgttgtagcaatgaatttttcgcacttggtgtcgaagagcttcatgtaaaggcatttataaccgggcacgggtagctgactctttgtaccaataacctccttcccacagcaacatcaagcttccataatg

SEQ ID NO: 470 - DNA, 703 bp, Nannochloropsis_gaditana
gcgattgacctcagccctgacctccaggaacgcagctgtcacggcgacgactgggggcccttcccccctccctccccccctccctaccttttcccaagtcctccatgcttccctccgtcgcgagagccggtcgcggggctggtgcgacgcgagcaagagctacgagcccctcaaacaggagcgaaaaatagcttcgttgcccaccgtgctcgcatgccacgcgggggtgacggtggggacaggcgcgggggtggcccgccggatttggcaccaattaaatcctttggggggaccttggttgccagaacgggtacgcattcgggcgggagggaagggggggagaaagaaaggagcggggggggggcaggtggtggtgtgggagcaggtggtggaccctgagcgcgggggggagggagggaaggagggaggagaggagggcgggggggagaaagtgaaggaggaattttgggtgggtacctcggatggaaaaacggtgaaatgggcagaagagctccaagatgtgggaacggaggagaaagaggtggtggagaaagagtacgagttggtgtcgctcgtctcctttgtgcaaggaagggggggggaggaaaagaaggggggcgggcgtgtcggggcgtctacggtgggaaagtccgatacgaatgtgactgaggggcatttactgttgcacgtgaaggtgccgatg

SEQ ID NO: 471 - DNA, 703 bp, Nannochloropsis_gaditana
tccctccttccctctctctctccctccctccctctttcccatttctttccccatcattgtttgggagccatcctttaattctttttcttgctcaaagttttcttcctcttcctttttcccgattccgcgtctcccttttctctcacctcttttctccattctttccctcttcctcacaccttccctcccttcctccctccctccactctcctttcgcaggacaaaaactggattaatggcaataccatttctcagtttcggcgcatgcatgacgctaacttccaggtcggcctcagtccctttgtttcgtgtttttctttcgtgttttcccccgcgatatctcacggcatccatcctcttcctcctccactcccctcatttccctccctcttcgtctcttcccttttcatcaggatataaagcttctagggccagacgagctcgtcgacattcgctacgccgatatcctcgccaaccccatggagactttgaggagcatttacgagaagctccatattgaccagtacgcctgctttatctcccgctggctttgcgtttcgctccttcctttcgtacctgatttcctttctctactctcacgctaccaccttcatggcctgctctcatactttctggattcatttcttctagtccccttccccgtaccctcttcataagctttgacgagaccttgcggcccgcc

SEQ ID NO: 472 - DNA, 703 bp, Nannochloropsis_gaditana
tcccgtcctcggcttccccccctccctctctccctccctccctccttccctccctccctccctgctgttggcaggcatggccgactcgacgagcgtcattgccatccggaacatcgccgcgggggaggagatcaccatcgactacgcgacggtcaacagcggcttaaatacctccgagggtgacaattttacctgccggtgcgtccgcttttctcatcctgccctgcctccctccctctctccatgcctacccccgtcctcctcttcggaagtttttatgaccttttcgcgtgtcccgagaggaccgcggcaccgcatacgccgtgctgcgttcctcagcctcttctttcccgctctccctgcctccttccctccctctcccccgccctccgcagctgtcaggcgcgtgattgtcggggattagtgaccagtcgagattggatgctcccgaaagtgcaagaaaagtgaggaatgcagcgggagagagggagggaatggagtgggaggaaaaaggggagacatcagcaaggggaggggggggtggaatccgtgaaatgtggagggccgtggcggcagtgagagaggagcacgtcgtttcggaaatgatttgtgcgtggaatatatctatatatatactggccttatcaatataccctccgtccttccccttctcttcctgtaggtactggccgcatttcccacc

SEQ ID NO: 473 - DNA, 703 bp, Nannochloropsis_gaditana
gccgcgggtgccttgtgcgggccgttcccgtgtcggacggagaggttggcggggagggagtgtcgggggggggggaggcaggagacagggaggaggaagcggaagggccccgtggcggcttggaggaggaggcggaggagtgggatagacccagcgcttttacccccagccccgccccttgctcctcctgacccccgccctccctccctccctctttctccccctcgtggaccaagacccgcaactttctctcctccgccgagtcacccaggcccaccggagaggttcccccgaattctcttgggaggttttcgggggcaatgtacttcaacaaatccacagagggttgcgccgagacttcgatcttctcctggactgcctgtggcaggaccgaggcgagaaggcgccaagcccctcccaccaggaacggcacgttcaccacgcagatgcggagaacccgacccgggtagtgggcgtgcatcaagtgggaggtggtccgcagcacctccagcacgtccggtgtgaggctggtcagtcccaggccccctatgtccagcacggtcatcgccctcccgtcgtcctccccctccccttcccgccggagcgcccggtacaaaaactcgttgaagtacacgtaatgccgaccaatctccgccgcgccgatcccccgctttcgcaaggcccccaggtccatccggcccgg

SEQ ID NO: 474 - DNA, 703 bp, Nannochloropsis_gaditana
aagtcccgtcctcgagccgtcctgttggtgaggctggtaccggagaggcagctctgccgtcatgatatgtaagattttggagtgttttagacaggggagaagtgtgtcattctcgaggcagtggttgaccgcaagtcacgatcccgcttggttgttgccggtggaggggggaggtaatgcgtcgtgccttttctcgtcgtggcaggaaaatgtccattgatggggcgacctcgctgtgaaggggaagtgatcgattaaaggcgtggtaagcatcagcagccgacggaacacaatggtggaggcgtgcaatacggacctcgcaaagaaaaatattaaccaaatgtgtcgcgtctcgttctcgcctcgctcgctcaactcaggctttgtagcagggggaggtgggtactcgtataccacgcaaacgcgggcgtcaacccgtcccttgatgtcatgctgtcgtccacacatgcccaacattgtttccttgaagcctccggctgtcccgagtgtgttgggtggatagttgtggagttccagccccccaaatccttagggcccgtctgccatgtgtgacggggaatgagaaagtgcttctccctcatgcccttcaactatctcccgcacacacagcaccaagcacccaagtaccctccgcgctcctgtaccgacgcacagttgtcggacgggtggcacgcatgatatg

SEQ ID NO: 475 - DNA, 703 bp, Nannochloropsis_gaditana
tatgcatcctcctcttcgctccccatccctccgttgcgaccttttttggcgggaccagtgcgtgtcgaagcccatcatcccacccgtctatatggcccctatgttttggggccccttcctcctcatcgggctcagggagcgggccagcaagcgtgcgtagcaactcggcaagcgctcggagatccccctccttgtgctcttcggcctccccctcctcctcctcctcctcctcctcctcctcagcgagctccatcccgccgaaatccaggaccgcgaagccaaccttcctttcatcctcctcctccacctcctctcacccaccttcgtctgccccaccttccccccccatcccctcgcggccccgcgtgcacataacacgggacgatatcctccctcccagcgcgggtacggccgccgaaggggcactatcagggcaagtggaggaggagaacaaggaggacgacgaggcagcgccaaacccatcacttgcatgtcctacgacgtggagggtgtggccgcgcttgcctctttcgtgccagcttcctctccctcgacctcttcccctcctcgacctgccgccgccccccccacgtcccgcttccattatttgggcggcaacgctgggcaattcctcaaatacttgcagcaggagctagggcaggcgaaggcggaggcaagtcaggtttcgcggcgggcggtgatg

SEQ ID NO: 476 - DNA, 703 bp, Nannochloropsis_gaditana
ttaaaaacaagacttccatcttctaaactttatcatgctggcgcagcagagagcttcttgatgtggagggtagttccgttactgtgccaccaaccgtataagatcgcctgctccacttaactctccgtcccatcttgcttttataagatcggtacacaatgccctcgtgatttcatgcataccgcactcactaccttcacgcttcagtgtagtgcatcatacgtagagggcctcgactctttgaaaggggcgtatggcatagtgagaacttatcatttcagggagaggggggattagttccgttcgtgcgacccgagagtgggattgcgtgtgggattctgttcgctccgaccggtgcgtcctgtattcccggtgaacgcatgcatctcatctcttttcgatggaatgcattgcaaagactttaaacgataggagctcccctggacgcttatctgctgtgcactgcgtcttgtcacagcacaacgtggcgctgaagattctgctctgaggggtgcagcctgacgaccctagattgggcccataccacaaagcgtgtaggagcggtactcgatgcccttgtacttctactcattcctcaccggccatcttcctttttcagtgtccttaagcatacgtggaactgagcatagtcatgctgtgcacaaaggtgaggacgaagccgcttttctttctagttggcatg

SEQ ID NO: 477 - DNA, 703 bp, Nannochloropsis_gaditana
atttggcgtttccacacgattaagagcggggggggggaggaggggaaaggaatacatgataaggactcctcggagctacttacctcgtaattttcggtcttggcacctggtgcacttgtttccatgcataaagcaggcaatgtcttacaggaaatccacacccgacaattttacagaacgtctcattgcgcccctcgcatggtccgcgtggtttcattggtcctttttttaagtttccccctcttgttcctctgttacgtcaccgtcttggcaacggctagctcgttcacgacctgaagaacaaccataacatttaaacacgctaggccaagcaaattcccttataccccctcgcattcccgttggtctggacacacttcatccttatcaatacactggcattgccacggggtgtccagcctcgtttttgttgtcattctctccggccgatgtcggcggactcgggggcactcctgggattaacccctgcatcatgatcctcgtccctcccccatattactaccacgcccgggcaactcacaactcctattttgcgcatgttctttctaagatagtgtcaggtgtacccgtgccgggttagaagtttggtgagggacgacttgatcgtttttgtccatcgctatttcccggcgcccacacaacgtgtaacccccctcactctttggggatcgaatcatcgatg

SEQ ID NO: 478 - DNA, 703 bp, Nannochloropsis_gaditana
tacacttcgctcgacacccttgttctaaaaggtgcgaagacattcttgctgcgaatttttgttccattttattgttcctatagccctctctttcgcgttccattgccatttcctcgtacctacccattcgagcacgtgtgaggcggtctcttcgtctcgtgagcatacccacaggttttaagaagcttcgactgatccctctcctggccttccacaactccatttcatcctctttccattgtgcgtgcttttgtcgtggggaatcgcgcattttcatcttcaaaggtcgggggaaccgggagggaactgaggtccgcatgacaggaggtggaacgaagaggagggagggtggagggaggggaagacaatacgaggagggtccaggtgcctggccagcgtggcagtagaggctcatcgtgaaattatgtatttactcacgttctttccctgtataaacaaagggaaaagggggaaaggattacaattttcgcagacgacggaagcctggttgatgtcgcatccgattaagatcgagaggggctagaatacgtcaagcgcattccgtgcgcccgtgaaccttcccattcaaacaaattagcgtcccacgcagaggcaccagcagcaagtaagcatggagaatgatcaaatgcacggttcgggtgatgcaagtctatgtaagggggcgtcacgacaggagccgatg

SEQ ID NO: 479 - DNA, 703 bp, Nannochloropsis_gaditana
cccctccttccctccctcccctccctcgtcttcctcccagcagctcttgttggactcggcgctgcatccggtacaagacatcgcacgccttctcctcctcccccagccagacccaggcgtccgcggccaggagaaggaaagggagtggcgcctctcccctcatcctttccaatcttgccttcaccgcctgcctcctccccaagcctcgcaaagccaagaaggaggaggtgaccacgtccatcatgctttccacctcttcctcctccccgccctccctcccgttctccccttcccctcccgtcaatcggtccgtcacctccaaaactgtcttccaggcccgcatccgacagagtgcgaccaagcccccggcgggagcgaaaaccttcgggatgagggaggacgccgctgctctcggcgaggaagtggtcggtgaggtgactgatgcggatggagggaggggaagacggggaaggagcggcggagaagaggggagacgggggtctaggaaaggtggacgtgcgggagtgggaaggcggaggagggggaggaggaggagggggaggaggaggaggaggaggaggaggagggagggggaggaggagcatgcgatagcggccattgaggtgggctttgatgtgatgacggcgaggacgaagaaggaagggaggagtaagacgatggagattgcggatcgcgaaggggg

SEQ ID NO: 480 - DNA, 703 bp, Nannochloropsis_gaditana
tgttgggtagggaaagactggtccgttctattgcctttttcccccaccctctggctgtcattgcctcccccgagacggaaagccggaagtgttttctttcttccctccctccctccctccctccctcccttgaagtcccgaaggaaacccccttcatggacgaatcctcgagattctcttcttccctccccttcctctactcaggtccccaaagaaaatgaaatgaaatcaaaccaaataaaaggacattcatgggaatatgtatatatatacacatacaccatttctcctcctcctccttcttctccttcagtttaacccggagccgaaccctcttcccctcctcccatcaggatcccaactcgacggccgcctggaatgcagtcgtcaaggggcggaagaagtggattctcttcccccccccatctggttcctcccggggtccacccgtctgcggacggtaggaagggaggaagggagagagggagggagggagggagggagggagggaggggaaaaggggggaaaggtagggtgcggaggaagaaaagacgatttgcagtgttgacggcgagtatacggttgggggggagcatcaggacgcctgaggcgcagagcggctcctttgtgatgaaaaatggatagttgttgcctgatgtcccccgatttttctgctctggttcaattgcctcacccaggtctg

SEQ ID NO: 481 - DNA, 703 bp, Nannochloropsis_gaditana
caatgtcacagcccccgggatcacggtacgtgggcatgggaagccgaatctctctgccaatatgctcaaatgccgtgcccgctttccctcctgatcatacacaggtggtagtgaacgtgattcccgacccctcggaccccctcttcgtgccgcccagcaattttgccctgggaaatcccccaacctacaagtccatcgccaccaatgccagcttcagtggagatatcaccgtctgcctatcctatctcccttccgccttcccggccggcacgcagcctcgtctctttcatttcaccaacaatgcctgggcggacgtgaccacaagcgtggaccccgtcgcgcagctggtgtgcggcatcgtcacctccctgagtcccttcgccctcggcaccgtcatatcgccgacctttttggcacaagcctacctgaagtccttagtgcaggctccgggtcgccggttcaccctcctcttggacctgctgttcttggagcggcctgtggaggacgtgatcgtctcggtgggtgaaaacaacatcaaggacggggtggaagacgcaggaaggccgcaaggcgaaagaagacctgagcgggggggatgaaaaggaaggaatggttcatagctctgtgtatgattccctcacaaccggacctcgcggctccattcccacacttgttcccctacagtgcctgctgggagggaatg

SEQ ID NO: 482 - DNA, 703 bp, Nannochloropsis_gaditana
aggaggagatcgaccaggacacgagcgaccagaagccgaccccgggcttttgcgcggcctatgacgcaacaaaaagaatgagtacgtgaggccaagacttattatgtgcaacatggacacacctccccgattatattgtcagtggaccgtcgatggccctcattgctctggtcaaggagcccttgatcctctatgcgtctacatactagggttactcgccacaaattccgccccggtgctgcaatcggtacgcgtagatccagggacaaaaaaaccagccgtccactcccgtcctacacccaaccctgcttcagcgtgcaacgcccatgcggccgccaaggcccgggcatcgcaggacccaatggcatgttaccgcgagatcgatagagggaccggaggcgtcgccgaggtcgccgagagcgtgagaagctcggaacggtcccctccttctccgtcttcctcccccatgtgccgtggcctcagagcggcttgtgccatgccgaggcaagcgtgcgctctgtgctacggtcagcatgacgataaatcaaggggggagatgctcttgctccagtggtagagaatgtgcgaccttggtagccttatactcccaactgccgggtttctatgctgaattcctctttgtaatatttcgtgcattcatgctcacaaaaactacagaagccgagccttctgaccaaaaatg

SEQ ID NO: 483 - DNA, 703 bp, Nannochloropsis_gaditana
gctatggccccacattgggaccgctacgacgccgcgttaccgtccaaataccacggatcccaccgatgtgttagaacatgccgtgatcaggcacaaaacgcgtgggaacaaagggccgcgacattgcaaatggcccaaatgtgggcaaaagctcttggcctcgcgaaagccactggaagcgacgcgcgacgcgagcgcattggccgaaggccatgtcacattcaacttcacacaaaaaccaaacgagatgctagggacgtgtccaaaccttctttatccgctcgcgggtatttgtgtctcgcgtagctcgtccagattgtcgcaagcatggctgttttatttgtgcagtctaacgcctttcccagtcgcagcccgttgctatctatacgtcccccacgcaagtgtcgtcgttcaccaagatcgacccattgattcttttacacacaggaaatcgaggcaattactgttggattcatcccttggatctctttggggtcggcgtcggagggcggcgttatggacgatgtggaacaagggataagggaaaggaggagcgcggctatggcttacaaagttgggagactggtggaaataaaagcgaaacacgcaggtatttatgaagcacgggaatcagggctcgatccgggctttggaggcaccgtcatacctcacacatgggacgtcattcaacgacacaggcttt

SEQ ID NO: 484 - DNA, 703 bp, Nannochloropsis_gaditana
tgtacgcgtcgaccagggtatggcatgcataatgtgcctgcgccatgcgtgtccgcggcttctctccatggacttcacaggaaagtgcaagtgggtctaaagtcgctcagcgactgcctcctcgctaggcttgacttgcattgcattgctttccatcgagtttctcatccccaccgaccagattgataaacacaagcaccacatcggctgcttacattctgcgttgctgagacttgatcgtggagtcaggagcacgccgctgttcctgttactttaactttttcaaagtcgtaattaatagcctaacgttttccttcacctacctgtcaccacaagcaagctatgttagagcgacgtcgtcctttttgacatttaaacaaccgggttagcgacgagcatacaaatgtttcttcaacatcggattatcacgatgcggaaaagcccttggcgtctctccatggccttggtcctcgtctttctacttatcctttgcgggtgcgaaaagctagtgacggctgaagtttcagcagggggccattccaggctggaaataaggccgcaggtaacaagtcgcgatagatatgcgattcagggagtgggaggattcgtgcacgcaccggggatgtcggacgaacgccgcctacgtcggatgcccttgtccacgtcgagacactcgcctggcccgcctcttccctcaacgatg

SEQ ID NO: 485 - DNA, 703 bp, Nannochloropsis_gaditana
catagtacgctctcattcttgcgcgtgcgcgacgtagcttgcgcctgggctgtgtgtctgtgtcctttgtggtctctgggggattgttgtcgaggcaccaggaggtcggagacggcgaggtagcggcgacttggtatgtaaggacgcgtataaattgctgtcagatccgggggggcgccattcctttgatgcgacgtggccatgcattggcatatgtcgtaatgtctggtgtttttgcgagagtcttggcctggtactcgcggaacgaaattggcaccaattgttttgataatggtgtgctgaagcacttcgacggggctgtctacactcggcttcagtcctgcatgtctcggaccaaagataacatcctccaaaccccaccgcttgtgtgaaacccaccggatggtctgattccctttgtaagacgtcggacgtatgagttgccggtgcgaatgtacggtattaccttgtccagacgatttacgtgctgaggagggtatccttgctgccttgcccgactgatgttctgtttacttcagcttgtcgcgcacgcttcacgtgttttaattcccatccctcgtacagcgcacacttcttagaaaactggcatcgttggtgagcgccttgctgggaaagtgtgagcactgggctctttagtctacctctgtgaaaaacacaggggccgagatcacgaggggggatg

SEQ ID NO: 486 - DNA, 703 bp, Nannochloropsis_gaditana
caccgggagagcactatgtcggtggacgaactgaggcgattgtatgccggagggaggggggcgacgcccctggaggaggaagaggaagaggagaaggaggaggaggaggaggaagaggaggagaaggaggagaaggaggaggaggagaaaggatatgagaaacaggactctgggctccacatgccaccgcgctcgaaggagaaggaggaaaaggaagaagcaagagggaaggaaagaggagcgaaagagggaggagagggggaggaagaggggagggagggaggaagcgaagccgcaggggagatatgcggatcgggatctggtttgaagcgattggaaggcgagggagtcgcagccaggggggaggaagggaaggagggaggggatgcggtgctgcagcggctggaggccatggaggagcgggcgcggtcggtggcggtggagcggcccttcctcctctctccggccctgaagctgagggagtaccagcacgcgggtctgaactggctcgtctctctctttgagcgccgcctaaacggtatcttggcagacgaaatggtgaggggggagggggagggagggaaagagggagggggaggtggagggattctctgtccttcggctggcactctcccacgcacactcacgtcacctctcccccactcttcttttcccctcccttcctccatccctcccaaagggt

SEQ ID NO: 487 - DNA, 703 bp, Nannochloropsis_gaditana
actcgctgattcgcaccaaggcttccagctggcggactgtgatgggaacggtggggctgttgccatcctgagggagggggagagggagggagggagggagggagggagggagacccaccagagggtggggggggcggagggaaggagaaggtcaagggagatgcgcgtcgcgatccgatggacaacgggctttctccaaagtgacaggaggaaaacaaaggggatcgatccacctacctcggactcgagggtgcgacggcgcacggtatcccgaatgcccacgtactcgctcgccagggtctgccctgcttcgacggaaaggcggggggcacagcgttgtcgacagtagctggggaaagaaggcaaggagggtgggtgaggggcaaagaaaggggttcagggttcgagaataaggggcttggtgatggaagcggacgagggagcggggagggcagaaggcggacgggaagggggcagaagggaggcacgcacctgacgaatttcttgatggtgggcatgtcaatatccccctccgccccctgcgtgacgcggatccccgccggcgcgttcgcgttcatgtggaccccgaggacgtgccgagcaatgcccctgtcccgttcttcgtcccgaatgtcccggacgatgaatatcaggtcgaagcgggaaaggatggtggtcatgaggtcgatgttctcagctgcgg

SEQ ID NO: 488 - DNA, 703 bp, Nannochloropsis_gaditana
tccctccctccctccctcccttactccctcccttccccttcccaggcggacatgccctcagggaagtggcgggaaagggagggcttcggtcacatcgcgggaggtagccagtggcacattgtgcactggactctgctgtacgaggtggttgttgatccccaggtgggcaaggagggagggagggcgggcgggagggcgggggagagggagggaggttgacgagaaatggaagcacgtcaaaggaaaaatttgctcggagaggatccaggaccagccctgcggtctggtcgcaaagacggtctggttcaaaaattcgaatttccgttgcttctccgttactccaggtccagaaactgttactctcgttgaagaccaccgggatccccgacgagtcctttttccccaccgccgggctctggttgcaggagaaagcgcaggtaggtgatatgatggaagaggtaccttcggggaagggcgatgacgtttgtccttcaccttggtgatgatggaagaggtacccaccatcgtgtaccgggggttgggtcggagcgcctccaaagcctttcataaccatcctcgttattctctgccaaacgcatgcacgcgctttccccgagtgggagggatgagatcccgtccttcccataccttctagacgtgtttcatcggtcttttctccctcccttgcccccccaggcccgcg

SEQ ID NO: 489 - DNA, 703 bp, Nannochloropsis_gaditana
ttgaccgtacccgcaggacgagtccgtcccgcacgttcccgtgtccctcgtccttccccccccccccccgcctctccgtttggttgcattattctgagacgatagcccttcctttcgatcgcgtcgggggcgtcggcgatctcatgcgtcaggttattccccaccttcgagccggcggttcctgtaaaaatttatgccccaagtgccacgtacacccgcacaggacgagcgaaaatagtttcctggtaacatgacattgggtgccgtggtcgcacggcgtggatcggtggggtggcgattgacacgtcgcaccatcctccccctcacctcccctccatttcagcacggggggagacaagtagtgaggcggccgctcacacttttaaatccagaaacaccacaagaattagcgtcaataccaccgcagcaccaggaagaaggcatcgggaaggctacatccccgcgacagaggaaacgcaggtcgagaaatctcgcgaggggcttctcgccgcttgctcccccgaagggagagatgcaatctcccctcggtgagtcccacgcccgtcggcacgagttacaccgcccacagcggccacaaaagcaaggaaaggcagggcaggaaggagagaaggcgcccggacaagctgttcgaccctggcatccgccaggtgtactgacgagctcggagggggaggagggaatg

SEQ ID NO: 490 - DNA, 703 bp, Nannochloropsis_gaditana
cggacgtgaccacaagcgtggaccccgttgcgcagctggtgtgcggcgtcgtctcctctctgagtcccttcgccctcggcactgtcacttatctggcacaagcctacttaaagtcctcagtgcgggctccgggtcgccggttcacccttctcttagatctgctgttcttggagcggcctatggaggacgtggtcgtctcggtgggtgaaaataacatcaaggacgtggtgaaaaatgcaggaaggccgcagggtgaaagaacacctgagcgggggggatgagaaggaaggaatggttcatagctctgtgtatgatttcctcacaaccggacctcgcggctccattcccacacttgttcgcctacagtgcctgctgggaggcaataccaccaccctccacgtccaaggaaacgcgacacggctccttcagggtcacagtacaaaggtgctcaagcgtgcccgactcggtgacgaggccctgagcttcaagcgcggaaaactccggcccaacacatggaggcccaagtacgtgcttgtcaatcgtccctgtgcctgtctcttatttattatatctcgtcctattatgtatcgtctcggttattgtccttcgattcctttgattctctttgagcgccaggcaggatcagatgcttgaatcgtcgggttctattgtcccttcgcatgacatgcacctggcaccctgg

SEQ ID NO: 491 - DNA, 703 bp, Nannochloropsis_gaditana
aaatgtggtgcggagtttggtaactgagaaagaggctcgcattcgggagggtatgcgaatgatggccttgacggactcggcactgtatgcgagctgggtgttccattttgctacgacctttaccatcatcgcggccctgatcgtgctggtggggggcaaactttttcagcattcggacaagggattggtgtttgcgttctttctgcttttcttctttgcaacgatggcgttcgcgttttggatgtcgacatttttcagcaagagcaagacggcggcgagcttgggcatcatgccttacttcgctggttattttctgacgatggccttgaagcctgcctcgggccgcagcgtgaagctactggcgtccttgcaccctgcagcggcgtttgcactgggtattagtgctttcactgagtatgaggacgcacagcaaggcgtgacgctgttcacatttgcaacctccgcgaacgggaactttgctttctcggatgcgttaggcatgctactggtggacgtctttgtgtacgcttttctgttttggtattttgagaaggtttggccgaacgagtttggaacgcgtttgccaccgtattttttgtgtatgccatcatactggaactcttgccttggtattggtagaggcgaggtaaggcccttacacgagggaataagcaactcttccggagagctaaagcaagaatcg

SEQ ID NO: 492 - DNA, 703 bp, Nannochloropsis_gaditana
ccgccttccttccctacctcccttcctccacttatttccccccaaggcttcaagctgttctgccacaagcgttgcaaggccctctttgaagacgtgaagagcaagatcccgcccaccatggtcaacttcttctcccactttgacgaggcctacgacctgggcgagttcccgaaccggcatcctttgcgcctgctcagcgtgcgcatagatggcgtccccgtggaggacttgccatgcatcgacgtctggaacgcggacagtgtcaaggtacaggaccgggggggaggagcccggggtcgacaggggcggtgctgtcatgcgtctcggggggggggggggaggagggacagaggtgtggacgaggatggtacggcggggaacccgttgagaacagccccaaaaaagccctcccacgcggattgaccccccagcatgcctccccctttccctttgtctcctccgtccaggtgtattcctccctgaccgcccccgccgcgagcaagtcctgggaggaggagacgggtctctatcgggaggtggaggcccgtctcttgggggacttcgtcctgatcggccgtttcggcggcaagtacggccacgacgagcacgatgcgagcaagatcctcttccgctacgtggggcacacggcgtttttgacggaaggcgtggtggagcttcggaaggatgcctttgatatcatgca

SEQ ID NO: 493 - DNA, 703 bp, Nannochloropsis_gaditana
ccttctcggacttggagcgcttcgaagccgcctacgggaatctccaggacgaatcttctttaacttccctccaagaagccatccgcccgtacctgctccggcgcatgaaggaagacgtggagaagggtcttccccccaaggaggagaccatcatcgacgtggagctcacgggcgtgcaaaaacaatattacaggtattccctctctccctcgacggcaactcacattgagtcctcctcctcctcctcaccccttcccgccctgtccctccctccctccctccctccctccctccctccttccctccctccctcccatcctcccctctccctcccgtccagggcaatctacgagaagaacgtggaattcctcctggggggccggaaggccgtcgacgggcccagcctgatgaacctgtgcatggagctccgaaagtgctgcaaccaccctttcttgaacaagggagtggagctggacatccggagccacgcagaggccacgggcaaagtctacacctctgacgcggacctgctggtgcaatacaggtgagctgcctgcttgtgggtggggggccttctgccactttgacgtgtacatgcctcggttgctcgacgtgcactcgcatggatctaggaatgcgcaaggaaaaacgaccacagggacggccttgtacgatcctaggattatgacgatcacgactgata

SEQ ID NO: 494 - DNA, 703 bp, Nannochloropsis_gaditana
caagggcgccatcgacgcggccctggccaaggaaggggagggagaggctacggcagtccgtgggacggcaagagtggcgccgcctcgaatcattatagcgggggctcctgcctcgggcaaggggacgcagtgcgagatgctacaacagaggtaggcccgttcagcaggcgtcctatcccgcgctgcacactaagctgcctcgtgcatagatacaaaataaaatgaaataatattttcttggtgacatgcgctccggatgagcctgagggcgggtagtgggggctgtgggaggcctcgggaccccacggagcccggtatgcctgtcccagagacgtgcgggcgagaggcgcctcgagtggcctgtgcctccttctatgctcatctctatctgctttctctccccttctctgcccgccttcttcacttcttttttccttcccttcaggtacggcgtggtccacctctccacgggggacatcctgagggcggcggtgcgggacgggacgccgctgggcgcggaggcgaagggcttcatggacagaggggagctggtgccggacgagacgatctgtggcgtgatcttggaccggctcaaagagaaggactgccaggagaggggctggttgctcgacggcttcccgcgaaccaaggctcaggcggaggctctggggatgctcccagatgccttcgtcctcctgaacgt

SEQ ID NO: 495 - DNA, 671 bp, Nannochloropsis_gaditana
catcagcacgtcaaacgcgctccgcgatgccgagaaggttgcggatgcggtgaagcacgctgtgtcgagcggggtcaagtacgtggactgctcatcggattcccagaacgagaagcaaatcggcaacgcactttcggcatttgatcgggcgtccttctacgtggggtccaagctgtcgtgctgcgacgccgcgcccgaggacgtgaccgaagcgtgcaagagatcgattaccgagcttggcgtgtcttacctagacaactacatgatgcactggcctgtgcagttgaagagcgattcgaaaccagtgtcattggatggtggggacacaaatgagcttgtccaggacggcgatatggactgcatcatggcaacttacgaggccatggagcgccttgtggaccagggccttgtgcgctcgcttggcgtgtctaacatgggcatacgaactttgagcgagctgctgtctcgatgccgcatccgcccaacggtgctcgaggtcgagatgcacccgtacctggctcagccaaagctgctcgagttttgtcgcgaggagaacatccatgtggtggctaattcgccgcccggcaagatgagggacggatatccagatgactactcgctgctcgatgatcctgtcttgctccgcatcgccgaggaaagtggccgctcgg

SEQ ID NO: 496 - DNA, 703 bp, Nannochloropsis_gaditana
gaccgaaaaccgtaacgtcgaaggcggtaaaggaaaaagacggcaggtagcatcactcctagtaggaggggccacggccgtcgtgacctccccccaggccccatggaggtgccacacagagccagagtccagctggaaaagacaaaggaaacagtggaaaagcgctctgattacttgacacgactagcgagcgagtaagtaattggaaagaatgagagctccgggcaccttgaggctattttcgaccgccccccgctgcttcaagcgttcatggcttgaggggcttctagccggaagtctcgttcgttccacgccccgcattgagaggggctatacccacgctttccgatcctgttctctcatgcacaatcacaaaattggcagattgccgttgcaccttccatccatgctgtcgccgcggtgatatatcacagatcgtggaggggcgctctatcattagccgacacaaccccctctccacttcggagggcaacaacaatagcattgaccgggtgataaacaggctcgcgttgaccggggtacacgatccaaatgaggtttgggcatgcatcgtacgtctgtggagggtccttacaacgcaatcacgatttcgtccggctcttgcctcttatctaatgtctccctcgcaacccctatggctaggtcggccgtgttgcctcatcaaagacggataccctgtggc

SEQ ID NO: 497 - DNA, 703 bp, Nannochloropsis_gaditana
gaagagttgaagtaaaattcatctgtaagtacaggactgcgggccgcttaatcttcatccatcatgacaacttctgcggcttcctctgcgaccaacgcacgcgaaactccctgtcatactcaaaaacgtgttaggacgagcctcattgtagggggcgtgcccaattgaagttattgcagaaaggttatcctatgatagggccgagcaagagctgggaggaagcgatgggagcaagtgcgatggcatcactgtgcaatctgcgaactccgaccgacaagcttgggatgtcaattggacataggtgcgatgtgaagaagaatcggacgcaacaaaaaggccgcgccgtgccgatggaccagggcccgtaaaggcggccactgccgggtcgtggggtcgtagataccccggcgggggcgggaaagtcaagacctgaggcttgaagatattcgagaagcgccgcgcaggagcacacattggctcgaaccacaattttatttgcacgcacatgcacttagtaagatgaactcaagactttgggtccctctgttcacgggcctgggcattttggcctctgtcgctcagtaccacaacaagaagatcatacatcataagcgcgccaagctgtaacacccgccataataccctcaccacccacttcccctcaaaaaaggactcggttctaatcaaccgacgctgtgtcatg

SEQ ID NO: 498 - DNA, 703 bp, Nannochloropsis_gaditana
agtttaagaaaatttgtcccgcgatgtccgttcggaagaaggttaagagacgatactctactcgacagacaaatacttcgacagcaatctctcctgctcgtctcacgttgccaaaaccgccagtccattctaacgtcatgctctacgtctgcgatatgatctgcctgaaggggcgcgctggtggtgatatggtctctttgaagccatgtttaatacaactaggattatctgggataatagcgattcacatcgctagcccgcccgtgcaagcaagaaagcttgtgacccagcagggcgttcacacgaaatcgtggcaatcacggatattgaaatttaaatgctacatgcgtgcacttttataccctttagacctcttatagaggacggcgacatcagccatctttccccgacagcgctcgcttgctcgctcaagtctgggaattgaggcatttcttaaagcgttgtcgtctctctcgctgatagaccccggtgggagcctcggtctcgtcatcacccccagggcactgacacgaccgcgccaaagacgggaagcatactggtttataatggcgtgttcctttatatccaagcgaccagaccgtcgtgggtgtgtcgagcgtgtggggctgaactcgcccacagaaatttattttatcaattgttccgactccggccctcactcctcgtccttcacaggtcaatg

SEQ ID NO: 499 - DNA, 703 bp, Nannochloropsis_gaditana
gataagttgatagtgtttccagcttggcaatcggacagaccaccctctaggatggggaggaggaggtggaggaggtcttgctttgccctgttctctatccaaatgtagtgggcacgcgcctgctgcactggtacactcctgcgtaaagtaaggctcgcactttattgcaggaggggaaagattgtgtgtcaatacgtgtgacagccaggaaggcagggtaggagcgacgggctctgccgttccgacaacagagatggcacgagtggtcagacccgcctgaacgcgacgcgacgccacctcgagctccaaataccaaagcacgagacagtgctagagcattttttcatgcaatagatgagacatgtgcccccgacggtgtctgggacacgggcacgtgacacgtcgcgtgacgggcgagtgtatcctggcagatccagcggggcgccccaccatgctcggcctccatcacgcacatcgcccatgttactttcccgtttcgccactgcctcgctgcgaccgggggaggctactaggcaggacatgcttctgacacaaccatttcatgtataggaaagggcgagaaagcctatgtttgcaagatttcacctccccggccaccacgccaagtccgcaagatccaaagccaaggaagtaaatggcaacggaagtcacacacagcttccgacatcatctagtcaagatg

SEQ ID NO: 500 - DNA, 703 bp, Nannochloropsis_gaditana
cagtcatgcgacgtcctgctgagctcggctagcaaagagccgaggcaggctaggacatggcgtgtaaggcgcttacgaacatgagcgacgcggcggggcgctagaggatgaggatcaggggcgagggcggggcgtgggcgaggaggaagggatcgtccgtggactgcccgagctcgcccacctggttggcgctctaagatacgctggtctcgcaggtgtggattatcgggtcaatccagactgaacgaaggtcgtcgcaccgacaacatggtctggagatttagaagctatcgcatcggatgcaccggactcttgtggagaagacaggcttacccatccctctatcgttcctgtgcgtcactgtgtattgtctgtgagtggtgtcagaaatctgctgggcctcggccggttcgacctcatgatatttgagccttgcacaccaggtgcatagcggggtgttttttaattgcttattgacagtgatttcagtgtggccccaattttgtgcgggcaggaggcggtcgacgaatggtgcacgagtgatggatgagcaagagttatgacgaaagctcacttgggaaactacaagaggcacatcatgtcgatcgatgttttgcatatttcactttcttaagttgctaaaatgcctcttgattattcccgggacgggcgaattaatacagcttggcaacgcgcaagtatg

SEQ ID NO: 501 - DNA, 703 bp, Nannochloropsis_gaditana
tgtttactttcaaccatcctttccctggaagctgctattacgttgatgggaatgcgtcgcctgtcggctgaaaaaatggttgtacaataatcgatggaacgcacgacatggctctcgcaattttactacggccggctgagaacatgacgcggcgattggagacatcatgctttagcgttgagaccccaaggcgaacgacagaagaaggtcccatgaaaatcatgccaataaggtggcgtggcagagttacattgccgttttatttgaccatctcacgctcctggataaatgtgcgcggcagacagtccttcctcttggggcggtgacgtatgcgagcggctcagcgagtcgccgcttagagtctcgacccgccgtgccccgctggagcccctttgtccctctcactgcctccaatgccgatgctcacaggctccactgcgatctcaagaatcagggggctgcctcgcaaggtgttgcttactcgtagagtctcttctttcaaaagtccccgtcctggccggtaaaatgcgggctctagtgcgggccccccgcatatcgcctgctgtgaagcagtcagcatatttagcccctgctcttccaacattttggcggatagaaagtattttcacggcatatgcgaccaaaaacctatcctcctccccccgccttgaccggctacgtgaaaaattgaaagaggaggatg

SEQ ID NO: 502 - DNA, 703 bp, Nannochloropsis_gaditana
agcatcgccccgaaatccgtatcgtcacagcgcgaggctggagatgcgctatttgcgacaatttcttgcgttatccgcattcctttttcaaaaagagtaggtctttgtgctcttgagtcgattccttttttctgattgctttacattctttatcactttttacttcctctttctagagcagacgtttgttccaaggccaagatgaagacaagattagcggcgcggcggtcgtcacctctaagacacatacgcctgatatttcctatcctaattattttcgacctgcagattgcggatactgttagcgggtttgttcttttaaagccccccccccaatcacattctagttacctgcggccctcaacctcttcaaaggttccaccgcgtcaaccgtgtgttgcgcaagccatacgctccatcaatcttcgtggtatcgcaatattctcattaggtcttaattcttacattgtcccgggccctgacaactctcaagacctgcgggaattcgatattccccagacggtgacggagcctctcccccttccacaagctgtctacgtctttggtggctacaccagcaagtccaaggctcgtaaactcatccgcaagggacaggttcttgtcaatgacgagcctggaaaaacttgtgaggctatcgtggaaaaaggtgatagaattaaagtcgtagctcaggagacaaatg

SEQ ID NO: 503 - DNA, 703 bp, Nannochloropsis_gaditana
aagcaataatgcgctgtttcaaagtttgcaacacggtgccaaagttccattatagccggaaagctatactatgatcaacctggagcttgcaagatgatgtctagctctgcaggtcaggtcttattcccccgtatctttccttttcctcttcttaccatacacggtggataacgcgctcgcgacgatagataggaggagcactttcatatttggctcgacagccaggcctaagaatgaaagtagaacttgcagatgagtcaaagaactcagatcgcggcagcacgcgcagtgcgggtcgacttggtttccgccacgacaggcgagccccaggcgccctccctcttggagcccgcactcaccagtaatccatcacgacaggagcagtgccggtgacttccacccttccccccacaacgaaattactcctaatttcagtgtccgtacgtgaaggcgtcgtccagcgcaaatagacaaagaggctggctatcgtgtactgtggaacgaagcacaggggtcggattatcatcgcaggcggcgaaggggaggaagaatttctcatgtgatatttgtctgttttaaagaactattgacgcaaaaaatcctgtaacaaataggatttgtgtcgatatggaggcgcacacggaatcaaaagcgttcggacagctgaaacacaattaagaaggccgacatttgaaaaaacatg

SEQ ID NO: 504 - DNA, 703 bp, Nannochloropsis_gaditana
taaaagcgtggttcagaggcctgtctgtctcacggagagtccggctcctccaagtggtcgaaccagccttcctgcacctcctcctcctccttcacagtaaggcactcgcccttcctccgcgacaaggccgtcggcccagtatggttaagttctatatttttgcagagtctgtccccgcgctcgccacacgctctatttcggggaggcctagccgctctaatgcgtggtacgtcctattgtatctacctgacatgtgtttggtacgaaagattatattcatcacttttctataaacacaagtgcacgtagttcaatgaagcatggcgttcgagaagctgcggactgctttcgccttcgggaagagccattcatggtgcggccggacgagagccgacggagcgcgtggggcgaccccgtgcgtgtgggtacgagagtgaggacgtggcgggcttgggagaccttggcggcgagtttgcggttgtttcggccatcatccacgcaaatgtctcaaagggatcaacagtggcaggagcccgtatcccgggtcgcgggcttcttctcgagagacctggtgctggatgtggacgagtttttccaagttctggaagatgcgtccgatggaggcttcctccgaggaggtttgacgaagatagaggccacaggcgaaatattcggagaggccgcttggtttcgctgcaaagga

SEQ ID NO: 505 - DNA, 703 bp, Nannochloropsis_gaditana
tgcgacctgaggagtcgcgccggcgatcccgggtatagtcccgctaatgtcttccaggcaagggtcgagcgcgaggactccaagcacttcctcagttgcaggggcaagcgttgtcgatggttctagagccttcgtctgacaaccctctggatatcatttcgcacagcatccgcagcctgcgagtccgtcgcgggaactaccgagcgacgtcttcaacagagcccgggtctctttacccacctcagacaagcatgggagacgacgcgaacgaaagcaaaaaagaagtaagtaaatcatttagtctctcagatggtatgtagattgattaaataccagggtgggtgcgaatatcaaagacatctttccagcctccggacagtcatgtcaagttagaggaccttcccgtaaaatatctcgctacatttcgaaggtgaaacacgcatcggacgagtatgatgttgtttttgtgaaaaattactatcacgaaagggctctgggccaatgcgttttgtggcggttcatgcgactttggtgatgttggggtatacggcctcaggacaagagtcgtcttcgggctttatcactgacaattaactcagcggtgtaaagcttcttttcggacgtacctaattaaacgccatttgtcttattcaatgtctactagatctacaattacgagacgagctggctcatctttgcaatg

SEQ ID NO: 506 - DNA, 703 bp, Nannochloropsis_gaditana
aactagccctaaggcgcaaggcgggggggggttcctgtcgctggcgagaaccgggggcagtatcttccatgtaaactccaggggggttatgccacacatttgaccagctcgtcagagtcgaggttttaggttgtctcacatttggttcttctcattgcgtgtgttagggaaatccgctagctattttcgagcctctgactttttgaccggtcccatcacggttttcccaccacgctaggagcttgtggacgtcggtgacgggatgagaagggtgtcgcctctacttggatgggtgcttgcacaaagtcggcaatggactggttcggcagcatttgtgtcgtcacttcgagccttggtgtcatacccgcgtgtttgcttgagacctgtcgtccctcatgctgctgtcagctcgacatgtctcaggagacgaagcacgacgacgagctcaacggtgatggcggcgtttgaggcagacaaaagcacagtttcatccggcaccggcaccccaccaacagtggcaacgatcagttccatatctcccttcataaataggcacgatgttaccgtggaggtacactccggtcgaggtccttctctgcagcgattgcgcgttcacgtcctgcccctggaatcggacaagttggaggtactcttatcacaagtttacgaccgtgtggctcaaaggggtggaattgtgggtatg

SEQ ID NO: 507 - DNA, 703 bp, Nannochloropsis_gaditana
ggcctgtggacgcgtgacttagaaattttcttttgatggaagctggataccatctcacctcctctgccaggggcagttgttgacgctttttccccttgcccatcgcgatagtcctgcgtgatgctcttcaaaaagggtggatatcagatcgtcacgtgaatgctcgcactcaagcgctccgaaaaagactcgcacggggttacccacacgtgtggtgggccgcggactggagaaggccaggcggggtcgtgtcgtgtgaggttgacgttgggtaggaggggaacctctcaccagtgccaagattgttcttcacctcacattccccgtatgcactgtgggtcgagtgtccacaaaagccgtcatgaactggtaataggcatacctcggccggatggctggctggccgccgtcctggtgcccccaggattccttggcgtcgccagcgatgctcggatgggaacttatcgtgcccgccccttgcgcgtgcgactgatgttgacgggtcatctcacgatcctagtgtcgatcgtgcacaccctcattgccatgttatgccccgttccactcttatcggcatcgtttgtcgtattctcgttgttatcttgtgaacaagcggttccttttacgtcacagccctgccaggtgcatcttaagcaacccctctgatccaggcccatgtcttctcacttctcatcggctccca

SEQ ID NO: 508 - DNA, 703 bp, Nannochloropsis_gaditana
actgggcggaacgggaggaatggaacgtagggtgttttgcagctcatttagcaaagcttcctcagccttgagctccttggccagcttgaggtatctatttcgacgccactcctgatcatccgatttcaaggttacgtttgcaaactcctgcagtacttgctgcgcctttcggtgaagttggatggccgcctcgtactgggaaagcaagccgtgttcccgggcttggcgaagcaacagcggaagttttttcactgccgaaggaatcgagggcagagtggctgccgccttaattgttgcactagcattttcagcggtatttgtacttgattgaagggtatttgagccaggaaggcttgatttattcgcagcatcggccatcgctacttcgtgcctccttccttaacttgctctgatgagaacgtgaaggacaagaaaagaacgaaattagtgtcgaatgcatctggcgtgctcggcttgtacttttccccctgaaaatgtgcagcgaaagacaattcaaagcgtatgcctggagatgggcggtccgcccatggagtcgcgggcttgctcatggtggaacatcgagccacttttggcgaccctcccgcctcatcccttctgatggatggggcctcgcgttgccgccagtcaggggtcttactcacgcatcctctctggcacagtgggcctgcataaatttggaatg

SEQ ID NO: 509 - DNA, 703 bp, Nannochloropsis_gaditana
acatcgcctgtttgtatttatcatagtaatggtacgcaacatgtacatatgatgtgtgagtttcgtcctcttcaaagaagaagcttttagccggcctgccaagctcccgcccggcccgctgtcgcctctgccagagcaggtagactcgactgttggccatcaaattaccctcctgattttgtgtcactgtcatttttaacagttttcgcgcgatatactgttgtgcaaagctgaatggatatagacatattttatccaacgtacgttcaaagcaccgtgcactgcgagaacttcagtcatttccaatctgcctcctaatcctagctgttgcgggaactttaattatacgcgtcccaagcttcagagacgaatggtgcttgatagatagcttgatccttttccagcattttttaattcacattcttcatgtgcatcttgcagattatgtaaaacgtagtattcgattgtaagattatctctctcgggtgaaccttgcgacttgaaggcaactgcgactcagtatttcctaaacaactcatacatcctgcaggaacagatgttttcatgcgaaaataagatagcatcaattgtacttctattagcatgttttatcacttgcgtggcttacatgcctgtaccccttttccgaagaagtttcttctcctcttcatacggtttcccttcacctgctctgcatggtatg

SEQ ID NO: 510 - DNA, 703 bp, Nannochloropsis_gaditana
aggatgtgtgccgcctccgtgagatcgtaattcttggtggtagttgacgtgggatgagtgtagactacttgaagtcgagttggtacgttgtcagtgttagcattggacacaaaacgtgcctgcagcttttgtatcacaggataggcgctgtcctcggagggagccgggtaattagtgagtttgaagcggacaaattttgatggctcctggatgaggctctcggtcagcttggaagccaacctttcgtgtggtgtggttacgacacattgcaatgtgtctcttcttttcgacgacggccttgtcgaagttgcgacgcggggagcggcagggtaatgggctgtgtaggcgaagcataggaccgtggaatgaagaaccaaagtgacaagcaaagcaacgctgctcgatcgacggggcatccctctgaaaggctgtgtcgtgacgagggcgggaggggagtgcgggtggtagggtctgaggtgcgaaaagccgcgtgcaagtgaagccgtgctagcgatgccagcgaggagacaggcccgaggaggctgctccccgccacctctgtgagtgacgttccatttcgtatgaaacactcgtccgatcttcttttctcgttagcaggaaagttcatccattcacaagggtgggctgaggttgttgggggatccgtttttgcttcgtcgtcaaaaactacgatacagtcatg

SEQ ID NO: 511 - DNA, 703 bp, Nannochloropsis_gaditana
ctttatctggcacaaagttagtaagggagcaaggtaagcaaatagaggtatacttcaagaaaatgacagagaatgtcacgggaaggtggatggagtttttaaagttttgaaaggaatcaaaaataggatggcttggctcggtagaagtatgagcccggtcataaggcttcgttcgttcgtcgtggaagtagcctttccgacgcacgacatgagctgggatgttacaaagataatcataaaactcaatgaaagctcatcatgaggtgacatagactgcgtactatatatgaatatggaattattacaatgcatttgtgcccctcagtcatacatttgcatacgcatcgcttgtgttttgcaatacgaaactgattcttcaggtgtcccatatttttcgaattcattccgcttaaaggcgacccagtttttccagtccctcgcatatttccaaggatcattgattgttttttattttttaaggtagaggtatgtgcataaaatttgtttacacgccttcgagatttgtgactcctaacggccgttgagccgttgggcgagcgaagaggaggaggtaggcaagggcatcatcactttgtcgtcagtcaggctacactcggaaggccttccatcacaaatgttgtcaaagtttcttttctccaaattatgccttctcagataaagagtccgcacagatcacgtaatg

SEQ ID NO: 512 - DNA, 703 bp, Nannochloropsis_gaditana
acctgtgatcgtttgcttgttgcttgtgctactggtgagtgagagagggagaggacgcttggctccgcgaccgcttgggaaaaccgaggaggagggcatctgggtaggaaattgtcggtgtggaaaaattgggacctcgaattaaaaaaatatgatttgagggaaattaaaaggcataaagttggagggaagggatcttcgagtcgttcctccctacccgcttgtcttgttcctgctcgcttacaagtgttggcgacaaccagagtacggacctgtatgtgaatacacaaaacgagcacttacccatttcctcacatgcaaataggcaaacaaaaagtaatacattgaaagcacgtgtttctcttttgctcgctgtcttcctgtcatccacgcctcgcatctctttccctcagctctggccacccgagctaattgctacgcgggacctcaactacgcgcgacaaaggttggtttacgtaacctgtgcttccaatagcaggcactttcgcaaaaaaatatgggtggcgaaccgtcaaaaattttgcatgactctttgcgccgggacaatgatggtgaccagacacgatcccgtccaagtttactccacgggggggcgaacgtgctgcaagatgccgagtttttcgcatcgaatggtgtaacatgtgcattaagcatttgtcaagccagacctccagcgagcatg

SEQ ID NO: 513 - DNA, 703 bp, Nannochloropsis_gaditana
tcttgtctggtaagtgacgcacgggaaaggacaatccatgtcgtcccgagcccggatcgtgaaagaccgctcaacgccctactattaggggccttcaagctcgtgaattgggccgaagatgcctggcttgctaccttaccaagatcagggtgacttgtagcaagaattatggccgcatttgatataaaaatcaaataggaagcatgttgtcatagagatgggcaaagcacgttgataacagccagacggagattggagtactaggtaaacattctcttcgcgtccactagggacggaaaattttgcgcttatgaagcgttagggatgtgcgacgtcaaaagtcttcttgttactgattataacatgcttgaatcgcggcaccagccgacgtgcaaatcgcacactctcacagggaaggcaacagcggcctgggtcgcgagggcgacctaagggcagcccgacgctgtaccctcaaaagccgtccttctccctcattcatgctcccccccgacccgggtttatgagtttatgagcaagcacacatccactacatcccttgcttaccagagcgtgcaaaccgactcccacatctgccctacagagcttcgctaacaactacaagtgtacgagtgacggcggtcggcgagtacattcagcccaccttcctactttgtcattcgctcatttctaccaagagactatg

SEQ ID NO: 514 - DNA, 703 bp, Nannochloropsis_gaditana
ttcatcctccgcgtcgtccacgccaggtccacctctcctaccggtcttcctgatggcgatctctcgataccaaagtggtgctggtttctccggacaagctgttacgatttcggcctgccctagttctgtgtgtggtaaattcctcaattgtgacgaatcactttcgaaaaagcaggatagaagagacgaaaaaaggaaagggataaggcggaggacaggcgtcgaaacacgtacataccggtgaaagatgtggcaaagtggcagacgcggcagatgattgggtcctcatctggaaggtcaagcaaggcatgacactctgaacaaaaaggcacagcgccacccgtagccatcaaaaaccttggggtcgatgagtctggagtgagagcaatgtttgggggaggttaagagtgatgggctgagaaatacgcctgacaacgaggcatttgtgtatgacaaaaaatgttagcttgtaccgccgacaacagttgtatgctagccaagattcgtatggccacaagatcgtgaacctaaaaatagcttatgaggacagcatgcgtcgctaggggtgcatgctctcgtcctctaacgagcgagtcgagcgtctgtatctctcttgcagtgttccctaaattcattacgtcgcattaccctcctatgggaaactgaatgagagccttttgcaacaggtacccagctaactatg

SEQ ID NO: 515 - DNA, 703 bp, Nannochloropsis_gaditana
aacaggatgagatggggcattctttccttccctccttctcgaaacttcaaaatccagccctgagtgccaagcactaaaagcaataaatcaatcattacgtgatccagaaaagtgtgcgagggattgggccctctggcagtatttcaaggacttggcactcaccatgtctgtctgactaggtagtggatggagtgggggaggtctggctagtacgtggtttttcctgctgggtgaaacaacttgaaattgtacgcgttttaaaaaacatgaggacgatgtgataccgtgggtccggtttttgtgcacacgtgcaacaccgctcacatgcggcctgctcccaccccaaagcgaccgcgagaacctcgcggtccttctcgagtgttctttagggcgtcgctgcgactcgcctcgaggggtgaaatgagagaatcgcggccccccggcgccttgcaattagatccacgctgccgcacacgccgcaggctcaagctgggagtgaacgcgagacagcgactcggagatcctgacctttgggactgagaggtgtgcttcgccggccttgattttttccccccgtacctcgtcctcatgcatctctccattgtccgaccccgtcaaccttcaccttaccgcaaggtgccaccaggacccgcaaaagttggaggttgcagtgaaaattccccagtcgtagcaaagaattatg

SEQ ID NO: 516 - DNA, 703 bp, Nannochloropsis_gaditana
taggccgatctttgatcatctatacataagttgtcttcgcagaacactgtgtcgaagactccccgcacatcgtcgatcaggcaccagccttccgctaagcggcccgagaaggggagcgtgtcgggatcccattgccaaaagcaggcattttttaacagcagcatggttttcactggaggataatgtacagatgtagacaaaaaaaaacaagtggaagcgttgacattgtataatagcctcaacattctttgtttcggggggtaaagacaaagggtacccagggggggtcaggaggtttgacagcgacttcacgtcacgtccacggtggagcgcgcgggtcaagataccggcctgcttattaaatggcagtgagactcgtactgatgggatagtgtgtgggcctaataaaattattcaagtcgtatttcaatatttgaatatatcatctcatagttggcagaccttgcatggttgtggagcggttttggcagcggcagcaggttttttcgactccttcaacagccgtgtcggcctacgactatcacgataagggtaggtatctgggaggataaaacgtgtgtatggtggcttcttgcatcttacagatgttttattctactagagaataggtgtatattaccgtattgaggtttttccccttttgctggctcgttcttatcgcctggtggaacaacaggggatg

SEQ ID NO: 517 - DNA, 703 bp, Nannochloropsis_gaditana
gcgctcgtgtggctttcttccttcgaattatttccctacatcgacagtacgtataagaagcgaacgattgcgctcgtgttaccctgcagcagcttatcctccaacctgccaaaaattaaaaataacatccttgcaaccattgtcgtcgtttccatgtcctgttgacgtgcggaaaaggaccagactcgctgcgacgcaagtgcgagagaggacaccgccagttgaagataccattttcgcgctctcttcgggccagggccgggccggcgtggcagtcatacgtatatctgggccccaggcaaaggagtgtttagccatcctcatggattcgcacagcgggcattcctccccacctttcccggcgccccgcatggcgtccctccggaagctctactgccctgtcgggcaggaggcactggaccaagccatcgtgctctggctccctggcccccgctccttcaccggcgaagacacggtggagcttcactgccacggcagccgagctgtcgtccagggcgtgacagaggccctacttgccctggacaaggggggcgaggctcgcgtccgcctggcggagcccggtgagttcaccgagcgagctttcgcgaatgggaggatggatttgacggaggtagagggcctggccgacctgatcgcggctgacacggccgcgcagcggaaacaggcgttgaagcagatgggc

SEQ ID NO: 518 - DNA, 703 bp, Nannochloropsis_gaditana
ttgacgtgcggaaaaggaccagactcgctgcgacgcaagtgcgagagaggacaccgccagttgaagataccattttcgcgctctcttcgggccagggccgggccggcgtggcagtcatacgtatatctgggccccaggcaaaggagtgtttagccatcctcatggattcgcacagcgggcattcctccccacctttcccggcgccccgcatggcgtccctccggaagctctactgccctgtcgggcaggaggcactggaccaagccatcgtgctctggctccctggcccccgctccttcaccggcgaagacacggtggagcttcactgccacggcagccgagctgtcgtccagggcgtgacagaggccctacttgccctggacaaggggggcgaggctcgcgtccgcctggcggagcccggtgagttcaccgagcgagctttcgcgaatgggaggatggatttgacggaggtagagggcctggccgacctgatcgcggctgacacggccgcgcagcggaaacaggcgttgaagcagatgggcggggccttgcgtcagacgtacgaggggtggcgggaggagctcaaagtgtgcctggcccatacggaggcggtcatcgacttcggcgacgacgagttagacgtggacgaggccgcctacgacgccatccggccccgcgtgaggaggctgagcgaggagatgcg

SEQ ID NO: 519 - DNA, 703 bp, Nannochloropsis_gaditana
ccgggccggcgtggcagtcatacgtatatctgggccccaggcaaaggagtgtttagccatcctcatggattcgcacagcgggcattcctccccacctttcccggcgccccgcatggcgtccctccggaagctctactgccctgtcgggcaggaggcactggaccaagccatcgtgctctggctccctggcccccgctccttcaccggcgaagacacggtggagcttcactgccacggcagccgagctgtcgtccagggcgtgacagaggccctacttgccctggacaaggggggcgaggctcgcgtccgcctggcggagcccggtgagttcaccgagcgagctttcgcgaatgggaggatggatttgacggaggtagagggcctggccgacctgatcgcggctgacacggccgcgcagcggaaacaggcgttgaagcagatgggcggggccttgcgtcagacgtacgaggggtggcgggaggagctcaaagtgtgcctggcccatacggaggcggtcatcgacttcggcgacgacgagttagacgtggacgaggccgcctacgacgccatccggccccgcgtgaggaggctgagcgaggagatgcggcggcatctggcggacggggggcggggggaggtgatccgcgcgggcatacgcgtcgccatcgtgggcccgcccaacgcaggcaagagcaccatgctc

SEQ ID NO: 520 - DNA, 703 bp, Nannochloropsis_gaditana
gccgtgaagcagcactggctagcttgcgcgagacgggtgacatggagcaggcaggggctaatctccacgacgcggaagttgtcgtgcgacaaaagcacttcatgacggcggcagccaaaatattctcaaagtaaacgggataaagaacgaaatcgcgtaaggtgcgagcaccagagttccgaccctattatttgtcgtgtgttgagtttgtcacacagagtgtgcagcgcctccccggtcctcacccgtgacaccccttttcttgcaacgtaaagcgttgggcggtggtccgcttttgcgaaaaatggaattgatgagcggcgtgcctgagttgaccttgcatatttgcgtgcggggcatgctggcatgaatttaagacctgtttttttgtggtcggggccgctacatagcagaagggggatgtctctcacgaaagcaacctggagacaacggtgccccgaccacgctcttggaagtgggcatctgtcttgtctaatgtacacgtacattgtcatgggacggcactcactctattggatagttgcatagcataccctccacatttcttgcattgcatcttgtgaaaaaaaaattggggcactgctgccaaagcttgttggaagaagaacctggagaagttcgcaccaattcttttcgcgacttcgcacacatcgcacaggtaaaaacgctttctcggacaatg

SEQ ID NO: 521 - DNA, 703 bp, Nannochloropsis_gaditana
cgtagagcctcttagtcgttacttgtgaataagtaataatgctgctttgaagcaaactaattctataagtgatatacgcttgagaagtttgttttggatctagaatgtatggtttacgaacacatgcagcgggacagaacttagcgggaaaagatactcccccagcttgccgcgagctaatacacgtactcatatcccaacacttttcttctgggacggttgtaatatggcgacattgcagaccatgcggtatcggtacacatatggtagaggtctccacattaatttaggagcttggtggactgcactcgcttgggtgacttgtggcctgtcctgggcgttcatgcttcccccccaaggaaaaccgctgcgagtacgttgtaccttgtgtacgacatttgctcgggtagcttccactaggaataatccagactcgctggtgacttcacagtcgactttgacgcttgctgctgagcttcgcgaggagcttttgtcattggttaatatcccaccagaaataaaagaggacagatatgaagctattgcacagcggatcgatttcgtcgtgggtcagctgaaagagacatatgtgcctccacagacccttccgttcatgaatctactattgcaaggatgttggttaaatatttacaattcctggactgtgcgaaggagcgtctgggaaaagcgtgacagttcgatg

SEQ ID NO: 522 - DNA, 703 bp, Nannochloropsis_gaditana
atacctcgttacccatgtgatgtccaactttcgtggcatcggccaagtggcttcggccagggcgacagcagcgaagcgactggcccctccttgccttgctcgcacctccggcccgtcgagccgaggagagagaggatcggatcgcgcaaatgggccgaggcgatgggcttgaggtcctttcgtcccggcctgcttttttgtacttacgctcgctcaatgccgtcacaatgctctttttttaaaaaaataatggatttaagtacatttgtgagcttacattggttctttccccgcgctcacgctgaggcaagggctcgtccgggccgctctctcggatcaccccatcctgtcatctaactgaacctcaacgatcgcttttaggctccttttttgagtgccatacttcgcgtatgtggtccaagcttagctccgaattgcttggaaaggaaactcaagatgctttgacggatgccttacaaaaaggcaagcaggcttggcagtcaattgagcagtcgctggatcaagccgtagatgcggacacggtagtttccaaggaaagcacactgccaatctctatcccctacatttctacacccgaggctcttgattcgccttgtgccgatgctgtggcaaaggccgatccgtgtttggaggagcaaatcgagtatgaaggaaccacgcaaaacttgtcccctcagtcatg

SEQ ID NO: 523 - DNA, 703 bp, Nannochloropsis_gaditana
cccaatcaccacccatagcccacggtccccgcgtttccattccatcctttcccccccaaaaatacatggttgtttgcgagctaccctaattttgctgagttcactcccattttccaacctatccctaccgtatcctcgtgtcctgcctaggagaccaagagcatgcaaaaaaatatgcggcttcatgttttggtaggaggccttaccgccttaatgtgcctgggtatagtccgaggaatcgggaccatgagcccagaagctgccaaccttgaccgtcagcgtctagaggagatcacgagggatttgcaggcgcaagtaagccgcaaccagctccccggaagcggcatttcaagtttaccgagcgggaaagctcgtcttccaggacgcagtggggtatcaagatcgcgagctgatgcggcctatgggcatgaacacaattgttcgtctcatgtcccagacaaaaccactcgttgccgcgggtgtaatgattttattggagcgagatctgattagcttggacgatccgttgtggaagtattaccccaaatttcgcaatgtacgagtcctcaagtcggatggagccaaagaaacggtaccggcgaaccgggacattaccattctcgacctgttgctgcatacggcaggcctcggctacggtgggggcttcaatgacccgagcggggacagcccccttgcaaccatg

SEQ ID NO: 524 - DNA, 703 bp, Nannochloropsis_gaditana
gtgctggatgaagattgagtgtaattcttcaattgccccttttgtactccctatctgaaaccaagcttaaattccataaatttattgatttgaggatgttgtgagcagagttccttggtgataaagagaaatgtagaggtaaacggattcggatagggaacctatatgggccaaaggaagaaagcttagcgcaaattgtttgccctaaaactttcctacagctcgcaattaatgattttgagccataattaaaatgattagtgtgtataagaagcaattaatgatgaggatagccttttaaagaccaaacaaaggacaatcaaagcagggaaaagggcggcggactcggatactttccatcgcccgagcaacgtctcagcattccttgcgcctgaaagcctcctgtcctatttttgctttctttaggcattgattgatcggccacagagagaaatttaccgatagatctccatcaagagcatgctataaggtcttttttaaaaaatgtacgtgttaaattggtgaatagagtttcttggtctcccattcatcacgaaagcgggcggtaacgcgttctaggaccattaccccaggcggataagtattgttttggtaatcggtacgacgcccgtgtgaggctcacggtaaaacatgccatcacgacacaggagacgttttaatgcctgtgttaatgcggcgaaac

SEQ ID NO: 525 - DNA, 703 bp, Nannochloropsis_gaditana
ggcattgattgatcggccacagagagaaatttaccgatagatctccatcaagagcatgctataaggtcttttttaaaaaatgtacgtgttaaattggtgaatagagtttcttggtctcccattcatcacgaaagcgggcggtaacgcgttctaggaccattaccccaggcggataagtattgttttggtaatcggtacgacgcccgtgtgaggctcacggtaaaacatgccatcacgacacaggagacgttttaatgcctgtgttaatgcggcgaaacagatttgacgggttcgttttttatttgctggtttcggtagccctcatcttggtcccgctgtcacatgctttcgtgcctcgaccgcagcaaaatctacctatgcaccccaagcagctttccacgcgaagcctaggccgtgagatgatcaccacgacgcttggcggagaaaatatgtcctggcaagatggcttagcccttcttgaatcgctagagtcgcccacagtagagatgtataacaaagtattgagagcctgtgcgctgagcggtcagtgggaacccggctgctggcttctcgatgaaatggttgaactgggtctagacccagacaggcaaagttttgtctctgccatcgaggcttgtggcacgcagggccgctatgaggaggcaaaccacgtgttgagttacatgaaggaggccgagcacga

SEQ ID NO: 526 - DNA, 703 bp, Nannochloropsis_gaditana
gaccttgcctgccaaagtagccacaacattatctttttgatattgcacggaattgcaaagacgattaaatatgagcgggccgtcggacggaccatcctttcatggtgtctcggtctttgggagcgtgaaaaggaagacttcggttccggcgccgacctcgtcgtcgctgccaaatccctccgtccaacgcgcattgcaggtcgctcaacgcgctgtcgagctcgacgaatgcggtcgtgccgaggaggcgttcccactgtatcaagaggctgtcgctcttttgcttgctgctgtaaaacaagatagggctggcaacgatcagatcaaacgggcggccaacaaataccttacccgagcggaggaaatcgatcgactgttgaccctgagaaagcaacaaaccaaggaatcaccaaattcgaggctgaaaaaagacgctcgttccaataactttccacttgcatcgacaaaaggcctcgagaaggggcgtgcctcggcggcggtcccgacggggtctcgaatgcccaggaggcccgacgactacgattacacgggggggcgggcaaggaaaggcgaggggggggcggcagtaagccacgggtccgtgggccgagcaggtggtatgggtgaaaggagtggggggaacactctcagttcaaccggtgcgcgtccagggcgagcaagcgacctggaagcgattgtgatg

SEQ ID NO: 527 - DNA, 703 bp, Nannochloropsis_gaditana
atgatagatgtatgatgataagtttgtggggggaaaaaacgtgtaaatagtaggaaaagaaagaattatatcacatgaagtcttgaaagatcgaccagaaagtccacccgctaaggaaggccggccgcagttcttacaatgcccctcggctttctaacaattgtcagcttttcttgtgtacaacttgaaaaagaatcatccccgtttcccatccatctcgagagcctcgctcttagtgaacatcgaaagcggttaatgacctttcatcgacgacagatcacccagtatgcaggtatccaaaaatcaaagttcctgttcaacgtaggtaccattgcacggatttctcaccacaagccgtacggtgctgccccgggcaatctccgtcagaagtctggcccataccactagggcggtggatggcaggcttgccgtcttccgccgaaattcgcaccttcgtattctctcgtatcgaagtcattggaaactatgaggacgctatcatgctcacaaacaagcatggttgccaagtatacaatatagctgccagtctgcgtgctttctgacgcctcggtcctggtgacagcttggtgacctcctgaccccacgtctgcgagcgaccgtcggtctgcgcgccgtcgacgaaaccatgaaaacgttgttcctcacgcattttaccaaccttcatgcgacttacacagtcatg

SEQ ID NO: 528 - DNA, 703 bp, Nannochloropsis_gaditana
atatcgaaagcaaccgggatggtagagcaggttttatagtcaaatattcctaccctctgccacgctttgcttggatcgaatcgatgtcgtcgaccctgtcatgggtatacaaacccctttgagattgccgactcagtagtcgtagctgtcaagaattttaaaaatctgttacagcgtatgttccgagaggcgagtcgaggcaggcacccaaaaaaacatgtggtcatggccaagtcaatccgtaattttcagaaaggtgctcatgaaccttttgctatcatcatatttaaagtatgctgttgaattatcttgatttcgttggaaatttcacgagtccaggaaagagttgcactatccgagagagagccacgaggtgtcgggtgatggaaaaaaaaacacatgtacgcatgattcacacgatatacccagtatttcaggcgtcgcaaaactcatttgccctattaagataaagcccgataaaagtcctacttacacaggggaatgtgtcaatattcagccaaagcatgtgttaatactggaacggcaactaaaaaaaacatttcggttcctaccaacatgtgtttcgacgtcaacagaatttaagcctttaagcccaagtttgtcaacatatttctatccttacgataacagcaatcagaactgagcatattaggcacctttatcctgcaacttagctgaaatg

SEQ ID NO: 529 - DNA, 703 bp, Nannochloropsis_gaditana
gtgcttgaggccagaaaggcggggagcgagcgagcgagagtccgagattttgccgacacatgcctcttcccttacgcccgtggtacgcagtgccatcgaatagaccgcggtccagggccatgtgtaggtagctcgaagcagttattgttcgtatgaatctctctgacttgtcttctgtgctaaaggaggcctgccgcggcacaaaaggtagaacccggctatcccccgtctgctgccagcaggagggggagcccgaaaagaacgcgccgcgacaaaccgcccgcagcagcatcacacgtaacttacctggaatatattaattttcacccgacaggggctagggcagcaactttcctcctctctcgcaagaggtgaggaggtggatattgtaggtgcgaagacaaggacgttttcattgtcggcttgtcaaactcgatcctctccttcctcgtacaaattaagcgccctactttcgcaattcctacacccacttcttcagcaagccaaaccaacacactaggcatttatatgctgtgcacggtcgccgggtatgtttgaacgcttaactgctgcttgatgccttcggcgtacaagagccccttttggcgaaacgctgtcttagccggagaccaagtgcgcttgtactggcttggggcaaaatcgctcacatctatgcagctaaacattttcttgtatagagatg

SEQ ID NO: 530 - DNA, 703 bp, Nannochloropsis_gaditana
gcatttctcgattgaacctcccgactggcccatacacatattctactacagacgctgttgctacgaaaggtaacgtgccacacttccaacaagaagcacgcgaatattttattcggtgcttcccatgagcgcttacatcaagattggccaacgtgacgcatcaaccagttaatgaagcccccacaaacctcatatttttttggcaggtcatgcttttgcggcattctttgcgtttgatccgtacatcgtcagcgctttgcctaattctgattttccttatcgcctggatgtacaagaatgatgctagcttacgtggcgccttaaaagcaccacaaactcgtgcacatgaaatgatgagcacaattgcgattccacgtgatcatattagtcctcaaaccgcctcgaggaagctgcagcagacagttttacgggcatacacaaacttgttccggaacagcagccgttttgttaccaatacgcctgaaggtatctcagggtttttccctcgtcaaactcaaataccgaataattcaggattggagaacgggcgaggtgccgtgaacggaggacgatcaacgcctctcactcctagcattgcgggcgctcagtcttcaagtctcggtgagcatgatatgtgcttgttatatataacttgatgtgcttgatatgattttaagccctgacctcaaaccaaaggcggcca

SEQ ID NO: 531 - DNA, 703 bp, Nannochloropsis_gaditana
ccaactgacactcataggaagacccaccaatcgctttacgtacatgcatgctgcgtaaccgagtacagctacactaagtgaaaggaaaagccatatgtatgtagccacttgcataaaggagacccgcggagtcctgggtgtgagatcgcgacgcaatgccgcggtggacgctgagtcggagacagcgcgaaaccggggaaggggggcagagctttgggaaagggacatgggcagtattggtgccctacgtaacttgagcgcatgcgcaatgccgtcgacgagttcatccaaagtcatgcttttccgtcttggccctatccaggtgttgctgtgcttctactttcccgcggtgctcatcccagttgactacccaaggatcctgtgaccctttatcgacccgacaagaattcgtaaggcgtatatggcattcgatttatcctatgcaggttgcgcagtgtggtgtcaggggtgatgaggtgcgaaattgacaaagagagagagggaaatcacgcagtatcctccgctgcgcctcccaagtggaatctctcgccaagctcgactcggtaggaaagcgagtaaataactctgaagtaatctctgggaagtttcactttttccgtcgcgaccgacaaggagtcactttacaatgccctaattcacaacatacaaaggatcgtcgtccatctcacgggtgaagcacatg

SEQ ID NO: 532 - DNA, 703 bp, Nannochloropsis_gaditana
tgccacttgagagcggagatcctgcagattaaaatcgctctactctgcttttccagagcacgtccgcatatggcttgcgtgcaatagtttctcttccatttatctgaagttgctgtccagcgtggaattgttctcacgacaagaggcatgagacctctccgtctccacactgggagagtggatagggcgaggtcttgcttttcaaagcacggactctgagctgataatgctctagcgacttgataacgcgaagagaagccttcgcaagattcagtagtgaaggtcaagacggctttgactcgattgtttcgcgtgattgtggagggatggtcaagcggttcggaggtagcaaggatcggggcacgatcctcaagagacgccggcctggggcacttgaatgcggtgatgatccctcttattcctaaaagctgccatctcctcacgcgaatcactccaggcattcacatcaaacatctcgtgcggcagtgagctcgtttgtgttaattatggaggatgtcttcaaggtcttgctgtctgatttttaaaaaagagccttaagtgtgtccatgttatttcaacatgacaatcgtaaattccttcccctcgtcctgctcatctttggaagcggcactgtaaaaagtaccttgcagactttagcacagagtaataatcacagtactatccagccggctggaacaccatg

SEQ ID NO: 533 - DNA, 703 bp, Nannochloropsis_gaditana
tcatcctgtggacccatcgcccaccgccggcggccctaccgctgcctgccccgtccctttcagccaatcagacgacgccatgcttgagcgcttcgtggacgtccacgctctcgccgggaggtgccttgcgtcgagggagatcagagggcgaaggaaactgtcttcgtgcgggcgcctggttggtttttttaaattatcgacgttgcggtgtacgcgtcgcatttgtgttcagcctgtgtgtttaccactgcaagttacttcacctagaggtcgctgcctcgtcatgccggtcatatcagaagcaaccagcatgcgagagtgtatgactatgtgggcgtcaaagtggcatcgcattccactatcactgggcagataatatgtgatgtcccttcatcagtacttgtgcatgaacctgtactctattctttcgtttggcccttccttcttgtttcgcacatcatgcagtttctatagaatgtgtggtccggagacccctgaatttgaatttgcggaggatgcacgccctttattacagaactttttatcaggtccttcgccacgaatttggtcactgtccacataagtggaagttatacatacgatgcttgattggacgaactcataatgttacgtaagtcaccaacctcgaatcctcaaattgaacaggtactttcttccttccagaagcaccgccactacaatg

SEQ ID NO: 534 - DNA, 703 bp, Nannochloropsis_gaditana
cgctgccagtttcgcccttgcagaccacgactcgattctcacacaccgcctgcatcagttctgccttgtaatgatacactggtaagatttcctcgtgctgatgctctggatcaatatgacaacatttttcacgtgtgcttctagtgttacttctcctcctgcgacggctcctgtctttgcttcgctctcttgaactgcaccgccgcctttctctgctccggctcctgctttcagacgcaaagtaccgtttcaaagcatcatgtcgccgtttcctgtttgggttaccgatactgctgctcctgctaaactcttttttatgcccaacccaatcgtcaacataactcgtatcttcccgttctccgctttccctggcaaccgtcttcttattatcttggaatttctgtccagcttctgtgcttgttgcgttttccatgtgcccgttcgttcacgctgtttcagtatatatacatatatattggagatgtttacatccagatgcgtatttatgatgagagcgcttccagcgaaggctatcgccggcagggcaccacgcttggtaacgctgatgcttgcttcgcacgagaaagccactaggaccaaggcctagggcgggcgcaccgctacatgactatcgtacttccttcaaacacatccaggtctcgtacgctagcattatagcatcttctggatctcttgtacgatg

SEQ ID NO: 535 - DNA, 703 bp, Nannochloropsis_gaditana
tttccgggccttaggaagaagtatttttgaaacagatttttttcaaacaacttcgtttgtttcttgtttaagggtggtcaaccttgttttttttatttagtcgttatagagatgatttttcagcactcaagaaaggtccgagatggaaattgcttctcgtgacgctatgctctgaggagtgggggccgtaagatccccttgttcccgccttattagcttgtcggagacatgcacccaccctacacgctacttcacaaagagccatagacttcaagcattcgggggacaagatgtaatccggtgtctgagccccgtcgaggtcttgggacacgacgcaggaggcggacacgttgggaaggctcgccaagggaagggaagcgactcgctcggagggagttcgaatatggctatgggtccgtcccctctctttacccatcccactttttcacgggcatgcaaccgaatggcgtaccctaaaatccgtcttcaactctgatgagttgcttttgagtcgtggcaattttttgcctagtcaattgaatattgctttgcggaaagagaggcaaaagaagaaagttttggaagatgcaggccgggcgaaatcgatttgtcatgcttatcgataatcaataataagcacgacttgcatggctaatttcccttttttcttgtcacaacaaagcataattgttggataattatg

SEQ ID NO: 536 - DNA, 703 bp, Nannochloropsis_gaditana
gcatgcgcaagctacagcaaggcggtggatggggcacgcccaggggggatcgccagcggactagaagtcgagcaatgaggctggagggacaggattgggagcggtcgcagctgggtagggaagtgtcgggggatgtggatgagtaccgccgactcgttcgcgccaccgaagctttgtgggggagtgctgtggtgtccacctgccgctacggggtttcgcctacttacaagctatattgccagcaggagcgagaggagatagattttgtggtggtggcgccgcggtgcttctgcctgatcagccaccaacccaatcatcccctcctgtgcaaactcttgtctatcattgtcgaacgggagcgcacacagccgcagagggaaaacgtgctgtccgcgttgaagcgacgacgcagctgcaatgcgctgtcacttgcatgctcgccctctggcagcctatgttcatcccccactgttgcgggcaccttgatggagaagcacgcaggcgaggtcgcaagcggagggggcgtgggagccatgggcggagcaatctattacgctcccgatgggggacactgcagtggcgacgacgatctagtttcttcgcggcgacggtttttgcggtatatccagcatgatgtggtcttcccatccacagggatcctcacgctctcttttcccccgtacgccccctcgacaacccgcct

SEQ ID NO: 537 - DNA, 703 bp, Nannochloropsis_gaditana
ttaaattgagatgtgattgaaaaatacattttttgagaaaaaagagttcgtgcgattcggtaggacactttcctgtgtgatgatggcgccatatttatatcattttcaaggaagagcgctatcggagacttccagggattcgcgaatgttacatgaaaaatcgtccaattgcgtgcctgagcatccaaaaacgtcaccactaaggcatagtttaattactgttcctgcaccctttcatctcgtgagctcgcacggattggcgataggggcgcgacgtgcaggtactgctagtagcagcgaccgaggatgatcatacagcggcctggtatgaacccgaagtccctatatttgcggacgagatgatggcttaatgcggcaaagtaatgtacttgaaggaactggaacgttcttcgcttgacagcttcacatccacctgcacagggcggtgtgacggtgtgggaggttggaaggggtattgcgtgagcttgcgtcttcacacgccctgccgagcctaaaacttgcgctcctgtatgacagtcgggacggctcagcaaaatagtcggatggcacttgtgctggctttggtccttgaagagactatctggtaccgcgtcgcgagcgtttaaggccggagaggttgcttgcgcttcttgctctcttataatgatacacttcaaaccttacccaataggtgaagaatatg

SEQ ID NO: 538 - DNA, 703 bp, Nannochloropsis_gaditana
acttcttgtctctcctttatcgccttcactagcgcatcgggttgatcgacggtgatgaactccgttcgcgtgtgcgaacggaccgctgctgccaggctgaaaagccaggacgcagactccatgcaggacctccactaacaggagaaccaatagcataaagctggcaccagaacccctgcatcgtgccatcctatcaagtgcatgtatcatgtggtgttccagataaaaaaaaatcaggatgtcaaggttttgtatcaccagcaggaagacatggtagggcaacaagaaatgagcggctaaggaggctaaatggtatccttgggtgccccactcgggctcggcaacgtccccattcctttgagcatcagaaagtcgtccaaagaagagacattacaaggacgagtgaggaaacaatctggaatgcgcgtaaagtccagcctccactccttgcttcacgaccgagagcctgtcctctggctgctccctcctcgcggcgttccacccccctcctagccagctcttcctcgagatcataccctcccacaagtggtaccgagaagatgaaaagctaatcctcccattatttcttttttaaagccacattacccttgaaggtgaccggtggggcatagcgggcgtacgcgtgtgcaagatttatacggagctttctcgtgaagttgaagactgttcgtcagcgtgaatg

SEQ ID NO: 539 - DNA, 703 bp, Nannochloropsis_gaditana
ccaggggaaggggggaagtgcccgcggggtcctctagggagagagtgggggttgcgtcgggtgaaagctgcggagacgacaggagcgccgcatccccccgtccttcctctgatgcatggaccggcagctccgagggagacaagccatctccgcgcccctcaccattttctgccttcaagtgtttcgttcggaaggtcatggctgttggctccacgagttccaccaatccttcctccttcgtcgagcccccgacctcctctttccctcgcacaggtttatgcgcatcgtgcgctgatgcgatcggtagttgagcggggccgagctggaaaatggcgggagagtccaggtcggcgtgggcgccgggaggggaggcaaccaagggccgcgcggccgctgccaccatcctcgcagcctcctgcgacaagaatggcttaaggagggtaaaggggaagctctcggccaaaaaagggtgcataagcgcctgaaaagctgagaggcgtgagcgcgggtcgaggtcgagaaggccacagacaaagccgatcaggttcgagtcctgggagcgcaggagctcgcagacgagacggcgatgtcggtcccggtcgtaccggaaggcgttgggcgtccccgcggggtccgtgagggccgtggtggcctggaccgggtcgtcggggagggagaggatctcccgccgcagccggtggtc

SEQ ID NO: 540 - DNA, 703 bp, Nannochloropsis_gaditana
cccatgcattccgcctctgatgactttctccagccctcttgccggtggtcgtcgctttgtttttccacatttgctgacaatttgagcactctttaactttcctatttttcttgtccgtggtacagtaatttcgttcatgtacataatctggcatttaaaagagctctttcattttcttaggttattttgctattcagtaaattgacatgaaacggtgttcaactgccgatggacacgaaagagattttgatgataagccgactaccgcgcctttgtgaccgagcgtttatttacggtctcgagattcctttcaatgtctgcaccgcctccccttgacggtgccgttgtgcatggtcttgctttagtaaaggcgcttttaacatgaaattggtgctccttcctaggcaggatgctcaaggtacagttgcaggaaataatcatgaaaaactttaggagagcccggcatgggatggaataacctagaagctcacaggatggtaggccatggttaggtcatgggccgcctgaccgtgttcgcggctggcggagggtcgcatttttcttgcggactgcgaggctgggcagtcgctggcgtggcagtcgccagcgagccaggtgaattgagtgcccggtcccaagaagttgacggaagtcctcacttctcaattcttccttcgcgctgtaacgtagcacagacattatg

SEQ ID NO: 541 - DNA, 703 bp, Nannochloropsis_gaditana
tcgtccttattttcccttcctctaaccgccacagggggtccaggggaggaattggaaattgtgccttccgacgtcatgcatgcacacgactcaattttcatgcatcctgctcacaaagaatttaaattggtctgaatcaaccaggacagccgcaatctagggaagcaagggcgtcgtacgcccccgtgcccgtaaagggaatatgcaccgacccttggaagtggagactcggacaaattaccaccacaggccattagagaggattggaggcggtgccgacgtggtgaccggcgaaggattatgtgcgcttgctcgacagcatgcatcgaagcttatcattttgatcgtggtggccctcgtaatagcgaccctttccactcagcactcgatgaacggctcggatgagggcaactttgcaggcgccctggaccctggaaacgggggcagcgatgctgagtcaattgaagcaatgagtgaatgcctggaaaacatcgacttcgaggattttggctccttttttgggggcgtgtcacgccgggattgtgcagctttctgtaccgccatgcccaactgcagggtctggcagcatgtggccacgtcaggaggaagctgtaatacccgatatagtaaccatacgggctttgtatcaatgcatgcaggtgtggaatcctgcgtacagctgtctcacaagccgcccgacatg

SEQ ID NO: 542 - DNA, 703 bp, Nannochloropsis_gaditana
ctggccgactatctaggtcctggacttttccttgcagatatagatgcaccctcgtggagggtttgaatatgttgcgagaggtacgcgcctcggcgacccgggagaggtgaccgtgcaaggcgcgagactgactttggcaatgccaaatgatgcgatgcgaggtcaggagtacaatcccatcgcgatgcacgattcgattgctacgtccgtcaaccagggacactctgtctcgcatcaggcactcgatttcaaactctgagagcggcggccgcgtgcttccgggaggtaaaggcaagtcttgccagaagagctcaaacgggttcgtcgtttgaagtgcagccatgggccgctaatatatacagaggtaaatgcggaggcccgcttttaccggaagcgctgttgatattgttcgagtgcggtaagtgcaagcatatagggaggcatatcgccagtgccctgggtaggggagggaaggtgaaagggtctccgattgctcatagtatctacttccgtgttgtcacattgggaaatccggcacgtgcattggcatttcccccggtttatcttccaagatgtgcgctcaatgccctcatcttttctacgtttgctcttatgtcggcgtccaacccgccaaatcattccgcggtctcatcctgatcgctcaactcagttttccagggagtcgggcattacggcaaacatg

SEQ ID NO: 543 - DNA, 703 bp, Nannochloropsis_gaditana
tcgagctcagatgagtgttatcctcgtcttccactattacgaggcggcccctcttcatgatggaaggcgcgatagaaggctactgcaaagctatcattttccctgtagacagcgaagggtaggacatagaaagataggacaggcacaaaataagaagaagggaggactttaccagtgtggtgcgattcgatatcagcacgtcacacaaccccacgtctctacgctcgaagaggaggctccttgaggggaacacgcccctcgtcgccgcccgcatcgatgcctcccacaaaacaccaccgaaaaggcggtcacaaagctgctcggggacgcccgcgttacgatttgagacgaggaaattgcgaagaggacgcactagccatccgcggggaaccacgcgtgtattttctgggctctgtgtcgtgaagagcccgtgcctttctcgtgccggtgctgtccgccggcggggttcttccgcacgacttggtgatgatggtgcctttatgcagcatatctccaaccattcccaaccaatgcgtcatcattaccaatactaattcctcggcttactcatactattgcaatgctatttctcgcgcagattgactgcatgatcatgcactgaggcgtgccgccaacgttgcgctgacgcttcttatccttctataccttggatgccagcactcctagaccgactcataccatg

SEQ ID NO: 544 - DNA, 703 bp, Nannochloropsis_gaditana
ggcagccattgtaatattatgtcaagtatacctgttatcgctatgttaggtctgcgagggattgtattcctctttatctcactcttaatgcactgttgctttagcatgtcctgtgatgaagcagattcactgccattttgcgtcactcggcggtgtggatgatcttggcacgacattcgccaggagccgaatcaatgcttagctcaggtacaagggtaaaaactaaaagtagcgccaaggaaactgttttgtgctcacacgtactcccgaaaatcattcacacgacctggactgctggcatcgtcagagaagatcggatcggatcggatcggaacggatcggaacggatcggatcgcatgtttctgctcgtcagtcgcgccgcgtcggacgctccagcctccccccatcctgagctcgtgcgtgcatacgcagaatatctaagtcgtgcttcttttgggatggttgtgcgagaattacggccgcagttcgaagcagttcgtttgagagagaagcatggatccacttcacgtatcgtcaacgtcttccgtttttcttttgtaacgattacaaagcacatcttgcatccatccgtttgtcaagataccatgaagcaacagattcataccagccactaattagacctttctttggcacttttagcaacaaacaaccaccaacccccacttcgaccaagcaactatg

SEQ ID NO: 545 - DNA, 703 bp, Nannochloropsis_gaditana
atcagagttgtatcccctgcatcaacagatgagaaatcggcagtcgcttcaaataccaggtacagcaaaagaatcagtccaaaatgatgtgattgcttcatagccacaagagggccttgttggctatgaaaactgctttacgagcgtgagaggaggttgcttgtgagaaggagggttttgctttgtatcacgtccagaaggagatcctacccacgactgccattttaaagaagcatctggaatgcatatatcaaatgtttcatcataggcaaagggtcttgactctgcaccgaccaatctctcgcacgtgctgacaccctattccaggtggcacgcggccggcaggggtggatgacgcccgtcggggccgagggggcggggaccgaggactcggccttttgaaacggctgtagccgtttcatccttttctgcccttctattcccgttcttgccttgtgtacgttacctgagctgaacttttggggaaaggactcttgcgaggttgatactatcatggaagtcataacaaaaaccacttttcacattatgtaaagacagactgtgaccagccatccagaaagtgcgagcaaccgactcctaccatttgccgccgaacttccgcgacaggccatatcttgagcgtttctccagtcaattcgattgtatattctatacttgtcacaagggcatcaaactagctatg

SEQ ID NO: 546 - DNA, 703 bp, Nannochloropsis_gaditana
ggaatgcatatatcaaatgtttcatcataggcaaagggtcttgactctgcaccgaccaatctctcgcacgtgctgacaccctattccaggtggcacgcggccggcaggggtggatgacgcccgtcggggccgagggggcggggaccgaggactcggccttttgaaacggctgtagccgtttcatccttttctgcccttctattcccgttcttgccttgtgtacgttacctgagctgaacttttggggaaaggactcttgcgaggttgatactatcatggaagtcataacaaaaaccacttttcacattatgtaaagacagactgtgaccagccatccagaaagtgcgagcaaccgactcctaccatttgccgccgaacttccgcgacaggccatatcttgagcgtttctccagtcaattcgattgtatattctatacttgtcacaagggcatcaaactagctatgctaaggtcatcaagaggttatagacattttgaaaaatgtaagtacccagttagatcctggttccttaccgtcagtccgatgagtgaactttacttccgatcattttcacgggatggcttggtagatttcatttgatattccgtcctatcacgcacagcatcatcgattgatcgcacctcaaaacggctaggtgtggtcatatacctctctttcgcgttgctcttaggagctttaccgt

SEQ ID NO: 547 - DNA, 703 bp, Nannochloropsis_gaditana
caacttgctgtacacgagcctcgtcgtccgagcccaggggcccctaagggggtagataaggggaaggttagtgggacgcacaaaacggtgcactgcatccacgcgttgccagtcacaagtccacttcacaaagaaatcggaaactggcaattcacacggtcatgcacaccatcccgaccagcccctccgcggtgtgcgaggccaactcacgctgtcacagacctggcacggcccctccctcccttccgggcggccagcaccaccacccacgactacgcgtgtccgcgacacggcgctcaggccaggaggcagcgtttgttcgtgtcggacacgctgggacatttgatgcacgatgccttagaggtggtgcgtggcaactgtgtggtgtacggtacttgtcgcgaggggagtgcctcactacggcatagcgggtggtggggaggcctcgctttcttcttaggctttcgcggcccggcctgtgttcgtctgaccacttggacggagaccagggctacgagatgctggatcgggttgttcattatgcacggcagcattgatgagtcttgcaaagccgggcatggagctcaattttcgagaacttgatgtcgtgggggggggttaaagccactccacaccgtcgtttcctcgctcctcattcccttccttcctcccttcgatggctttcgtccacaggcacaaaatg

SEQ ID NO: 548 - DNA, 703 bp, Nannochloropsis_gaditana
aggctgcgacgctagctatccagaatctaggagaagggttacgggtgaagagggactgccgtgatccgagccgctccctcacccgtctcctactccctgccctgtcttggcgtcgtgggggagcaggaggccacacctgtggccacagggcccgtgcgctgtcgttccttcttcgatcgtggtatatggagtgaaaataccagaggcattggcggagggactgagtagcgcgtgtagatggtgtggcctgtgcatgacaaaggattcaacctttgacctccaaacaaacatatctcaacagacacaacgcgcagacccatcggaaattcatgcgacgacactgccgagggcgtatttttctgtctgtttaaacaatgtctgatgaggcaagcttgattcaggagcgattagacgatttggctttgaccatgtttaatggcgttttagaggtctctcgcgtaagcggagatgaagggcggaaagatgataagtgccacgttgcggtaaggatgggagcgaaaattggataccatagaaaggcattgagatatgcaagaatgcagttggtattggggtgcttcatgagacgatcatgacgggtcaagttccatgttctgttttctttctcagtgtgtcaccacttgtggcctcccacaaggtatacaaactgatctcattcaccttgttttttaacacatcaatg

SEQ ID NO: 549 - DNA, 703 bp, Nannochloropsis_gaditana
gctgttgcagcggccgggcttctgatggtcaatgcgttcttgaaaggtgtgcaaggaggcaagctcgacgaaagtccggtcctccgtgctgccgcagttcgccggctccgagtgacagtggagccccccattctcgtggtactgtgtggaggattgtgaaagtattgcgctgtgagaccgcgggcgagcgaccagcctcggggtcggcgaaagcctctcaacctgggcgacggccgggctgtctcccttctaccctgcctgcctccctcccaggactggactacggacatgcttaccgcgccccttcccgtatcacatcttctctatcattaggagccgggaggaaagattgccagaaccctacagctgagagggttgagggagggcagagacagcggcgcatagcacctcaagtccgaacaagactggcgaagtgaggtaaggagcaggatctctgccgtgcaaaatgttcgagaaaacaacatttttggccgaagggtatgcataaaaacactgagaggggaatgatcttgaattttctggttacgttttaatatcgtggagggttaatcatgtccctcgagaacctacagcagatgaccaaagataggctcccctaagaatatacacgcaatttattttatgggtttcacgtcttccaagctcccacagtgatcctcgtcaagtgatcaaaaggaggatg

SEQ ID NO: 550 - DNA, 703 bp, Nannochloropsis_gaditana
aatcccatctacgcgaagaaggccatgcacgtctatgaaaggatgcacgaggagagcgctgacgtggctgaaaaagggcttttcaggctggacttcaactcggacaccggcgcctggggtgggaaacactactcggtgggcgcgcgtggtgactccttctatgagtacctcctcaagacgtggctgcagggcaacaagaaggaaacatggcttcgggagatgtttgacgagtcggtggacggcgcggaggagctcttgatcgccagaggcccagggggcagactttacatcgccaacaatgataacgggatgcaagccaagcgcatggagcacctcgcctgcttctaccctggcactctcgcactgggggccgcgaccctggagacgaaaggcgacgcggtcctcgaaaagcgggccactcactacatggacctggcgcgggagctcggagaaacctgctaccagtttgcaggctcacaaatgacgggcctggcgcccgattcggtggttttcgaccaggacggcgtgccgcaagcctcggacccgcgatacatcctgcggccggaggtcgccgagtccatgtactacctgcatctgctggacggggacccgaagtggcgcgagtatggcgccaagctgttcgaggccatcgacttctactgccgcacgaacgaggcgtatgctcaggtccggctctcaagcg

SEQ ID NO: 551 - DNA, 703 bp, Nannochloropsis_gaditana
gagcagcattgcaggatggccgtggacaacgcggcggacctcgtggctggaacttggtggagttgcctccttggcttttcctttcgagtttgtgttgagccctcaaccataaataagtgttgtcgctcctccacaagcaagtgcagcagagaaggcacgtcgagctcctccgtccgccgtctcacctcctggttgatcgtgtgagtgagaccaagcataacttgacacattgaagaaataccgacgcgacgtacctcaagcctcttccagtagcccgttcgcccgtgttggttcttattgcggtacatgaggctcgtcaacaagtttgtctccagtgtccataacgagagcaagtcaacctcctcacttggcccctgggtcgtgctataaccaccatcatgcatggcaacaattgtctttttcagcttctcccctcaagaatgccggtcgcgtcgtcaccttgaggagcatgcgatttttcaagtgcatttgatgagtgatgcgagtattgtcctgacctgtatgtgacgggtcgccgagtggaagcgacgcaagccttgagcacaggcacgccactcgcaccatcggacagctggagtgaaagattaaaaacacatccctttttcctcttacggtttccgatcaatccacaataaaacatgcggcacaggtcatagtggtggtgaagcttgacaacaagatg

SEQ ID NO: 552 - DNA, 703 bp, Nannochloropsis_gaditana
agccatgcgtgtctttggctgaaacagggttaggcacacgctctgtaacacttgcaagaaggtgtatcctgtgagagatgcgtgtaaactctcaggcatattttaaggtggaatggaatcgaatgatggacagagagccatgcgtgtctttggctgaaacagggttaggcacacgctctgtaacacttgcaagaaggtgacctttacaacacttcgttctcccccaaaaaggagcggagaccagcgtgataacgccatgacagcacagaatgcctctaattattaagctagacatattgaaagaattaatagcatggtatccatccatctttctcttttacttgggttttccttgtgttccgatttcattccattgctcgccgtctctttcgccctcaacgtaagccgcggtcgcgcgtccgcccatacctcgggcaacagaccgtcttcttctttcccttggatccacgccatataagtctcaagacacattagagaaaggcattgcttaacctttaggaatgcttacttttatggtcttcttctaataccttctgaaaaccaaggtctggccggttatctcttgaaaatcaaggagcaactagacttggcaggcaagatactttggtgcccttttttttttttcattgcacgcctccagatttctaaatttcctgagcttctgacaaatttcatagtcatg

SEQ ID NO: 553 - DNA, 703 bp, Nannochloropsis_gaditana
acctttaggaatgcttacttttatggtcttcttctaataccttctgaaaaccaaggtctggccggttatctcttgaaaatcaaggagcaactagacttggcaggcaagatactttggtgcccttttttttttttcattgcacgcctccagatttctaaatttcctgagcttctgacaaatttcatagtcatgttgctgactggtgtgcggagggcccgggtaaatggcaaccggctgctcggatgggcggaatcgcgaatctctcacgcccctcgctccgtcatcgacactagcctgacggcattcgcattcgggagccacaggcacatttcgacaaagctctttattcgcagtaagtggaaacgccttgtataggcggatatatggccttttgatcccgtcagtcggaaactgcgcggattaccttggtatcacaaacttcatacatatactacagtcgtcccgcattcaacaacgcctgagtccctccacgagtttctgcgctcgtatggtcctatccgcgaaggtacgtcccatacaacagtttgaattcgtatggtttattacatatcatcaagcccgccgcgctgatcccgagatacgtatttcttaaaaagtcaagattgtccccccgactcgtgacgaccgccctcccttcgctttcgtggagtttgataaccttaaatcggcgcttgctgccatg

SEQ ID NO: 554 - DNA, 703 bp, Nannochloropsis_gaditana
tatttatgagaaatatcagagatgaagtccgccgcccttgggccactcagactggtgctcgggtatctgtagactgtgcgctcctacactagaatttactggccatcacaattttctttcacaaacccaaaggtccgataaagcaaatgcatttgttcaaactgcggcaggatgggccacgagggacatgtatttcctaattgtagcatcgcgtgctttgtgccgaaggtggtcgagtgggtgtacgaccagtagtacgctcagctcacctccccgcaagaaatgaacaagcttacgagtttacaggaatgagcgtgcgcctatcgtgcctccttctttttgagccgtcaactcctttacctgtgcatccttcaatctgtgacgagtgttgtcttttccagtttagcattctgtcttcctcgttctctgtttgcacttaactcgagtaattgagagcgaccgtcgtgtgacaccgctcggcgcttgtttcgcccgccgatcatcgtgcccagagatgtttcttgcttcccgcagccgccagtcctggcttctctcttcattcattcccgccactcgcacaagttcatttttaacagcatgaggaagtgcgtagaatagctgtctcatctcttaaacggcaggggaaaggcctaaattccctactcttgcgtaggacgagcggaccaaagcgacgacaaccatg

SEQ ID NO: 555 - DNA, 703 bp, Nannochloropsis_gaditana
ggtcaaccgactcagaaacgttttagaagcaatcggcgctaatactgatcacatcacctggtgcgacaaatcgttgtgtgcgattggcgccacagtctgtgtcgcggcgacaagcctgtggccctgaaggcgagtggcggacactctctcatcaccctcccgaactaacaccctttggcaagaagggtagtgcttcgtcagatggaataatttgaactatatgcaaggcgaggaaatgatggctgtgagaagctatgacagcaaggggaggggagacagtttttggctggctcccggccgtcggaggcattcttccaccaccctggcgccctgtattctccgcctccctcctatttaaccaaaggagatttccaccacaaaaaagaagacagtagcaaatgaacgataaatgtgctatgtgtcgttgctcaactcaccgctgaactgggatattcgacaaaacataggaagcaagacagcgcagaagtggagctcccgttctcctcacttcctctttcgcggcttgattgcaatggtgcgtacaataacaatatcggagtagcgtcgcaatattgtacaatgttgacaatcctaagggaatatctggagatgtctagagtcagtgaaagctttgcgcgaggcgtgtcgacggagagggcgcaggcccctctgtcgcgccgggtgagagccatggctcaggatg

SEQ ID NO: 556 - DNA, 703 bp, Nannochloropsis_gaditana
gcccatttctcgattgtgtcgaccagcagaccgaaagccaccgctgtggtattttccgtcataatattgggagtcaaaccttcaagtccgctaccaacattggatgtcccctttttgtgagagaacgatggtatgactttgcaggatgttcccagtgttgtaaattggcttccgattggcaagctgttgccgcggtgccgcttttgacatgttccagctagcgacataggaatgtttgggctgctcaaccaagactctgagacttgaagtcgtaaaatactccaccatagcgcaaagaggatcattacggatggcattgttgatatttctaaggggaggttgttcgggaacgtacgtacatttggcttccatgagcgtatgaaaaaaaaatgtataccaaggaggtgacagttctgcactccttcaaaattttcaaagggcgacattaagtccaagaaactttttgtcaatcgtgtgaatgcttggcggaagcttttcactcgcaaaattgaggatcaagctcgccaatacccaccctccctttgtcctcgctggataacctcgcccaacgcggacaaagctccgccgcacgtgcagttcactgcactttacataatatccatgactcattcttacgaatgctctatctatccagctcatcacggtagaaaatttcgctgcacctgtcctgcggttaagtatg

SEQ ID NO: 557 - DNA, 703 bp, Nannochloropsis_gaditana
cttcgctaccacagtgttatccgcgaggccctgagaaatgctcacggctatgtcgtagggcgtggtcacccatgcagtaccctccttcactgacccgtccggcagcgtcactctcaggggagtcttcggcttgctttccaactctgcagctcgccgggctgcacagctttcaaaaagctggagacgctcttgaaggtatgcaggattttcgctcactgtgaaaggcccaccaatttttccgcttccctgtttaatgctctgccccgttgacttggttaggcgggtcttctcgcgaccgccaactttgctgccgctggctccatcacactccgaaattttgagtttcgacatgtctttctccgtaaggtcctgtccatgcgtttgagatgagccattttatactctttctcgtaagacaccaaatagaagcatagtaaaagggtaagacggctatgaagaagccaggcccgtcaaccattgcttgcttagtctccctttaacttaccgcggcatgacacccgtgcagcgggcaggtgcaagacatcctgacccgttctccagcacccctgtaagaaaagttgtggcacaatttggcgtaaggtcttggcccgggattcgtggcggccccgacgggtctcggagcgatagctggtggagcctgaggcgggctgaagcagcgatacccgtccaagtgccggcaatg

SEQ ID NO: 558 - DNA, 703 bp, Nannochloropsis_gaditana
tcgccactttccagtagtgccaccacttgctttttgaagaaagtcgtcttttaaatgtttcatcataactctttgcgtgtgtcgctgaagtcgggggggtggggacaggggaggttcttgatttacgtgtgatgcgttgtcttttttagaactcatggtgccgcatattgtgtaagcacgcgaaaagtgagaagaccaatgaagattgacgctgtccctctcttctgaagagggattgtgtctattgcttttaataggcataacttctcttggcagccccttccaggctaccaagcgtcgcgatcctctctcaggcccatctcgggtccgacagagagtaatgtgccgttcagacatataccctggaccctgagaagatatcacattctcaatcctcgaagaatccattcaatacatataaatcgtcaatgtgtcatgacgcttgcctgacacagaaatacattgtggcccactactatggagaagcttcaacaggaagatgatatttcaggacatcgttacattacacacgcgtcgtcaaagctttgtcttgggccatttcacccgtggcacgcgttatgtcttaactaactaccatatattttcaactgatgtataggcttgttatcccttcggacagcggtagatttatcacactcagtcgtcgagaatactggatacgccgtggaggcccgaggcaatg

SEQ ID NO: 559 - DNA, 703 bp, Nannochloropsis_gaditana
gctctcccatagccagcacgggcactcccggctcccagccgtgcatgactctagaaggaaattcaccgttttatttctcacccgaaagctgtacaagtccgagacgctctcccccttcgtcacttggtcctttatttcgcgcgggcggcgacggagctgcgtgtacgagggctttgacttgctcgagcccgaggctgcgacgatgacgccctctttccccggggggggcacggcttcctcctgtccgccgtgacaggcttgaatcatccacgcttgcagccattggtccctttttgcgctctgacagtatatctagatttctggggtcatgcaacgtctgaatgcatactttgtcctgcgtttagttttttctttccgtgctgccgacctggaaatacccgctaatgcaggtagtacttcgaataacactgtccatcgcatcatgctcgcgagatagagatgaagaggggctttacatggtaggcactcttctacgtcatcaatggggcattggtttagctgttgggttaggattttcgttgtaaaaatattggaggttgcttgtatagctaggagacgcgaaagattgtgcgcctatgacacacaaagtcttgcgaacggaatctcagtacaattttgatgatcgaaatcattagtatactatttcacctcatgtcgccgccattattccaatgcttttacc

SEQ ID NO: 560 - DNA, 703 bp, Nannochloropsis_gaditana
gcctcgagagtgacgactcctttcgcacatcgaagcaatactgcgcaatctataatcatttcccgcatatactactacaaacttcagaccatcaaaggtcgctgcataatttttggcaaaattgttagcataatgaccatcaaaaaagagtaatcgatgtcactcacatcaccaaaaatgagatgtcaaatggaacacgctagattcttgacggcccatatactggcaaacttgtactttgtgtgcttggtggtggaagagcgcattaccatctcggtgaatatgcccaactttgaccgatcaggtttcgggtgcttagatacaatttgatcggacgcgagcactcaaaacttcagcaaaaatccgtcgaccttcgggtttctggcctggtgtagcccgttaaaagtaccccaaaagtacgtttttgatacttttatgataataaaaatgctattagaaacatacacttatctgcagcactttatggcctgtcatggaaaaaagttccgatgacttcaacacgtaactattttaacagtatgatcctgttcattctacagaaccagaggggcatgaattgcacacacgtacggtatccaaaaaattaaatagtatctgtctttaatcagcaaaatgatggaaagcctcggactttaatcatctttttacccacgtggtcgtacaaaaatcgacaagcgtgatg

SEQ ID NO: 561 - DNA, 703 bp, Nannochloropsis_gaditana
gctggccctccatttcttctagggctcgcataatggtgcgggaggttgccgcggcgtgggggtggtgggtcatgatacttcccagcaatccctctgcacggagaggagtctacgtacccttccaaaatccgtgctacccgttgctcctgaggcggatagtggtgttggcgtgttagcaaatgagtccttccaatcggagtcacgcgggcattgcccgatgtcggccccgccctgaaacggtcagcgccgggggaaccccccccctttagtcctgtactgcgcgctctttccacgcctcggaccttgaacataagacagacatctcctcattaaggtttggctgattgacgagcgcctatcctattcaggagtcatgtggataaatcatctggctcgtggtcagatccctattatcgcccgtcgcgtgtcttaacccccagtgccgtgacgacactctttcttacagcagtattttccctttatcctcctcgtgaccgcaagcgcgaaggcggctgccagattgtacgatcgtatggtgtcgaattctgggctggacctagaggaggagcattttgacgaaaacgaatgctttcatcaagagacgtgggaggacggcgatctcgttgtcaagtcgactagacgaagtacccgcccgcagctccagcaaaaagaaagtggagacgatggaaataccatgaacatg

SEQ ID NO: 562 - DNA, 703 bp, Nannochloropsis_gaditana
aagccaacggcgtgcccaacaggaagcctcgggcgtcgaagcccccgatcttgtcgatcgccatgcccttgtacctttcgactagtatttctatggtccgacgaagcaaagcaggagatagcagaaggccgctgatgtcgtaaaagcggtcaatgcctttgaaggcgtaataagggattacagccgcgatccttggtatggatggacagaaaggagggggatggaaggggcaaattaaaaaataggcaacgccagtccagggaagtgcgatgccttctcgttccccatatttatcaaatttatcaaatgaccatacttgcgtttatcctcctcgtaatcctgcgaagtcgcagggttgactccggccatgcttctaggaccctaactgggaaagtgagcgtaaaccctgccgaacatcgacatcaaaaaaggaagtgtgtgaggagtcgcctatcgttgatcaatatcaaaccacaacaaactcaaacaagacaacgacacgactttaaaatacagacgacgagaacggtaactttcctccgcatttggattctctgaccaacctcctcccagtggatgcctgtccgggcggctcgattgcccattgatatgcccgtatttgttgctactgtggttgtcacaccatctcatcatcctgcgctttcaattgtaggtgctgcagcacacatatcacatcccgatg

SEQ ID NO: 563 - DNA, 703 bp, Nannochloropsis_gaditana
gaataactatattgtgtaatgggtaggaaaatttcttaaaaaccttgtcttgttacaatggtacagccttctaccccttccaacacagactcctttcaacgagagcatgtcttctcttcttagacgagtctccttcctggaagcatttctctgactctcttaccttaaccatcttgactgaggcctcagaaaaactacaagagtacctgtgcgaggtggtcgtatagagtgggcatgacggaggacaagcgaggacacggagacaacaaagcggctgcgacgacgaagccgggattctggtggcggaggacacaccgagtcgccacagagccgtcgcactcaactgcagggtcagcatcccatgcgctaccaagaactttattttcgtcgtaggtagcagttgagtaccacgaagggttgggtataagcagggaaagcattccgcaagcgcgcggtggtaaaggaatggaaggcgagggccgctcgcttgtggcggcgggcgatggcacactccgcggcacacagagcgtacgctggccaaagctcactgagaagcatccgacagggcctttgcgggcacgtgcaacccctgattatgcgcacacgtgtgtatctacagttaaggcatattttagaacactctgcgctacccgcggactccacttcgtcgtgacttagagctgcattatgctccaaggcaatg

SEQ ID NO: 564 - DNA, 703 bp, Nannochloropsis_gaditana
cgtgaggctggttctggacgtggtccgggccctcgtctttctggaggtgcgcggcctccaaggcctggccctgcggcgactcctcgccctgcaggcgcggcaagctgcctccctctcctcggccgcgccctccttcgcgccgcgccacgagctggagaccttccagacgagtacgacccgggagctggccagggccctcgaggccctgcagggggtcgtgcagggtgtggaggaggggatccaggcggccttgctggaagccggagaagttgcctcgcacgcctcgccgctgtccgggagcggcatgaaggcgagcgggccggcgagggagggcgtgctctacagcgagtacttgataccagagctgggtatgggccagtacgtgttccaatttgtggcgtggctgtcggatgcggtagagcgggtggctggggtccccttcaggctcagcgagaatgacttggtggaggtgggagaggtccgtcgtagcgttttccctgagcgtttcttcgcgcacgtctcgagctttacatccctgcttggcagcggccaggtggaggaattggggtatccgagctcggcggtcgcatccaccgccctacctcaatttgccttgcttcttgccgtgctctgtagggacctgcagagcaccctctggcctcaagccatggccacactggccctcgtctttcccgccaccatg

SEQ ID NO: 565 - DNA, 703 bp, Nannochloropsis_gaditana
gttagatgaacgagaatatagctacgcacgtttcagaaatctgaggtgctcgcattcgcttttcgccatagggttttagtatttgttctaaggtttgtcaacgaaaatggcgaacggtcatcaaaacaaacttaccaacatgtggtggtggccatttgaagtctaccgctgcttgttcttgtggaaaggactctcgccctatcctcagatcattggcgggcgtaccgaacttcgttgaacatgtggctagacgcatgcgtcacccctgtccaaacccgcttctgctggaggaatgaggcgaacccgcaaagctttgcgttctaatttttgatatgtttaggcttgtgtttaaaggtatcttaaccacaaagtggctgtaagtttcagataagatcgggcgttgcttttgtcagcgagcacctctgtaacagacccgctccaactgataacaacaccagcaacgacgtgaacaccagcaccgccaacaacaacattatttaatatctagttacagtcatgcatcttctagccgcactcgtggccctgcccgccatgtgcactgcttttgtcgttccgctaccgtcagctccgaaggtaaggcgttcgaggtttcagcatctggactcaggtctacctcagggctccttcacgatgttcgtttcccttctttacacacgtccaacagcatgccgtacgaatgatg

SEQ ID NO: 566 - DNA, 703 bp, Nannochloropsis_gaditana
cgtgcagcaacaaaccaggacaagaaaattgatatcggccatacaatttcaccagtttgatcatggtctgtgcacgaagctgctgatacccagaccggctgctgctcaagatcttgtatcgagtagttcaccttgacaagtgatttgtttacgaaaagatccggattgaaaaaacaatccggttccgcttctacatcatggttgctcgtcatggcaggcgaagaatgaatagctcttagatatgcgactctatcgttttatgctcccatcagttcaaggagacttccattatcgcatttgtgctttatatcggtctgaaagaattcgtcgtagggattgttgagtgtgaggaggttgtatcataggggcagggacagtctggagttatttgagatgtatgatacccaaaatacttccctccagggaggaagggctgagctctgcgtacgatatgcttgcgggcctgaatcatatgcattgcaatgtgtcctgcctttaaaggatgcttgggcacaagcaggtggcaggcgcacagagcgaggaggaacaagcgagcatcggtgaccacccggagtggcggggagggagcagggaattaggcaactctttctggcccactcccgctccggcatctcctggaagtaatgatgcgttctaacacaattaacgctgattttcatcaccgttgacattccactcgaac

SEQ ID NO: 567 - DNA, 703 bp, Nannochloropsis_gaditana
tgtgggtgatggaagtgccgcacgtccgcgtgcaatttcccagggaggtcgggatggaagccaatgagtgacgtctaaccctgcgccgtgaagtcaaaacccctcccgacaagccctagcttaccgtgcgatcttcatcctccataattattgaggcaggatgtgccgaggaggggaaaacctggagaaaaatttgatgtcggtgggatggatgagagagagagggctgattattcactgaggaggaagaggtcatttttgggaagtagtactccaggagacccaaaaacgcatggacgcttcggcctgcctggtttcccgttccaaccctcagaattgagtcaaacttcccgttgcatgcgccgcagtgtggcatgattgtaaatggaaggacttggctgtggacggcctgaggctgtctccacgtcggcttcagtcagggagcgacgaactctaaaccaggcccggccacacccctacttccaagcaccgcattccccgcactcaaaacgattcatcgtcggcaatcaattgcaacgtgttcctatacttcacttgtgtacggccatatcagagtgggctcgtcgagtgccatctcccagactgacttcgtacttcttttccctctccttcaaacaaagcgacgcgattcccttttccgcaactatggcaaccactgagcctaaggttgctgccaaggatg

SEQ ID NO: 568 - DNA, 703 bp, Nannochloropsis_gaditana
aagatttcggcggaaaacttggttcatcacgtcacccctgattcttttgcctgtgcaaaacttccctctccccaattgtcgctactgcgcttttaacgcacgagaaagactcaaagtcagcttacaaactaagaccgggtaggacatcatgcgcttgcatttcacgctgagattttctttacgagtcaagtggtcttcctggcacgacgtccgacggacgaccgacaccttgtaagtgcaagaaggatatagtaggtcaaaagtcttgcaggatacatcacacgctcacaacaagacctttagcaattcgaatggactgggagcgactgggctgataaccttcgggtgttaaagagcttactttaatgtgcccgcctcatgcaggactttgcttctttgtattcgcgagaagttgtacccgcaggaccatgaagacaagcaacatcttcaagccagtcatgtgtaattcctactccgttggggtgtctagttaggatcaccatattgagagagtggggggggaggttctcgaccggcgatttgaagaatcgagtcctgatcttcattcgttaaagtaacttagcgacgtgcggcgagttaagcttatgagccatctgtctttttttcacaattccacagtggcatgtgcgtgcgactaggtggacgtgagaggtaacgctacctgaagggtagagcgctgatg

SEQ ID NO: 569 - DNA, 703 bp, Nannochloropsis_gaditana
taaaaagcgtcctggggtccagaacacgcaggaagtgtttgaggcgtccactgaaagtaccaaggtcataaagagacttgccaggctcgaaatttggtagttttgcccgatgagatttgaactcgcgcccagaggtcatggctggacgcagtcaaaagagtgaccaactagagtcctttaatctactagcctgatagaatcaacgcgccttgtgaaaaggaatggacaaatgcatacagggatatgaatgaagtaaaaagacagacgtgaatggcggatcaaaggatactttccccgtatgaggaaaacattccaattacgacatgctagttgaccaccgcgcgactctcaccacggcgctattcccacaagtgcgtgctattaatcgccttcacttatttctttgagcgtttgaagccctcgagagagtcacacagcaaacaatcggcgctggccttgcctgtccgggcgaggaggttgctggcgatggctcatcatggctggttgcgtgtgatgcaattggtaccctcgattcgcacgtcgtcttcacgtcacaaataagccaacgcatacgaatacaagcgagccatacgtgcccgacacaagctccgagttgttgtggagacattcgatctcttcaatgctcatgaatgcctcagtgaccggttacatggctctaattacttgtcaatctcacaaaatg

SEQ ID NO: 570 - DNA, 703 bp, Nannochloropsis_gaditana
ccctcgcgccagattcgagcccggggaaacccgtttaaatgggacacgcaaaaccactcaagacactcattggcacgaggccgcccgggcgaagcccctttgctgttgcgcctctccactccatgtccttttcttgagtattgaaggctgccgtcagggacatcatggtagcctttttgttcttgggcactgttgtagatgaagcacgtcgaaggcgagcggccgggcggcagaggaacaagtgtttaagtcaggcccttttagggcggtcggaggccgtttacaaagcgaaatgtaaatgtcttcacgtgctcttgcgctttgggcacgttattgaatgtacgagggagtcagtttgttttcacattgcgcaaattattactcccggtttttctctcccccttttgctttcgcgaccaaccaactcgagatggtttggctgatttctgaacgcatggcttcttcgcaagacattatagccaagaaacctgttgctcgctgcaaacgtttaggctgcgcgcgaaagtttgcgctgccatcacaacctgctcgccttcatgccttgagatcacgcaaagaaacgctcatacgttccacgccatgtacacagaagtcaggagtgacgtgacatacctcggcattgccttcctttctgtcaacaaacgggaaacgagtcaaagttgcgccactaggcatagatatg

SEQ ID NO: 571 - DNA, 703 bp, Nannochloropsis_gaditana
ggatgcgattggtggcctctaagacgattggcgttgtattgtgtgtcacgttgcttggttcgaaaaaagcatctgattgctggccagccgctgctgtcatcgcgccgtcaacttcaggtgtttcgtccagaaagtgatacaacgcgatgttgcaccaaaaacctcgacctgtctggttatcttcgagggccgggagaaaaggttgaacactgggcaggtgaggccatgcatagagttgcgtctgataggcgcgggttgtccatgtctagaacgatagttgctgcgggcaaaatgaggaagaaaggaaaaataacaagccaacgcatgcatgaaggttgttctacgctttctcggaaacctttttttgctgctttgtctgctgggtgatgagcgatcgaggacggaaagagggttagccagattggggactccctacatgccacatggaagactgcccccgtctttaagccacggtatcgggtgcccttcctccgatggtctaaacatgatgcaccgatatcgttatcggtggttgccatcctagctaacacgtcgaagcgcgtgagggcgcccttagattcgatgggactgttcactactcttggtctggtcttggcggaggttcctctttggacagtgccacatatctctgattcccacgcactcaccaatttcacaggaccgcatttaaggtattctcatg

SEQ ID NO: 572 - DNA, 703 bp, Nannochloropsis_gaditana
aggtgacagctgacgcgctaggcaggggcggacggtcagaaagaggaatccgacgctgattcataggacattaaaaagttcgcgctcgacaccgatcgactcatgcttgttgctcatgaatcagataagaggatcccagagtagatgtggatactatttttggaggaacttctttttcattttcattggagtcacggctggaagaggaacatacgaccatccggccttgtagattcatttccttccataggatgagaagacgcttattcaaccacaaactggacaacatttatgcctctgatgtagcccttttcccttcgctctccccaggatcggtgccgaaactttaacaccttctgaaaaatattttcacgcatttgccacagatgtcatcaccggggtgcgttttaccaggtttcgacatagctctcatcacgttgtctccttcatcaactgctcttgccgtgaaggatcgccaccgtcgctgtattgaatgaccggtaaaaataaaaaatcacatctcgctggtttgatcccccttcgacaccgccgcgtacatttcctgactctggaaggggagaaagaggaggaacgagagcaggaaaatgaggcgccaccttctccggctgtcgtgcaacaaaaacagacggaaccgcaaaatccccccagtaatattaatggtgtaccttgccctgcttcaaaa

SEQ ID NO: 573 - DNA, 703 bp, Nannochloropsis_gaditana
caacgatagcagaccgaggcggtttcgatccaaaggttttttcgaaggagatagacggatgagtagcggatagctgagaaagcagccactagtatgtgtcacaaatcaaagaagaaacagaaatgattgggtctggtgtcaggcgggtagaaatttgctttttaaggggaaaagccttcgagggatcggcgagatgacgcgctcgccgattcaggcaccaggaggttgcccaagctgcttcctcgtccttggtctatgcacggcattgcgccacacgtgtgcacctttttcacaacatactcacacacttctgttccctgtatctgccagggtctctgacgtcctggaaagacttcaaaagggcagattcagtttgtagaggcaaatacatctcgctttattgctaggaaaaggtccgatggctgaatccagagaaggtgtaagtgaggaactacagatggtggaacataaattaggcgagcatcagcgtcgattgggtgctttgatggccgggggaaaaaagttgtgggaccgtaaggtgacttagacaaaatcacttcaagtcccgatcgtttccacaagtgtagactgggcgagcgaagcatttccctggtcaaacaaagtgctgaaattggaagatggggttttcggtatctctgtaccgtggcggtgtcatcaaaaggaaatcataaacgccacaatg

SEQ ID NO: 574 - DNA, 703 bp, Nannochloropsis_gaditana
tcctggaaagacttcaaaagggcagattcagtttgtagaggcaaatacatctcgctttattgctaggaaaaggtccgatggctgaatccagagaaggtgtaagtgaggaactacagatggtggaacataaattaggcgagcatcagcgtcgattgggtgctttgatggccgggggaaaaaagttgtgggaccgtaaggtgacttagacaaaatcacttcaagtcccgatcgtttccacaagtgtagactgggcgagcgaagcatttccctggtcaaacaaagtgctgaaattggaagatggggttttcggtatctctgtaccgtggcggtgtcatcaaaaggaaatcataaacgccacaatggcttgcgcggatacatttgtgatcatgcgcacagatggcggaaagagtctctgttcccagctgcctgcgtcaatgccaggaaagggtgtcggcattgtcatatctccccttctttcacttatatctgaccaagtgtatagccttgaaacaattgctcccggaggaagtgccatgttggctggaagtgcgacgagtgaagaatctgggcaagtatttcgtcgaatggaagacccgcgacgttccctgagacttgtttatgtgacgctggaaaagataatcaagagcaagctctttgtttccacactggaagccttaaacgatgcacaatgattggaccgatt

SEQ ID NO: 575 - DNA, 703 bp, Nannochloropsis_gaditana
catcaagattatctaccgcgggcgttagaatacattctacttcaataccgcaacgacccttattgctgctttttattattagcgcaaaagtttagagacttgctcaattatttcctgagatatagaaggcggttattaggtgtcaggatatttattcgaaactgttcacaatttcatccctctctcgaatcatcccgcaacttcacaggcggtttcaatcattgagaacctagaagaaggatctttagccaatagggcttccgctgcctctcctcctccatacgttccaattagccctgatagcgaaacaactgacttaagcgaaggcgagccggcgggtgcgttaaccacggcaacagtggcggatcctactcagtgcctgggagtcctacactcgcccgcgggtggacagacctctttccctacatctgcttctccgaatcgtagatcggcagctgctccgccaagttacgaagagtacggtcgcgtgacacgcgcattatcttccccagtcatggaaaccttaaatgacatggaattgcagacaggctacgagacccctcggcccactgtgcaagaccgtctcaaacgatggtgggaggaaatacgcgctgagtggcgtattctgggtgtctttcttctgttgattgtcatctgcttcctcctcgcagatctcgacttgagtgtgcatttgcagacgatg

SEQ ID NO: 576 - DNA, 703 bp, Nannochloropsis_gaditana
caggtttgtggatgatgcctcaggactttttcgcgagggtgattcggtgcgatgtctcctccatcgggtcgacgccgataaggatagagtttttgtgacaactcaacgttcgcagttacctgtgacagattctttttttctagaaactcttctgctcgagtcggtgtccacaattggcatcgacacggaagaatcggaagttttcgattggcagcgcttcgctttaggggctaccgttaatgcaactgtgacggctgtgaaagattatggaatcgtgctctccggtgaagaccatcggacggtcatgctggctccagggcctgatcatgttctcgcatgcgctccaaatgacgaagtgaaagtacgcgtgcttgatgtagattgggccaagcgcgtcttggttgtaacaatgctgcccgaattagttaggcgaggtcgtgctaaatatcgaaagacggcagacggcctttccttgcaaacgggcgcccgtggtgttgcagagattgtccttaagagggatcgttacgcggtggtggaaatggatggcgcactggcttatctcgcggttgcagattatcaatgtccatatcttgccacaggaaatttagaattgggcgtcaatgttgatgttgttgtacgccgcccatggagaaccggtctagggaaaaaatgcaggctatcttatcctcaagagcccattatg

SEQ ID NO: 577 - DNA, 703 bp, Nannochloropsis_gaditana
tgactatcgaaagctttcaatccttcgcaagctctttcccgacgatcctatccttgcggtgacggctactgcaacaccataagtgttccgcgacgtgtctgatgtactgcagatgcgaaatgtagagctttttaaaagcccctttaaccacccgaatctcttttaccgtgtgtatccaaagcgagctggattggacgatgcagtaatggccgtttggaaatttatcgtttgaatcagagtggcatactgtactgcttctctcaaaaggaatgtgataaggtatttagtaagctagctgccctgggtgtcgttacgggggcgttccatgcgggactggatgtggccgtaaaggatcacgtcttgcgtcgctggactgccggtcatgtgcaagttgtggtggctacaaaagcatttggaatgggatgcgtatggcgaaagagagcatgaaagtcttgtgctatgtacgattattccggcacgctggacgatcttccttatcctctcatttgaaccctcttattctattctcactcctccctgcaatccgcatcttatcgtttaagtatctccttaacagccaactcatgacgacatatcatttatgggtttggcttttttctcctcgtcatatttcttctctccctcgtaaaccctcctcgaccttctttctttcacatgtatattggtgtaaatacactcatga

SEQ ID NO: 578 - DNA, 703 bp, Nannochloropsis_gaditana
cggttctggtactccgccaaagtgcgctcagccaacggaacagcttgctcgccccctaaaacgagggcgaattgaggcgcgctccatgacgcggtcaactccaaggcgtgctccgcgcgtcggagcacgtcccgatacgatgtctccttgaccatggactgttgaataagggattcgcgagaaacagccacatgtccgcactgccgacatgcaagttcgatgcacactgcaggccggcacatctctcctttgcccaggcctccgggcttgcacttgatggcaagccttcgaagcagttcactcgcctgtctcgcgacttcctttgggaaagcacctcctagacgctgtatcaaaccctcgatctctgtggatgcattgttggccatgacctgtgcatgaagaggtgtaattcgatgagcgattgagaagtattcgtaaggacgttcgaagttctccggagactcaggacttgggcagcggtggcacgtaaataggcgccaacctgaggctcgctagcgcagaaatggcgaggaggacggccagaaatgcacggctttgaaagtgacggcaatttttgcaagtttttgcaaggccagccacgaccaacacatcttactaaacaatggagccgatccggttgtgtgcactgagcagagtttggtaagccccttttaattcttcccttatttgtgcctagaaaatg

SEQ ID NO: 579 - DNA, 703 bp, Nannochloropsis_gaditana
cgctcgtgaacgcgcactctagggcgtttgccgctatctaaagagttattccacccctgtagtggcgaatttgggattcgtccctcatctatgccactcttttacacccctataattttcacagctagcgtgacggagctttaaagacatcggtgaaacatttgaacgaaggcccgcttgaaatagaggtgctatttacagcaaacccaccagtgccgtcgcgtacaaacaagcatattcaggtaatattcatgtatccagcgaaagctatatgctctttgtctccagcatcaacgaagggaaggaatgggcgtgagtgcctctaaactccctgatggtcagactgttcgcaagaacaacaatgctatcctgagtctttcttgcactttacgatgaagtttattcctcccacctttcaaatcctcgtgtattttcaagaacgctcatcgattacgccgtcgggactcctgcacaaagtttactcgcgaactagcctgtgctttttgctgttataatttaagccgcatcgttccccgtcgacacaagttcgaatgttccgtctgctttgccccctttgtaaaaatacttttactttcagcggtcacaggggaaagatactcaagactaatgccagaccagaaactaatcgtcctttcttactactttgcacagtcatcccgggcagcaacaccatcgtgtaatg

SEQ ID NO: 580 - DNA, 703 bp, Nannochloropsis_gaditana
tccacccaccgtcattgcacgcggaggaagcagcggggaaggagggcagtcttcccggagcctccccacatcccgacttggagacggcgtattggagagagggcgggtgcatggggcgcctcgattgaccccactgttgcgagatggacagccccctgccacgcctcctgcttgcttacaccggaagacatattccagcccgtcagcagaggtcgacgcctcgagcgtgtggctcccgaccgccgcacggtccctgcctccgcgaaacacaaacgacagcagaagcggcggcggtgccaggagaccctcaccgcgcctttccacggttgcagacccagcagtctatccctctgacgaaggcacagcccccagctcacaggcatcgaaggctccggcaccactgtcgctccggggacgtgagaggcccgccacccgaccggaagcagccaggagggacgttgcccgggcgggcgactcgtcgaatgcacgggggcttctgcgttttgccgatgagacagaagccgtggaacctgttccctatgtcacgattgccgcggccgcgccagtgagcgtgcaaggggtagtgaaacgtatcaccttcgcaagcaccgagacgggcttcggggtgctcaaggttgaaagagagggctctcaggagctggtcacggttgtgggcaagtttgggccgatcagtgtgggcatg

SEQ ID NO: 581 - DNA, 703 bp, Nannochloropsis_gaditana
agcttagcgcaggcagaagaggaggcgaaaaattcacactatccaaatatatctcagcacctgaagccaaatggaagcaactcgttcaaaaggactttaaacaacgaagcgggaacatgtaacaagaaaagtgggccagaacatggagaaatgatgtgtgtcacaattcgaggggcggagaggctaggcgataatcatggaaaagatgattgggaaggtgcagtagacgttgaggcaacaaaatcccaggatgttgagctttgcacagatttatccaccgtgccttcaggatttcttgagcggcgaccttcgcctggaaaagatgacgcggaaaacgacaagtgtagtggtgaagaggatttgctctccgtcatccgcccacctctgtcgactatctcggctgcgacgaccaaaatggggtttgctgggagcaagcaaatgacttgcggagcatcggcattgaatgaaacctctaagcgcaaacctggatcaaacttgaaggctttgaagcctggagagataagtgacaatttcattgccctgaacatgaagcggaaaggaaccgggaaatttcgcaaaattaaatcagccaaatctttggcccggcggcatgcctggatggaggatcggcagcaaacgaagtcgagaggggggaaaggttgcgcagatgaagcaggtcctccatcccgcttatcccgtcccg

SEQ ID NO: 582 - DNA, 703 bp, Nannochloropsis_gaditana
tccagaatcctgtcgacttggccggggcctgcgttcattctaggctttcattaacggaggcaagggcctccaccttatcgtctgtctcgcctaggaacccacctttcagcagcacgcactaacacagcgttcctccgagtcctgggatgcagctaccctttcccctttaagctggtttgacagtggattcaatatgctatggaaaatgtcgaagataggaaagtgtagtcccgtggtcaaatcgttgccctccatgcggcgcacctccttgaccgggaaacagagcgtgaactagccagactagccggagatggcggtgtttggggcgcgacggctgcattgtaaatccatgataaatgtgacatatcattcacaagaagtgtgatgttttgtgccgaaaaagaggtttccttgtctccccgccgactacaagagcgagcgccactgcgtcgtcgacctcgccgccagcgtcttgctgcctcttcgccccctacaagcgggagcctagcgccccacggtcctgcgcaatgcgacgatgcggctttgattcaagcatggcgttatgtgcaaacatgaatactgatttacatccacatacttatccactcgtcattattccaggaagaagacccgggaaggccgggtgcggagaatcagggacacagtgtaggcagtcaaggcgagaagggcaaagcccaccatg

SEQ ID NO: 583 - DNA, 703 bp, Nannochloropsis_gaditana
gatctatcgaataataataatggcggtcagcaacgagaacactgtttgcacgcaggggtgtcggatttacgtcacatcgcaggcgcgacaaactccaaaaattgcgacataccttctgagcctccaagcctttcagccgattttgtgcctgctgctcacgaagaataatgaacggtcgaccatactcatcgaatacgagagacatggcttgatgacttgtcgtgagctgttttctgggttttgttctacgtgtatgaaggcgagaccccttcttttcgcctggagagctctgagcgacgatctgtcatcacgggtggcagtaggtgagaaatgttcaatgcaaatctctttcaattagtaacgcgacactatggcatcagctcccatgcgcagcacggtgtcaatttcggcagtgcaagacgccaaaagtagagaacggcgggtgggtggcgagggcggcaggggttccggcgattgacctcatcgtgtgactcccccccgctgagcccgacctcagactcacatcgagtgcattgtcataggggaaatgtgtcgaaatgatggtcgtgtggagcttccatcacgctatcgtccactcatcctttccaaactacggcagatttattctttacgtccccggcctggccttcggcgcatctatcgcctcttccttctcccaatttgttccaaggtcaaggcaatg

SEQ ID NO: 584 - DNA, 703 bp, Nannochloropsis_gaditana
ctcaccaacagcaggtgacatcgcaggattggacatcagcgagttagatgagtggacagatcggcaggtggaaggttggaaaagacgttttcaaaagatgactatacctgagctaaaggatacatccaaacgacgggggttgggtgctggcggccttaaaaaagatttggtattgcgtctcgtagagtcggtgagaaaagccatttctctgcaggggagcagctgggaaagaaatgcatgcgatacttccacagatgcggaccttgcggaggcagatgaaagcccaggagacgactcggacgaggaagattggcgattagacatcgttgagtcttccttaaaggagaaatttcagatacagattacacaagatagtatacccaccgcgcctaccatgtcacaaggttcgtattttacgtcaaacaacatagaatataatcttcaatctactcctctcggaaggaagcgcccccgcatatctgccctgaatgattttttgaacggagaagaagagaaggtatgtaggaatgaggatcttctagacgatgaggattaccatgacagcagcggcttaaaaaataggacgagggagggtcacaaagagcacgggaaaccttgtactggccacaggagctatgacaggaagagaaaagatcccgcttttaaagtttatagcagggtttcgattttgcctgcgcctatg

SEQ ID NO: 585 - DNA, 703 bp, Nannochloropsis_gaditana
tcggaccccccccgtcatcacacttacgcaggccctccgagccatcaggtcttgccgtgagctgaaccccatccatattgccagccctcagccgtgcacgaataatctcctcgagatgctccggcaagcgtagcacaaaagcttgctgtgcgtaatgaccgctcatggcgcccggattattttctgttcactgatttggatcagtcctttgtgcgtgtaaacattccccttgcaagcgcggccttcttcgtgtcttctgtggggtttcggagggttgaaaatattgtgagcgtgagtagtgccaaaagctagtgtccttgtcgggcggctccccgctaaacgaggtttagaggtagcggcaaagcgatacgagcctcctctcgaaggcgatgaggtcgtcgaagccggggcacgggtgatggacaagtgcacgcctgcgcacgcacggcactctataccgatggtgctgatcatatgtacgccaccgcgcatacagagcctaatttcggggatcagagccacgcttttggagtcatcatgtttccaggtaatggcagggtctggcaccaacggtcgccaccacatcctcccgtgcatcctgttttccaaggcccaggtgctttaccgtctgcatcattgtcatactgaacaccctttatccttggcattaggtcgtcgttcgtttctgttggtcctgctcatg

SEQ ID NO: 586 - DNA, 703 bp, Nannochloropsis_gaditana
ggtcataaggcggacgaggccataggcaagcttgcttttcggcatacgcgatcggacccgcacttccaccacctctacggtaaggacgctcccgtacatgcccaaaacgtgccattcaccatactaatgcatcgtttttcagaggaatctttgcaaaatgccggacacccgctcgacctgtgaccgcagtgccattagcattatcgccctcgaccctggtcacggcggcctcgccgctcaagatgggggcctcgtgctcgcccgcctggcaagaaaattcaaccagtgttcccaggttgcacttcttcggaactgatttttgggctatttgcctcgtgtggaactgtacgacttagttggtgatactcgcgtgtttctttttcattgtcttggaattgagatgccgtgacatgcccggcagcctggcgaacagtacgatatcatacgtacgagatagtatcaattctcactccgttactcatcaaaacagacattgctaggacggccaaaggccttgcatttcatcagcaaaaaaaaagaattctgctacaataagtcgaacaccggccacggaccgtaagcttacagcatgagtaccgatagaggcggcggtgaggccagggacagggcaggcgctggaagcaatccggacgaggagaggaggcatgcaccctcacacgccgtcccaaaccttgtctcgatg

SEQ ID NO: 587 - DNA, 703 bp, Nannochloropsis_gaditana
cccgccgccggcgtagagtacaaaggccaataatccaatgttaacaaatggggttagtctgacaaacaatcgtgtacaccggcatagatgaaatgaggcctatcttaaccgaaggacgtcaacagaaggctactctttttaaccgcgatttctagctttgtgatttttagatatatgaaaccttgagtgatctcatcggaaatacactcagatccttcgtcgacagtgtagcataatactatagaagaacaagcacgaccgacaacacgtacgcgcagccgcgtgggccgtgtactacatatgttccagggtgatgtatgttccgggatttgcgcatgagatccggagctttgttggccctgtgaccaagaccggaactgagatacgtgactcaagcaatgtgagcataagtcagactcaggaaaagaccgcttctgccctgccacgagaactgagacgtggtaggagggagagaaagctgaggttcggccggtacatggaccgagccggagaaacaacctgagtccctcgctccccctcgcgtccgccccccgcttctctcccttgccctcctagccaccccgccactccgcgtccgcgtcgctttcctgccctgtctacacgcgtacctctttcatatggcattaaattccttttccattgatacagcatcatcagctttcctgcttggctcggtcacatg

SEQ ID NO: 588 - DNA, 703 bp, Nannochloropsis_gaditana
tcgactgacagcaacgctattccacgcgaagagaaccatctttgtctccgctcttttctcaaagattggtgccaacgcgtaggccagggtttgatgggaagtgtgggggctacatggcgggtttccacgtggatcttgggagagaatgcaaggctgcgtagccggaacggagtcgtgaggcgccgatgagtcgagcctaggactcaatttccacgccatcaatgccttttttgctcacctgcttcgaaacatatttatagtgcatactgttgcgcctccaaactttaccaagttcagtgtcgtaaagcgcatggaaaaggcagagggatcgacccggtctgacagaccggggctccgggttgctggcttcttgagctgggcctgtcactgagtgatatgatagaaagcccaaatatcaaggctgaaaagacttgaggacaaatttctacgaggggtaaagctgcccgtcgtaacaatgtttgtccgtgatggcggctatggtagagagctccctcgccaggggcacggtgacgtctgtcagcgagcaacttgagcctcgagtgttccggaggaaggctgggcgggcgaattgaaaggcacattcccacgacacaccacattgctccacacagatttcattcttcaagctcagtgctacgtacatctcgcgagtcagcactctatcaaagccgcaaggaacatg

SEQ ID NO: 589 - DNA, 703 bp, Nannochloropsis_gaditana
tcgtcacatgatgaatttggaggctgtcaacacttatgaaggcacacacgacgtacacgccctcatcctcggccgcgccatcaccggaatccctgcctttgttcctcgaaatagttatccgaaggcccaaaaacgcgagtcttaatgtaaaataagtacctccctaggatcaccaagaagaataaggttcttgatctttctttttttctttttttttgacactacggcgtttcgtacaacagattattgattgcagaaagtgaggcgctttccaaaccgacaaacgcagctaaccgatatttgtcttttttttaaaatactttcatttccttgaaagatattggcgcaccattgattgccaagcgctgcacataacgtcgcagttactgatgctaaggatcaagctaagagcgatcggagcgtccggtccacggtgctgcttcaggaacttgctgagcattgtgtgtcccaggacgtgatgttccaaaagcaatacgagatcttttttcaaagcagcgcgaagcttgacagcgctcgcggagcgatgtctttgtttcccgaacttggtgagggaagtctccgcttctctttctggcgatagtcggatccgcccgtctcattccgcatattcattttaccacacgttgcatcctggaaccaattgcacttttctctacaggtcggagatatttccctcttcatg

SEQ ID NO: 590 - DNA, 703 bp, Nannochloropsis_gaditana
acaagattcagaaattagaatataacataaaatattaatgaggaatccgacacacatgacctcccaactacaaagtgtactgtagatatgccaattctgtgcattctgtgctaaaaaagaagacacgcggatagacttgttgtcctcttcttctttcggtgcttctttgtcaaatcttgatactcccctgaggcctctatctgccgtgacaaggctgtctcgaacatagattgggaagctgcttttccatgccaaccgctactctctgcataaagatagagcgcactaaaaaaggtttcaatacgttgtttatcccaattttttatccaagttaacctatcactcgattgtcgtagaattgtaagaggctaagcttatttgtaggttgataaagcacttttgagtcggtacacggccaaaaatagctagaatcatgggccatgggcgagtcagcaaaaagccgtttctctaaccgtccctaacagtcgagcttttaacttgtgctattcttttgggtggatcacttgtcctttacgctgaacaaataatatacggcttcatttcacgcccaaatctgaacatttcattaggttttggctcttggatgacgaggatcatgccccattcttctccggagctctttatacctgccagccctgccgcggacgcaccgccatcgaccgatgtggacatatcatccatg

SEQ ID NO: 591 - DNA, 703 bp, Nannochloropsis_gaditana
acggctttcattgctgacaccgccgttttgcgcaaccacggcgagtcctgctgcgattgctaggatgcagtgaccgtgggacagcaaaatcgaggaagcaggatgtcgaagctggcgactacggtgcgattcacatctactaagggtacccgtcccggtccagccctgaggcccttttttctcagtgaaactcatgaatcgtgacccgtgggagcttgtcaacctcctgcagcagcctgaagcgtataaagtccaaatagacgccgcatcacgcctaccaatgcgcatccaacccctcatatttgcgatggatcgagtcgattccttttgttgcagtcgctgacacgtccgctttcagctgaaaggataacataccgggagatgaacaaaagctggaatcagggtgggtagacacacgaatacgggcgcaacacaccaaatcactggccttgccttaggatggtcacgggtaggaaaacacatgcttttgcttcaagggcctccatgtgggaacgctacgacatgtgacagggcgacgcgcgagtgctcgcttgttgctgttcgccgcttgccctcatgctcggagggcatgtcaaatttagtatggccgcaaggcgcagcacgttgggcgcaggccggacataacgctacatgtaacttactaattgaatgcttaacacttctatgaatcctgttcagcatg

SEQ ID NO: 592 - DNA, 703 bp, Nannochloropsis_gaditana
ggggccgcaccgagtcccgcaatgggtaacgatcaagaagaagccccatcgcttttattcccctcaattgtgcctcaatcatcgacatcacgacatcgactcagatcttcatgtgacagaggtagtggcgatgtagtctttcggcaagaaatagctggtatatttgaggaggtctgtccctgtgagggcgaatccaagcgcacgagtgagcaggatcgtggaggaagccacagcaggtgcacatggcatagtccctttttgcgtaaacccatgggtgtgataactgaggtaagcgatcaagacacgtatccatatgttcacggagactggccgttatcataaaagtatcaagtatgagcactcttttcgtcagggatccatcgtatgtcattaacctgtaaagttgcagtagcttaatgaaagtgacgttgaagcgtgcaaaattcgtcgtcttcttaaattgcttctctacgtgagcaggaagaagagaaagagaaacttgcgaggcgcctcagcctgtacgatttgctggctgttgggatcggagggacagtaggcagtggagttttcgttttagctggagagattgcaaacgcccctgacttgcctgcgggcccttccgtggtgctgtccttcgctgcagctggctttgcatgtttcgttagcggtctctctttcgcggaactagccagtgggatccatg

SEQ ID NO: 593 - DNA, 703 bp, Nannochloropsis_gaditana
ggtgggcaggcgcttcaatgtaagtcgaggatgatgggaattcgggcagaggcatgctcggggaaaaacccaggttagaggcgacaaggaaaaaggcgaggcagcaaaagccaaaaagctcgcccgccccctgcaaattgtcggggaggcctctcaggtaacagcacgtggtagcgtctccccgcatgtcccgcaccacgcccgcttgggcagagactcgtgaaatgtgtggttctgttgacgttaggacgagctcgagtcacggcaggcgctttagccgtcctttaggtggtggggatggatacaataaaagagaagaggcgtgtcgaagccttcaatatgcgtcactccttctctccctcaggcaaagcctcaggcgcattataggagccgtcccgcttggaaaccattagttaattttcttttctcgctttataattctactgcacataaatgccgcgcttacaggcaccacagtctctgtatttactctcacaacactcggctttcttgagggagaggaggtgagacggaggacgggcaaaaacacccgagcgagcgacaaagaagagagctacgctgccttttcagcaaaagtgacggccgcatcacatttttgtcaccgaccatcactcaagtgatttcaccattcacagtgccctctgttttttgagcgggacgggcgctaaagttgcaagacatg

SEQ ID NO: 594 - DNA, 703 bp, Nannochloropsis_gaditana
tcaagcgaggacgaggacttcgacagcgataattcttcatattcatccggagatagctttgactcggacttttattagcgttcttgagacttgtgaatcactcaaaagtcggtctttcatgtcattctctgcgccaattcttcttcaccattacgagcccatcgatcgtacttgcctgaggaagagtgatcaaacgctttcttggcattcataaggcaaaagaatgtcaatatcaatgctccataggtatattgctagatttaggaaggagaaattttctttaggatgacacaaaccgcccgcagaggaactttgcctgggtaaaggtcgggggatcgcatgggcctagtcaagaggggaggcggcggaggaaggtgctactggaagaacccatgagtaagggcaatctgtggtcattatcctatcaagaatgtaaatacggaatgctgaatcgtagatccaaaaaatagcctcaaatcaacattcgcaccgaaggatttgattcagtaatcgaggagcttgttggaagatcgaatgggtggaacggactgcaacccccaacccaccgcgaccttctcgaacgtgaaaactacaactcgacgggcatcaacaatttgggctgcgaaatccgtcaccactgatttctctacctttttttctttcaagcagaggaagtgtagttaccggcaccaggacaacgatg

SEQ ID NO: 595 - DNA, 703 bp, Nannochloropsis_gaditana
cttgcttattaaacaggtaaacttgccaccgcccgctgctaagtccagtacatttgtacttttccccagatctctcttgcttaatccgataagttttgctacgtagttcacggccgctacaggataagatggccgggtcctctcgtatccctccgcctgctttcggaagcctgcagccgcaacatcgtgtatctcgcgaatatagacccttggaattatgaacccaacacttgaggtcaaatttaattccagccgccttcttcttatttttaaaaaaagcatgcttgatggcgaagtaaatgggaaagaaaggtaaggaatatggttggaatgaattttacgcatctttcgtcttgaaccatttcatccaggctatattgcgcgtttccagccaaaattgatcgtgttataaaatctgttgctaaatagtccactttttatgttttcgagcggaagtttggtcaggctgaaacagtgagagggtcacattccttgttttggcgatgccggccatggggttgatgtctttttccctgagatgatcaaaacctcacgtgcacgacttctcaacaccagaggtttgtgcccggaggtttcatgaacatttggttctatcatggaagagtttgattgcgggattgatttgatcgaagtgacttctcaacctccccacctccgtcaaccactacctcctcaccctcca

SEQ ID NO: 596 - DNA, 703 bp, Nannochloropsis_gaditana
catcgatgctgctccgacaaagatgtctcgactgatcccattcgagttatcaactttgaaaacatcctctgatgagatcgaaaactcgatagcgggacgtcctttactacaagtcaatgatatcggtggagtcttgtctccgaattatgccttggtgggcgtcttgggagagaaagagccgcgaaaacagagtaaaaatgggtgcaattacattgtttggttcatagataatttaaaaggccaatctatcaaaattttattattcggagatgctgtactgagcggtgaaaacgtaccgcttggtgctgtatgcctcctcctggaccctgtaggctcaaggcctgccccatctgcggccatgtctttgaagatccacaagcctcatcaggtgatacagattggtctctctgctcattatgctacttgtggttttatagatccgtatggctttgaatgcgataaggtttacaatcgccataatgcccgattttgcaaactgcatagtgccacgccgccgtcgagccaggccctgagcctgccgaatcgagtggcaattaccgcgccatctcgtgcaattacaagttcacttcctacgggtaccacacgcccatgtgggctacgaggacataatggcaaacctcatatttctagaccgactatgtctgtggaccggccttccagcctgattcagaagccgggtaaa

SEQ ID NO: 597 - DNA, 703 bp, Nannochloropsis_gaditana
gctctgaagttgtggagctgacatttcccgctgtacaccaatggcacgaaagcgttggccaaataattgagatggcaccatgttggactgatgacaacgaggaagaaggcagaaccgaagcagcaaaggtttgcagcatgaagcgaggtcaaaagggtacttttacgcttccgccgtgaaagctcgtgatctcctcctgtcttcacagacggcatgtacactacggcggaaaacctatcgaccggttgtcgtgtgagtacggcaggcgcgtcagtgcaaggagcgggggcctgaggggggaggtcggcgagggcggccaaagatacatcctgcgctcagaccctttgtcctggcaatgtcagcgtactttgtgaagacaaagcacgttacgatggtatatgtggtactctctatggtaaattttctgtgtctggcctgtccatcaaaaagttgtgggcaacctttcactggatcgacctctcccctccgagtcactgcccatggccactcaagcgacccctcacgtcttctcatgcccgtgacttgcgcattcacagggctgcacgtcatgggtaaacataaaaagctgcagcagcagcagcgacagcaccagaaaaaagtagccaaagtaaccaaaacgctgacgcaacccaaggtcaaggcctcaaacaaagcgcagcgcaaggagcttgaggcccggatg

SEQ ID NO: 598 - DNA, 703 bp, Nannochloropsis_gaditana
gtgcacatgatgtgtacggcataagcgtgggtgtggaagtatgaagtcagaaagctcgtcgtcgagtaccccgcaattcaaataaggaatgggcgggaaagcaacctcctggtcagatgcggcgttgccgatgcacactgctcttgtcctggctcattttactgtgggctctggtattcttcatatcttcaacatcaggtttgtaataaatggtaatccccagaggccaaagcgtgaatgagtaggtgcttgtggtttaactcgagaacgcgcggctaattgcgactctacctcgcctgccctacgctctctgcctctacgactgctcaagcactctatattaccgcataacacaagtagtacaggcattcattgacatgcagcggaaaattatgttgccaggaacagaggctcctgtttttgttgcccattgacgaccaaacaaccagcatgcgcctccttctttccctcctcaccgttggggcgctctcaagaaggacgacaacctatgccttcagattcatccccttcctcgccactcgtccagcaccaccgcatctctgttcaatatccgctttacgtttttccaacccataccgccatgaatccagagagaagacaggtcagagtcggatgccccatccatctcctacaaccctcctgccgcacgcacaacagccgccacatgggaagggcaaatcta

SEQ ID NO: 599 - DNA, 703 bp, Nannochloropsis_gaditana
cgcctgcacgaataaaaggggattgtgcatgagactgctctcccctcaaagggcttgatctttcagctcaagcggcttttacgacaaaatggcacgtgaagtgtcgccccttgatggctctcttgagtgacttgaacgacaacgtgatacacatggtgaccattgagcacggggaggggatttacgatccaagaagcaaagcatcgatcattccagcatcaaaaggagacatgccgaggatactcttcgatagcggcaatctccacctcccccatactttattgtctttgcctcaaaacttgcgagtctttgtctaacttttgctcatctcattacaaatcaggcttttactgtccctggcccacatcttctcatcggggacgatcaaaaagacttgtcatcctgtggccagaacgttgggcgtttccgagggaggcagattgcaacataaaactgatggagaatgctacgctagaatccggcagaaaaggtcagcagcagcatgaatcgcagcaaatagatgaacaacgacagccacgccgatcgagtcgcggaggcgcgaggacaaaaagaggattaaaaacgcgccgtcctgtagacgctctgtgggtgagagccttgaccgcccttcctacagaagaagaaggacaaggacgttggcgctttgccttcacacagcaaacaccatgtgaattatgcgatg

SEQ ID NO: 600 - DNA, 703 bp, Nannochloropsis_gaditana
tgggttgcacagaaatgctccgaggatggtgtacataaatggataattgctgatcttggctacacatattaggtgtcagtagcctgaaacatgatggtcaacttggaggtctactgcaacatgttgctaaatttggtctgaggcgttgggatcgttattacaaactagtattttgtttcaagagacgctttccactacgtgcttcttctttcttttttccactatctcttcacaacggtatttgtcaatgtaatggccaaagcaagaatttttgttcccggagatatcgcaagtaacaaatgcgcgaccctatctacagtatgaagcgatctcccaggaaagtttatttttcaaattatgtataccgaacgactgattttctcatttccattctctcaaaaggcatctttcggatccattgttttcatgaacctgagcttagcacacaattcggtaggtttttaccagcgttctaagcttgcctgcgtccctgttattatgctggtcgaatactttatttctatcacagagttgtgcccctctcaaagcaagtggcagtcaccgtcatcgttatcggggtgggggtggccagtgcgaatgatctgacggtggacctcgtcagcgtggcactggccgcgattgctgtggggtgcactgtcatggctcaaatactctgctcacgtcttgaataggacttggaatg

SEQ ID NO: 601 - DNA, 703 bp, Nannochloropsis_gaditana
aagaaggacgacaacctatgccttcagattcatccccttcctcgccactcgtccagcaccaccgcatctctgttcaatatccgctttacgtttttccaacccataccgccatgaatccagagagaagacaggtcagagtcggatgccccatccatctcctacaaccctcctgccgcacgcacaacagccgccacatgggaagggcaaatctacatcacccctcgttgaatggtcgttaaggcgcgtaggaacaacccctgcgatcgatcttctggaaaacgctctggaggaggatcgattaaccaatcttggggtgggtgacgacgaagggctcctcacggccgcgctcaaagaatgccgctctattggcgacggtagacgagcactcaggtatctaggcatggtaaacgattatcaacttcgagagatagattgcgtgtccacaatctatgcatgtgcggccgagggtctgacggacgaggctgtcagtgtcttccgtcggctggcaaggaggaagagagggcccgtccgagcttggggtccgccgtgttacgtcgccatcatcgtggcctgcagcaagggcggtcgaccagaggatgcggtggcgtttttttcagagatgggggtgaacggggagccggccccagacgcagcctgctacgccgccatgatggagacctaccgccggtccgggcgcgcctcc

SEQ ID NO: 602 - DNA, 703 bp, Nannochloropsis_gaditana
cgggtcggaaagtgccaccaccttggccagttgcttcccgaatttcatgttctccagtcggctctttctggcacttccgctcttatttctgacggaacaaagacaccaccgccgtccctaagcgctccgactacgtcaaaacagtccactgcgatagatgtatcaaagatgtacgggtgagttgtgttgtaagtgcaccgcgcggctcaaaggcacagactgaataaacgaaggtccgaaactagaatttaggggtgacaccagttatttgaataaagcgacacacatacaagtcctctatgcatttccatgtgtcgcgagaggcgagaaagttctttgtgtgcttcacttgtaagggtatcacaaattgaagagatacattcaggcgctgtgcgctgcgattcggtgcccctctgttctccggatgtctcccgtcacggtcagcaaggatcttttcatttgggcctcgtggcagaaacaagcttgccgaagcgtgaccgagacgtttcaacgtctgacaatatcacgtggattactgtcatctgttttgttctaaaaggcagacgatattctcaagctgtacattcacgctgattcggtgctgtgatagggtggaaggcggagagccgtacgactgatatcgccgtaaaggcccttaacccagggtcttgggcgcttcctcgaattttctttgtggaaaatg

SEQ ID NO: 603 - DNA, 703 bp, Nannochloropsis_gaditana
ttgaaaaacacacataaggacaagcgatttgggagtaccgggcacaagttttccgccaacaatccttacggaaggcgcgaagcgggggactcgcgacagttcacgcgatgaaacacgtgcagagggcgaacatctcgaggagaggggcgcgccggcggagggataggacgcgatggattacgtcgtgggacgtaattttagggaaaaagaaccaatagactgaacatcacgtttccctcatctctttttgttgtatttctcgaagtattaaacgcaatctacatcactcaaaaaacctccccaccctctccgggtgtctggagcgaacacgctccaggccctctttcacgctcgctggccacccaccgccttatcacatttctgaatatgatgcgattcctgaaagtgaaagcactcactgtagcatcatttttttgtgttcacagcattttgcacggcttcattaaaccggcggtccatggacgaatcggcgcgggcgtcgccacggaggtcataggcccttggtgccgcctctcgagaggggagcgcacaagccacaattttctcagcctctcccaatattgaaattatcatctgggcagttgtacatttatattgaactcgggacggagaggccgcaggttccgtcgtaaaaagcagcgcttggccaaggcgctctacaacgaagccttcacacaccatg

SEQ ID NO: 604 - DNA, 703 bp, Nannochloropsis_gaditana
gccgccctcccccggtggtcaagaacgatctgcctaccccgtgattccgccactccgattccatgaacgggaaggacgtgggatattttcacatgtttagttgccaaggtctcagttggacatggtgcatgggttgtagaataactgcgcctgttgatggcgacttgtctcgatctcaagccggaattccgagcaagtggcgcgtccaggtcacgacacagaatgacgctccaaacccgcaagcatcgcgttatacgaaatatgacagtttttcaatgtgagactctccggcacaagacaagcactgattatgagagactttgctgtcttgcaactttgtgggagagcttcgtaccaacaaaaaggaatgggcccagcagcaacaattatggaatcacttcacaaagacaatctacaatgagttcactcttcttttcctctcacgtgaagatattttgagaggttttgttgtgtttgtgagggaaaaaatggagcaagctgtttcgtgaaccaattcatttgtttaaaagcactcgtacattacatggcacacgagtcgcgcggttcgggaacggaagtattcctgaagctgccatgccttgtaatgcatcttcataccttttagcgagccaaatgatatcatgatatacattttgaacgaaatatcgtatgtttcagtgtacaggaacgaaggctcgcaatg

SEQ ID NO: 605 - DNA, 703 bp, Nannochloropsis_gaditana
tgagtttttgcgtgggtgtagagtggtgggatccaggatcgacgagtccccgaaagctcttgtaattgagttgaaatactgtcttctctccgttgcgaggaaaacacatgtgcacacacaataggtaatagcaaatatgaattgaaaagtcaagctgtaaggaaggtttactcttcagaaacgaaggacaaaggcgcttgggggctccgatcggatcgatccgtgctttcaagcggcggtcctactagcagtgccacctatcagcagtgcactctctcgctcctcgcctttcagtccttgctcatttggccttcaggaacctattaggagcattctgtgaccctaacacatcctataaatgtatatatgccaatcgcactttatttgcagtttattcacactgcgacgtatccactcgcacttttgattccacttcgattttccaagtgctttcttttcctgctgcacggtccactaagggaagctagcgtgcggtactttgagttctttcctcccttttaccactcagtaggccaacggagcttgactcataggaaagcactgtccgtacggcttcgtttgggctcgagcacctccgacccaatttcgtcgtatcttgaagcaatcggctgtcgcccctatcgtccctcttttgccgaacaagtgctacatttctctctcattcaccgaggaactttgcatg

SEQ ID NO: 606 - DNA, 703 bp, Nannochloropsis_gaditana
ttccccgaagcgcagaccgcccatacgtcgcttgatctctagaatatcccggtcctcgtgtggaatttgccgtttgcgtgatggagaggggaaagagtaagggaaaggctctccgtccgcaatttgtgtgcgcattttcgatggaaacctgtcgcgcagacttgccgaatgctctttcctacttgaaacgtcaacgaaaaagggatgcgttcggcctcccagggtgaagcggcctgtgtgaacgtgagggaataaatagacagctcgcagtgcacgtaagttacaaattaaggtttcggcgtgtagtattgctttaatgaacgtctgtgtgttccagagcccaaaaatgattctgttgttatgtgctccgggatttgtcgtacttttcttgttctagaggaatcgccgtacagttgctgcggagtatcgcacttcttcccaggccaccatcttgcgaagtaatacatatcagaccaagtctcgacaaacattctttaaaacttatagactaccatttactctaccctgacattttcaatccaaatgtaaattttgtcccgctgatttcttcgttcccacaggtctagaagaagagaaggacgtcgcggtcatcacagcttgaacatacactgccgactccttgaaaatcgacttctgctttcctatcttattgaaggcaggcgaaaatcgtcccttgatcatg

SEQ ID NO: 607 - DNA, 703 bp, Nannochloropsis_gaditana
tgggtgtgtcacggacaggggttgacataccgcacggtggctaggcatctctcaggccttgtctccctcgccgaccagggcgcggggcgactcagcacacgtccgcgctatcctcgacgatctttcctgccgccctttgagagatttgatctcaaagtaacccctcgccccctcgacgagggtacacacatctccgtgcgtgctgatgcctgttttgcaagatgaccgacacgttgtcttcagtcaaatagatctggcatcacatattattgtgtggcccgtggggcattaacatccgtgtgaacccttcctgtctgacagacgcgactgggctataatccgaaccagaattacactatgctttgaaaattaggtatgattgaagactgatatttgatttcaggcagtttttgcggcattaatggccgaggtcagatttgtgtccagccctactgagactatgtgtagccattcatgagatagatctcttctctctgtcccgttactatgcggtgcctgttcaagaacaaccctatcacattggacaattagttaacctttccactgtcctgcagtgcgtcgttgtcccggcgggtgtggagagacatgctgcaagtggctcacgggtttcgacacgcgagtcaattaacgtttcctcctgttcccgtacttgatacaggtcacctttctacctaacaccatg

SEQ ID NO: 608 - DNA, 703 bp, Nannochloropsis_gaditana
tgtcatctaggagtacgaccctgaaatgaaagaaatacaagatctcaaaattacacccgaccccgccaccatatgcgaacgtatgtacacactgtaatgtacatatcgcggtacacatacacgatgctgcttatgcaaatgagacttcacttactctggggacatttgttcaagactttgtcatttttccataagagtggtgatttaatggtaggctcattgtcgatgtcataattaccaactagaacaggtgctgatcatcacaagcaaatttgacctaatttataacagaactaaattttggtatccataggatgaccttttcgtgtacttggcaaggagttgaaatggagtgtagaggatcgaacgacgagaaacttcttgaggcgatgtggccttaaatatttgaagaaccgttaggacagttacgggaaagccgtttcgcgatttcaaccaccctattgggcccttccacctcctatgatgtattgctgtggtcaccgcgacttacttctgtccgtctgtattgcatccatattgagtattatgtcaacctggcatgtcgctccattctggtatcctttccgcgtccgattatttccttcttgtgtttcgttgaaggcgcggcagagaagttgtagggaagaccagctgattcaagatgcacccactgacctttaatagttttcctatccaagacatg

SEQ ID NO: 609 - DNA, 703 bp, Nannochloropsis_gaditana
aaaagacctcaatcacatcgaaaggtgtaggctgcaaaatgtgaaggaaggacatacaacgacaccaggaataacaggggaaaagtgtggtagtgacgcttgctggatgcaacgtgtagaagttcatgtggtttgtcacttttagccaggatatcatagacatgatgcgcttttgagtgactttgatgtgctgctgatacgagataaatgtgagtggggacgtcgacgcgctgcgcaatttgccgtgacgtggaatggctaggtatcggaggatccttaatcttagggaagataaagaaaagttatgatcgcgggcaaagataaggtttttaaaaaatgttatcgtttcttgtacctgttaagtcataaacaacagttgtcagggcgctttccccttaggcatgaataggccctaaggaggatagcaaagaaattgtggaatataacgagctgtacaaaaatttcagcatacatatgattacgttattgaaaagcttagcgtcagatttgggccccacttagctttacaccgtactctccaggcaccatgtcctattgaaaaggttgaaaacctcctgacccccagcgaccgctggagagcccgccctcggctcttgttcctgctcgtctccggagatcttcgtctgcaagaacgccaacggagacacacatacacaggacgtcttttggaacctctatcatg

SEQ ID NO: 610 - DNA, 703 bp, Nannochloropsis_gaditana
tgcccgagcttcatggcacctgattttcgatggtacaaatctcaacctctttcgagttcttcgccgttgttgtaccctttacctagtgtttcacatgaaggtcgcgcgctggcacgctggttgctgttgaaaaagaaaaatcgacaggtcttggcgagcgagaccgactactagtagtagggcaagggcaacgcaccgctacgactcgtaacctacgagtccccaaaaaaaatcaaaaagcctgggcttggcgaagtcctgttttaccgttgtaagaaagatcgtcacgaggatgcctatgacccctcgagaggtccgaagaaattcttctttacgagatgatgctgttgccgggaatcgtctcactcatgacttcaatctctctctatctcatcaccacgcagcttcttcattcatgtgctctatatctggaaagagttcgatactgctagtggctgtcattttactgtcaaaagatatcacgtccaccagatccttccggctgcctttatcatacgtcaaacgcgtatacattcctccatgcaatgctcaagcattcttgccactactatccgtttctcaagctacctcacgtcattcgagcctgctgggcctgataagattacctatgagggtgccacggactgctgcatccgatgagactgggctcggtggacgtcggttccttgtgtcaactgagatg

SEQ ID NO: 611 - DNA, 703 bp, Nannochloropsis_gaditana
acgggaatactaacgcaacatgtgttctcatatgctcctcatacactcatcgctcttcagtacattacacgcgcgccgccccccgggatgatgttcgttaaacacaccttggcaattgcgaataatttttgttaatgtctcggccttactactcccattgagaaaggaagagaaatgggagcgcactgtagagtaggagcactgcggatgctctctttggtcttcttggatggcggcatgcatgtggtccctgcccgaaccgtccataatgcactccccggaaaatgacgagctcctggaagaacgctggaaagatttcaatggcgtgtgcgcctgaagcgtgattcgattatatttgaattagaaactgtgaaaactgagagcgtgccggcagttcaggggcccgctattccggttaagtatcatcgctccagcgccacgtcctgatcgacttctagattgccttactcgcacactttcgctaaggtttttctctttcataatagcttgagatttgctctgccagctgcagcagagttgtcgcactttgagagacaagctcgcaaataatttcccctttagctacctcaggccttccctgtcctccaagcattccaagcagccccgatatcccccagatatgcatatacccggtattcgaagcatttttcattcaactcatcatttttttccttgtctgaac

SEQ ID NO: 612 - DNA, 703 bp, Nannochloropsis_gaditana
ccgctgcattcgatacccttgccgcctctttggccttcgacaaggtgcgacacgccacgaagacgtcatggcctgcagcggcaagctttttcgatgcatccaatccaatgcccgaattcgcgcccgtgatcaagattgtttttttcccttgtccaccggtgagcccgccgctggcgttcaaagaagggacccgcgcttgcactgaaccagtagatacaattgtgagtcctgaagcaagcgctgcgagcccttgcgtgatgacatctttccgactcttttgcttggcttcgcctggcttttgaatagcgcgcaatctatgcatgtcaggctttctaaacgagaatttcccgggtactcgaaaagcaaaagttttgttcgccagcatgatcatgaacacgatccctagaagtccaggccttccactcatcaactgcattcctaatttgagttctatgtgtcgtcctaatgcctgtgagagtcagtgttgtgtgtataggccgcgttcgcgtgttgcgtggatagagtagacctacgaaaggagaagcaacggagctgaagccttgcggcatcgctgttcttgcttacgcccttttcatcactcgttgtcctgggaatcgtcctcatgaggcctctcgtgcagcaatttatgaggagattgctcaatctgcgtctttactgatagcacaacagcaaattggtcatg

SEQ ID NO: 613 - DNA, 703 bp, Nannochloropsis_gaditana
ggggatgtctggtcatctcgcaccttaatgcccttgtccttctcttgctcctccttcgttgtgaacggtggagcggtggagggcttcaactgcattgtgattccacctcttctttgcagagtgatacgagtgcgcccgcagacaagcttgcccgccccaatgccatgagatactcccgcagcctcgatccgccctctacggccttggcccggaggcttgcaccgcccgcgcgccaaaaaggcatgtgttgtcgcggtagacgcaacggcagctaaaaatatgctgaggatcagatgccgtggcatggctcgttacctgtatgtaggtattaaggcgtgcgaataagtcgacatcaagaggtagttgcagtgcgagcttcctcctccgagtcgagtctgcccgccgggaggtcgagcacgcctccgcaggtggggttggatcctacgaggaagacttagtggtctggcgaattgaatattcagaggtccttttgtttcgaaaaattcacaaaagaagtattatggacctccgtcaaggtctgtcacaacttctatggatccagtctgatgattctcttcgcgcctcgagcccgagcaggactgaatgcaagcttttctcttagcagcatcgagtttcccattgtttgatcggtttatcccgacacgcaacacagtgtagggtaggcggcacctagccagccatg

SEQ ID NO: 614 - DNA, 703 bp, Nannochloropsis_gaditana
atttctttcaccctaaaggatgaaacgctatcagaagaagaccttcgggagctaggcgtacacatcagactgcaccgtgtgcgtcttctcaaggttattcgcgactgcaggcttcaaggagtacaatttgctgcggtaaattgccatgcggaatattcggttgacccagatagcggtcgattttcgtacttaaagagttttgaggaagagcgagattacgagcttgccttaagtaggacgatagactcttctcaagttgagttttcaagtcgtgactcattgacttccccagcgtctcctgactgataatgtgaacggttgaacgacaataattcagatactggaagtcaaaaatgaaccctataaaatactgatatatatttatatatttgcttttgctctgtttttgtcgtgattactgctgaaatccaattcccgtgctgtactttatcggttaagtaggaggttgaagtggccgttgtttttaaacgacttctcgcccgtacgcatctccgtttcttcgactggataattccaaaaaccgggaaagagtcgttcaaaattttggtgattgaaatgcatttgtcccaaattttcagagggaattcttcttgaatatctatccctactcagacagaaagtgtgctcgggcatcaattgtgccttctagagaagaaagtaagaagttaccttgagaggaatg

SEQ ID NO: 615 - DNA, 703 bp, Nannochloropsis_gaditana
ttcgactggataattccaaaaaccgggaaagagtcgttcaaaattttggtgattgaaatgcatttgtcccaaattttcagagggaattcttcttgaatatctatccctactcagacagaaagtgtgctcgggcatcaattgtgccttctagagaagaaagtaagaagttaccttgagaggaatgtcctcgacggcaacgccgcgtgctctcacacgagacaaaccggggacctcaaggagtagcctttcggctaaattgaacaataaagccagagctataacacccacacgcggaaaacaatcgataagagaaaatacgccgctgaaacgagtccaaaaagaggtagggtgtggtggtgaaggtaattcgattatttcgttctttcaattcgacacgcgtttctcaatttcttatttaaagcgtcaggacctggatgccatcaatcatgcaaatgcattgatccgccttgatgcaattcaaggggctcgtgaggccaagatcaatgtgaagacgggtgtgtcaaaagaggtggcgcgccttcaagatcaggcagcaatgtacttcaggcgtattcaggtggaaagggtacgaagcgcaataaaaccatcacaatatctaatcagaaactcactcgctagctttatatttgcaccatagcgcaaggtggcagagctagaagagcaagtaaatactgcacaaatg

SEQ ID NO: 616 - DNA, 703 bp, Nannochloropsis_gaditana
ccccgcccgcgtggcttcagacaggctctttgcaacgaggagctgggatgtttgcaaaaaagttcgtggtaaattcatcctttagtggtacaagcataaataccacccatcttaccttacgtgacataacagacccctctcgcgtgatgagctagtggctcctggaagcacctgtttggcttttgaagtggcaagggtaccgtcaagagcgccatggctaagtttgtagctgcacgacacgaaaagatgcgataaatcggactgcatcgcgctgcagttaagccgaagccgggcgtaccgcctcgctgaggcagggaaaccggggaggaggatgctgatgacggtgacggtgatgacggcgatgatgtgatggaaaaggcccttcggcgggtggctgtgggtggcggctggagggagcgaggggtagagaacgcgccgcgagcgccatacacgacaaaacgtgccttagcgcgtattgagatcatttgcaaagcgcatcgatggtcgtagggctgctttttccgcggtcgcattaattgggtgggagcgtgttcgaccttcttggtgcaatgtcgtccccctgctcctttccttacccgttcctccttgccggtgatgtatacccgaagtcaatttcattcacactgtagacgcaacatttcgacatctttttaacacagacacacttcttgctagcacaatg

SEQ ID NO: 617 - DNA, 703 bp, Nannochloropsis_gaditana
aagacggatgcttgggcttggattgatcgagcctcaaaagaaggggaggacgtgggcaggatagaagccacggagttggaaacagtcgtacggtcccaaagccgccgcgccgctgccatggccctcagcggaacaccatgaggtcggctcttacttatgattggaaggccctggcccaccaagtggtaccttcccttcccataacttttcgcgcaacctgcacgcagcatagctgccacttgttgatctcgagtccttcgctgccagcctcgtggatggtatagtatgtacagatggaagagcctgaatggcagtggagggcttctatttgcgctgcccgtgccccgtccctccctccctcctgggcctagatgcctgtgaacaagaagtttattgtgttgatgtgatattttcccaggaagaaagccaggttaggaggttatgaaatctgcaaagtagcttacggcagcggcgtaacctcgtggccaaggcggcatcctcgctcctctctcacggcgacgttcccctccctctgtgctctccctctcccctctcaaagcctgctcggagcgcacccgtggtgcgtatgccacagtttggcttgtccacgacttctcgaccttacgattgctctcattttcccggaagggtcatcatcaggcgcctgactctccatcggccagtctacgcgcgctttaggatg

SEQ ID NO: 618 - DNA, 703 bp, Nannochloropsis_gaditana
gttaggtagtgcgctgaatggtattttgatttcacgcgctgatgactctcacttaaagaaaatcaagtgcgcgaagcctgtcagtcgtcgactgccaacggtcgggctgcctcgaaagttttcgctggtcaaattatgcattgtaaagttccaatttgtatccttcttacgtttaaatgcaatatcaggacgattaagtcatgtctttggctcaccaatacttttgccccggagaaaatggccttaacgtgttttttattgcatcccttttttcccactctcatgacagccaaaccttccgttttattcctggttcttctttgggatctgcccattaactcggggcaaagggtgaatctttgtgacacatttatctggtaacacatttatcgtacctattgatgcaaaacgagctcgtgaaaaacgtggatgcttccccgctccccatgcctggggctcttgcgtctacggacattcggcctcagcctgtagaaaagccttcagttgtactcgagggcccagcagaatcccaatcagatagtacgtctaagatagttggtgacaatataagagcgattaagccatcgacggataagcgttcgtttattcctgcacccacaccctccggtgaaccctgcgtgtcgtcgcttctcgggtcagcggctatgacctctcctgtctcacagtcctgcgacttaattgt

SEQ ID NO: 619 - DNA, 703 bp, Nannochloropsis_gaditana
ttggtcttgtagccgaagagcacaaacatccaacgaatcatggtgaaccacgttcgaatccatcaaaaaccgttctagtacccggcctgtctgcacttctgtcacatgcagcacacatcgtgagtgctcctcccgcacgtgctccagccaaggtactggatatagcttgggccaacgccaaggcgccgccacatgagagcatgtaaagaaaatcaacggggcatgcttgcttttccgttgtggcaattgtacaccaaaagccgtgccacggcagagcatctcgtgttgcaacatgccctgatcggccagtcggaaccaggaactaatagacacacttatgcgatgtaagggcaaggtattgctggtcgagctgactcctgcgctgaaggaccggtgtctgcccattttgtgtcccagtgccggtgataggcgcagggaggttattttcatgccttcggttccgagggtcattgaccagcgtgcattcactcgcctgaatcctgtctacggatattttttcacgaataagatgtgaagactcggaaggtggggagtgccatgccctatgctggcttcgaaagcgcccgtatcgaagcagcagaagcaaataggatggtgtcgtcgcctgctgtgtttaacctcctggtgcctcaccacgccttcacacggcgtccgacagggatatattagcatgacgagtccg

SEQ ID NO: 620 - DNA, 703 bp, Nannochloropsis_gaditana
gcatcggctggctctgatacctcaaatgggaaagaggccgcttggcccatcgctgcttggcttcgcgcgcggcgtgcgtttccgtttctactgactgcacgtactgcggaaagggaatgggaagagatgaagaaacacattgcctttaacatatgacagtaatatgatggtgtggtgtgagagctcagagtgattagagtcaccgtccattcatcggcaactaaaaccgggggcgggctcctcacaagcggatcggtcgcccgcctctgcgagaggagagatggtcaaggcgacttagtgctcccggacaacatgcgcgaaggcgtcgggacacacgcctacatagagcgtggcacttgtgctttgagccgcgcctgtaaccctcaaatggatgcacgtagccatgcgcctcggccgcagtgtggtgatagggcgggcatgagggggccggacgcggggcatttcctcgcccatggagccatgggtctttaggcgagttctccgcttaactccttctcactctcagctttgacggccgcaatcaatacactaattctcatacgcactccatacgaaatagagaggaaaattgcaagcgcaagtccgcgcgcttccctcgtgttgggctactgtcaaccagacatcagtttagtgcagcctcccgtttgaacagttcttcgctgttcgtcaagcccccggcatg

SEQ ID NO: 621 - DNA, 703 bp, Nannochloropsis_gaditana
cccgtttgatgatgaggagggagggaaagatgaagtggttggaggagagggaggggggggaggaggcgggaaggtcagagtaagggaggaagaggagagagagggagaggaggaggacgtggaagagggggaggagggggaggaggggcaggaggagggggaggaagaagaggaggaagaagaggaggaggaagaggaggaagaggaggaggatgatttttatgaggcagcggacgaaattcccggaggggaggactttgctgacgagggagaggaggaaaatgaagatgacgactaggatgactgataaattttaaaagtaaaggtgtgaaatgccatgcatgcacacaaagctattttctaaaaaaatctacgagcagcccaacctcccccggcccatatcctctcgtggcaaccggcgcatagtgcattcattttccctcttgtttgcgcgacgattgtgtttgaaaaggtcctaatgggtgtttaaggtgtaaacttacaagtctaggggagtttgttgaagagcatcagccttgtgggaggtcccgctgacggaggaatttaaagaacattcttaagcaacgttttgttcacgaagaaaccattttctgttgtttggcttacccgcagtttctattccttgacatcccatggcagcgcctagccaatttgctgaagtacccgattagcaatagagatg

SEQ ID NO: 622 - DNA, 703 bp, Nannochloropsis_gaditana
tcctcttggcatcctttgcagcgctggccttcggcgtgttcatactaacctggcccgttcgagaggaatgcagctgagctggtgcgttggatagggcaactcgagcaaacaagtgaaagaagagtgatggaagcatcgattcaaagttacccacgatcgtcatgaagagggctgcttaacactttattcagtgcgcgaaagatgaagcattcaatcgactgattttctaaaaaaagatccattattggactccattacatgtgtttatgccgaccttacgtgtcatgccggagttttgaatttatttgcatcttcttgtccccgacttttgaacgaggaggtcgcccaacgctcgaacaaagcacgcagttctgctcccctgtatcgcaaccgctacacgaatcacctaccaagcgtggcttcaaacttgccaagcgtagtgggcaaggggcaaggcctcttttcgtgttcacacaagaaaacgcaggccctaaagacatggtctcccgctagtaacggttttccgagttttcctcactttcacggcgcaattactaggtggattaaaacattagcagaacaaagtttcattccaacattcatccaaataggtacttattcaaggataaacaccaaaggccacagtttcattatggtaagcctttttcgtttcattttcgaatattacaagcataactatgta

SEQ ID NO: 623 - DNA, 703 bp, Nannochloropsis_gaditana
ttttaaatgttgtgtttaagggaaggtaaagagtcacaaagcaatggtagcgtcagccattatcataagcatacataattttcaaacgcgtacaaacgctcgctcgaagtcgattaaagacgcgtgttggctttgcgccttcatgcgccttgaagacgcagaaatgacgcgacagcgagacataaagtacagcatgtaggcaaagcacaattaaaaaaaaaattaagaaaatggccacttcagctggtctaccgcaccgcaagacggaggatgtcaacagtaggctacccggatgtggggcgtcacggccaaaatgagcgactgaaaagaggatcgggaaaggcgatatgccatcagggaaaccatgttgacgtcttgtcacatcatgactttgttggaaaatactgttgacttttcttgctgcgtataagcgtggatctcatttttttgtcgcaatgtgggtgaaacatattgggcatgtttgtcgtgttggatccgacagaaaaagacgacttttcccaatccttcaaaggcaacgtactcacttaggacatcacatcagcaaacaatatattgaacatctttgccactctcatcttcccaagcaccaaacattgagtgggaaaaacaattttatttagaatccttggccttggagctgacgaaaccattccctcatctttcatacaccccctcgaaaatg

SEQ ID NO: 624 - DNA, 703 bp, Nannochloropsis_gaditana
cgtttcaaccctgggtgtggccgggacaagaacacggtgtcattcgaagttcctgttcaacagcctgtacgcctgactcggagctgtaccggacaggctcctgggctgtacatgatatattttcttgaatctttgtgtctgcttctcatcactcggcgcggggctgaagtcgctgataataatatatattataaatattgtatattattgtataatatcatagcatgggcctgggtcaaacccgaaaaggtacaatttacgcccactggaaaacacccatgatgcacttcttgtctcactgaagccgactttttaacttttcttcagaaaagtagggaagagtgggctccgaacgtgagaaaccaatgagcagacacctgtctgcagacattgacgagtcgtgtaggcgtgagcgatgtgcgcccatgggcacacccttcatcaattaatgtctctgaaattcctttatcatagaatacaattgatacaaactcacgtgcacatgcactcaaaacccattcaccctaagaggactacgctacggcccttacagtcacaagacgggatgggtttgagctccctctccagctccttagcgcgcacccagggggcggtgggagagcgtagtaagtcagccatcgacgagaaattgcatcgccgcctgtgtaggctgcctcgatcggcacaacagcaacggtgtatg

SEQ ID NO: 625 - DNA, 703 bp, Nannochloropsis_gaditana
tctagaggccttgagatccgatcctgccagaacaggcagtcccagtataatgttcccgacaagtcgagttcactctcgagacagatacgcagctggcactctacaaagaatgccagaaagatctgcgtctcgtcatctgtgagatggatgcgatcatgaaggattttgttggcctccgcttcgagcttggcaagtgagcgttgaatagggatgccatgacgtgtttgtgtactcaatgcgtccagtatacgtttgtgtcggaaacgctccttatgccggtggtcaggaagactgtgcgtcggtatagtgcgcaggttcaccagatctgtgacgctgcttagccgggatagagctatagaaggcgcttgagccatatgatcgattgtcggatggcgtttcgcggggaaggagaaacagtagacaagcggatgtctcgttatattttagaagaattcttctcctcagcgcatcaaatctgtacacagtatgtatgtagtttatttcgtaaggagcggaacgatagaaggtggcagttgaccgtattagcacgccatacatgatcgcgtcgaagttgcttcaactaatgcgcgtaagtagcttcaatgccgcccggtcagatcttgtggaaggaaaaaaaaacaactcgtacctccacaaatattctttctcattccacagacatcagtcttaacgacacaatatg

SEQ ID NO: 626 - DNA, 703 bp, Nannochloropsis_gaditana
taagatgaggccggaggtaagaatgtttgatgtggatgaaggtacgacaacagaaagtttcgtcgcgagaaaatttgccgacttttcatgactcccgctcatgtatcaacatatcaatttattccccgaaaaacctttaaaaaccgtacttacttccccatgccttgacgcgctagccggtgtgttaccacctgcatgttcagcgaggtcagcgacctggacgccgcggagaggctgtgccggctgaggtctttttcgtcatccttcctcctcatctggacgcatatgagatcttttacgtcatcctctcttctcatccccccactccctcctcccttcttatcacccttcctttccaccggcgtgctccctacgttcactagtggtgtggctgtgtctctggctttgacttctttgggccctgtattcgcacttgccactgcaagttctggttttggcacgaaaaataccgtgtgtgtgaggatgagggttgcgattgatttctttcgcgttggacggaggcgctctcatcacaacgtctccctccagccacacacgccctcttcgctgtctttcacctccatcccaccctcttaattaacgcgttcctaaaccattccttcgcataccacattcttgacacacgtaaaatttcacagtgcgcgatacttctgaattggttgctccgccgtaatcaatcatg

SEQ ID NO: 627 - DNA, 703 bp, Nannochloropsis_gaditana
acggtgagagaaggtgatttggtctagtggtcagggctgacacaaaggcaccttcacaaaaccaaggaggcctgggaacgaagatcttgggatcgtcagttttgggcgtgaggcccatgttttcaaatatccgttattatgacagttgaaaagtaaccgtcgacgctcgctttcgtaggctggggctggggctgagggaagttgatcctgagcagcttttctttgcaacgaaccgcgcaaaattttatgacttattttgagaaaaacaccaatgcatgtttttaagttaatagcatgccagcattaagggtggaaaggtaacaagctgtccgcttttcgcttatttcacgttcaccaattttcttcgcgtggcttccctcgcaagcgcatttgtatcgcgtatgagacataagtattcgaggacgtggcgaggaacccacgtccttttgatgtccttttttgttccaagctttgtaaagtgcaggacggtacatttatcctcgttgatttttgcgactcaataatccagtacttaaagtaaacggccattgaattaagtagcactgtgtcgaagcccgacaggtgtcatgtcgccctacacgtgcttcccattgcctccatcgagatgctactggacatattattctcaacatggtttactcacaagttctggggcacattacgtcatattttgaaaaagatg

SEQ ID NO: 628 - DNA, 703 bp, Nannochloropsis_gaditana
caacgatctgcgagaggtgcgcttgcggatcgtccaaaggagtgtcttttttctcctcctcagtaccgttgaccttcccaaatgacgagaactgcgaggacttcttcataggatgtctctcgtcggctggcgcctgatctgctttctgggtgtctgggcagatgttaaaatatgaaagtgtgagagggcaccggggaagggaagacgacgggcgggtttgaaagtctccatcgctggttgtcagggcctcaaaaaggacatcgacaaggtcatcgcggaggtctagcgcgaaaggacgtgtatctccacggtcaccttgtccctgtggtgtcatgaacgtaaaaccctgtcgagcgtaccccccacccgggctgcgggccctcctgcggctggcggcctcttcggcgagggcgacagcacgcatggtcctgaggcaggctagtgcgtacatagaatgctctcttgccgcgccatttggatgtggttgggcttgtccatgtggatggttgcctgcgaaacatgaaagtcgcggggacgggcatggttgtgtcatgagctatcctcttctgcttggtaaggaggtcatccctgcctttattcatcttcgcattacttcacaagggcaagaccaattactcattactcactgcattctcattgaaacacaccccgattgttgttggcgacaacaaagcaaaagatg

SEQ ID NO: 629 - DNA, 703 bp, Nannochloropsis_gaditana
tgcatagcttcatttttggccagtgtgctcaggtttcctccttccttccaccggatgattggcaaggaacctcgaagctccgggtaggaggctggtaacgagatgcctagacgggggcaggtgcccacagtcaaagcgagacagggcaagtctctggaggaaagaaattggacagacttctttatatccacagataaggctgataggactgcgatacgggaggtttcttcgatacaaatggctggaaatgaaggaggaaaagaggggctcgtgggagggtaaattagttcgagtgcttccagctcatctagctgccgctgcaaacacccacgcaacagcgccgaatcaacaccgtcctcactcccttctttctcttcggtagcttgcggcatgcgtccgtctgtgcgtgggagtcgctgcgccgtgagaaaatatacaagccatatgaccaacctcctctcctatccggcgaccactcctcgctctgtgcagcggccctaacagtgtactattcaagcatgtccggattgatctcttgatgtacacacggcgtactgtggcttttcaaggtcattgataccttctttctacacgcacagttacagaccagacctaatggtaaacaagacaagctagcttttactccttttcccccgcggccacatcgcccatatcgctttaggcgggcccattcagcatcatg

SEQ ID NO: 630 - DNA, 703 bp, Nannochloropsis_gaditana
gcttttaaatgtcttttttttgagccgacgatgtttgcattgatcattccacttttttctgacttactgcttgcggacttatatctcccagtagttcctgcgcttccccttttttgtccagataacttacccggagggtggacgaggctgcggaggaggtttgccacacttctttttttaggactttgccccctgcccgaatacaaactgagggcgtgtttcgattaggatgggacgggattgcattcctctctttccgggattctacatctaaaaacttgccgtcacggtgggttccgaagcttgtacagtacgtgttcctgatgccttacataaattttgcttccgtgctccgtcattcgttcgctcacttttctctcacaaacataagcactacgctcagaaggaagatgaatgggcgtgtggatttggacagtctcatgcgccaagtccgttgctaccggaacgtggccagggtccgcgccgatgtgatagcctgcatcgcccaggtagctaccgtcccttgcttttcgttttcttggcggctttagcagcgcgacgtgatttgactttgtttaactttttggctaagtttgtgccttcaatgtttttacgaccgcaagtgccgatttctagttgataagactctcatcgcttctattcgtacgcttcttcctttcactttcccctgctatgccaggtg

SEQ ID NO: 631 - DNA, 703 bp, Nannochloropsis_gaditana
gcgctctcctactatagtagtccaggtcatggcccggctgctggcgtcaacagacctttccaagaaaagcattctactttcccaaaacctgtttcatggcaacagatactaacttatatcatcaaaatgcttcatgtgaagctgctcaggggtaacgagtatggcggcgtcaggggagatcattcttgaaagagagagccccaacacatgcgccggtgggatcgaagcagccacgaggaatcgctgcaaaatcaagctcgatgccttcacaggcccacctgcctgccctcgagtcctgcacatatcgccatctgttgcaacgtcaaccactaaagcccccgcctcgcaactggacgccgccgagaagtgcgcgaatccgcctgcgttgcaccgcctgcatctacttcccgaccgacctaccatccgatcatgtcaaactgggataaagcggccacgctcacccagctccggtcatatacaggatgtatgggcctcagtgacatcaggtgcacctgtgaaaagcagcaatttggagacagggttgtactacgacgccatccaccggcttcattatcatccagacagaaagcacccggaaaggcctgaacgtgtggaaactatattggcacacctggcgagccgcggagtgctggataaactgactgttcttggccaggcaaacgcggtggaatacggtgtcatg

SEQ ID NO: 632 - DNA, 703 bp, Nannochloropsis_gaditana
cagagacgaacaattctttgggaatatggaccggaaggcgatcaggtacggacggtgggggtgaatgcactggcgtgggaaaggtaggtggagggaagggaaccgacgccttcgagggcaggtggtccgcttcacgaaaaaaagttgggtggccgaagagtacattgatgagtgcagaggcgcccaaaagagcaagtagtgccaccaccaagcctaggagctcggaaggctccatggctggtgatgggtagcagcaaacctctgttttgcgaaaaattatatgctgtgagtcgtccctcgtccatgtaagtactacatagtatggggaaggggaaaggcgaaatggctcccacacacgtccacaattcccttatatgtggcctgcaaaagggtaattggcagtctagtgtcgtgcatacatttatttttgtttagttgcgctgcatcatggcacaatggccaaggtaaatcccctgggctcctccctctcaaagttctcgatatcaccgatatgacctcatgccctcccgcgtgacttgaaggctcgtgaaaggaaacgtgtcccagccggttgaactcgacatacatgtccatttcgtacgtccgcacacacagtgtttggcctcgacaagacgctcgatccacgcacccacctcttgcccttgaccacgttgtcatgataaatggaaggaaaggggcaatg

SEQ ID NO: 633 - DNA, 703 bp, Nannochloropsis_gaditana
cgccatgaaaggagggatggggtggggaacatgtacctcttcgagtctcttggcgagtgagcgagggcggggcaggtcgaaacaaagaaacaaaggtcacgttctgctgtacgatggaccacagccaggaccacagggcgttgcaaatacaaaagaaatggtcactgcccatggagtgaccaggtcgatacctacacttgtttttgtaagcagctcttcccgcctttccccttcacttcctgacgttggcgcgaaaaggaaataaaaacccgacggcacggttagcccggccgacctcccacatcccccgacacgcccatgctccagcctggttggaaaaagcatcgtctgcttcaggaggccgctcatccacacaatattgcagtggccccgcctgaagttgcagcaatgccgtagtcgccgagtcattgtctttttctttgcctcaatatagccctccgaaaggaaggcaaaatgacgtcttcacgaatgacgagcatcctgaagtatttaagatacgcgtatggataattcaaaggttttttccttaaaagaaagcatattactgattttcagttgtcgatatggcttctaacctaatcctcttgttcactccatctcgaaacttccaaaacgtcacttgttacctttcctcaatttattgcgacagggcagacagcaagacgcctttgtcgttctcatg

SEQ ID NO: 634 - DNA, 703 bp, Nannochloropsis_gaditana
atcggagacagcaagaattaaacttaataatattatttgaaggcacggttgcccacaagaagcattatcaaacattggatcccatttccgcaacgcataacttaatcagctaactagatttatggcaaagaaaaagatggaccagcccgtgtcgaccgcaagcaaatggtcaaacgtatgggccaaccagactttcctaaacatgctgtctattttcgctgatgagcgaaaacagaactcggatacataaataccatctttataattcgcatacaaaataagtgttaatgcaattaccaaatactacacgatcgggatcctacattacccatcgatatactattcgacatccgcaacttttatacactagcagtccgcattaattctttggaggccacatcagtaaatcttagtgatcgaaacatcttgaaagacgtcgtggcggcgtttcgtcatcaagaaattagaaattaagtcatattaaactaagaaggcgaaggttgtacaggtatgcaggtgatgaggataaaccgcaacgccaggtttccaacgcaaagaaaataaaacacacacataaatcaactcaactcaatgaaaatcatttacgcctggagatgcaaagacgtagtgctcataagtcaggccctgaagatccccttcccaaacacttgttttggcgagatcggagctcgctagaaaggag

SEQ ID NO: 635 - DNA, 703 bp, Nannochloropsis_gaditana
gcacaaagagagagggatgatgaccagggggaaagaagggagataatgatttcagtcacgggaataacgatccttctgctcgcatgtggattatatcacgttttccatctgttatgacgatggaaataagagaaagcgaataaatacgcatattttaaaaacaaaatagcgcttacttgcagattcaataaaatacttcgcttttttcaacttgtgtaaatacatcaggtccttatgcgcgccaagcgacataacgtggtgtacaaatttaaagcttgcggcgaaaactattccgcagacggcaaaaggatcatgcataaacgtaatccagcttatgttgcacggagggacggcaatgaacgacggcaatcattacgccgtcccccgttttaatgcatgatgatcctatgtcgggccccgggcattgccactggatttatcgattgcgcgactgtcttgggacgtcgcatttgaaatttcatcgagacaagtattcgttcaaagacgcgcgtgtgccgaatgtgctgtatttcattgcagggatgcagtgagacggtagtcgtgtgggccagtccaacctacgatcgaatcgttgggctggggtagacaaaaggagacattgtgcatcgacacttgttccaatctttcctgccttacccacgccaattcgacaatatctcgcatatgcatacaggcactcatg

SEQ ID NO: 636 - DNA, 703 bp, Nannochloropsis_gaditana
tataacatcaaatttgacatcaagatttatgccatttcaaatgcactggtgctccgcaaaatcgtcttggttgtcttttgaagcacacccataatttaatggtgcaaggaggagcgaccaatgcttttaagcaggaagaatcatgcacaaattatcatcaaccttgattgaaatgacataaaatgtacgcaaatatgtagggtggacattatattgagcggcaaagctggaaatcagcggcagcagtcgcacaatcgacgtgatgagcgaccatgacatgtttgcacccatgggatatcaaagcgcctctgcagctgctaccatagcggcctacactttcaacaaacagcatgaagagcatcaacagcaaaatcaaatgcaatacggaggtattacacacgtcgtgggcaattcccaagcaacggccgggccggcctctttcggtggagtgagcaagagtacagcgggaaagccaacaatgtcccatttagaaagtttatccgaccaacatcgacacgaacaatatcaaaacctgcagtccttgctaaccacccggagctccggtagtgctcaacgcgcggggaacttgagcagcagtacacaatgcaataaccaaggccaaggaactctcatgacagcctccccccaccatcttcccttgcatttgccttcctccgccgggcaacaacactctggcgccatg

SEQ ID NO: 637 - DNA, 703 bp, Nannochloropsis_gaditana
ctgcaatgcatgcacaggcacagccgactgtggtcagagcctttgggtccaataatctcaacaagtagattttccccccctaatgttcgagctgaattcctctggccgaaaagccccccgaaacgccttcaagtcacatccttcgtgcacggacacacatacacacatttttttgccaaattgtcaccagaaatttagtttcaaaaaggagtgagaaatatctggcagttgaattatattattattattattatattaatatattattatatattatatatattatatactgtccgtcagcgactcggcgaaggcccataccaaattttctaccctgtgagacggatcaaaattaatccgtcatgtcaggccagagagacttcccgtcgggcagtgggcgttataggtaaaccctgtttcttaattgctactgcaacagaggtgccaatcgatctacacctgcggaatggtctaaaaatcaactacttggagcaaatcttaaactcacggtgttcaggcctgaaaggtgtctcatggcgtatgcttttatttattgttacaaacccacagcgatatgcccgcccatgcagcatatagaaagttcgcacttgccagggcggtccaggtagcacggtcaccatgcatgcttttcctcggtgcgctgagcggggcgatcctgggcagcattattggtgggcacatg

SEQ ID NO: 638 - DNA, 703 bp, Nannochloropsis_gaditana
ggagaggtgctgctcgctcaaggtcggcaacaaacaggttgaaaccgggatttgatgcaaagtaggtttcgcgatatcgttgaagcgatcatgattatgaatggtaatgctgccgacaagatggagagtctgtgggccaggccatgaataaaaaagaaaaagaagtgcacattttttggcagtgtccgtcgaacatatcgttaaccgagggactggggctgaaggattcagactgatgccttccaaagccaacatgtccacgagacccattttcgtttcgcaaccactcccttttaacgtcctgtgccgctctgtattgacgaattagccgtcgcatgtcttctatgaatacggtgtttggactgggtcgtgtcggctagttggggggggaggaggtttcccacatgcagaacgggcggcagctatggcccgcccgtcttccccctttccgctcgttacctttttcggtttgttgtcgtacatatcatttgttcgcgaactaagaacgcctgattgcctctctcacacgtcatgggcatgatttgactagacatgctttttggaaactggaagccgagagggatgtggcagggtgtttgttcccagcctcgccctttgttgcaacgctttgtcatccatcgaacacatttgatgatcgtgatcgtagactttatgctcgaaaattcacacacagacaaatatg

SEQ ID NO: 639 - DNA, 703 bp, Nannochloropsis_gaditana
tccaaaaacgggttctccagccgtcgagacttgcttgtctgtgaccgatcattgctttggtgtggggggtccttgctcggttgtgatcgatttttgcccgtcgtgcgatcgatcaatgctgaaatgtttaccgtttcgcgtgagccccgcaacctgattgcttgaaagtcttgttgcaatcattggactgcttttattggctctgtaattcgcttcgacattctgcttaaatccacgacccaccagccgttgagacgctagtagtgctccactctttttccatgcacggtgaagatcatcgtacactgtgctgtcagtcaagttcagacatgaaatatatgtaaatgttagcttcaatacgaatgtacacacatgtactttataagcagtgaacgaacgaaaaggaaaggggatacatcatggatgttaaccctcgttttcgacaggcagtcggggcccgtccggtcttggtcttggaacaactggagcgctctggatcctccgcccttgaggcttatgtccccgcatgttttcaaaggaacatgtcggcgtcgcttctcaattcggtggagatttgaagcggaacaaaattttctcgtgcgaactgcgatattggtgacctttggcttccatctccgacatgatattagtagattcgcttagggaaagaggcacccggtcgccggctgcatccaacaacatg

SEQ ID NO: 640 - DNA, 703 bp, Nannochloropsis_gaditana
gcccagtcagccgttgcgacgatgacaaaggccacctagaacggcagacctagggacaagcgccatgagagcgaagtgaggattatttggtccatagaaattggaactcgagttttataatcattgttaccgctttcactcttctaacaagtgcgtctgctactctcctattctcccacattcaaggcacttcgtactcgaaggaccataaaagctaggggaaatggaggttctgcctcctttttctgcgtaagggcgcttcctgtgcctcctattcgacaaaagtcagcccgaaggcgctgtaaggccagcgaacagcatgagaaatctttggggaaggaaccgcctgttgattgcgctttatgtgccctttgttgctctggtgcttttccatattatgagtctgaaacatgcacctcttttaggcaaggtcctgtttaccggcacgaggccgcctctcaacaacaaagtactcgcgacgagggcgaaggcggagataaagggagcacacgggggacaagtctttgtggctgccaagagaaggacctaccatggttctcgtcctttcagcagcaatatttcaacctcaggcgtttcacataagccatatcctcgcagtgcagagcagcttacatgcaataaatgggccgtagtgacgaccatttttggacctactgcacttgtgaagcaacttgtagaaatg

SEQ ID NO: 641 - DNA, 703 bp, Nannochloropsis_gaditana
gctgcggagagaagatggtgatcatgctcgtcggcaacaagtgcgaccgcgagggccggcgcgccgtctcccgagaggagggggaggcgttcgcgcgcgagcacggcctcctcttcacggagacctcggccaagacccgcgtgaacgtggacgaagccttcgtcagggtggctgaggcagtgtacgagaagatcgaaacgggggtgatcgaccccgcggacgagagtgtgggtatccgcttcgtgcacagggcggggcgcgggggagggcgggtggcggtgggggcgcgtggtgaaggggaaggggcggagaaggccggaagctgcgcctgctgagcgcggatgggttggggtttgatgaggagggaagaggtggcacgggaccgggcctgtacagggtaagggagaggaaggaggcaggggctgggggggtgaggatggtcagcggctggtctgggccagcccgtgggagtgaggagaggggcgacgcgaggaagggggaaaagctttgtacatgcagaaggaaaaatgaaagcaaccacgcagcgaaacgagaggccggcagtgtgatctgccgaagaccatgcatagataccgcgcccttatgcacatttactttgcaacgtcctacacgcctccctccccactatcccccttgcccccgcccgctcacgtgcccgggcccgccacctccaggggtcccg

SEQ ID NO: 642 - DNA, 703 bp, Nannochloropsis_gaditana
acgacacctgctggcgttttagaagtcgcaaggtgagaagtgtggccatttaagggtcaaacgattgttttgcaaaatctttgtgtcgtagggatgcaagatgggaattgagttcatgtccttgtgcagcactgatcgacagtagtaccgccaacctcctcaccccctgcgactcggagccgacgcgcgacggcccaagacgtcgcacctacgacgcaacatgcaacagcgtcttcccgtgggctggtcaacttatgaaaaaagtgcggactagggagatgaatgttctatagatgcctaagtcgtgcggatggagtccaaaatatgtttattttttgtaaaaaataacctgttgtctcccagaaaatcatcggcgagccaggccacgctagctgcacttttcccatagcaccaaacatttatctcgcaaatacaataaccattacacacaggatgattggtggtgcatcacgtttttattgaggagatcttttctgagtcgaccaaaatccggagaaactgtccgaggctcgactatatgtggagctactaaagtcaagcgccgtctactcacaaaaaatacatgtccagggcgggggcatcacaacttgataccgcagtgggaatgcagtctgatgataacacgttgcatcctccccttgaatgtcactctataacttctggactgaatgaaggtactgca

SEQ ID NO: 643 - DNA, 703 bp, Nannochloropsis_gaditana
atcattggtagtgggaagtggaagtacaagcaatccacgcgatcgctctctctcctccaacgcagtagccttagtgtaagagaggaaagagcagcaacttccaattaaaaaaattacgtagtattaaattttataagattctgtttgcatgaagagtgaggaatagaaatgaaataaaatgtccgttcggaggaggatcgcttcagctcaccaggtggaacgctgcggtgtcgcttgccacagttttgtcaaggctgatgaatgtcacagaaagactaccatcctcgtctagctctgtaagagaagggggaagcttcatctctacatctacgagaggcatagtgcgtctgtcggtgtgcgggggcagtgatggcggagtgagggcctggagcggggggtacggggggtagcgggcgtttgcctcaggagagggagacaaacgccggggctggaaaacgcctgtgccgtcctcgtgaacgccctcatgccgtagggcgcttagagcaacttcgtggtttgcaccgaccaggcaattcttctcatgccgcaaagcagtccagtgtatctcgatcaactggagtgccctgcggcgactcgctccttcggaacaccggcggcacatgtcgaagactggccagctttcctgagtgcaatcagaagcgcttttctcattccacgtactcgtgaaccgcaggaaggtatg

SEQ ID NO: 644 - DNA, 703 bp, Nannochloropsis_gaditana
gcggtgtcatgacaggctacccatgcaatcaaataatagctagtagaaagcgaaaaattgttgttatgttgtgagagtctttaatgcagggagccagaaacactgaaagaaatccctagtatgaaaatctaaaaatagaaaaggacttcctcttcttaaggttacaattaggtcaatgtttagttggtcctacatgcccttttcataaaggacttaattgacatctggatttttttgggcgacacatgtatctgtcgatgtcagtcaaagtgttactcgtttctctagacatgaacgattgtcacaggtaagctggaatttacgtgctactcatcaatttgacaggagtaatagtgacactttgcccgaatattggacctatatgatgttcagggtttatatagctattttttgtaacattttgagatttgagggtaaagtcaccacctcgtcgccacgtgaaagtttcgacaagcctgggaggatacccggaagacctgtctggacggcatcgctcggtaatcgcggaacttccggaggcagctaggggtaccctcactgatctcactgtcacgacataaaggacgaaagaaatcgtaacttgtcatcattcttgatctaattgacataaggttccgcacgctttgctcaccttttgttttctcttcaaaatttctttggcttttttttccgaatctcgcag

SEQ ID NO: 645 - DNA, 703 bp, Nannochloropsis_gaditana
gcgtgttcgggcagacgaaccaccacgcacgtgcgtccccatgcctcaagccctccttctttaaagcttactggacggtccccgtaggaaaaatttagctctcggatgaggacagcgtcgttaggcaaaaaaggaccagtcacatcctcctctggcttaagcggagtcttggtaaggtcggtcatgtcttagtttcaaatgcgttgatatattgggtttgggggagaggttgcgacgcattgttaggtaatggacagcttcaccagcgccgatagttatcttatcaggcagccgctgtggtagatgcactctagagcaagaggagactataatgaagtaatcattgcatacgcattaagggacatttcacgactgcatacccccgggatcgcctgacgcaccactcgccagctcggctgttcgttccctgctacggtagcacacgtgctccccatggcagttgctgccatgcgaaatgcgggctcacttcatttcaccggcgcgacacccttcacgaaaggtacagcgacggtcccccgtcattacagcaccaagcggcgagtgtgaacagggctagccacagtcctcggggtcgtcgtcctcacttagcacgcgtcttgtctactagccgcccgcgactcctctatccattccttcagcagtgcacaccttttgcagtctcctgctttccccagaaagcatg

SEQ ID NO: 646 - DNA, 703 bp, Nannochloropsis_gaditana
aatgggccgagagggcttcccgccaaaatctaaggaaggccctccctcggagaggagggcggggtgaggtgtgttctcgtgtaggtcttcataccgccgacttttgtgtggttttaaatcactcagcgcaatcgtaaactcctgctgattgaaaagaattctttgtacatacgtgaaaattagaagtcaattggtgtttgagcatacgcatcacagacctcttcgtatgccattcgtgaggcatgtttgtagcagtacggcttgtagagcgcaaggcacttttaatctgctcatccgcatgctttttgctcgaagcgaattctgtttaaagtgccacagaacgctcaactgtataaaacatcgggtatttgacgctgataagttgggcaacagggtatgtactcggggtctgcacgtcacaaatacctcaggagtcttggcgggaagagttatctcgacgtgtctccctcatgtgctcggaggcgcgccggtagacttcatgaacgatacgagccgcccttccactgaattcttcctgtgaataagctgaaataggagggatgtgcggaaacgtgactgatttcccgctattttgtcaatgtaagccgctaccctcccttaacttaatttccctcccttttccatgcgcacgcaccttgacgtaacaggaaatactaccacaaaatactcctacaagaatatg

SEQ ID NO: 647 - DNA, 703 bp, Nannochloropsis_gaditana
acgacagcagcacaagcgagaggatgagattccttgtcacaagagaaggcatagttcgtttttgtaagggctagttttctgtcggatcaaacagtgcagagaagggagaggtgaggaagcttttagcagaggattccttggctgaggatattgcccctccggctcaaaaggggtagtatggccaagagaagccacgtgccgaacaggttcaccgtgccttgaaaataaagaagcacgtttggtacgttagggatggcaacaggttgggagtcacacatcacacgacaaggttataaaattgaacttgcctccgaggtgcattgctgcccgttgaactcgctgggggccgctcctggacttcaacgaggactcgttaagcctgaaactaggaacgcgtagacattggaaaggcataaaatataatgttcttcaagcctctcgctttagaaatgtaaatctaggattgattgagtatagattcggaatatatatcagatttaaacgtttttattagccccctactattagcgcctgcgcgcgttctcgctcctcttgaatcctcctttgatccatgtgaaagaaaattagtttctacttgcgacgcttgtcaatactgcatctgtataaaaatatgatcatataatccactggcatcatgctaacattttgtgaacttaatttgcgcatgcacagccgataaatg

SEQ ID NO: 648 - DNA, 703 bp, Nannochloropsis_gaditana
aatttgcgcatgcacagccgataaatgtcacgatctttcctgtgcaagacagcaaggaaaacaatagtgatcgtgggtcatgctttactgagaatacctccgccgtggaagtctactcttgcaattctagtaagttatgcttgtaagtgactagccctgcgcataatccgaatatatacgttgtaattggaaactactcagtttgagcatgttgtagactgttctaattccattgtaactttgagggggaagtagtatcattctcctttacgattgattaaatcgatacgaatctaacaaggattggtgtttaatctgttaccatgcataggccctgtgcatcgtcaatttacagagcacggtagcctttgtaccacccctggtgggggcagttttcactcaaagtgaagaccttctgccggcagcaccgctgaaagacagcaacaagatcgcgagcgctttttttggaagtctaggttccttcactagaatacattccaagtatttcccttgtggaaccaagccaaatatcagaattgcagcgcgcagtagtgtgccctccaacgaaatgatggagggaaacttacaagaaagacgttatcaaattattgcggcacctgtatgcgagcctatggctcgtcgccttcaaatacagtatccggagcgctttcgttttcatcctacctattgggggaagtttccg

SEQ ID NO: 649 - DNA, 703 bp, Nannochloropsis_gaditana
tcaagattctgttttcctgctttgaagaagctaccgcccagtaattttgccaagcgagattgcggctcatttttattcactgcttttccagcataaatactagatgtgccagattgaaggaaggcattgcggggcaaaaaactcttcgcagaaggcactgaaatgacacatagaaggacaaggcaggagtagaagacccaagccattctaggatgaaggactagggccacaaatcaaatcatactacttgagggatgaaaatatggtaaagaatgtggaggaaatcttttagtctgcaacatttaccttgacggatcgtgcacagcccttcagaagctcgtaagtgcgggggcggcccatatcgagtaacggacacgtgcttaacggctgaggacacaaacgtgggagcaaagaagcagtgtcctcgggactccacatacctcttgttcacggtgaagcgcttgcggcgactgaatcacttctctcatcgaaaccattctatgtctaatatacaggacgaacggtcgattgtcatttgcacacatacctatcatgcccggtacctcctatcctacgacgcaacgccggtacttgaatgatacctatctctacgacatatcttccacaattttagctgtggagcccatgcccccggacacctcagctggcagcaacaaaatgccatattttggccttgtgatag

SEQ ID NO: 650 - DNA, 703 bp, Nannochloropsis_gaditana
tgcatcgtcaatttacagagcacggtagcctttgtaccacccctggtgggggcagttttcactcaaagtgaagaccttctgccggcagcaccgctgaaagacagcaacaagatcgcgagcgctttttttggaagtctaggttccttcactagaatacattccaagtatttcccttgtggaaccaagccaaatatcagaattgcagcgcgcagtagtgtgccctccaacgaaatgatggagggaaacttacaagaaagacgttatcaaattattgcggcacctgtatgcgagcctatggctcgtcgccttcaaatacagtatccggagcgctttcgttttcatcctacctattgggggaagtttccggatggcactgacaacatagaagtcggtggcttccaaccacacaatgtcatggcaggggaacacgtgttatttctggcatcgttccacaacaacgacgttactctctcccaatttcaagttatggttatgcttctacaaagctttatcgagagtctcacaattgtgcttccattttatcctgtcggtacgatggaacgagtgagtaaagaaggccaggttgccacggctaatacgtatgcgcagatgttctcaaatctgccatcatgtggtcgtccaactcgacttctcatctacgacttacacacgctccaaaaccgcttctaccttcacggtaatt

SEQ ID NO: 651 - DNA, 703 bp, Nannochloropsis_gaditana
tagattgtaaaaattgttaatgtttgtagaaaaaaaggaaaaaaaatcataaccaaatagaaatatgatctctttaaggccaagagattttgtaagacccgcgggcccgtgctcatcaccggctgtagctccggttttggtttggacctcaccttcggcacgaggacatgggccggacatcctgctggtagccgcccgcacgtcgtcgtcgccggccgggtagagcccagtcacgtccttggcattactttgacagtcctaaaaagcttattctatgtccttaacgagaaatgtatatcaattagagcgatttcgtgcctttgacgtggacgatgaggtgaaacaggagccctgacccgcttggaaagccctttgtctcggaacaagtggcatggggacctgtcatccgttcttggagccctgtcttctttcctttctccccatccgaaaaaaagttactatgtttacgaaacaaaatgtaactctcactggacgagtgaggcttcaatcagtgatttttatgatagaatgcttcaatcatgtcgacgttgatttttatgtatgcaaatgaggcggtattcctgactaccgacggtgatcacgtcgggtttcgaccacttctcattttctccctttcttctttctccttgaaaacctagctcaccttcctcgctgtcagccatctacaaaattcgggaatatg

SEQ ID NO: 652 - DNA, 703 bp, Nannochloropsis_gaditana
tgcctcctcgtccgccggcaagggccacagctcgaactcgctcgcaaacgttctaagagaccgcggaaataacgacattttaagcccgtgtaagtggctgggcccaggtaaccatggagaatagcgcctcttgcatacaggtcatacaatgacagatccacacgttcctgccacctcacggaggtcgatttgccgcctggtcgagtcgcctgttgggcacttgagcatcgaagagagtggacaaagagccctgtgaacactgtgccccgtgtacgcggtcgaaagcaacatatctgccgataaacgctctacttcacaggcgtgggtcccggcaaggattgagaatgtcgtccacgtgcagcggcttgaggcctcgccaagcgagaaaagcctgatgtctcagctctccggcgaccaagcccccgcaacaaacactgatagtggcgcggccatgagcgtgctgcattgcagacggataatatagaataatacagaactgtcacgtggacactatgcagatgtactccaatcttatatccgagctagaatcgagctctttgcatcgcttgctacttttcccgtgcatgcacgacgactcgttgacgcaccaatcatttgatcttacatttgaaactcacaaacctggatgctccactctctctgatacagcgaccgctgtccgtcctccaagcccgagaccatg

SEQ ID NO: 653 - DNA, 703 bp, Nannochloropsis_gaditana
aacggctggggattacaataattacgacaccagggcgctcagctggtgctcatagggcagtaagacattaattcaaagtgtgcggatactatgaggtagggggcgatgccatgaatggtttaacagagatatcagaagtgacatggggtggaggatcactggatgtgcccctagtgggcccagtaacggtctgactcctccttccgacacccgacgtctttgtcgaggaggtccggtcgcaagccctcgtaccttccctgcgttcttgacttacatgccacacgcttgccgcaaaaaatcgcgttcaaccttcgacatagcagaacaaggcgatgtcaaggtcgaactgtcgcgtctcagagtacccctttttctcattgttttgcttatcgcccactgattgcgggttgcgtctccgtctccctccttcgcctccggggaaggaaaggctcattatttcgtacagaagattctatcgtagtcgatttctgtgctgttccatggaaaataaatactccacgtttcctgatcgctcaaattcttatcatcgaagcaagctgttagccagcttgtcgcgacccgttgaggagtgcttcacagttgatcatgtgctcttttgacattgtgcgcatatgcagggacagcattcaaacgagggaaaaattacctgcacgaatcggaaatatcggtggctgagggcatg

SEQ ID NO: 654 - DNA, 703 bp, Nannochloropsis_gaditana
cctgctcgatcgtatacctgaagatggactttgatgagatctaaaggtagcaacagggcagaagagactgctcccgccactaaaccggcaaccaaatggtcctctacttgggcgggggctttggcgttcatgctgcggagaaatttggctcgcgcgctgagaatggccgggccgcttgaggaagtgtacttcacttttaaaaattgagacgctagcctgacggatttttcctgcttccaatattgtgtgcttgcgtggcttggagggaacgttgataaggaaggaacctcctggctgtgggacgcatggtccaatatggaagagatcattcgcgaaagtggttgaggcggaatcagtcgatacagggaccaagaaaaaatgtaagaggtgaattgattatgttatattaattcacacactacaccgtattggcgggcccgacaattgggcaacagtcctcagcgccccccatcgcttgggcctggcgaagctagcgacaggcggcttccacgcttgaacatgccagcgacatgcagcaagcacgcaaattctatctcgaaaaccaagcatacccctgaatatacactacatagttctgtgaaagccctaattccatttgaagaatgcgggccaatatggttatcgatcgttgaacaagccttcctgtctttgccctttcaactctgtcaccaaacccatcatg

SEQ ID NO: 655 - DNA, 703 bp, Nannochloropsis_gaditana
aggttaattgagttcggtggcttgaacgcagggtcttaagtgcgtgagtcacggggtgcagcgacccgaaggagggacacaaggataccaaggccacgtccatggataaagccgtaggccttccttgcacccggagttgtagcaaatgtttctgatttactcatattttccaattcacactgcagggagcgagacaattgttgagttcgcttttgggctgacgaggagttaaggggtcggggaagcattagccatgcccggacagcatggaagctccgccacacttgcgcgctttgtcatcctgttgattttcccatatgaaattcagggattcattacggcacctatggatggccaagggttttatgcccatcgtcaggacccttattcctatttcctccccccctcctcctgttccccttcctcccgccatcccctcatcactttcctgtcatcttcttcttcctcgtcctctgcgtcttcttcaccttcttcatcttttcccactgcatcttcgtcatctcctacttctggagacgaagcgttccaaaaaaaaaaagaaaacctaaaaaagacacttcggagagaatacgcctctttcttcgcacccatggagagagacatgtaccggccagatgtcgagttcgttgatcctctcacaagattacggggcgttgattcatatcaacgaaatgtggacatg

SEQ ID NO: 656 - DNA, 703 bp, Nannochloropsis_gaditana
tgttttgcagcgcgtagggcgtcagcctcgggtatggtggaggaatcgatgaaggttaaaaaaatggttgatgaggtcagtacagggtgaaatcttcggccgcactcttacctgctcctttagcagatcatacgcccgccgcaagcccctttcactagccgtaagctggtccacccccgacattgcggggctcctggagtccgtgctgtgcggctcctctgacttagagctctgttgggaagaagaggcccgcggtaccaatggcatccatgaaggcacatttttagaattcaattactatgatagatatgtccacaactgtcaacgacgatagcacaacgagggagagacgaagagaaatcctcctttccatccgggagtaacgcgcggaaggatcatggcgtcacagctgtcgggccagcagtttgccgccctcccacactgtaccacgcgcagaacttgatcccctcgttgaggcggatgttatcgttcacataacacaacgtagaatgtcgcaacgtgagagaccacctgttcgcaccgatcgcttttaattctttgacttccttagagtccccttgttggagttaaggaacgaaaaagttacagatgttctttgactccgcctccttttttcctttctaacctcaaggttccccgcaacaaggcttaaaaggtctggatagctgtggaaaagccaatg

SEQ ID NO: 657 - DNA, 703 bp, Nannochloropsis_gaditana
ttgtatcgatgcaccaagtacgacgtagtcgagtagagttttctatcttatgcgaaattgatgaagcacggctcgacgatgggaaacttataaatgtgtacttttactaatagcccgtcagatacatgagcaaaagttatcaatacgctattctccacatctgagagcttttggtaatccaaacttttgcatagcacatactacaaggcatactttactacgtgggcaacatcattgcggaggctggcgactttttatgaattgacacaatttcctagctttccaagcggttattaaatgcgcaagaaggcacctttctattttgacccctctctatttcgagtttttttacacatattgagtacagcatcattatgcggactcaactatcctttacgtcttcaccgatgtggaaggctagaaaacttcagaaacgtagaggaaaattaaaaatctcgcaagaagaggtttaaaatgtagagatagacgttttctcacgcgtcaaaacttctcgtaacgctgccgagagcacaggaccttggagggtggcggtcgggcggcctggcctcgctcgctcgctggccccctaggaaaactaggaaaacgaaattccgtgcacgcgtcccttttttgactatcgtgtgctactgaatacaccacaggcgcatctgattcgaattgtgtcatagctgtactctcaatg

SEQ ID NO: 658 - DNA, 703 bp, Nannochloropsis_gaditana
gagtatgggtcacaagtagaaaatggcataagagatcgaggtttggacgatagagagcttattttgtcttcctcgtcttcagacacggcatcgccacctaacacagagagcacgcctgaggacgaacacgccaaggagggatccttcaaaccacttgcgtagatgtgatagtataccaccaaatcaaaagaagaagaagaaatgtttcaatcgtcacgtggaagtaacttacgattacttgttgcggaagagatgctatcaagacgtgtcaatctgagtttcatatacaagatcgtagatactattcttcactctgcaaatcatatcagatttacgatggatgatgatatttcttctgaaatttccctggccatgcaatcgcgcgaatggatgtaatgcagtatgtacgcccgtgagaaacacagggatagtggttctgtcttggtcagcggggggccctcgaggcggggggggggctggattcgtctgcgttttctgcagcttttcgcctcactcaaagtagggcgcgacagtagaacaaattgtactcgcacacacgtagtatacccattcaggctttgtcgccattattacttgaatttttgggttctttcctacagcctgctgtcgctaagcgcctccttcatctcgccgtcggcaccctacacgcatcgacaaagttaacctgcccggcattctcatg

SEQ ID NO: 659 - DNA, 703 bp, Nannochloropsis_gaditana
gtattacggctcttactccgatactcgtggctggccaggagtattttttttggcgcgaagcaggcaatgagtctcaggaaaacccacgacaggcagaagtcggcagagatgcgacgactcccgggtgtatttttccagtgtgcgcattgagaggaccaggaatggcgctcactacagtacgcccccaccaatgaatgcatgtttccagcggtgcacgcacgacgtctctaatactcttatttttatttggtgaacaccacctcgcattctctttcaacagggtatattctgcgttaaactcgaaggttaaaacttcttgtctaccatgcctttttcttgctgctgtctgcagtgtatcgatacttctactctgggcatacaggaacgctttgggaattttgtgaggtatgcaggtggcgattcaagtggatgagagtgttaagcgcaggacatggcagaaggagtacacggaacgcggacataagcacatcagaatgtgtccgcctgtatgcggaactaaacaaaaataaagtttacttgaatgcagtgtcaataaaataagcaggcagatttttattgaaataaaaaaaatgctgcaaatggcttcttcgatgtcttgactgttaagaaatgctcctgatctataccttatagttaagtcgtcgtcctcacatacttttacaggattttaccacctggaatg

SEQ ID NO: 660 - DNA, 703 bp, Nannochloropsis_gaditana
gaggggaaccccttagccacgaggcggccgaggagatccagttcgggcacttgggccagctccagcaaggctgcccctggagttggaaggtgatcgccggcgtcaaccccgcctacgactttttcccctcccagcacatgacctactaccggaaggggcaggccttgtggtaccagccagtcttccgcgtcatcaccttcgacggcagggaagtgtggcgacgccggctctaccgcgtgcgtcgtgggaaagttcctgggaccttctattactcggtcttggacaacggcgtgaccagctccgagttctggcgcattttggatgcggccgatgatctgtcctgggtcttgttctactacagtggggcggcggcggcagcgggtcagtcgtacacgggtgcgattttggcctcgcccacaggcgagtggccgtccgcggagccatgcaaagccaggattctggcggctttggaccgggcgggcatcaaggaatgggagctcttcaacgtgcatcacgacgggtcggacggagcccccttagagatcgatcccatggcggaggctcgcttcatgtaccctggatgggcgggcgcgagaaccagtcaggccgatgacgaggggcgtgtcacactggctccggccgctgtactgtaatatatcgaatgtgtaaaaccaggaaagggaatggggaaggagaagggcct

SEQ ID NO: 661 - DNA, 703 bp, Nannochloropsis_gaditana
ccgtggacgcgtgctcgtcaatagacccatatatggagggggatgctgctgctggggctgttcttggtcttgttctagacatgtgcaactttagaaaagcttgcacgcgggtggttgcgtcctgtacgtggtttatttgaaaccagtaataatcctgaagcagggcgcgtacgacttccacaagtcgatgttcccgggcacagtcgcttaaattcaaaaagagggaggggagatatggcctggttctgagtgatgaaagtcgctactacctctctgtggtacgaactcagagtgtgcacgcctagagtcaaaccacatcaatggtgagtgagagacgtacgctgctcgatccgatagacatccctattcaactccgttaaaaaaaatcaagtcgtccgccatctgcgtgggttgcggtcacttctacatttccaagacttctaagggcacgccttaagcggcggggaatgcccttgagacaaagcgcgtgaaaatattgtgtatcaaagtgctggcagactcacctcccgaccccgcccccctccgactcggagtcgccgccgtgggcgaccggcctcgctcttccgcatgaaaacccccacatggaatacacccccgtgccaagccgaggagttgagcggggattatgcatgtacaaggtttggacaagttcgttgacctcgtcgtcttttctgtttagggg

SEQ ID NO: 662 - DNA, 703 bp, Nannochloropsis_gaditana
cttgatcggcgcgggggagaagtggattttgatgcggcccgacctgataacttctgcccgcaacccgggcaataaaggcggggagacgggtgcgggccctccagcacctcactctcaatcttctcagccaagaatcctgggtttttctccgcagggacttgctggggacgcgcagagggggcaggcgtcggggtgggtgtcggggggggaatcggtcgttctacaggccttgtcctcgcgcgaggtcctgcacgtgacggacagcgccgagtggggaacaagccttaccctctgcgcgcccgacatggccttgttgtcccacgccgcctggctcatcactcctgcaggcactcccctctacccctcctggaacctggagcggccctacctagcaggtccctttgccctccacccgcagcgtcatcggctctctcctttgcaggaggagctcttcaaaatattgccgcatgcagccaaccgggaggaggcccagtacgcccctcggccattgggtgattgtggaccgggagagcaagagaggctgctggtggaggacctgctctgggtcgtgcaaggttttgagggaaaatacgtcagagccgcctccctcccctgtaccgccgcgtcaatcatcccgaatgacttccgcttcgagctggcagagtcggagcgcgagagcctggagcctgggctgagtaggatg

SEQ ID NO: 663 - DNA, 703 bp, Nannochloropsis_gaditana
tcaggataccagtattccagtggcagcgaattgttccttgcctgtttacctgtgccctattttttaaaaaagaaaattcaagaaaaggtgctattaaacccacattccaaccctaaatcgcccacctggtgccctctttccgtggttttgctcagatctcgatggccctgggtgggactcgccatctcgctgcgatcagtctcacctcccccctactatccattttttccgcccccaacagaaagagccatggacactggccgacccgtccacgtgctgcccattcgccttgcaatcgctctaatacatgtcttcagcgttatttgtgtgctctcgtggctttgttacagtgtcgatgtcgtgttgatatatggcgcggcggcaacgtcgttcaagttgcccttgtatgttgagatgcgattacgcctcccgtccgtgctacaggaccagggcacgaaattcattcaggctgcttcaagcgttatttcgccgtgcggtcgtaacgtgggataagatgcctaccggttgatgacgcatcaaatgttttagttcccaagccacgtcttccgacccctcgcgcacagtgcatgtggaatgctccgtttccctgcagattgaagttcttgccgcctgttcatgtgttccccacgcccttgtcatatcccagacacagaaaacgccaatggcaccctctatgcagatg

SEQ ID NO: 664 - DNA, 703 bp, Nannochloropsis_gaditana
caggcacgtgctgcagcaagcggctttagtcctgcaatggaggcttttgcgaagaatttggatttttacacggaagacttcatgcgtcggctttgggaggattcccggtcacaataccagtctaaccacttgtccaaccttctcggtcgccttgattacaatggctacttctccgccaaattttcttgaactggtttaccggtatcaggactattgcagccacaaattcaaagcattttgtttgatgaaaaaagaaccatagctgaagcccaatgtacaagtatctctgtatcgatgcaaccaaaggaaatcaaaagaacaagccatcctttggcacaaagatattgtgttgtgagtcatagtcctccgctgcttttacgttccgctacgaacatatccgagcacgacgcgacgtcacttgcttcaagcgtagcagtctttcgcaagtcacgaacgtctctggtagtgcattcagaaacgaagaccggtaccttgtggcactataatgacattcctaactggcttcaaggtgtttgcgactgtccacggtatgtctttcgaaacgggtctcacagattccgttagccccttccaaaagcgcggacgagggctgtgccgtgggtggacttttgccgatttccacatcaccctctgtgaacgtgggatttcttcaaaaatcaaaaataatccttttaacacaaat

SEQ ID NO: 665 - DNA, 703 bp, Nannochloropsis_gaditana
cagtagtggagtcgcgggggggctgtcggcgacagtgacgattgtgtgtcagcatgcagtcaacgatgtcaagcaacccagagccgacggtatgtcaccgtccacagccacgaaaagcaaccacctggagcgctcatgcgatttttcatctgcaatccattatgcacaggtctggtgcaccgcaaagatggaagacaccaccatttatcagcacacggggggatgtcaacctgaggacgtacttgccactgccgtggtcgctggagatctcgaagacacatctcctaccgaatcttatcattcgaccacgcaaatgggcacgaagcagcggacacacgctcctcacactcacaagtatcggcatctgtccttcccgcattcgcaatctttggaatgtatatctcagactgaatcgacgttggggaaggttggtgtcaggagcaacttgaccagcaccgaggtggagtgtagccgcccttactcctttcaccacccacctgaaacgagtacaaatacccaacggccttacaagagtggcagtctcagcaacgggagcgccatcacgccagagagcctgaccttggcctatctggaacttctacgccgggcatcccactcatccgagagcgaggcctcaacacccccttgcgacagcgaagatttaggcgtccctgtcccagccgacgaatcaaggagacacatg

SEQ ID NO: 666 - DNA, 703 bp, Nannochloropsis_gaditana
gaaagggcaaaaagcatccctctttcggctccacctggggggggagcgccctaccctctatgaaatgcatgaagttgtagctcgcgtctgcagagcgtacaaacaacgcacacagttgccttagatctctcacaagtttcggaagagaagcacaactcctcagaaagacaatgcatcattcaaatggaaatgcggtctggcaacctgttccgctataaaggtcccaaccaagactaatcgttccatggttgcaagaagttgatgaatgcaatgtatccacgggcatagcaagccaaaacaggaatgggggcaaccagaggcctcacctctggccaagcattgatttgtgtattcattctaacacagccgaggaggatctgtgcccgtaggcgcccgcatcttacgcctggctaacgaagcccgaggggaatgctctcttcaagaactgcctcctcggcagagggctcgtcccgatgagtgatgatgtttctcggcagagggcacctcccgatgaatgatggtgtttctcctcccccctcagagcctgccctttccgattacaagatgaacatttcccccacaagaagcggaaaacatgacgttggacgcgatgattcaccgcccttatacctgtttctttttggaaaaagacagggaggcctgttcgctatctctcgtggccggtctgacctaactcgtcatg

SEQ ID NO: 667 - DNA, 703 bp, Nannochloropsis_gaditana
gggcccttaagtcgtctccgattggtgtcttatttcccttactgatcgctgcgcttgcccccatccgcgttgcaatcgagaagcttggatggttcgacaagaaagatttggagatcttagactcggaagatgactaagttggcgaatcaatctgcgctaaaacatatgaatgccggattatgctataatgtgctgacgatgtgaatttacgggaaaaccaagtgtaagggatatgatgagacagcggttacaaaggagatgtggctttaaatgttgaccaagaaagaaatatgcgcctggccggctcttactgaaggaacatgaggaaggagattttccaggaaaagcccctcaccttttccttgaagcgcttcgccacaagaagtgaattaagctcacaatgtcgcagccggcccctggttttccatttttacgccgcatcgaaaagaatcgggttaaaacgtaacggcttggtgcggatatccccgaggaattagcaagacgccggaggttccgtttggtagccattcctgttttccggcttcggattcatgcgagatttggatatccactgaacagtctgcagagttctttgattgcgccttaaacattctggagaactatgccaaacatatatgagagattgcatttcatggccacacggatgatttgataaaacactcgatacccttccctccccgaa

SEQ ID NO: 668 - DNA, 703 bp, Nannochloropsis_gaditana
agatgtcgtttgggggggaggacgaggcctcatggagggggaaaagtgcggtgaggatggatgtggttggaagagacacggaagaagaggaagagggggagggcggctgcgcgatggaggtgtcgagggaggggacgacggagggaggggaggccgggagcggaagggaagaggtgacgaggaccctgccttccttgcaggtgaagggcactcccgagcacaagctggtgtcgggccttgcgggggcagatgacgatggacgggagggagaggcgatgggcgagggggagagagactacgacctggccgcagcccgccccctccggttcggcggccgcgcctccctgtcctggcgttggggtcgccgagggagcagtatggggattgccgagggcgggacggaagggaaggaggggaggcgaaagcggcgtttgccgatggagacgtctctggtgctctctggggcggagatgaaggcacagatggccgacacgagggacatcatgctggagcgcgtgcggccccgggatcgacagcggggcgtggggagggatggcgggaagaagggggagagggaggtggggctgcggatgcaggcgcatgcattgacggggcagttggcggaggggttggagggcgcgatccggaagatgatgaggcctgcgcctgggttccttctgccgatcgctacacgggagggatg

SEQ ID NO: 669 - DNA, 703 bp, Nannochloropsis_gaditana
agcctccgtcactgcatctaggtacgccgtgaccttgcgaaaaagcatttggaaggccggctgcaacgtagtattatgaatgataccgcctgtacgaaggacaagacgatgcaatgtgaggatgagtggctccgatacaaattattcatgtctgcgcatggactgagcccggttctgtggccctattaccgagttttggacctctgtacagtattacgtatcaggtactgcgggagggcttgagcgaagcagcgtttcggagaacaccccggaagtgcttcaactcggttcccacagtctttttatcttcacagtggatcccgaataagtgtcctaaggccacaataagtatcaagatatttatcacctcttttttcttcattatctgctaaaacagacctcgccagggggtcaaagtagctcgcaaatatcctccagcgccatgggagtatccatattacctttcacgtcaaaagtttcctgtcttgtgattttagtcttgctcttgtctctggtagatggtttcctactccctgtgcaaatatcatttgacttgcgctcatctgtaccagagcataggcgccggcctgcgtatcgagagataggtctcgccgcggtcgacagccagcccccatcagctccctcgccggcgcaaacacaagcagaagaaagcgatgtggacgagattatagacgctgcaatg

SEQ ID NO: 670 - DNA, 703 bp, Nannochloropsis_gaditana
tcggggagcgcacgacatgtgcattgtcgagagtatgtggccagaccgtagcgcagcatttcggggactttgtttcctttgtcaaggacgatggagggaaaacccctaacgcacccgcgatggagacctgactaaaaaatgcgtcgaaggtgggaaggccgtggtagccaagggccaaaaaaactcagtacctgtggcgctgttacgtttcttgctctgctatgatcctcctcctcctcctcctatttttaaaaaaatgtatggttgtcgtgtgaggatgcccgcggactggtgaaaatgggctgaccgagcttttgcctgaagcgcggggaggaaattgtgcgtattcctagtttagctgacagaagaggcggtcagaaattttatatccgattacgccgccccgaactgcctttttccatggcttgagccgtgggaggtgtgtcataggagctctgagggttttttctcccaggtatacgctttggccaggggccacgccagcgctgtgtgatctgattgtgcccggcgttttgaccagcgacgtggtagggctggaagcatgggccgagatagtctcccagggtatatgggccgcttcctctaatacgtctggcgcgtaccgcctctttctacagaagcacatataccccgtgatgccgtccatgagcattggagaagaaagatttgcgattgtcatatg

SEQ ID NO: 671 - DNA, 703 bp, Nannochloropsis_gaditana
ccagacggtccacgccagcagggcgaaagtcggtgatctgtttgagtcgcatttctgggtcgtggcgcgctgaacaccttttttttccacgttgatgtcaagctcagtgtttaatgtattcactgtggggcacatgagccccctttcgcgttctgtgtcagtggccaaaagcgaggggaccttgcgcttgaagaaggactcaggtcctcactgtgtgacatacaggcgcacacgaaaaggctttggcgcatacacgatcaaatgatgtgctactttccaaatgtggtgcttgatttccaatgactacggtgatgaagtgttcgtgcagtctttgtcaatgtacaccattcaaggtcctcacagagctctgccacgggaaacaagatgccattaggcggggcaaaggtgctacatccttgaaagccgattcacagtatcctccgcgctcatttctacctaccacagggtccgaagaatgaatcgagcaaaggcgacctggtcatacagcaagaagtgggcttattccgtaatctcaaagtaaacaacttccgcagctcggatctcgccattaatccagttcttgtctgcagtgtgacacaagacgctggaagatttttattgtaccagagttacccagaatagaactgagtataaacaacaccagaagcatcagagctgcctgtgacattctttggaaaccatg

SEQ ID NO: 672 - DNA, 703 bp, Nannochloropsis_gaditana
ctcttcgtcttggtgcttttgacacacaaaataattattgtgtagctaactaaagtagtgtcaaaagaggcgcatcaccctttcccgtcgctgactcgtcgccttacgcatgttttcggagtgatgcacttctatcagattatccaaaacgtgcgacatcattcaacgtatgacttagtcttagttaattaatgcgttgctttcgacattttccggatcgtccaccgctgtgtgtacggcttacccgcttcccgtgcacctgcgcgcagcctcctttcttgccccacccgctgatggaagcgcgatacagtgcatgcctcagcatgactgattattccacctcttgttttataaacaggaagcaatcatccccatgcctgttcgtcttttcacaaaaactcatctgacccagtttttggccgtcggtacccttctgtccggcacgactttggtaggagtcagagcctttgcttcgcccgccggccacccgacaaccaccaggatgagcgcgagtaccacgggcagaccgtctacgtcaacatccacggcttccacgctctttcccatccctctccgaaaagtaactggggaagccgcggccttgggaggggctattcgggcggaaaacttgatcaaaccggatggcgcagttatttttgtggtccgccgtcctggctgcattttatgccgggaggaagccatg

SEQ ID NO: 673 - DNA, 703 bp, Nannochloropsis_gaditana
agcaggagcagatgctgcataaagcggtgctttaggagtatatccaatatttcgctttacatagggaattggagggaaatgacaatcaggatgatgaaagcagtagaattcagacatcgattcggtaatgatcatcataccatttatccactcgttcccgacgcctggggaggtttgcttgagatgccaggtcgtcgcatacattgaattggggacgtaaggaaagaaaatcacgggaacaagttcttacttatcttttggctctctgtccgctggtttttgtgtctcttctttgcctgcttttcctctgtcgaggcccctctcgagccgatctgcgaccagccatcctgctcgcccatggctgaagccaaccgcctgcttgttcttccagaaggaggggggaaggtctgacgcggcaactcctgtcacggcctctgctccgttcgccgtgaagacagggtcgtcgtaggtttccatgttatcagggatggtgtccgatggcgtgggatgctgctatatcgcagtgtggtccagcttgtccttaggaatcaagaatacctgaagatactaacccggcattgcgcagcgcaaccgcacactcccctacacgcgacgaagagtttttgtggcgtggaaaattataagcagcatatatatccttaattttgtatttcacaggtggcatagtaacagaagtgggatg

SEQ ID NO: 674 - DNA, 703 bp, Nannochloropsis_gaditana
gcttggaaattagggtgctcacgaaaagtcttaatacgggcacacgaaaatccacgcctctatgaaggtgcactcttgctcaagcttcaagaaggaggagtgagtgcgatatgcttgctctatcgaagaaggcgggatagaatggctcgacgaatacaccattaagttctacttgctatgcttttgtcgccctgcctccagcaagaaaagcctcgcatcgggaaaaaaaaaaatagctacggattgaaaagggacttaaaatccgtcagaccgctcacaagtgtgtcgaccatgtctacttttctgctttcgtcgctcccccttcgtcttgtgtgtttttttatgtgctttgcgttggcgtgtatctccaatccttttcctcgggatgggcgagcaggggaagagaagctcactcaagccgtctacatgtccggctggctttcatttcctgtaggcgggagcgttgcctgtcaggtagtttgtccatgttactgttactctcattttggatgccatgtcttgagagccaaacctgtatttgccggtgcaggccagcccagggcactgacatgcggtttggtggatagggcgtcgatgcccgtcgtcatcttcacactcctcagattgcattccctcgtgcacacaccgacacatatttccattactggacgtacaacacaggagtagctgccagcaaaggatg

SEQ ID NO: 675 - DNA, 703 bp, Nannochloropsis_gaditana
ggtgtcggtgtgctgtcaacgctgctcctgacgctggggctgttgcgtcgtctggccgacattgtcaccttatgcttgtgtccccgatagtgtttgaatggataggtcagagtcagttacgactggaaattcctgcttctttaggcgagtcttgaagctttcccgaccagaaaatcaaaagaaagcgagcccggatgacgatggtgagggaggccatgtgatgaaataggtcccttcggttggcgagggctgatgacgaccgagacggaggcgatatgatggaaaacgacctttccattgagccgtcgtgcccaccacaattcgtcgcgagcatcgaagggaaccaggcactcgaacgcgaccatcgaatacgccggcagcatatacacaggtcagcgtgaagggaggatagagtgaatgtgtgattgtttcggctatatggcagaacctggatgaacctgaggctcgtcagcccttgaacgtcactggagaccttcgggtagaaagtcagacccttgtaccatttatgaatatagccattccgaccagttttcatttaatactaacctttatttccttcgtttggttatatcaacgtactttatacgccatgagcaggaaaatatcttgttttttgtcaggattgtcgctgctaggatcggctttctctagctagacctctcttcaagaaaagtccacgatg

SEQ ID NO: 676 - DNA, 703 bp, Nannochloropsis_gaditana
ctccgccatggcagcatcccgccgctcctttcccaccgtgacatcttcgtaccatttaaaagcatcgttcaaatactcttcctgcaagctttcacacgtgtttggacacgtccctggggcctcatcgcttccatcgcagcagtcgcaaatcgtgtcccccacccgggatgccggcagcaaatgcggctcgcccgtcaccgaagcattgcacgcaaatgtcgacgcacgcttcaccatcgagcaagcactggtttttggctcgtcgcagccattgaccaggtcgtcgcagtagttgtcgttgtgcagagcggcgggtacgggacaaggcgcccggtcggttgcgaagggtgacaaggtcacaaaggacgtgacgatgaccggaagaagccgacgcatgatcatggtgctcccacacccgtctgtgtgttaatgttgagggggaaaagccagcgcaatgagatgcgacccaaagaggtttggggggcacatcgggtattgttccattccggcgaagaacacgatgatgccatctccttgatcattgagggttttgttcgatctgtcgtcgaaggaaaaaatgtccgtggaacacgcccaaacccataaatggttcagtcctgcatgccagaacatactggattatggctagtcgtctcgcagcacctttactcacactcttctctccccgttcgcaccgccaagg

SEQ ID NO: 677 - DNA, 703 bp, Nannochloropsis_gaditana
gttgaaggcctgaagaagctagttggaggtgtgtgtcgtcaagagcctgctaatctaagaaaaaatggagccttgaaatgtcgattgccttacatgctgcgtatcaatgggaaaagaggaccgacgcagttgttgtactgtttttattaggtggagattccctggtccttgttctgaacatttacgtgatggcaagcttatacgcacgctctctcatactttcaattcaaagcacagccgtttaagacacgggtctcgcctaaggaattatcctgtcacgaaccatccagccgtctaattgaggaggcttcaaccatcttgtgagttgtagagcacgcttgccttaccctagggtgtaaggcccgttgacgtctatcgcgacctgcatctccaacagccggacgccagggaccagtcctgcgtttggtatagagggattgccatagcgaacagcatcgattgcttctgaccgccgcaaaactgtgtcgtacgacctcgtagtttgtcgggggattgatgcaatcacacatccagtatgctcctgcagagtcttgcttatgcacgcaactctcctgcgattcaatacgacaaggaaatgacgcatgattgccaaagtcccccctcttggacgcaagcacatctcttccccttctaaattcaactctccctccctccctctcgagcagactctcccgcgatcatg

SEQ ID NO: 678 - DNA, 703 bp, Nannochloropsis_gaditana
gcaccgaagcatggcacagaagctccgacgtgcgcggaaactgaatctgatcctcgacatcgacctgaccctgctccacgccaccatcgatccaagggccgagcgcctggaccaccaaaaactggaagtgcacgccttcgacatcttcaaccaaggtcggatcctccgtcactggtgctgcctccgtccccacctccgcacattcctctcccaggcccacgccctgtacgtcctgaccatctacacccacggtcgccgcgactatgcccaccaggtcgcccgcctcctcgacccggaccgtaccctcttcgaagatcgaatcgtcagtcgggacgactgccccgacctccacgggcaaaaatccttgcagcgactttttcccgggggtattgagatggccttgatcttggacgacagcccccaagtctggcaaggcgagcagtcccgccaccttctccccgtcctccccttcaagttctacacagagtttgaggaagtcaaccgggtcgcggggcttgctccggcccctgtcctgggttccagcgccatccctccctcccgacctctgtcgccccctccctcttcccctcctaccaccactcactcgtcaccggctccctcgggggtttccgggaaagaaacggacgcggaggcgggtcggaagggggaaaagacgccaccggtgccacccactgtgtttgga

SEQ ID NO: 679 - DNA, 703 bp, Nannochloropsis_gaditana
acgcccgaaaggtgcagcggaaaaaatggaacatgctgatggagatggggaggatgcgaccgcggaggccctcgttgcggcgcttgaggacgagctaggatgattgaaaaatcaaaaagtgacttgaatgtagaaagaaactcaatcaaatatgcatcttatttctttttcgtacgtctgatgaggaggagaaggagatgcaacggcggacggactcccccggaggatctctttccggcatttaagaacgaactggcacgactgcaaatgaaagaaaatacttggatgtaggaaatacaatttgaaatcgatcggatatacgttaaattgtttttgtacacctgccagtgaagggttttgtggaagttgcaactggagagagaggggaggttttgaagtgaaatgtcgtccctaagcagttcacgctctgattgcttcatgcgtgtacgacacatatttggaggccgcattgctgtacttaatttgtcagcgttaatttattacagttggcgtcgacaggctaattttcctccgttgcctgtgtttttatcctcctaggcaacatcgccgcctcggacgtatgctgtggcatgtacacaaagttatcacctcatctgtcgtcgcttcaggacaggatgccttccataggggcttggagttaatatgaagggaatcagcggtccgacaacaggaggaagggatg

SEQ ID NO: 680 - DNA, 703 bp, Nannochloropsis_gaditana
gttgaagaggtttcctcctcagatgtcgaaacagcttacctcgggttgggggggctggctgcatcgcccgacttagggatagctttggccttggagacagaacccaacacgtgtctgccaccaacatctccagcgtccgccatggtggctgtgttgctccacagcatcacggcaatcatcaatatattgatggcaaacgggcgtaaacagtgaaggcaattaaagcggggactctttctttgaacggcctcaagtgaatgtcccattggccgcggtcacacgttgcggatgtccacgaaattaaaaacctgaactcgttccaacaacgtccgtagttacatgggggaagtgagaggtcgttacaagaataaaaatcattcgactgggtatcaagcacggaggaggtttactagcacgcggctactacgcgcatgatgaggggacatgtgcatgaaaggagctgggccatttaacactgatgcaaagagtgtggtgctacgggcgcacaggggcgcaaacttggcgttgattgcacctcagaggccattactcgctggcagactcgaggccgtcgccaaggaacaagaatctcacgcacgcgttttggagctttcaaaaatctgacgctttccattttacccgcagcctgaagatcagacgtagcggctgtgttcaatctgggacaggtgtggcgtcctaaggg

SEQ ID NO: 681 - DNA, 703 bp, Nannochloropsis_gaditana
cgcccaatacggccgaaaccattgataccgacccgtaaaggagcatggcgcgcagcggaggtggtgaaggccgcctggtgagggcgaggaggttaacacggtaattgatccacatcacaatcaggcgaacacgccactttcttcccaatgcacatgtattgtcaactgcacctagttatgagatcatacaaaacctgacaggcgtggggcaccactttcgtattgcaaaggccggatcttgggctccagctttcacagatctttccatcccactgcatgaatattgtccctcgagacgcaccttcttccaactactcccggcgactcgggtaacagaggcaactcgaaacatgttaaatacgacaattactgcggtcgtcgaagcctcgctgtgttacaagtaggaaatatataaaatggatcatcagcaggctgtggtcgaggtaacggcgacaggcccggctctcgctcggaagatggtagcggcgattgttccgtgcctattgcgtcctgaaagtttcgttgcccgtgtggccgatcattcagcaattaaactttacccgagctaaacgaatcttcaatttttaacctggcccgcgccatcctcgatcacagtggctttcattaccacactccatccttcgcttgtgacagacagcacgagtaccaggcgacagaaagaagtccggagataatcaatatg

SEQ ID NO: 682 - DNA, 703 bp, Nannochloropsis_gaditana
gcctgtcggcgtcaaagaaatgggaccaaggccttacatatgctggatcatatggcaatcgatggcctggcgccagaccgtaaggcgtacgtgcacgtgcttggggcttgtggcgcccaaagtctcatgtctgaggcagagacgctgctgcacaggataacaaatgaagacttgaaagggagcgttgaagtggatcaagagctctgctcttctctagtcgtgggggccgcagagaacgggcgccggaagggttgggcaggaagctggagggcctgggaggtggtgagggagcacaggaccggcttgacagcgatcgcattcaaagccctccgaagctctctgacacggacggggcagtatgagcgtcttctcgacctatgtcgtgatctacaaggtgcattagactcgagcgggaggtcccaaggactctctacagcttcgcagtccgccgaggacgtggctactactggcatcgaggcttgcctccatctggaggaccacgccgagctgaaaaagtgcgtgcagaaacggttgagacaaggcgcttttcacgcgatcgtctatcaagaagctctaagtgcatggctggccttaggccggtgggacgagatgcttcgcctctatcgggacggacaggagggcgaggcctgggaggatgactacttgctcctgagcatcatggccacaggagcggcgcgtctat

SEQ ID NO: 683 - DNA, 703 bp, Nannochloropsis_gaditana
atgccatggtaccggcgttttcgggcatctttgcgacaatccctccactacgtcgagcctgaaatgctgaggtgcccagctgccctgctggttgtcgtgtcgtcctcggaccagactccaatagaccggtttaaggagctttccttgccttgccacctgccagccgcctttcaaacgggtcaattcgggagtcaagacgtgccgattgtctatttgctgcttcacgatgagtgggaaggaaacgagagagggaacggccttgtctgtgccgcagaattgcttaggcaaatgaaaggcgagcttcccaccgccccctccaagctcctccgcctgaactcgctcccgccccactccctcaacctgaaccaggccgccatctggcgcctgccctcggaggtcgacgagccctcggccgacagcttcttcctcaacgaccccaatgacccgcggcagcgccaccccgtgctgggcggggacggggcccgcggctcctgcctgagcagcgaggacctgctcaacctgagggagctggccctcgagctgaccgagaagatcgtcatccccgccgtggagcgccgtgtcttcaccctgcagaccactgtcacgcagtctcgcaagggcgtcaagaactttgtccgctccctctggcgcaaaccgcgagaggcggtcgccagcaccaacgagcagcagccgcaggacggcg

SEQ ID NO: 684 - DNA, 703 bp, Nannochloropsis_gaditana
ccaacgagcagcagccgcaggacggcgcgaccagtcgctcgggcccttcctctgccgcgagcctggtagcctcctgctcccccgcgctttatcgctttgaccggatcgaatctcagattcgcctcttggccgacagcctgtttgtgatgcaggactacgaggcggccctgggccattacaagctcgtccgcgacgacttcaaagccgacaaggcctggatgcacctgggttcagtctatgaaatgatcgccgtttgctaccaccacctcagtcacagcacagttgggaatgagggctcgcactctgcgggtggcccgtcctctcattcgggggggggatggacgctaccgcagggagatggagggggcgatcgaagacgctctcaaggcgtacttccggcaggtggaggaggaggagcatgcctccgaccatctcgccgggcccggaaacgggccaaaggatccaggcagtagggccggcagtcttgcggcgcgcatggccaccgcgccagtttgttgggaacggagtacttgctagcggctagcccgcccaaagccgtagacgctgctacgctgctggtgaacgccgcgcgaaaggagacccctttgtgtgccgccgtcctgctcgagcaagcagcctgggcatttcttcacgcgggaacatgcgcaagttcgccttctacatgaacatggcgggacgggcc

SEQ ID NO: 685 - DNA, 703 bp, Nannochloropsis_gaditana
gatcttcgagaattgccttgcgcgggcgacttcttgccccggaaaaactgttaacatcacacaaaacgacaacgctacggcaatacacgccatggcaccagtcgacaaacagcccactacgttacgttcaattctcgttcgtaaagcacgcttgtctgaatccgaatcaggagtgcgtccagcctcgacaacaccccgcatccttttccgctgggcgttcccgggcgtttcggacgtaactcgatcacgtcatggaacagtcggccatgaccacgacaacaccccgatgcgtggccaaccggcccaagtcgtcgcctggcacggcgctggtgcctatttggtgaacggagagggcactctctggtcttattgggtggtttttagaatacgaacgcatacgtgtttttgttgacgccacagagcgctttctctatgaatgatcgggaacaacgggcttatcgagtgctccgcatttactcttggcgcaaagatgtcctgaatacagacttttgttttttacatgaaaacatcttccagcacatatgttgtttttatttaaaattatcgtatgcctgtcatgcgactttctgtctctggtaccgattgtcggcttgcatcactctggatgttccgagcccctgatgatattgtgcccataaatcactcacaatgacagcgtttggatcttacgtcggcgctcatg

SEQ ID NO: 686 - DNA, 703 bp, Nannochloropsis_gaditana
acaaacaaaacttaccacctcccccttattattaactgatttcagatgcacttccaggttgcttttatctatttcatgtccatccagagaggaacacaagctggtaatggtagtttccatgcagcacggtaaagacaatccgcaatggcaggagctcggtcgaactcgactcaaactaaaccaatacagtgactccaactgctattctctgcgaaaagtgcctctggattttcattttgagctcacacaaacaataaaaatcgacgtatacactgctgcaaacgatgaagacgatgacgaagacgatgcgttggacgcttttcaaggatccatgatgtgcctcctctccgagctgtgcgctgccccagatcgcacagtctcatttcctattgaacaaaaaccttcccactccttattcaatgacatacgattacagttggatgtaacagcagaaaaagtagagtatcaaaattcctcgctgcgggtgaagctcaaaggagaacatttcagacatgttctgggtcctcaaggaaaagaaaaatattacgtttgcgtttgccgaacgcatgcacgacaaggagaaatttcaaaagaacgagcacaaaagctaatcatccactccaccgaagcaatttccttcgcaagaaagtcgtcccttcccgatggtccacctccgtcttggcggagcttcgaagtcaacatg

SEQ ID NO: 687 - DNA, 703 bp, Nannochloropsis_gaditana
gaaaataatcagctatcaagcaacagttctttttggtatgatgcatgtacacatgtattaaaaagaggataggtgagggtaagggttggaaatatcgaaccaagagcctctgtctgtactacacaagtcagacaacaattatttccggtgtggctcagtgagttgataccgcgccccttatgggctgtctggggaaagccatcagtctcctctgtcgcgaatgtagcaaatacatggacagtggattctatacaacaatgagagcactaaaaaaattaacgcggaatatgtcatgtacgaaagggtacaggctaaaggggtcttgtagtgtcccgaccttgggggatttccttccggcgacgctcggtcttttccggttgtatttcttgttctagaagggaagcatgggctttcacattctagactgtcgtgttgtccgcttcacatgagatcatattgtttccaaggagctgttctcttatgttatgttctcaaataatgttttcccaggctttcacgccccgtaacattccatggaaaacaaacaaaagaaggcttattcaacatcaacctcctgccgttgtacatgtcctttccacaacttctgcaatatctgatcttgttcagatacatctccgctccacacccatggtgacaatatcacatctgccctattacaggaaagaaaccacaagtcaacatg

SEQ ID NO: 688 - DNA, 703 bp, Nannochloropsis_gaditana
acttcctggctcactgtacacctttcccctcccttgtgtcggtccaaatgccctccctgatcccgatctttgttatacctacggaaagggacctccaaagtccattcctacgagcgcggggagagcaatagtgatttcaatttttctttattacctttcgcgcgcctttgtacgctgggacccggggcggtataatttcctagtacaggcaggaggtataagacagaggtccagatattaaaaagaggatttgaatacttcctgtccgaatacactgaataatattgatttgtcatttgaattgtgtcatatgttgacccaacattattttttttacttgtgaggtaagaaaaccgatgaatacggctctttctatcttttatcccccggaaatgagaccgctgagcgactcctctcggaaatgagcaccccactcggatactaggaacgcaatctttcgttgttttttgggggaaggatgtagagccttgaaccattaaaggcacccctggtgagtgagcgtacaggtgctacaaactttcttcagccatgatttgtttgttgatgggccgtccccgctcagacgatggcgagctcaaagcgactcagaaccgcccgtcatccggtcgcagccatgtcactgtatcagcagcatcgttttcatgccctgcatttcaatcttccgtctcaggtttaagaaatg

SEQ ID NO: 689 - DNA, 703 bp, Nannochloropsis_gaditana
gtacattaaatgccatggaatttcgtattttggccgaaatcatgacactttagcgctcagtggccatgaaagaatcgcagggggggcagagcaaggcagagaggagggcgatggatcaggaagggcggagttgcatcttaaggccttcttccggcctactattatcatgctcacactggctttatcgcgcgtggccataaaaatcattgtcagttttaatatagataggatgtggccgatttctaggctctttttttcgcgatggaggtgccttcggtgtattttcccgtgttgatacgatgtccacgaggcacgtcctggtccttactaggactcctcctaggaggcgatcacagtggtttacataaacgtaccgcccaatggcccagcataacagcagtcaaccctttcacgcatacgaaacaggagagtggagtatcagaagcgcagcagtggcggcgttgtctttcccttgggtcacttcactccttttcctacctccttcctcctttacccattcgccctgccccctctcctgcaccgaagtattgcgtgcacggcagcattccttcggaacgaaggcaaaattacaaacacaggaccctgccgcgctctatcctcgactgggaaaaccgcaggagttgcattgttgagcacatctgaacgagaggcattttagcacggtccagcctcgaccacaatg

SEQ ID NO: 690 - DNA, 703 bp, Nannochloropsis_gaditana
aaccgtgacccgtgtaggagacaggtgaaaggcaactgacaacactgcgtaagatagcaacatccctgcagcaagccatacccggctaccctgtagccgacaagctcgttgagaatgtgcatggttgctgcgccgtgcctctcccatccctgcgtatggtgaaaacacgctcggaggagcgctacgcgaggagtgactcaacttcctatgccgccaccttcctctttgtgattcttccacttcccacgccgcgaataaatgcacaattgtgccctgttcccaagaacagagagagcaaacaggaaagcatggtcaacacagtcggcgtcgagaacattgggcgcatccatgctgtcacacgggggagggcggagggaggccggggccctcctctcgggcggctcggatccaagagagagagaggttacgcccgaccggcccatggcccccgctaaaaaaaaaagctatcaagggggctgaaagacacggcttgtctcgatgatagcattgctggacgaagaataccaaaatagctcttgtcttgtatggtaagggcgagctcatacagtacattctccttgctttttccaatgccattacgtaacctgtacacgacagaccaacacaggatcaagaatcaaaataatcgagcagaaataaacccgcaatcatttcgagaccacgaaaagagaacaagaaaatg

SEQ ID NO: 691 - DNA, 703 bp, Nannochloropsis_gaditana
ttaaaatgaaagtatacgtgtgactgaaagacttgagagagagagatgctctccactcgtcgaggcagcgcgagcctccttcgcgccagcacagaaagccctctggccaggtattgaacacggcgagcctggttctacgcgaccttctctctgtgaaaattgccatatctttttatggaagccaccataaggatgggagctagaaaaggagggagaaagaatagaggcgaaggcacgagcgtgcgggtagggcgccggtccgacaacatgcatagtccttgcttacaaattatctctgcgcggacactaagactcagcaacgaaagtgacacgcctactgcgtcccactcggtccaggaaatttactcgagacaaaaggaatataatgatctaggaagcctccgtggttacgttcctagcgctacgatccctcgctcttgcataccttcacactttccagcgagtactcatagtactcagcctggggaaaggatttcagggggccgtgtccccgggtgcttgccacagtagtgtattcattgtattacttccctccaatctactatcactccttagcccttctgctttacccacacttgtgtagtcgacaggctggacaccaagcagaaagcggcccatggccgtgggccgacacaaacgggtgccgatttaccaagcatttcaattatcgaatggcaagatg

SEQ ID NO: 692 - DNA, 703 bp, Nannochloropsis_gaditana
aaatttactcgagacaaaaggaatataatgatctaggaagcctccgtggttacgttcctagcgctacgatccctcgctcttgcataccttcacactttccagcgagtactcatagtactcagcctggggaaaggatttcagggggccgtgtccccgggtgcttgccacagtagtgtattcattgtattacttccctccaatctactatcactccttagcccttctgctttacccacacttgtgtagtcgacaggctggacaccaagcagaaagcggcccatggccgtgggccgacacaaacgggtgccgatttaccaagcatttcaattatcgaatggcaagatgagggagaagcttgtcatctgctttatcgtattgggatttgtgttcattatgcaacaggtgctaacaaaggtgagaaagcttatgtgccatcgggcttccccgcgcgtgaattcgcctcccttcatgaagcggtatttgattttttccggtacgaacaaagacgcagatttcagtttcttcttccgcaaaagataaaacaagtagcattagtcttcaaagctcaaatgaagaaacgaggccgattttacatgcaactcatggggaggatgagaaaatggcggcggtagagatgcccttattgaaaactgggccggatcccagccttctgcccccacgggctgaccaagatttgcgttca

SEQ ID NO: 693 - DNA, 703 bp, Nannochloropsis_gaditana
gatgaacttgaagtgggcacttaaaaggtggtgagagaagctatcaaagccaaagaaaaatccatagaggaaacaggttttcactaaccctcatcaagatatgaaagctttctcaaatgaaggcctcttccattgttgctgctggtcatgtgcttacctatgcgtgtcatgaccccaccggaagcagaacattgcacgttccgagaccgtgttccgaagctacaccaggattcttcttgaaaatttcgagtactaatggcctgaaaactgcccaaggatctatgtcaaaatccgacaagatccattcagtacacttaagccggccgagagcttgtcctgcgtgtccgtgacgcggcgtctgcttgaccatcggcgcggaggccccgggagtgtgcagggagggcacgcatgcctgtgatcgcggggcaagcgccctcccacgctgattcgaaggtcacaggcttcgagctgtctcgggatattgagcaaaacatggaccgagggggggaaagcatagcgcggattctctgtgtgacagtggtggtgtcttgattgccacataagatccaccaatagtcttcgttacatggctctttttgccatcgtccgggcggcctcgctcttcagcaaaaattgtcggcagcttggcatgaagacacaaccccgtcccaattgcttcattgcacaccttacccacatcaca

SEQ ID NO: 694 - DNA, 703 bp, Nannochloropsis_gaditana
gtcataaaaattaaccacaggtgcgcgctccccatggcgatgcaatatgaccattccacaaaccctatgatgaggcgcttgtgcactgatttgtcgcttgacaattaatgctggtgccgaggagaatactcctgggtgttgtgctcgggcacatgtaaaaggcatccgccaaacattgcttctacacatcgtggtgtccccaaccagaccacttgatcgtgtgacgaatgtggcaaacaaatttcacagccctctccgcctgcatacatatttcacagaaagcaagtaagttagcctccgagataacgtagttatgggtataaaacgtgggagcttttgcaataatacagggagaaactcccgaggaagaggaggttgcatgacagcacagtactatctcgcagaaaatgagtgatcgagagacgaaaagaatagcatccgggggtttgcgcggtgactttaagtgcatacggtatgtctgtcaagcccgatcaagactttcttcattccagtgcccacccacggccgcgccagtcctgtccagcgtcttcaagaagcgagtgggcgaggccccaggagggcggcaggctttccacagacgggaggttgcactgcccttccacgcgttttcatcaaatagaatctcatttaaacggcatgcattctgacacagtttgacgaagagaagcgatacggtgtcatg

SEQ ID NO: 695 - DNA, 703 bp, Nannochloropsis_gaditana
aatgagtatcgccgtgcgtcgtcacaccatagttttaaatttggatgtaatccgatgcctgatattatgggaccgcatcatagtagtaattcctgaaggcgcagactccacttgctttcgggacctggaggaaaacctgcgatgccttcgcctccagcggagaacatttgacatggacattgacttgaatggcgtcgaagaagaagaatttgagtttttggccttagaggcagttctcatgactattaacgatcatttcaagagcaaattgaaagatctgcgccctcacataatcaaaaacgggaaagccctgcttggaaacgctactctgaacagcgaacaccaagacacgcttcgccagctcaaaagcaaggttactacatgtcaagcaaaagtgcgttcgctgcacaaaacagtggttgaccttttagatgacgaagagcatctgcagatgcttcacttgacccgcacccagagtcagcaacagcaacaacagcaacaacagcaacagcatcagaaacaagaagatcagaaaccaaacttagcctccgcacaaaagaacgagtatcatcaacagcaagaatggcgttttcgagacacacacgaaactgccatgcttggcagctttgaaggcggcaggacaaggggaagaggctgctcaattggtggcgaaaccgaccaacagctagctggcgtgctcatg

SEQ ID NO: 696 - DNA, 703 bp, Nannochloropsis_gaditana
ggcggggtaaagacgggcgctgacgggggcgacgtgcaagggccgggggaggaggctggcaggagaatgtgggctgaagattgagaagggggataaaggaggcacaagttgcaataagataataattatattggataatcagctggacggggccctcgggatgaccgaggggaggcgtctagcgcatactcactggtcggtatcctgttggcggggggggaaagaggacggaaggcttgtgccaaggctacagtcgagagaccggcctttaaaaggctacctgcgcgcattgctgtacctaaaaccgcgtttctatgtgcgaacgtacgaaattaaatgagttatccgcatggtggtgcttttatcttcgacagtttctagtctcgtcagacgctctgtcacaccgacgcctgtgcgcagtctgcccagttactccgtttggaaaaccagctaggcacgacggcagcatccagcccagcatgcacgggcaatgtacccgagccctggccgccgtgtccgacgtctcggacagtgcgcgtggcaatggaacaaagtcggagaggaggtttctcggcgcggcgaggggtcaggttgggtgagacttgcactgtagacgctaacctcagatctgataaggccactctcacatcatcgacgcgtcttacatctacgacaggaccactttattcattatcacaagatg

SEQ ID NO: 697 - DNA, 703 bp, Nannochloropsis_gaditana
agcattctatgggcgcgaccatcgagtctctgcgcgctaacatcgaagcattgcaagaaagagtggcagtattggaagggagaggagaccaggggtgaagattgctagttagagaacggcattcaataaagtgatgcaaacaattcatacaaatgtgtaagaagacattgtgtaagatacttacgcattgacgaataatgtgctcaaattgaaaagagagtgtacacttcataacctcctcatttctcatccgatcatgtggtcgtgtcgaaatcgaaacctagcagcacatccacgagacagcgtaaattcatgcatcctaatattaattttttgaagccctttatcatatgggtgaagagcaaagctgtgaatgttacgcgtgcgagcacgcctgttcgactggggcgccggagaggacatgaataactgggggaggtgggagagccgtatgggccgtcacaggaaacgtcgacttcgagaattccacgcagtggcacgccttttgcatctaatactgtcgtgatccatcgttcacatgcagagcaatcgaggaaaaactttctcatccagtctcagacggtgcccactcatttcttgggacagtttgacgtcttagacgaccaccgtattgcttccgtcttccacgccatcctgcctcctccctatctaaaattaggacagggcatacgcctctaccatg

SEQ ID NO: 698 - DNA, 703 bp, Nannochloropsis_gaditana
ccaggagtcaaaccgtgttacgtccaccgagcagcgacaaggagcaatccatgtccgacaagaggctgtgatgcttaacactgtctctccgaccgcagggctgggtatacgggaagaaaaacacggcgctctttggactttgaatgacatctataagcgcatacactcacgaaggacactatacgcggcacttgctaggattcataacagaatgaatgacatgcggcttctgaccacggccttaaataaacttctcagtcttattagcagacatgaaaagaaacacgcatttgcgtatctctatctcaatgcgaattctgcaaggggacgggaagcggccgatgtggctcaaaagtctgaagcgatgcttcaaacgcatcgtcacgcctgtgcagagaaaattctatcactttttcgacgccgggacaagatgcgcgcatgggccgcgataagaaagtcgtgtgctttcgttgtcaaggtcatcaatgtgcatgaccggtacaagatggctgctgcttttcggtactggcgcactcagactagcggggtagctcgagtgcagcgatttctccttcgatgtcttgcccgtcagcggctaaaacgtcaccaagctgccattttccgccttcagacttggttgcggaaatgtattcggcgtcggctggtcttagataccgatgtcaccacaaagtggcagaatatg

SEQ ID NO: 699 - DNA, 703 bp, Nannochloropsis_gaditana
acctattagaaaccggcccctatagttcttctccatcaactctgtgaaaatttgacaaagggctcctcttttttgtagcttctgataaaggtataactagcttttgtataaagatccgcagacacgtcttgtataaacagttgtgaaagaaaagccgttgacctcctggcaataccatttccgccaaagtcgagcattttctttaaatgacggtcgctagtgtgctgccaagtgcagtgattacgtcgaattccaattgtgccgaataacggttggaaaatggacggaggtgacacggtgaggcgctcgtgtccccatcgggtttgcgaacatagaaggggccggttctggcgagctctcgtccgctgatgacatatccgcatccctcttagtaagcacacacgcgttgtttcacagtcagtcgctctcacgaaagaccacaggtatgatacgggagagtactattaggagctgagtactatctgtctcgccattaccgcacctgtgccgacaaaaaggacggaaaaatggcctcctccgcgaccttcacgcccgcattaacgcccttggaggcctttagctcgagtggcccaccgcgcctgcgcatcaccaaaactgacggaactgtaatctatagtaacgaatatgaaggtgtgatccggttttatccctcaccctctgaggtcgtctctgctatcgccca

SEQ ID NO: 700 - DNA, 703 bp, Nannochloropsis_gaditana
ttggaggcctttagctcgagtggcccaccgcgcctgcgcatcaccaaaactgacggaactgtaatctatagtaacgaatatgaaggtgtgatccggttttatccctcaccctctgaggtcgtctctgctatcgcccacgctgacgatcctcaaacatgcgcgctgctgagagagtgcgctcgacaggtatttcgcagaggccctgtcgacaaattggcagactggggtgatcactttctatgtgtagaggtcggacctcgaaaggacgctgagccgactggaagcggctcaggaagggaaattgacaccgggcggctgaagtccctccacctgactgcacagaggggcgtgtgcgggtacacgtttaaaagaggagatctctgctggaactgcagaagctgtcagacagatcccacgtgcgtgcaatgcgacccatgctttcgggccagcgaccacgcaggccacgaggtgtacttccaccaggctagccccggaggctgctgcgactgcggagacctggaggcctgggaccgcgcaggctgttgcactgcacactcggggtcggaccccttccaggatccggtggacagtcttcccacgtccatgagactcccagcacgggtggtgctcgcggaggcggtggccctagtcacagacgcctgcctccaggccgtccagggctacaattcctcccacacccacg

SEQ ID NO: 701 - DNA, 703 bp, Nannochloropsis_gaditana
aaggcgctgtacccgctgtacctggagacacggaagcggggcctggggacggggggggaagaaggcttgaggaggagagtgctgcagagccttgaggcagcggcctcgatgcctgtccgaggagacgaagggggtgacagcgaaagcgacacccgtttggtcgagctgatttcgtcggcatccagcagcatggaggagctcctcctccagaccttgtcctcctcctccgcagctccgcgggcctggctggagctcgagcgcgcgttgcaaggagaagcgcggggaaaagggaagggggagggaggggcgagaaagccctcccccgcagactttgatcaagccataactcggctggcccgaggcgggatggcggaccatgcaaacagcttgctccgacgcctcaccctcttggggaggctgcctatggcctcctcctacgccgcggtggcaaccgcctacgcccgacaagtgcgtcgagccggagctcggcacgtgctgcaagagatgcgtggattgagtgagaaaggatgcctggccgaaacggaggtggcggccgcggaggaggcctgtgcggagttggcgagggctggaagggacggcgcggggggagagggagggcggtctgcgccttcacggggagaggacgcgcggggcgggggtcaagagcgttgtgagggtggtgaacgggggaggagggaggcgg

SEQ ID NO: 702 - DNA, 703 bp, Nannochloropsis_gaditana
ggcgtttgacttcctacaaaagtttcgttagagaagcataaagttgccagtgaagtgtcccgagtggccttagaagcctcaaatacgcggcattcttaaaatgacacatgttccagaggacagcagcctgccgagtaacaactggaggacttacatgaaaaactcggctcgtgggtgcttctttcctctcgaatagcttcttaattctctccattgcgaggcagtgtgcggttcaatgtctattttaggttttgctcctgagggttgctgagagacgcacgccgtcttttcgtgttcggcttgctcgccaatccccttatgccggctgctcaccctcacggtgcccctcacgcactcgctgcgagctatctatgtgtgggctgtctagaacaggcgggatcgaaattgagggcgacaacgtcagacgaacatggccgtgtcgggcgggctgcggcggtcacgagtgcgtgaggaagaggtcgccagtccccgcctctgcctcgccgggaatcgccgccccctccattgttccttcttacaagggcgacgggagcaagcagggggagggaggagggttgccgcctgcatcatcgtaagaactgaccgcgtgacggtttcattctcaccaaatcctccaggagtctcgccttgacggtgtggtcggtcgctgatccggattaaatacaagcgcgctcagggcatg

SEQ ID NO: 703 - DNA, 703 bp, Nannochloropsis_gaditana
ggatcataaatcgtgaggaggcagaagagatgcaaggcaaacaagcccgggagggtgaaaaaagagaaattaaacgccgagctgtagcagaattgaaggccatgcttaaggagtggacctatgaagccggaaaacaggctcaggggcttgaggagaaagtaaagttaaaagagaggaggctggctgtattcctgaggacgacgaggaagaaggggcgaacatgactatgaatgctcgtacgtcgatgaccctaccgatttatggattttttcttatgtacactatggaatgaaacgtaccgcaaacaatcaacataaaaacgcttttcttgtcagcccggttttgtttgttgaaagacctcgtttgcgacaaaccccttccagtgcaattgtgtaaggtccattattgtaacctgccaccacatcaacgacgtctttaatatcgggaagatcgcaacgtccttgtcgtgcccacgcgccagtgaggcagtacgggcaaagacaggaacgttttccctcggagatagcaatcggtcataacgtcactggcgcctgctccggcatcatcctagtgcaatcagggcctgagaaatggcggtcccccgcaaataaggcgctttgtatccccgcacctctcaactcccctcgatatatgtatatgcatagccaggtagtttcactgtgcagtcatggcggatgacgac

SEQ ID NO: 704 - DNA, 703 bp, Nannochloropsis_gaditana
gcttcgagggcagcccccagaagtccagagctcaacagttctggtcctcaataaccatgaacgcttttcaatgtaagggacgcagcgagctgtgaacttgcttggtgctcgtgaaggagcgagagaaggggccataaattccgtccagcatggtgcctctcgtgaggagatgcgatgcttagcctagtttcaagtctttttgctttgcttgggttccatcgcgaaatgcatctcgaaaaaaatagtcatcgatgtcggggaatgtctctatctacaggtaacatcatctgtagcgcaatacttccgcttctcgtaggcatgaaattgaagtctaaggaagtctccgtttccaacataggaaagaaaacatggaacgtacgacgagcatccgctacttcggaaaagtcaaagcgtcggcccagcttccatgataatgaaaggtagtgatagtcgtggtcagagtagcggtactagaggccctagggtcgaacatgagctgcgcatttgtcaggatgggatggcggcaagagggaggaggcggaggcgaggcaggagggtcgatccgcacgctttcgagcgccaacttgaggagcagcggcggaggcagcaagcagcaggggagggaggaggggtaaaaacgaaaggaggagatggagaggaaaaaatcgaagaaccggtagtcaatagtgaagaagccgggatg

SEQ ID NO: 705 - DNA, 703 bp, Nannochloropsis_gaditana
ccggtaggagaaatcctgcttcctcagccttcgcatgtggagacaatatcgctcctcgctttccaccagcccgtagggattttcccaaatccaaaatatcggtgccaatggcgtgcatttcggaagaaaggaaaggcaaagtaaagcaagggctatctgtccacggtaagggggtgcaggaagttagtgatctctcatgcgtaagctctggagtacaacaaacatagacaccgcgctgtactaggggcaaagaattctcgttagactctttcacgaatccactgggtgagcgcgggcaggacaaagggtcccagcaaggctagcacggcattgagtgcttcttcgtcttcgtcttgggcttcagcgagaccctcgcccctgccgtcacggcctagcacagtgccgcactgcaacaactgccacgatgagcgcatggctcgaagaaaaagtacggcatcgaatttatcacggtggagggggacacgcgccagtcgctgtggcgcagccttcatttccaacctcgtctcggaacagactcgcccgcggcccaagcgctaagagcggacgaggacttgaagggggcgggtctggcacaggcgaaggggaaacgattcagacatatccataccgcgtttagcacgatttaatctcacagtcgaaagcaatatgacacaggacccatagcgggggctgggatgggatg

SEQ ID NO: 706 - DNA, 703 bp, Nannochloropsis_gaditana
gcaaaatatagccttgtacgttgcatgacatgagactttcggtggtacagtatacacaaaggcacacatacacacgcacttaccaagaacaagatccttgtaggacaatgtcataagcgacgcaaggtacgggaacgggtcccctcggccttgttatttgttcctcaaaaagcccccctcgtgaattttgaggaaagtgcatgagaagtaagaaggcacaattcaacgataagaaattttcctatgcaaatggtaagggatttccctatcacctgtggtgggactgagtataaagacgagggaagagggaatgggagagtacaccagcactcacgcatatcgacatcgcatatcatagttgcctcaggctggaaaccggatggctgatgattctcgtaccggaagggatccccaataacatgatgtttctcgtaccggaaatgatcaggaagatgtttctcgtaccgtgatgtttctcgtgtggacagccaccgcattgtccggtgacgagggcctcgtaaatgggcccccggacccctttctattattgtcaaaactcgtccaggaggacgaattttgggctcacttacattgcccctcttctttatatttttacttgctgtcatcgcagtgtacaattcataagcttattatttcttttctgagatcctcggtcgcgctgtgaggacagtcaatcgcaatg

SEQ ID NO: 707 - DNA, 703 bp, Nannochloropsis_gaditana
gtgctcctgacagcaataaatacatgaagcgtctgccaaagcatttgaactggtgcccccgtaatacacgtggacagctaagaaatgttcaaattggtacatcatggtgatactgattgataatgcgccttgacagtacatgggaccgtaatccaatccttttctgttatatgttttcaaaatgtacctgtgtgcgtctcaactttatcctcttgagtttgtcagagacaaatcccgataggaggcacattcactagttcagtcggatctatcgaaagaagtccacgtatcctgcaggtgctatttcatctggttcaagggctcaacggacaattggaaatgttatgtctaccttctatttacacatcttgaggttttacatctcccgccaccacagttgttccatttgctagcttatctgtctttgaaggccattcgctaagctctcgcaccgcaaaggagggggctattccacttcaccgcatcatagaatcctcttttgacaacgcccactgctgcagtgtacgctcgacaatcgtcggtaaaatgtctgccgcgaaaattccggcttttctgtcagcttccagctttgccgtagtaggggctagtacaaaccgagagaagttcgggaataaagtcctacgttgctatatccagcatggcaaaagcattacacccatcaatccaaaagagaggatgattg

SEQ ID NO: 708 - DNA, 703 bp, Nannochloropsis_gaditana
ggaagtcatggcggcggcagcgaggtttggtttgcttccgacgctgatcagcggggggccttgcgttttggtggagcttggcttcgatgatcataggtgacttacatcggacacagcggaaggcatctgaagccagaaattaattagagcagcctctgagttttagttttgagccatagaatctaggcatcaaaaaggattcacctccctcacgagccagcaggcccttgcgtctgagcagaagacatccttcgccaggtaggaggttagatgttcactatctgaggttgcaaggtgacaaacgcgactacgtttgctggcgagcttgtgatatatctcgtgtcgcaaatgacaagcatgtcaagaggactttgtacggcaagataaaagattttgaatgaacacatgattataacattattttgactgttgatacacacttctcggtgccccaacaggatggttctcttcgtatgccttcctctgaccaagttttcaaagttttgaagaacacatgtgcctcattacctcttgaatggcatatggttaaatcttagattcaaatagatgtgcccttcttcttttgcgtcaattgcttcgtagagccagaagaaacaagcaccaaagctgtcgcgatgggcgtttccgtctttctgagctttatctccgtatcccccctcacatctcaggtgtatttatcatg

SEQ ID NO: 709 - DNA, 703 bp, Nannochloropsis_gaditana
cctcttaccccggcctcgaaaaagcggtccgccataggacacctaaaaaggcaccctgtttttagcaccttccgacgtatcccctgaagctcgcctgtacacggcgtgtacagttcgcgtgagaactttaaatagtaattgttacgtacaatatacctcgcttgtggaagctgtcggcgatgggcgttgatggaatgacatgaaaaaatcatcgcggccccgaggaatgtgatcagcaccctcaccgaccttcttacacggcatcggcgcataagcaaggtcggcaagatatcgttggccatctctggcctgtccgtggcaaaggctaattcctcagcccctccggtctcctgctcttcgcgccctgtccccttcgctgagagcctcgcacaaaacgctatactctgctgccctcttacggccactatgacgtattttgaactctgatcttggcctttgtatcctctttgagcctcctttctcatttttcgctttgcaatttcacgtttttggacggcgggctgctaaatgattttatcttctaaacatgacacaggaggttttgcgggttctagcaggtttcagcgccctgggagataagtaccggaaaatgttcgggaatttctgtgttccccaatttctctttcttgggctgattcgagtagcttggactcactcgtcacagccgtggacgtactcaatg

SEQ ID NO: 710 - DNA, 703 bp, Nannochloropsis_gaditana
ccccgtgcggaaaacatatttattgataaacatttttgcatgtttttgctttattgacttgcacggatggaaatcggatggcagaaaacaagcttgagctgtgaaggtggctttttattcgacgggcagtgatctgctgtcgatgccactcgggagtatcgctagcggaggatgtcacaaggagttttaatatgtcattcggccgtcgcttagcaatttaacccgtcaatgcaaatagaagatacgttttattagcgctctggctggcactgtggcctccgtgccacaagagcgcgggcaagcaagcactagcagtggggtacatgtcggggcagggtacctcttgcctttgaggaaaaatttattatcccttacgatgctaaaaaaagttattccagacttactaagagctctaattcttcctgtgcacagacgcgcggcccctggtttgcacgcccgtctggatcctgattgggcgatgcaacgacaggaactgcgggcattcctcttgtgtggcgccgtattgaccagtctcactgttatgtccttttctttcagtctattttcgttggccagtcgtaacgcgctctccctcttatcgaatcggagcagtagatggcgctacgggcgagtgcttccatccggacaagcctcctccctacccgatgctcgtcagttccgagttgcgccttattgcgaaatg

SEQ ID NO: 711 - DNA, 703 bp, Nannochloropsis_gaditana
agtttaatgaccaatgccagaaaatagggagtggcgagagagctcttcatcaaaaacgtaattttgtagtcgtgtgaactccattctggaatacaccgcggggagccttgaaaatatgctaccgtcactatcgtagttcgcaaggaaagggagtcctcttcattcctcgctgccacccagccaaaaattcgtggccgggcatacgaggtcctcataaaaccttctacgttccgcaaggagtcgcgtacggccgactgcacatagccagctcctcgtaagacatcacgttactgagtacgcgtttgtgaatcccaaggaggccctgcataaccattgaggcccgagtcgaagacggacagcgtgtggctgggggagcatgagggatcgggaccagcgcgtcgctcccattgccctccttcacaccccttccccttgtccccatggctagtgctgccattgtacacgcctcgccgcggtatcactttgtcgtaccctcgtggtgaatgttcgtactatcccttgagagataaaaagccagtcaatacccaatgcacaggtatcacttacttagaatgccatgaaaattcgggcagctatcagagcaaaccatctcctccggccggcactaaggcgatcaactgttactggggcatgtggcaaccttcatgcagttgacagtacgttgcctccctctcatagcccc

SEQ ID NO: 712 - DNA, 703 bp, Nannochloropsis_gaditana
gggtgcccctacgtgcaaggcgcggagatgctcatcgcccagggggtggaaaggggggagggtcatggacctacggaccgtgaacatcatggccgggtacctagcgcggacgaagggcttcgacgaggcccaggcgatggtagaagacgtgagaaggggggccccggggatcgaaccgagggcggtcacgcacaacatccttctcgacgcgctgctgaaggcgagacgggtggaggaggccctggagtacttctatgccgtggccgcagaggcctcgtctgctggccctgggcctgacaagagcgcacggagagggagcaggggggagagagggcgccaaggcgggggctggaggaaggagcgggagaaggaagtcgccttggtggacagcaccacctacgacatcctcctgaacgggctcgtgcaaaacggacgagtctccacggccggggcagtccataccatgatgcgcaaggctcagtttccgcccaccatgtacacctacgcagccctcatccgcctgcagaagagtgccctggacgtgtaccggctgtggggccaggcgcgcgcggactacccacggctcagcctccctttcctcaacctgttggtttacgagctcgggcagtcccacaacgacttgccgggggccctggccgcctttcgcgccattcttcggatgggtcgtcagcccaacaccatt

SEQ ID NO: 713 - DNA, 703 bp, Nannochloropsis_gaditana
gggtgattgagagcccaacaaaagtatcgacaatgccggggcgcgagcaggactgcaacaagtactgcaagtgcaagaaaagacctagcaccaccgccgaccacactagcctacccactgccatacagaaagctggcacggttaccgcgtcgctggcaatatggtaatgccgtcccataagttccattcggggcatggctaattgaattcaaggaggtttgaggcgggtagaaaccagaagcaagtttttttggggtcaattcccgtcactctccactttttctttcccttattgaggttgaagacgcagcaaactgctctgagcgccctgtgatttgtgatttactcaaagtcaggacgagtgttgcaagacggggatagaagtagaccgctcccgtgccaagttctatgctctcggcgagcctcgcgacaaaagccctgtcggcggtctcaccacccgcggaagccgacgcgcgacgagtgtgctccgggcacttcaaaggcagtgcaggaatgcgtgtccttggggtcgtttggaggtgcccccgttgagtgaatgtaaagtggcagaggtggaaggaaacgtgggtggtgcgtgttccaagcaaagggggcggcggggaggcgacagggccttgcactctggcaggcgtgacgatgaaacgctaaccataagagaccacgcagtgcacgcaggtatatg

SEQ ID NO: 714 - DNA, 703 bp, Nannochloropsis_gaditana
cgtgaagaaccgtccagagggcctcgtggaatatgctgacatgtcctcaacggagagagaagcgagtgcaaaggcccggtaccgtcacatccgctcgtaaagtcgcgagcaggcactttaattttagattatttcttttaaagacccaacactagccttcggatgcgccttacgaaagttggggcaacagttgtgcttacgcggagccgcgacatttggacagagctgcgatgccccgtattatgacttttgccggcgtgacctcgaactatctcgccgcatttgagcagtcggaaacgcttcttggctccctgatgactttttgctccgtgcttcccgcgtacacaaacatttgtgggtagtgagaccgcgcccttggaaggatcacactggagagacacgtgaagaggggacaagcgaggtacgacggccgccaccactttgctcctggccttttgccacgcccaatgcagcaccgaaaaggacatagcactgtatgaaacgaggcgtaggtggttgaagggagttatcgcatgaaaggagggtatgatggagagtctgcgcaggtgggacgactcggctgatgagaggggcctggtcgccgaggtcgcggaggcaatctgcacgaagaaatgatttcgatatctctctcccacatggaagctcacggtagcaaacaaatcatgcttatctccagagtagg

SEQ ID NO: 715 - DNA, 703 bp, Nannochloropsis_gaditana
gtgcccactttattgaccaccaaccgctagctttctatccgggcagctctcgctcaggtatctgaaccaaaccatcagctcgaacatagacaagaaaatcacgtcgccacgcacaatctgattgtcgaaaatctacttcaaccattttcgagcaggctgtggcgtccagtcccatctaaacatggcatcacctctgcctgctcgtcgacggcggtggtacgtcccgaccatacatgtccttttgctgagcggttgggccgccatttcggaggcgtttgccgtccagggatgcaacgctccagcaataagagcgttgacatcgtcctcatcgaagcccgcggcatccagtggagtgacgtctgtgtaccgcaatgactgttacaaagccccgtctacctgtaaacctctgcagaccgtcggccccctcatgatgatgcctgatagcagcaatattggaagagacatacatgaaagcagtcgtagctgccaaaacatctatattgtgggtaaacccagctgtaggaaagcagtggcagaggccttgagcactgcaatggggttgcctgttattcaagcttcgagtgctgccacactccttccatcctcctccgccatcatcgacgttgacgattctgtcattactgagaacgagggcgccaccatactgagtgcattgggtcttgtcatcagattggtggaaatg

SEQ ID NO: 716 - DNA, 703 bp, Nannochloropsis_gaditana
cacaggtttggagtgatacaattactgtgatgagcacatctcgaaaacaacggcgaaggggcgacacttgaagaaagattctctacccgctattcggggcacattaaaatgtgaccggccaaagcatacatcatgtctcgtgttccactcatacttgatgcaaggctacgctcagatcttctccgtcgtacctggaatgtcccggaagaaacccagcagcttggctaaacagtgtcacaaatagtaagacttgcttccacatacctgtagatatgtttacgtaggttgtgctctttaaaaaatcgaacaaaagggaatcgtgaggtggtatcgaaaggctccttgccccacgatcatgagcgagaaaggctgacagctgacgcgatcattgtgatggaaaagggaacacggctcctcaggggcgggaacgcggggaggtgggcccatcgaggagaaagctggcaaacggagcgggagacggggtgtccaaataggtctgtgcgattcaattgccgctagaggttgacggatcgtgtattcacatacattgaatgtgatgctgagttgtcttgctatgtactctcattgtgagctcgtgctacttccaagcctctcatgaaacgggacacatatcacacaggtcgcgcccatgatgaaatcaacacgctcagttaataaggataccaatgaaatcaataaaatg

SEQ ID NO: 717 - DNA, 703 bp, Nannochloropsis_gaditana
gtacgtcttatgttgctggacaagctgaggcatgatatcttccaatgaactatgaggaacttgaggcgtcgtcggctctcccaagctgtcttcaagtgcagcgcctacactgttcaccagccgcagcataatttcagtattctgacgctgcttctctctcaagcgcgtcaactctgtaagtaggctgtcacacatggtggtctggctacgattactgaatccgcgctctgagtcgctctaggaggtgcgcgtttttattgagggtgccgagatcgccctgctggcaatgctagcgtaattttcctatatgtaggaaaagcagccaacagagatgcaaataaaggtattagatttttatgttcatgcaaattaaggtatgggagcagtcaaggacaaagagcagccgtaaattttgcgacaagacagccctgtcacggtcggaagtaatggggagagacggagagcttttgtcccatggggcgtgccccggtataccatggctttcgatatctcggtctcacagatggtgcctgacaactcacaaataggcctctgcattacgtatagtcgcttgccagagggctgacggtgcagattatgaaagcacgcacagcaggttagaccgtcccgacctcccctctacttctcgagttctcctcggcgtctttccttacttaggaaacaatagaaatatttagaaatg

SEQ ID NO: 718 - DNA, 703 bp, Nannochloropsis_gaditana
ccaatttaagctcgctcgaagtacgcagtgcgcggggggcaactgctccaacttacttgaaggagttcactagcgagacgggattttacctccttgcgcgtctttcagttcttgcgcaaactggccaagacttaagccgtcttcagcttacttctcctttctcctcaactccccatgtttgaaggaagtttacacaccagggcaggacctgtgtaaaaatgagctccacgcctcattcgaagcacgtcagtaccgagggcagggagaaggtctcgaccgcgcgacatcctgaaaaggacaacggtatgcacatgagataccacattgcccttcctgacattaagagctgcttatgcattgaaaacataccatgcatatacggtcaatccatggcatttatgtcgcaaaacatgcttgcagtcagtaacacagggtatgccaatagcccgtgagaggaccaattccatctgcgatgtaccatattccctgtgataaaatgctaaaaatgtcccaggaaacagaaagctgtggggtggggtgcaagaatggtcaattaaatgtgtgagcaaatgtctaaagccagaaaggaagaccgatgatgagaggatgatcagtctcacgagcatgctgagggtcccttcacgaagtctccagatgccccgttcacttttcccacccttttctcatgttgatctttcaaggg

SEQ ID NO: 719 - DNA, 703 bp, Nannochloropsis_gaditana
tgcaggagggagctcaataggtatttttgaggaccttgcggcgtccactcgagacggcggcatacaggcggacgaggagaccggcgagacgacgcccagccttgtccggcctgcgcgtgctcagccctcctttctgcagggcagccgagtcatcaaggaggtcgccgaccctttgcaacacgagacgaggaaaccgcaggccactggaaatgaggtggccgatggacttttcatgcacaaagtcgaggaagaagctaagcacgttgacgtgtatcgtcaagcatatgccgaagccttcaaacgcggtgttggggtcgaaaccatcgaaaagagtattaaagtagagagagacgatggtggcctcgatgggagtgaagggatcgaggcggtggaggaggaggacgttgactgggaggagggcgagtgagcgagggctcggaggggaagtctctttacgcgcccggaaggcgtgcgtggtaaacacaaaaaattttgatgcaaatcaacaagatacctgcaaatcgtgaacaatggcttaaaacgaatctttcaatgttgtcgtgcatttgccctcctcgtctttcccgcgcctaccgctgctgatagtggatcgtgatcacgatgccgtccatgtccatatctgccacgcatgcgtaaacttaccatgccattcttacattagtcacccgacagaaaaaaaatg

SEQ ID NO: 720 - DNA, 703 bp, Nannochloropsis_gaditana
cccctgccacgccggcacctaactttgcaactctgcccagtaatgcctccatctctcacttttccctggactttcacccggccaaatggatagaaggagatggatggaaagtaatgagtcatgatgttgatgcatgtcgaacggcatctttatctgcacagtcttcctttccactaccctaagcttccctaagcttcatgccataattgtgtcactatgttacatgaagcatgcacacgcgagaaaacatattgtccttaccttgtgtacggggaggtcactgattacttcccggactacctcagtatcttccgaagcgtagtgctccgacggtgctaacacccgttgctacctgcggtatccgaaggatataagtcaacaccgttaaaacaccatcaatggataaaagactgcgcgatattctgcttgtgatgcaacaagttgtgcgattgaaaggcctgaatgcctgtggaaagagtttttcctcgttcgccggcttcctagcctctccattacactcgccctcccacaagtcctgggatggccacgagagaagcgtcagggaacggtagacgcttgacaagctttttgtgtctcatatagatgtgttcacttctacacatcccctctcactcgccgtagaagctggcggagtggaagacacagagaggtggtgtgctgtgtagccgggaggtgagggatg

SEQ ID NO: 721 - DNA, 703 bp, Nannochloropsis_gaditana
aagtcatgctgacggtcatcatgagtcgcccgcacgggagggaggacggagaagaaccctcgaggaggccagccaggccgctgaagaagaccctgtgaaagcgtcgggcgccgaggactccgcagggcgcaaggaagaagcatcaagggacgagacggaggcctcatccacctcttcctccagtggagggacgggtgctggcagcggtgcgtctggggggaaggagaatgtgtttacaaggtggttggcgggacgccctcctcgggagtccctccgagtctttgttcgggacttccaggtgggcctgagggaggcgtttgcggacctgtttgggatgcgggaaaagagcaccggtatgaggaagcacatttatcaacaaagagcttcggaagcggatggggaagccgggaagcaagagggagaggagggggagaagggggaggcgggggaggagaaaaaaaagaacgccgggggcgccttggtggtggtgaagcagcaacagaaaacctgggagcggctagctgagcaattgcgagacgcgcctatcatccaagagattttaaaagcgggcacgaagctggcggacacagagctcggtcggcaggcgggaaagctgagggggaagctccaggaccgggtggaagacgcgcgggagctgtgggagacgagtcagaacccgatcgtgtacaagctctcctccatg

SEQ ID NO: 722 - DNA, 703 bp, Nannochloropsis_gaditana
gtcggcggtagagactctctgtgctcgaactcggcaatccgatgcgagtgagctacgagcatctggtgctttctttttagcacgcctaccagttttgtagttggcaaataataattgtccgatgtcatcactggcccttttgtcgtcgccgcacgctcgttctcgaccctcttttttcgaccttgcttttgcttgcaacccagcatttcctttgtcatcgtgctgttcgcagttgaaacaaagactcatttctggatgatttccttacatgattgctctacgcattacatagaggctctgcaattatgccacagtgggtcaatggcaaagatgtgcagcatatttgagttgaagcctaatttcgtctcgactacaaggtagagcactcttcagtgttaccacaagttcccaagaaactagcaaccacggacgacgacgcccgctctaattacaattacgtatgcgttctcggtcgcttgcttctgccattctcatgttcgcagcatctgtctcggccgtcttgaagtcagcgcgaagaggtggtcgtttcggttttcatttacaaccttggcctccatcatttgtccctacacttgctttaaacccgcgactcgtgccagaaaggggtagcagatggaccttgcaagccgcccgagggctcagcaaattttcgagagatggtggaggtggagcccggagtatg

SEQ ID NO: 723 - DNA, 703 bp, Nannochloropsis_gaditana
gactccgaaaggctcgggctcgggacccggacaccatcatggtgatgtcacgccccccatctattagatcactctgcctccttcactcttccacctgcctctacgaaactttgtggcattaacctcacaaaaactcatttttttccgacgtgctaggcttataattatgctgccatgctcggtcactgcttcgacagctctaactacttcaaaagcagactctgtgcaggggatcaacggtaccagtcctgacgacgatggctctggaacggacacagaacatgacagaagtatggtgcgaagtgggtccttgctgaatcatagtgcgcatcacttgtatgagaagatcaaagtggacgacgaaaaagagggcgcaaatcaacaactagaagatcagcagcagcagcaacgctcacatcactgccagcaagctcgagaaaggagcgaaaatcttccgggcggtcagtctcgtatttacagctctgtggtgcccttatgcccttggggtagcatggtagcacataccaccctttttgtccaccctagaaaggttctggttgagtccaaatcatcatcgttatgttcaggagatatgttgtcgcatgtgctctcgtttatgattcagtcagaccgcctgcgcatggtgtcaacctgtcgctggcttagacaagagcgattgtatgtactccgggagcttgacatg

SEQ ID NO: 724 - DNA, 703 bp, Nannochloropsis_gaditana
ctctcccaaagcagtggacgaggcgagagatggctcctcccaagtcctgttgcactcgagctctgtccgacatccacatgcagtagaacaaacctttccaaatcttcaaaaagtccttctctgataggttcttgtgtttcgccatccagacctccaggcgttttaaggcttgatctctctcccgcttctcgtttgccgccagcctcttggcaaagccgattatctctttctcttcctccggtagcatcttaccaccattaatgctcccttctagccctgatgacgccaattctgcggtaacctcttcattaaacggggggtcacaaaggtcattagcttttttgacttgcgtagaagcggggacacgaattttgcctgtgctccttgtgctgctcccgccacgacccatcagccccatgcgacgcggacgattgaattgatgcggcccgcccgcacgcacctgcaaatacagtgcctcgatgagatccctgcactacatattaggtaataagcgcattagtgtgggtctcacgtctaattttggctccgcaatgttttcagaaagcaagcctgtaaagatactaggcccgtcccgtggctccctctgggcaagccgtctcgcttgttccgtgcacccgcccatggcccgcccgctcacttccattctcgcagggatccaaaccaagcaacgccgtggacaatg

SEQ ID NO: 725 - DNA, 703 bp, Nannochloropsis_gaditana
tacgatctcgaacccgcttcacggataagaccagctacatctccgttaattaatgcaaagaccgatggttctacataccggcaagatatgctcctgcagcttccacaaacggtgggctatatttcctgtgccgtggccggaacagcgggcatttgagcgttggaataccctctcctaattcaccccacggggggccggcggagctgaggcctcgtgagggagggcgcgaggagcaggcctcctcctgcttgccagccttcccgcgtgctggcacatttcgtggggtctgacacgattgtgattcgtggaagtagcctgtcaccgtaagcttgtgctgcatgcagaccgaaggactgctgccccttactgattctatttcccgccccccccttttttgagccacggtgctggaggtagagcggaggagccgaggacacgctcagtcgctgagagagggtaatgaagacagcgagaaaaacaaccatccgtaggaagacacaatacagatcaatgcagtaaacgtttctcatttccgagcgaagtgcacgtgcgatatattttcctcgctgtcagattatttctgattcatgcttgccgtcttccggagctctttgtcatctggaccgcccctcactcatgtatctgtctttttttttaattttttacaattccaccaggaacacgaacagtagttatgacaatg

SEQ ID NO: 726 - DNA, 703 bp, Nannochloropsis_gaditana
agacgtacagtagggcttgtcacgtttctcaccaatccctccttttttccggtccgaaaattgtgcgactcgtcttggtgatcaggggttgcagggcttctcatgatttctgtttttaagacaaaggccaaatagttcaaaacaaagtgcttcataacgctgctgaaatcagtccgttagcgtccacgttctgggatatcacgcatttccttgccctatctgagaagatgggccggacgaacgcaacgtaccatccttcttgggaaaagtttcaagtcctaggtacaagcccaaagtaagaaagcgttttaccaccttcccattcaacgaatgttggagacacatgtattcggtatagatgacggcatggccgcagctagcttggcgcgacgggcagcgcgaccccgtgggggccctactgggcagagagaagagtatccttgtgagcctccggggacggtccgggcgatggagaggggcctcttccagcgagactggtcagcgctttctgcggacccgggggatcacgagggctgaagacgaaccattacagagcgctaattgatcagtgtgggcgatcacacgcgagagattgtcgtgcgcgcgcttcaagctttagaggtgtggcattttaacgctttgcagtatggctttgagtaagccggtaatgcctctcatcctggacttctcaattccaagcaca

SEQ ID NO: 727 - DNA, 703 bp, Nannochloropsis_gaditana
gaaacttaattggtttgagtgccatcaacgccacgggcacaattcgcatacccaaaattggacacggactagaaagaaaggacaatcagaaaatttcatcggtgaaggaaaataacttgcccttcttatccattttaacatcacacgtgggacacccagttctctgaaaggttacttacatgatccgaccattcattaccaccaccaccttctctatcttcaagtgatgagttgaaatttagcattcgatttaaagctgctgtctgctttattcgcagattcgtacccatggttgtcgagtcgagcagtagggacggcactacgcacaaggttgacaggggctactcctctcagttgagccctgggaatgacgggagtacgagccgctagccgatcccctcgagaaatcgatctcttatagcctgagcggtagtggtattgagcttcatcatcgagtgagcttcatgatcgttgtggctcaacaaactgccgttggggggggggggaaagacaggccctcttccaacttttttggcgagcgccggcgaccccgaccaacagtggccggagggaggaggcagaggagggggacaagggcacgaggtcaacgtcaacgacggcggaagagtttcaagtcaaggcataagaatctcacgtcacactagattaggtcacttctagtccagtagtacgggcctttatg

SEQ ID NO: 728 - DNA, 703 bp, Nannochloropsis_gaditana
agctgtgtcagccaagcaattctttgttccttcggccgcatatgcgtacaagaaaaagttactctttacttgtttgaaaaacacccgatatagccttccttgcccgcggtgcgggccggtggaatgcacgggggtgagagggaggggcggcacagcacctccccgtaccccccaacctggaacttcaaggagcgagtcagctagggtcggccttgcgtaccctccactgccatcaccgcgcaagatagagtttctgttgattttaagccccttaaaaacaacaaatcgcgtcggattctaccaagagagttccaacatgaattttgacatgactgattaaaagtgaagatccggaaaaatgacacttggcttcacacttaagtgttgtacgtcctctctacatgtatttgttccctccataatggaggatggtaaattgacaactgcatcataatacactattgtactattactcttcaaataaatcaactaagatgtgatctcgttgagagcgcatgtgatagtcgcatgtgaaggtcatccgcctccccattactccctctatgtacatcatccttcatgttttacacacagctacaaaaactaccagttaatcagttttcatttgacaatgggaggcagtacacttcaagctgaacggtcttatgaaaataccacacccgctgctgcgcagtttgacatg

SEQ ID NO: 729 - DNA, 703 bp, Nannochloropsis_gaditana
acaagggagcgagtataagagcgtgatttggtgcaagtcttgcaagtgcagcagggggcagggcgggaggatgacggaacgggaggctttgttctatcctcgccccggccacagcgaacactagcgccacccaggcatgtggctggaaaaagagtgacgcatcctgcacggaaaaggcaggcgtcggcccctttctcgtagagggtattgagcaacgggcgtgcagcacaatatgtcgggcgacacattgaaaagcatcacacgcgctcttttgacgtccatcagtgtttgagagcacgttttgtggcattggcgcggatggactcgctggcttctcttccgagcactgtttcatgtacccatgcctctttcacgtcgtgccctatgaaccgctcatgatgcatgagacaaattgtgccacgttgcctctcaccacggccccaggcagagatctttctctgcctatcatgttgtctctgtcttcccgtttagtgtcgtactcttctcatggagtattccccaccgatcttccaattgatgcgcagcattcgccccgcgacgaccatcttcttaggcacgcagtgtgatgcacagcacaatggagccaatggcaaataagcatgtcttcgcgtcttatattcctttgtgtgacttctttttaaccatacaggtccgccttaaataacgtcaccgttcgaaaatg

SEQ ID NO: 730 - DNA, 703 bp, Nannochloropsis_gaditana
tgaagcacaatttgctattacggacggtggcatcgctgacgagtgagaactatgtgaatgaaaagataaacccatgtgaggccagtatgtacctctacgcagatttggaacgactttgtagccactcggactggagggaacatgaatggccaaggaaacccatacgtgaagacacataatgcacgactcttcagggcctctgtcatggggaaagagtcaagcgttaaagaggatctatcagtctgtgaaaagtctgaagattcacgacacagtttccctagttgcaatgtttccgtttccgcttgaatcctcatgtgggatgtttctatttgccacgctcacaccaactgccacctcaccagataaggggaggttaaaacgggcatcgccgcaaacttaaacgttgaggaaaaaattatcgatttacctatggtgtctattgtaactgaccatcggaagggacagtcctccttcacaaacggaacgaatgaaagctgaaatcggctgaatggttgaagataggaaacaaatgcattgcttgttagattcccaaaataagcatgagttgtcattgtggttggaaacctcaccaatggcttctggtcttattacagtttgatttacgagagacaggtaccttaaaaatagatcccaaaccgaatttgacatagaaagcatcttatccgtacttccgtcttataca

SEQ ID NO: 731 - DNA, 703 bp, Nannochloropsis_gaditana
caaattttagtaggcagtgaaacatccacctatgattttttgacattatgttgtgcaaaacccaattccaaggcttgctaagaggtgacattgaacccgagttgacggcaaggtcggagtccgactccgcgctgggcgtgtctgtcgcgcccaaacggactcagcgacgctcactgagcgtgatgactgtcctcctcgtcctcctcctgtcccttttccccgctgttgcgcttccgatcccaaagttccgttactttggcagaaccatcggctctagctctcacatgagtatcgatatagctaatacggaagcgaaatcacgcccaatgggtggttcacggctcctggtgatgacagccttgtgagggcccctatttcgcgcaaaaatggtccaccttgagcgacagtgaggactcgcacacagcaagcagggcattctgactaggaaagtcgacgatggcaggcgggacgcgtgtcttgtccaacggggctttgtttcttctctcgttggccacacacgcgtccaggaatagtttgacgttgagtggaaatctttcgtggtgcgatggtttgtgtactgcgttgtaaccctagaactgtatcgacagcgtccgacactctccgtgcatcagcatttgatacatgactcaatgagaaaacgtgttccccatgttttttcacgaacattatctatctatggcag

SEQ ID NO: 732 - DNA, 703 bp, Nannochloropsis_gaditana
gaatcatcgctttgaggtgaccatacgaaaaccgctgggaattttcatgtcggaaggggaggcagacgtgggcgcccccaccatttcggaggtacggctaggtagcaacgcggataaggctggtctgcgcgtcggggaccgaatagtggcagcctctgccacagtgggaaacaagctgtggaccaaaacgacgctggtgggtgtagaatcagccatcaactcgcgtttccgcttttccgacgacatcaccttctgcgtggaaaggaccctggcgcaggacgcgggcgacgacagtatcgcgagtcggcaagtcgaggtgttcgaggtagagttggagaggccggtgccgttggagttgatgcaagagaatgcagaaggcggcgtctttgttcgacgtgtgctgaaagcggactgcgaggccctgcggcgcatccagccgtacgatcgagtcgtcgccgtctcggcgtccctgggagaccgcatgtggcggacgaactctctggacggtgtcctctcggcgctctgcacccgcatcggcagcaaggttcgcttgcagttcgagcgcagcccagaggtcgctcgtctgatcgcgcgtggtgccggcaaccctggtgttggggtagctgatctggtaccaccgctccctcctcgcccctctatggccgctgcctccttgctctccccgtcatccacggctgacctg

SEQ ID NO: 733 - DNA, 703 bp, Nannochloropsis_gaditana
caccatcaaacgacatagatgacattccaaacacccctccgggcttacattctgatggaagtctggatggatctgctttacaaagggacgtagaagccgacgaagcatttaaacctgcgtgttgcaggatttgtcattcagtcattcatgtacaaagtggccagcagtatcgcagctcgccgcttttccctcctgattctataaattagcttaccgcgatgacagtcccacgacatgaggcacttaccacggctccaattaggattgatagaagcagacagcaaaagaaggagataattacgtacgtggagcctcaaaaaatgaaaagtagcctgtaaatgtaggtgttgacctgatggcaaccaattgatagtgagagcataagatttcttaaaaggctatggcagcctcgagcatataacctccttccatttccccgggggcgtcaagatcaccgtctctacatgctcaggccggtcacttgcactgtcagacacaccgggcacatgcttgttcgcatgttgtccgtcctccatctctgtacgccaaagcatttctatctacatttaaaactcagacacggagagattaatccgaagagcagtcccggatgcgtgatatggcgaggcgagccataaagtttatgatcttatccctcacgttctcgtttttcttttaattcatccgtgctcaatacttgaaa

SEQ ID NO: 734 - DNA, 703 bp, Nannochloropsis_gaditana
ggtatccttgactggcgcacgctgctccgcctcttttcccccctctgtgccaatctcttcatttgccgcccgcgacaacgaggcctgtgtttctcctttccacaacacagtgggaggaggcatatgaaaaaaggccattacgtggcctaacgcaaaaaatataaggagaaaatgccacgttttcatcgagagggtcatttgacgacaagtcttcaggtgatcggcgtcggagcataagccgcgcgtctgtccactagcctgtagaacatggttatggacaagagatgcgtcaaaatttgtccagattcctcaaatatcacctcaattatctcataaacggaaatctaagaacacactcatttcttttggttgtttctctatgcgtgtttcatcaagccgcacgtctaagcgctggtgggacgcatttctccccctgaagctctccttgctgcctcctcgccttccgtaacagcgacattccatatcgcacaaaccatccaacacgacctcaccaacttcaccagctaggccgtaattctatcctcatcaccataggtagggtcatttttattttatttttttccaggcaggaagggacggatcaggaagtgctccattgtcgtctggtacaaggctgggaactggcttcgtgtcattgaacactcccaccgccagcttgtccctccattccgccaataccatg

SEQ ID NO: 735 - DNA, 703 bp, Nannochloropsis_gaditana
gacatttatgtccaaaagagaaactagaggagaacctcagcacaacgtacgtaagacacatcagtcagacaagaaaaagctacccggagcaaggccgctaggtgcttttccatcaagtctgtgcaacccttttttgcaatgcaggccgtataatctagagtttataaattttcaatcccatacgcgaaaggacagggtctgtcgcctgagcatacgtagaaaagcatgccgccagaacgagactccttcgtgatggtccgactcctagtcgacgcgcaattggaataatatgtggcgacgagctcgagatgctgacgggaagaacggcgtagcggtggaccgtcggacttgtaataatatatctatgcgtcacgaaaaacatgaaccctcagctgcagaggaaagggcagaggaagaggtcttgctggcgctgcggatgatgtgccagtccggtctgcggcacccgttgcacgggcattcgtacgcacgctatcgagctctgcggccgcgcgtctgtttttcttgcgaggctcctgtatttggacccttctctgttgcctgtcactgcctcttatgtggcatcattgtgcaccgacagtgcgtcatgcgcattactaaggtgccgtgcggaaactaccgtggtctccacgaccctagtggcctcctcagtagcattgccacccccagagaatatgtacacatg

SEQ ID NO: 736 - DNA, 703 bp, Nannochloropsis_gaditana
gcctacatcgccgtcaagctcagcttccccccttgcatgcaagatagagttgccctcttcctccatcgagcggtatgacgacgaacaaaggggtaatgaatcaaaaaacatgcatcgatcgcgatcactggaggaagaacaccgaaaatactcattcaaaagcctgtatattgcaagcatcattttaagtgctctcttgggccttgctgtcgtcagtattgttatttatcagagcaaaattgacggtaaggaatgccagtcgattttttttttaagagtacaacaaagcaaggcttaaaaagaagtcagcgaaacacatactgaaggaattagtgtgttgtgtgatttcacgagtatcttcacataatgtcttctgtcttgtacccctcctctttccaccatttcgccctcctccttcaaagcatccgcaagaattctcatgggggacgtagaaaacttagtacttgattcagccaatgccctgtgcacatctgatgcttcatccagattttgtactcctcaatcagcgggcgacttcgtgcgcacggcagaaacacgtgctagcggaatgctgaccaaccttgtggacttgctccaatcattgggtgaagagctctatcctccacttaacggcatgattaatgatctagatatggccgaagcagacttggaagatatcaaagtatacatcagtctcattatg

SEQ ID NO: 737 - DNA, 703 bp, Nannochloropsis_gaditana
acaagtcagaaatgggaaacgatgcagataacgcttctgttcaaatagcacccaactttttcttctccctagaaagggtaatacgacttggatgcatcaattagcaagtctgaccgaatgaaagctttctattgcgagtgaaaagtataagggtccgaaaaggaggaggcagcaggaacgagaaggcgcaagacatgcaagttctaagttattccaggcgagcgcaggcggtacctgagtctccgacccatggccattagtataagtggtgcttgtacacgcgtgaagaagaaatacatgcattttcactgaagttttgcaaggcacataacaccacatggtaagaaaattctaagcgagaatctgatgagcgcgtggttcaagcaagtttgctaaaggttttaagaaatgcacgcccgtacaagggcacaaatcgatgtcagaaaatagtttgcatttagtgtggagcactttttcgtgtctccaggccacctgagcgtgcaaaagcgcgtgcaccaccctgcttccggccttccttgcgccggaaaaagaacaacgccttgcgctcttcaaggcctcgcccaggccgcaaacccggtctagatactacaccctgcccggtgcctggcttgtcactcacaggcgactaccacgctacaggcatccactgtggcagggcacatagacttacggggcaaatatg

SEQ ID NO: 738 - DNA, 703 bp, Nannochloropsis_gaditana
aaaatgtgacgaggtgctaatggagatgatggttttctggtgggataagaccaagattttgcgccaaatctgggagacaagtagggaatggtccaagcgtgctactcgtcttttaagcccgggcggtgagaaggtgcgtctagacgttatggaggagcttcttgcggagacacactcatgggattttgagatggagctggtcaaccgtgtgcgagccgaggtagaacgtggaaagaacatattgagtcgagccactgctgcacttgagggtggcgaaactgcgaaactagagctttcggctttgaaatctctcataacagaaggggataaatgcaagatttatatagaggagataaaggctttgcgaaagcaccttgcgagtgggcaacgatggattgcgcgtagccaaaaaactagaccagaagagctagatgaaatgatggttcttgccgaagaagctaaagaaatccgagtgaatttaggtgaggaatatgaaagggtgcttcacaggattattcgctgctgtttttgtcggcaaatggtcgatggccccctaatacggtgcacagaatgcggcgagaaataccatcaacgatgtttcgatattcgcgaagcggatgcagccgactgggagcgacgtggatggtgctgcccgcgatgtttagttcgttggcacatgcgggatgcgctcgccaagacaatg

SEQ ID NO: 739 - DNA, 703 bp, Nannochloropsis_gaditana
attccttttcagtacggtcttgagcaataaaacaaagcctaataaatgtggtggaggttgttttgagtatttgacacacgtagaaggcccgggcaacgggcgacccccgatcttcacatggcccaacaatgctctgtgttgtttaaaacctacgatgagcgacgtggaaaattattccaccacccacacttatgccatgtagctcattaacacgagtgtgcgtgcatgaagcgaagcgtggaggctggccaagggttacctgatagtatcaagtcaagcgttgcgcgtcgccgtcggagcgatttttgcatgcaggcccgcggggagggcaagaacgaagctacgcaaatgttgtcacaaggtttcggcaaaataaatacttggagaagatgggctacgcatagtcccgcaatagagatggggcgataaatggttttacagtctgctattcttcacaaggatattttttgagcgcatgccgccggatttcaggccgcgcgtgcgtcgtctcgctgcttctacacttccacctcgctagctggagggacacaaagtattttgagtgagacgcaacgacggtgtgatgccggtcaacctcgaacgacctcttttctgacgccaacttctgcttgaagagctgcttctggaggtcatggactcacccttcattcggacatgccccgtgtaccctccccgccagatg

SEQ ID NO: 740 - DNA, 703 bp, Nannochloropsis_gaditana
tcgttgctacctcagcaatgcccgaggggggcggagcggatcggatcggcaacgaacggatcggatcgtgtcgaggaggcgctcgggacgtgatgggccgacaacagcacatggacgagaacatccttcgggtagcaagcaccccttcccccccctatcccagagacggtctcatcatgctcaccttctcccactacaattttcgcaagcgactcctggacaaggctcgcaattacaaagacaccaatgtgttgattgtgaacgaggcctacaccagcaaaacctgcacctgttgtggaacaattcacaacaagtttggtgtcaacaaaacattcgattgtcggtctagttcgtaaaaaggcgatcgagacatcaatggcgcgcgaaacatttatcctcgctgcgttgttgaggcagcactggattggatggtgcatttaggagaggggcggggcgcatgcgccatctttggaaaaagcaagaacaaatttcgatgggcaatagtccttctcttattcatttcgtttatgccctcacctgaatccattaaagggaattcatacgtcgtgctggcgtctgtataaagcttataccctttgtttagatctgggaatgccaagagtaacggttttcgtcctttggctttgtcccagggtcttgcgatttgaatccagcgactgaaatactcatttcttgctagaaa

SEQ ID NO: 741 - DNA, 703 bp, Nannochloropsis_gaditana
tatccatcgcggacactgcgcgcgcggcagcttctgtcgccctttcacctgtttgtacttcggtgggcacttggtgtgttgatgatgtccccccacagctgtgtgattctgttgtcctagcggagagaagtaaagtaggaggatgggggtagaacgcttggcagccggcgcgagctcgcccgtctcgccttatctccttgatatgtctcactttctcggcgcttgcatgccgcacacggggcacgcctagggcgacatgctccagagaaggagccgacgtccgtgtcgcgagctttctgtacctcctggcattcattacttcttggaaattgagcaatgaacggagagcggcgctgtagcttagccccccttggtgatatgattgtgctggattttactcctgacctcaagaaaaggaggcatacttttgggattgatccggaacatccctttgagtaattttcctggtctgtcgatcctcagatcgtaatcatttgttgcgatggggcatgtttctttcctcaaaaaatcagatttattcaatttctgcagggctgaaggacacagacaggcaggggcaagcgcagactcctgggtttgactttacaaggtcatcaaagcgaaaaagaaggatctgtttgggaaagcattataattggtctactgatttatgtggtgaggcggtgaatccgactgttgcatg

SEQ ID NO: 742 - DNA, 703 bp, Nannochloropsis_gaditana
aagggaagagatgtccaaaagcccaaggcagagcaacctaatttacatggtcaggaggcaagtgtgttcagtaagaaatccagagattcattctcataccgacggatcagcactaggatcttattttgacgcctaagatgcgactgagaccctgcggcagcccaaagaggcgtgtaagctggctccctgggggtcgcctcagttgagtagagtctgttccccccgccacagcgctcaaagcctcatccctcgcacgcgagacgcgccgatgcacccgaacctgagacccgaagaagtgcacgcacggccacgcaggatggacggtggaggagcgtcatgacctgttatgatagactgaagtcgtctcatctcgggacaatcgagacctgagtcagcgtttgccaggtccaacaatcgtcccctccctcctttccacctgatttcatgcgtcctgcgtcgtatcgcgatttcgcgctgtcgagcatgagtagtgggcgacatctacgcataatgttctcgtcgacgcttgtgtagtattagtcagagaaagcggcgtggatttggccagacttattgcaatcaagggcaggcattgatggaagcgctagcgtttacgccagagcttcgggctccagctccagactgctccgacatatgactcacctccatctcctgcactgcttttctacataagtacaggatg

SEQ ID NO: 743 - DNA, 703 bp, Nannochloropsis_gaditana
aatggtgaaacttgcgctcttgtatgtttataggagaaacttggtgcctggtagaaacgggtccagtcttctggacaagcctaatcgcgagagaagtactacgtggtgcggtgaaaatattccaacgccaacatgctgtacgcatgtcaaggatgcaaacacaaagctcctttcaaggtggatttcgggacgaccgtggctgaaaattgccccgacggggaaaaaaagcggcgtgggcgtgaccgcgtatgccccaaagcctccttgaaccggggccgtggactccctctcgctccgcccttgtcgtcacctgcacccggcattccctcgcaccccccgcacggcttgcgcacgacgggtcttggcgcgaggatcctgtggatgcaacacttgccgcaacatgggatggcgatggtgtcgcgtggtgatggttttgggtggtgggatcttccctctaaggaatttcaaaggggagaatctgtcattccccttgcctcgctcgtccgctgcacgtgtagaacatgcgccccaatgcacttgtgtatccataagattcccacaaacgtgaccacggctccccaccacagtttgcaagtcggacagcatccacacccatgctcatttgagtggccgggtattgtgaggcactggcttgtcgactagtttttgccccttcaagatcgagcgtcgcttttttgacatg

SEQ ID NO: 744 - DNA, 703 bp, Nannochloropsis_gaditana
tcctgacgggagcaatttacgcactgctgacttaggccgtttgcagttttggacggacgttgggaacaggcacatgggctttctcgttagacaatccatcgtccgcccctttcacagcatcattcaaaagccagggagtcaaattcaggataaagagcgacctgaagggactcgtgcctactgctctgatcttctcctgctcgtgcttcgacacaggcaactgcggtattttcaaagaaaagtacagctctgaacagcaacgcgtattctgagagttgcggcgtcctttcatactttgtacttagcgagcatcgcagggctcagtttatggcaacgtggaaagagtgcatcgcgagtgtcttgacctcgccgatccatcgcccaggtactaactaccccaggtacaagctcgctcccacctcctagcagaagttgcctttttcccttcttgcgctcctcgcgcacaggggccgcaaaacttccgggacgcacggcgcacaaatgctttattcaaagctcgaagctttacaaagttttgaaagcagcagtgttatgcgtctgtaagcaaatatgtattacaaacgtgagcatacgtaatcgaatatgacagttgcactctataatgtacacgtctcgtcagtttctacattatacacaacgcggacataattggcttgcgagagggcaacattcctacttcatg

SEQ ID NO: 745 - DNA, 703 bp, Nannochloropsis_gaditana
gtacccgccttgttagagctaaaagagtcgctgtgcccgcgtttgcatccgccactttgagcgcctcctttggctgatgatgcatggcgcccgcgggtagcgggtccagctgcgccgtttttaccgccaccgctaccatttatatcaggctcatgactagtggtgtgatggggaggtttcacttcagaatgtgaccttgcctttggtttctggaaagagttcataattccgaaactggtatgccctggggatggaggaggttcaatcatgagacttggcccctggccacatccacgcgttatatttacactcaacagtcgcaccctgacgttggaaaagcctgaattcttctcgtgtatcatgtaaaccactgtacaccgctgcaagccacgactagcatggacagagaccacggcgtcgctcccaggccgctcactcgctctcgcggaggcttgctctgagcgaccgctcccttcgataaagagtccgcaaaataatcacacgcgttgccatggtcgcgtccctcgtctcactcacaggtagcaatgggattgaacgggcggccggcgtcgttttggagacacatacatgaccgtgcacttcatttgaaaagtgaggcaggtgagtcgtcgatcttttctagcacggtactcaaagtgttggctcaaatggacgattgtctcgaccatctcgatcataaatg

SEQ ID NO: 746 - DNA, 703 bp, Nannochloropsis_gaditana
caaggggccgctctcaccgacagactcccttcgccgtcgccacggtggagtgggggaattcggaaagggacagcaattgggcaggtggggggaaggattggatgggaaaaaaggagaaaatttgttgcggaagccattgctggatggcgaagacattgtatgattgtacatgaaaaaatctgtgcataaaaatacgagcaagcatctgatccgccaagccacataaagaaagaagtggctaaaaaaatacagacgattgcgtaaataaacatcatatgtgtttcaactagccactcaaacttctcccttccttctgatgggtgcgactgtcgttcaagattgctctccattgcggcacgagtggcatgtcttccgagaccctcgcagtatcaccaggaaacgatacccggaggacgcccccggccgacccgtgtggaccgggaggccccgacagacaaggtcaatgatccagtcgcgcccaaggtgccttggcgggcatctgacttcttgcccacgctcatcggtccgccgttgtcgagtccatccaaaggcttagtaacggggccgttcgtgtctctgagggtcggccatggtgtgcatgttgctatccggctgtgctcaccacctttgcctttcctctgcttccttcactgcccctttcagacgctctataacacgagtgagaccaagcttattcccaatg

SEQ ID NO: 747 - DNA, 703 bp, Nannochloropsis_gaditana
catccacgccctcggcctccaaggcctttttgcagtccgtgataggagcaccagaagcactccgaagctccttgaccaatgccagcggagcagcggcatacgagcgagcacttacacttactcttccgccaaaatgttccggtaaaagaattatttgtgcagcatgtagtcgggaagtaaacttccagaatgtcatggtgccctggcggcctgcgtgtggaatgaaagggttgcatagaccataagcgtgctgaacttgcctggggcattcgcgggcccctgccttgtaagaccagcaaataatcaatttctaaatattgaaacccatgtatgtaaccaaatccattaaaaaaaacccgttgtttggggaatgtgtgcatagtacttatagctactcctgaggcgaggatgcgcggaccaaacgcgtcgccgctgcaacgcatgaaaaaaaggtgatggcctcctgcgaaagagacatcatcatggaagcgtcttacgtttgccaggcagctgctacaggtgttttgcgcgccggacagctccgtgcgtaatttttgaccacgagcaacagcgcagaagcgcttgatctctttcacggcctccgttgtttttatttctccttcctcacttaagactcccgtcgggcacaggcgagggaggcgttattacccgtcatctcaccgagtcgaaagagggccaaatg

SEQ ID NO: 748 - DNA, 703 bp, Nannochloropsis_gaditana
cggtgccgctttacgtccgtgaaggcctcttgagccatcgatatccccaacacgatggtcaacgggaagagtgtggagaaagctgtgaggggcgtctcaaaaattgtcgtatacgtccccagcaacatcaaaaagcccatggccaaaaaataaacatttgctaagcgtctgaactgctcgaaaatggatcttggcagaaaggtgacgagagtgtacttggaatttttcacggaattatcacaaaaggcagaagcgtgcgcccgcttttcgcctagacgggcaacctaattggaagcgaagaattgagtaattggcatggataatgtcatgaccttgttttaaatgagcggctacgcgcaatgacatgaatgaggtaccacctctgtgctcggcttcaggacatcatggtgcggtggatgtcgattattatgccacatcgaaaggattacgagggcaaatttgcacacgtgagctgcctttcgctagcaaaagctgagtgcgtcattcacgtgaagatcaacatctcgcaggcatgttgctggattttattgtgtacgttaggaaaaagccaaatgatgtcgctacgctccaaaaacttacatgaataatccgctcatcctcctcctcagaaccccgaaaggacatccttcggcctactggtattttcatgagctgcgtcctgtaatcaatcggctgcttgatg

SEQ ID NO: 749 - DNA, 703 bp, Nannochloropsis_gaditana
tacgtgtgaaggaaagaggatgagtggtggagtaagtcttcaaaaagttgatatctccaccaattattatcctacatcatacaagagcgtacataagcactttgaatacggaaacgtgcgtgaaaattgcccaaaagggtggagggccccctcaggctggcgcgggaccgggcttcaagctgacttgtccgaggatctccgccactcgaagggggaaggagcacagaaacgcgtaaaagacgcaagactgtccggcgccacctgccgcgacgaagcgcagcatgtcacgctctcttctcatccattctgacgcagcaaagccttaaggcacccaaaggagggccaatatgacggcaaagacatgaccccggggcagcaaaaggcgagccctccccagacccccccgtcatgatgctgccgcgttctgcctgcctgtcacggcgaacaaactcgaggcgccatggtggcatttcaccttcctgccaactcgttctatgttattgctggatttgggtgcgcctcaactgtttctggcaaatttacgtaggcactttttccgtctaggtacaggctgttccactgtggcctctggcttcgcctctctgctccatcccgcccgctctcaacagactttgaagttcttgcacccatgtcatttcaagatgtagcgagccacagtcactcttacgagaacggggccatg

SEQ ID NO: 750 - DNA, 703 bp, Nannochloropsis_gaditana
aggtcttcaaccgcggatcagggggttgagcagctgtcacagtgtgcacggtttttccgacatcagacttaaaatacgaatatgaaaaactttgcccggcctcttccatcaaccacctaattatgacttccgtatgaaatgctttcatattctttgggcttacatgggtatattgtggcacagaaaatcatcttccaaaactcttggctacaccaatcggatatgggccacaattgagttgcaagtggaatggatgcatggcactttctacttgtactaggtcgagtctttgatggacatattttaactgcgatgcatgggcttgccattgacaaagctctccaatctagacgaagtcctatccgggagcagaggaatcatgcatgatcgatggcaatcataagagaccggcaggtacgagcgacaacgcgaagctgaccttgagagagggctcatcttgttctctcaagtcatctgctccgtcattactccgttcaatctcaggagtgtgatcgattgccagctattacagcgttgtatgtgcattcaaactggtcgcatggtcgtggagcagaggtttgtcgataggctagtttgcttttcttttcctgataatgcttgggtctccaggggaaggacactcacccacggctccaatatctgtgtccgcagttatactatttcgacaggctatacatgaatg

SEQ ID NO: 751 - DNA, 703 bp, Nannochloropsis_gaditana
caagaggcacagaaaagcatgaattgagtgtcgcggcctgccccagcccgcgtcctccctcccccccggcctccctcgctgaagaagcaggactttcgacccgccgccccacgcccctgcagagcggccgtactggatgaaaggcgggcaagacaagcaaagggcgcgatgagtcgcgtttgtgtgcccagccgcatcgtaataggtatttttgactcggagttagagcttttggtccttgtctgactccttcttcacttcgagtctctccgttcctgcctgggacttctgtgtcccttcataccatgtcacattgcagcttctcggctgaaaatccatattatgagtggtgtgaagcattttgacttgcattcgcgtgtcttgggtgggagcggggaagcgtatcgagcgcatagtgttttcgacgaggacgttgcccgtcgctagccacctcggcttcccctcctggccctcatcacttggtataactgagattacttcgtttaattaaaagcaaccgagtcatgttttgtttctcctttttaatacaagttatacaaatacagagaggcgactcgagtccgtctcaggcttgcagaatctcaggttgtgcactcgaatcccttgtcttgagcagggccgtgctccgtgaagcgccgtaccttgagggggtggagcctcttagcatagcacagacaacatg

SEQ ID NO: 752 - DNA, 703 bp, Nannochloropsis_gaditana
ttgtacggtctaatcgcatggttattacgcctgcgtacgcgccccggtgattttttgctccggtttcgtccctcttcagggttaggagagcggcggccgtgggcgatggagccaagggccgggtcagtcggaaaaattgcgcgaaaacccatgggaagtgccagttcccggattttcctcgaacggggaaagcaaggattgatggcccgtccacgtgcaggcgagtggccatgaccaagtgcatgcaagcatgtaggaggccatggatgactcggtaggggcgattttcggcatccgttgttatcagcgcaagcactactgttcatgtgtcaaattgagagggccgttaagccgtcggggaaattcaaaacgtgacgacacaaaccgcaaaagcactctgcctgacacctcgtgtagtgggaccccttaatggagacattatggagatcttctgagaaatgttggatcttttacgaaaacttcatggtaggatctctttcgtaggatttaaacgctctactttactaccatctttttcctacttccgagcttggacgcgaacgagatggaaaactgttctgaaccgcttgtcgtaatatatgacggatagataatgaacaatttttattttcttttcggtctgtcactttcgtttatatttattgtaaatcaatgtcaaaccgcgttacaggaagcaaacatg

SEQ ID NO: 753 - DNA, 703 bp, Nannochloropsis_gaditana
cttgccaaatacatgtcctgtgctagaagtgcccttcagaagcgttttccagggcagcggctcgatcgctcaagtcaaaggtaccgttgtgacgtaacagcaatatgccccgcgacaacaaccaagaccaatacgcccatgccatggacccgtccttgcttgttttgtctgtcgtaccgggcgtacgacttgtgttacggtctcacagagcttcgggtacttgtctatagctcccttaaggcacgctgtcacggccacaagatcgaatgggccgtgataaggtcccgctgcctttccttagcagcgtccaaccatgcctcagactagacatgtttgcgggtcttaattgcatacgtccgcgcgaacatgcaaaacagattatgatctttaaaaaatgagatgacacaagtatgtactttcctcaaacctcgcttcttttgatttgtcataaacaattattgcggcgagtcctgtgagacgctggccgctttggtcctcacagctgcaaaatgaccgttccgcattaatattgcagaaatgaacgattttaagtcgcaactaatacgatatgtcctactgtaagggaatgtaaaggagagcggcaccggctttgcgcttcatttgggaactcattctacacgtatcccacaggaagcggcttgattgtgcgccttcctacatttgcatacagccaatcaaaatg

SEQ ID NO: 754 - DNA, 703 bp, Nannochloropsis_gaditana
cgtctggccgtagcagtttatcaagtagcgttcagagcggatgccgtcgacgagcttaattagaggggctcgtcctcgcacttcctctcgtgtgaagatgacacgatccacgaaatgccagaagttgctatcaataggtgagcatgcagtttggcgctggtgaggatgcgagggaggccaatgcggagtggttgcctccgggatgctggggtccgaggaagggaagtgtcctgtgtcttgttgatcatattggcaggcttcgttaccagggaccatcgatgaggtgctggccccattatacacttgagaaaatggagcccagctcgtgctggttcgccatgaacccctgaaaaaggagtttggtgtttcgctgctattgctttccgcgcttggtttagttccatatcgagcttccctttcatcgtgatggccccattttcgccgcagcataaagcgtggccgcgtgaaaaagctggttgaatggctcattctgaccacctgtatgactttgaagttcgtgacgggttggtcgcaatatttttttctttacttctttgtcaatggcggtaggagacaaaaaaacatgttcctctcggcgaagggcagtagtaccacccagggccgacggatgactaacgccgcttgtaatggacactcaatttttacacgcacaaaacggtttttaattagaggcttggccatg

SEQ ID NO: 755 - DNA, 703 bp, Nannochloropsis_gaditana
acattgtcgtccatggtaaaggaagaatcttagcgcacaaaatagagacgagcgacatgttatcatcaacagccccaaagtcgaccgcagaccccaacgagctgctataccatactcccaacatgctgcacctctttaagcttgcggtgtcctggtcttgtgtacataatttagcgacaccaggccctgcctgagcgaagcttgcagaggagcgagaacaacgcaatgaatcccaataaggtcggtgaataaaagcaggcaccggtccagcggtcctcaaagccagggacgacgacacgaaacccctgctcgtggtgttctggcatcctcttgtgcgtcaggaaggcttggacgcttgtcatgtgcaagcggaggcgggtatctgcccgaacgctgtcttgaatttcttgcgataaaggaaagtcttgaaggaagcgaaatacgcccgccgccatagacccctgaaatttcaaagccttgtgagcttttctagccaccgaaagggaaataaaggggacacacaagtgtacacacgcgttctcctcgaggttttgtgctggtggcgagcatttgtgtcgcatggacttgcctcatacgctcgagcgaggtactgcatcttgctcctgtcttacgcgtcgtcttacttatatgatccctacagcactcctctgcgccttcgttggccacgatttttccaagaatg

SEQ ID NO: 756 - DNA, 703 bp, Nannochloropsis_gaditana
atgatgaccgatttgaatccgaagcgagccaagagaaggcgccaggagtagtactggatatggtccaagccttcaaccgcttgaccctggacattatttttgacgccggcttcggccatgacttgcacgccgtccgccaagtcccttgtcgcgctgctcccttgtcggacacagctttgccatgtgcgtctgctgccgcgtacaagacttccctcgatgaaattaccggcgacccatccgaaaaagtggagcccctcctgcatgaatcaggggacaaggagagcgacgaaatcgccgaagccctacgaattgctttcactgaggtcgcgcaacgcttgacagatcctttgcccgtccttaagtatttgcctcggcgctattatcgagcgaagaaagctacgcaagtcttcagacgggtgatcgataaggcggtgatggaaaggaggaaacgaggggaggaacaagcgaatgggaaggagccaggggtcggggatcggcaagggaatcttttggatttgatgattgccgtgcacgaggaaggcacctggtgcacggatgaaatgctcgcgcagagtatgacgttcctgatcgctggccatgaaacgaccagtgcgatgttaacctggacgttgatggaactgggggagcgaccggacctgtggctgaagctgcgggccgaagtggatcgcgtctgtggggtctc

SEQ ID NO: 757 - DNA, 703 bp, Nannochloropsis_gaditana
ggagccaggggtcggggatcggcaagggaatcttttggatttgatgattgccgtgcacgaggaaggcacctggtgcacggatgaaatgctcgcgcagagtatgacgttcctgatcgctggccatgaaacgaccagtgcgatgttaacctggacgttgatggaactgggggagcgaccggacctgtggctgaagctgcgggccgaagtggatcgcgtctgtggggtctctgccccctcatcgccctggccttctccttcccctcggtcttcctcccgtattgacgcgtcgcacgtggaccgcatgcccttcctccgctgcgtgctcaaggaatccttgcgcatgcaccctcctgtgacaatcatctcccggcggatcctgaaagatttggaggtggccgggtacttgatccctaagggctggcacgtaggtgtgtccatttacacactccaccgctctcctgccttgtgggaacgtccggatgaattctggccggagcggtgggaagaagggcctggagccaggggaaaggacacagtgcgaaggtgttctgtgggagatggcatggctcacttggaccaaaaacatttcgataacggtaccgtgccctccctacctcacgtgcctgtgtctggcggaaaacagggtggtgtgacgcttccctcgttcgacggaaaccaagctccgccgacccaggatcaacgg

SEQ ID NO: 758 - DNA, 703 bp, Nannochloropsis_gaditana
aaagcattttgcatggctggtggagacgcttgagctacagcatggagcacaacatcaagtttgcctccaaagcgctcggaaactttggccatcatcgttttcaggctttcctggtccatgatgtcgcatgtcacgctatatttttcactttcctgacctcctgcttctggccacgatgatgcaagaagcttctgaacggaggactcaaatcgaggaagggagctgaccatgacctcagcccccgctgcacgccatgcctgtgcgcaagcccacgccaaggaacgatgattggcgagaccaacgacaagacaacgtttgccggagagcatacttgtgaaagggccctgcgagaagctagtatctcccagtcatccccctctcagccgtctgctgccacagctgttgccccgagcatgtcgaatataaaatgactctagacgtgccttggcagctgtcgcatccgccttcaatgaaagttgctctgtgtggtaagcgaagggagacaggtggtggtggacaaggaagagaaggtattttattttcctatgttgcgtcagcaagaaagtttaacagcgaaaaatggcgaggacgcaagcacttcactttcctgaccgcctgcccgagaaaagctcccgatggccaccaaaaacactcaacccggacagctcacatcacacgcaatgctctttgacagcgttatatg

SEQ ID NO: 759 - DNA, 703 bp, Nannochloropsis_gaditana
gcagagctcgtacccgtggtcaggcgggagcagcatttcatcgtggagcttttcaagttgcaggtggacgacagtgaggacctacggaaattacagagtgtgctcgaggtagaattcgacaagctcagggataaattgaaggagcaggccgaggcagcgatggacgcagacccaattgaaggcttggcggttgtggccgtgatcacgggcctgctggggcccaagcccggctctccctcgggaccacgcgcaagctaccaggggggaaacgtggcgggaaggcgcgagcaggaggacgaaggcagaaagccgacacggaaagcgatgggccacgggatgctggtgacctcgcaggatagctttatgctcgagctcctaatctctttgcagcgatctttgggccaaaaatttcacacatttgtcgccgaccaggaggtatggatcaaccaccaaaaccccgacatcaaacgtgccggggtgttagcaccctttgccaagttcccgatatttgtggaccggctggccttggcggtgggcgggcaaatgatcgccatcgccgaggctgccttgcagcaactctccagtagcctccttgcttggttggagcgtctgagccttcggggggaccaaaaatatgcggacgtagtgcgattggaaaattatcatttttttgtacagaccatgagccctcgacagcagtgtc

SEQ ID NO: 760 - DNA, 703 bp, Nannochloropsis_gaditana
aactaacgcaggaggcttgttcccgcaaagctgtcgctgacagtttaacgaccgccttccgtcgtctgcgcaagcacatcagtgacgacagtggattgttcctccccctgtgggatcgtatttccctcttactctaccagcgctttgtgcggtatgaggacgtgatattgcagtgctacgatgtgaaattggagcctcccgcgatcctcgtacggcagcttgcacaagagtgccgtactcaagcgtctaagtagacaatcgaaaacgtgcaatgagtgctcgactccaaactgtaaagaatgtagatgacatctgttgaccaatgccactagttcctacggtggcttatccacgtagactcattgtttccgcgtcgtgtcctatgatgtgcatggcggcaatcaaagcctgtgccgccagactcgcccaagaaatgggcggtcggagttagttaccagtgtatcagttgtgccaccacaaagtctttctttcattgccttttattacgtcatgtgtcacgcgtcaatcacatttgtaggtggataggggtcggttactttgcaaaacggggttatctcgacttcggggtcacccgcttgacctcccccctcccttaccagatcgtctcaccttcccacacaccctacaacctccactatgtacagatcgacgaggtacgaagacgcctctcgactcgaggatg

SEQ ID NO: 761 - DNA, 703 bp, Nannochloropsis_gaditana
ggttggacccggaaggaaagtgctgagcacgaagcagcgggtggtacccgtatgctgcgggagccgttcggtgccggggaggatcctgctctggaagggggagaggagccggaggatgaatgtggaggacagatcatacggtaccttgtccatcgtgtcaaccgtgtaactgccatccggacatcggtcgggaaggcgcgctctttcctccggcacgctctccacgacgggaatctggaccaagtcatggcccgagtcatggcccaggcgcccgcccagctcggtttgttctacgacgcagacgcgattgtcttgcaccaggacgacaggaccttactcttggaagtgcttcgctccatatccgatcattttcgcctggatctgtcgggggacatggaggcaccggggttggaccgagagcccgactggcccatgctccatttggcgaccgaagcggcccggcggcggcgggagcgggaggaagggaaggatcgtgggatcctggcagccgctttgctcgacgacctgacgcactggcagttggaggagagaggggaggcgaaggccctggagactttccagcgttccgatgccttcaacagcagcgctaagcggacgggccaccgggaccgggtggtcgacgcgctcttggagacgtcgggagtggccttgcggcacgtgggggggaagggcccgggggaag

SEQ ID NO: 762 - DNA, 703 bp, Nannochloropsis_gaditana
caagggcatgcgtgacctcgccgaagaagcaactcgccccccgctcaaaagcccgcttttgctttcacgggaatgtatacattcctgaccacatgttcacgcattgataccagcacatggacacttgaaccgtacagggagtccgttcatgtccgcacaatttgtgagacgtggcctacgacagcgtgcttgcctcttcgaacgggtttcgacctggtcaggacactcctcccgatgtgcataccgtcctatatggcaatctgggcccaaattatgcgtgcgcaccgcgtcgctgtggacaaggcaaggacgcatgcacccttatttccccttaccttccgcgcggtgtcccacccgatcctacacgacgcggggaaggcggtccttcggcggggcaatgccttgtcccctgagcagctacaagtccttcttcgactagcaggtcgccttcttgggggtatggcacgagcaatccgtgcacgaggcatacataaatctgcgcctgcgattgcggcgggactcgtgctcattcctacaggattgggcacagtcttcgtcgtttcacacctggaggaggcaccgttgacacataggatgcagctcgtcttcgtcgacgaagagcaagaaatggaattgggagccatggcagcatcgcaagtatacaaagaagaaaagaatgctattttaacagcgtcggcgccag

SEQ ID NO: 763 - DNA, 703 bp, Nannochloropsis_gaditana
gtgtgctgcgggagtaagaacagctcttgtcaggcagctccttcctgactacctgccttccgctgcaaagccaccgcgcgccctgtcgccccccacctgtatcgacaggcatttaaaaaggaagaggttgcgatgaattttagaagaaaaaaagtcccggtgctactctgtgtggcctgggacaaggacgggctcgggcgtggcactcccctaccctaggcaacgtacgccactacagaggcctccccgccctctggtcataggcaccgaaacatgctgcctcgaactccacggaaggtcccagccaccctttcccggtctctgcacagtgacgaagagatgtcatcctttgacgccttgtgcaggggggccaaagatctggctgtcctgtgatggtttcttgctttgatgaagctgacccatggccttcgtcaaaagcaacggccctccttccattgaagacacgagtagtttgttttacatgcacaacacacagccccgccattcacacaacccgcggatgaagcatgatcatcttgagatatgagagcacatggggtgcctagtctcaagtatgctggattccttcctccctgtccacttttttctcatatgcttcatcccacatcttacagagcaactcttagcttactactgctcctgttgcctggggtctcaccccttcttcctccgtgcaaccatg

SEQ ID NO: 764 - DNA, 703 bp, Nannochloropsis_gaditana
aaggtatccttctaatgacttggggaggagagataaaatgtggaaccaacaaaccatttgttgtgacgaaacgtgtatgctgcatttggcctttttgtttttcagcggagaggataccaacgggtgaccgcgtagttcctatattttctctctgcggaagggtatatacgtattatataaattactgtgtcattattttaccattgtgttcttgtttttacgcgtaaacctctaccccaaaaaataatcaaacaaagaatgtatcgttcaattactcgtccacgtcaatttaatcctatttacaaggaaaagtttcacgcgcaaggaacataaaacctcacggctccaacggttctgtaacgtctcaacggacacgcacgcgtgcgtcaagctcaaggtgaccaggctctgccacacttgtgcgaagcagcatgccctgcaaggtccgcatgcgtgttggtactttcaatattgctgcattcgctagtgtctggatctactgggcatgcgcttgattgacgtgtggtgacgacgaggaaatttggtgaaggaataaagcagcaccgccatcggcgtagcatttcttcttcaatacatcgcttgcatggtttccggggccagcattggaaaagtataagatctttaccgaatttctacacgcatatggctttacacaggtgtcaaagccgtctaggcgctgatg

SEQ ID NO: 765 - DNA, 703 bp, Nannochloropsis_gaditana
agaggaggaagaaggaggaaaagcgggagaagaaggagaagaagaggagaaaaggagaaaagaaagagacgaaggggtgggatagggcgcgtggtgacacggaggagggaggtgatgggaggcagaagaggaggcagcggagtagcagcccgggctcggagagggaaggctttctgtcgaagacgcagcacgaggggaacgtgagagagcgagaaagggggagggaggaaccacatggcccgtggcgaggggagggggaccggtggatgcgagggagggagggggagggggcgggggcgggggcggggagggagaggatgcgttcgaggggaaaagggtgtcgcaggcgccgaggatggccttgcccgcaggggatgggtttccgtcttggcgagggaggtacgacccggccgtccaggagctgcaagggagggggggagggcggggggaagggagggagggaggaagagggttcgagtacgagggggggcggagccgaggagcatgttcggtcaagggctgaggcgaggagggggagggaagagtcggggagctatgaccggtattggaggcatgcaccggcggcggtgaggggatgggagaaggggtggaggacggatggagcaacggggaatctggtggcagccggagggtaccaaaaagaaaacttgacatggaaagcgtgtccctccgccgggccgga

SEQ ID NO: 766 - DNA, 703 bp, Nannochloropsis_gaditana
aaactccaaagggacctcgctcgggcaggaagaggagcaaggccaccgaaagaaggccaagcggccgctgcatttcagcagtgcggtgcgttcgtctcaggttttggggctgccgaagccgagtgtgtacggatccaatgacgtcgcaggcgcagatacggccacggaagacaaggaagacgtcgcaacttccctgtgtgcggcgatcgaaacacggttggtccgtgaaatccagcgcctcgcctttccctccctgtgcctcatgcctctcgaacgctccactttcgtcctcttttccccaaaactcgtcgtccccgaagccactctccaccactttgtgctacccatctcccgcaaagacgtggaccctgagctacggagggacataagatctgcggacggacgtgacttggcatcctcccttggaaaccgaagcccttctcctttcgtggcgagcccacgtgtcgccgtaaggtctccttcaggggagggggaactggcacctccggatctgaagactgatcagtctattgacctgtatggagcctgtctgatggaatgggcacccgccggcgcggacgtgcttttgccgcggtgcgtcgttctggtcagcaccgagccccgcgtcgcctctttgcgccgtgcggtcgtccggatgcgggagtcaatgggacagccgggggtaggcgggtctcccatcatg

SEQ ID NO: 767 - DNA, 703 bp, Nannochloropsis_gaditana
atgccgtatgcacgtcgatggacgacggaacccgctgccgctgccgacacacctgaggatcatgatccagtaattcgagggtccgtttcaattgagagcggtagcgcctctcgatcatcgtgtccgcgctcgggagtctggtcccacggggtaccaatgggaccgtcatcacgtgccgaattgttcgggcttcccaattaagagcccgtaagaaatattatggttgaggatatggtaaggaccttggtgtggtgcaggaaaaggaaaatgggacctgaccagtcaaattgtcagcccttcttgtactagtaggggcctccatcacatgcaatgcataatgcaataagagccttgcgacttaccttggaaaaacatctcatcggtgctcccattagcgacgtttcgtgcccatgcatttgtgcgctggtgtgcgttggaagtgtgtgtcgtatcgtcgttttccgtgagtaatgaaagtcacatcgtcttggttttgtactagtatgggtctgtcgagaccgactcggagtagcacagggcgtcagtcgctcacgctttaggtaaacttagttgttgttccatgagtgttcgacccgaggcaggggcacacacgtagcctctcacacttgaactgtaagtcagatttttaacgaaaaggggttgtgactcatttacctttaacacacaaaaaactaaggccatg

SEQ ID NO: 768 - DNA, 703 bp, Nannochloropsis_gaditana
gtatatacgttgtttagctggcgcttttgccaaaaatgcctgattacctaccaaatgaataaatacaatcacctcggcccttgtccttgtttgtccggagataaagtccgaccgccccgtcgaccgggagatatcactgcgcataccgtcgcgacgagcggctattggtcccattcgaccacactttatgtccttcttccggtatatatacgatcttattcaacttagtgtcattctgttgtccttgtcccagcatttgaacgttttcgggcgaaagctatcgcggcatagatgggagaggaaggaatgatgcgtgatacggatatatgaaggttgagcccagtccgtggtgctgtgaaagtgagtaagaggtgtccgtgccaaagttttggatctgtcgtcgttgtgacacgatgtgatcgaccataaacggctgtattaggccctcaatgtcgctctgcttgttgcatgcagcatagatctgcgtggcatggagcgtagctccattctgcggctcacatggtgaagcttccggcgattaccttaaaatgggagggcagtgtatgacattcagtatttcactcatccacgacgcggcatactgcacatacccatcgcagaggggctggccatttgcctgtctttctgcttgcgagatccgtcaggcgtgcgcgactctcggagggcttcctgtctcgtaatg

SEQ ID NO: 769 - DNA, 703 bp, Nannochloropsis_gaditana
gagtatctttccggcgagcgtatgcgggggggtgagattttgctttgtggaatttgcgaaaaagatagcctcttggagacgcgtgaccccactagcaacgtcgtagagggagtttgaacacgttttcagtagaatcgtgtggatgtcatgagcgtgatgagaaatttctcggtcaacaagaagggtggccgtcctgctcttttccgtcactcggccatgagcttgttccaggaatgaaaaataaaaaactgagcaccttcttgcctttttcaacatgaagaggcgtgaaacgagtaatgattgatcgtgttagaaaagtggaaccatactgtagacatcatgcttgtcttttgtcgcctggtggagaatacctcctctccctcttggggcaagctgtcagatccgacgacagtggccacgacccgtacctcaatgctctctgtcatacttgacagtatatgcaaaatagaataatagtactatgaattgcatttgatgtgggacgtaaaaaaaattgtcggatacgctacgtgcgttcatgtacaaaatttttcacagaccgatccgattaagtatgggcgcgccatggaacgcagtaaaagcttctgttcccaggcccttatattatgattgtttcacaatctaaaatacgatgcggtatttacgttttgaaagagctaacaaagtaactctattggtcatg

SEQ ID NO: 770 - DNA, 703 bp, Nannochloropsis_gaditana
ctttagcagagaagtagaaaatgatatgttgacgtgaagtccccggattgaaacagaatcgagaattgttgcccccaaaaaatgatctggtcacaaatttatctccactccaacatgaactagtcattttgatgcttcaattgtcctatctcttgataggattttgtttgccagtgccaagcctccagtactttacgctgacaggtgctttcatatgtcttctccaatttgacaaaagagtctgtcccgctacggtggatgacatcaagtgggcttgttccgtgtgcagcaaaacgccttttggggtattggctgagttatcatacgcccatggcaaaaattgttttgttgcctgcatgggccatgctttcgatcgaaagccgtgttgggcgatgatgaagtggaaaaaaatgaaacaatgcacgcagagttcaagggttttgttcccagccagaaaagagtatagcttagagaatttacgtctacgaaaagtgaattcacaaaagaaacaaattacgtaaacttgtgacacaggcaaagcagagagatgatcagcgtctgccaatgcgttgtgacgcacacgcatgacgtgagggcaatacgctgactgtgtgctctttttcctttccatgcagcggactcacggttcacacccggtcacatttgctctaacacaatagagttgcattggccaccctgcatg

SEQ ID NO: 771 - DNA, 703 bp, Nannochloropsis_gaditana
cacgtcagggacagaccctacggggcccgcgcgggtgacatgggcgggcaaagacggcgtgagaagccaggtgacgacccgcttgttggtgggcgcggatggggcggcgtccagggtgaaaaaagcgcggggcctcccgtcgtgggggtgggactacgcgcaacgagccgtcgtcgcaacggtctcactagacgagcaggccgacgccgcagacgcgccgtcaccgagaccttcaaccacactaagtgccaacaaatcaagccacagtagcagctccccggcaacagcctggcagacctttcttccgcagggccctctggccttcctccccctgtggggtccttaccactccatcgtctggtcgacgacgcccgccgaggccgatcgcctgaaagcgctccctcgggaagccttcctggccgagctcaacgcgaagctccagtgtccgattggcctgctcgaccctccctcgttcccttcttacgtccctcagcccctggtcaaggcgctcgtaggggcccaccacctggtggagagtgtcgtggtcagcgcggcgctcagccaaggtttccacgtcgcccccatcgttcgcgacgtatgcggcccccggctttcattcgacctgcgcgctgagcacgccagcgcctatgtgggcgcacgagctgccttggtgggcgacgcggcgcacaccatccacccgatg

SEQ ID NO: 772 - DNA, 703 bp, Nannochloropsis_gaditana
tcgccatgaagcgtggacgtagtttgcgcaaagatggcagtggtctacccgacgacttcgtcaaaactgctgccaatcgaagcgccatgatgtttgcctaacgccacataataagtgggagagggaaaggggaggaggttgcgatgagaggtatgaacggtcagctactctacaaacgcagggttttgtagagagtccgtacatgcatcagactgcagaatataaaagaccactttttgatgtactttcatgatcaagagtggaccaattcgcaatggtctcactgtggcaatcgaagggaccttttacatcattttgggggggttgctcttggcgctaccctctgggatcggaagcgctcttctcattccataatccaatcctattaacacagatactgtaaaataaaagggccttgtttcatcgcgtggctgatcttcgatggtattgtcgcgcggctttttatttgacgccattgtcatccttttcatcgcttgcctttgtctggccccttcaacaggtatgtctaatgattcatatcaaacgaacagcatagaatagtgtcggccccctcaactcactatcatacacagcaaacgaagtatttgcttctagctcagcaggccttgctatatctagcttactgaacccatcacgcttcaatcaagaataccactcggcccatcacattgagggaaaaatg

SEQ ID NO: 773 - DNA, 703 bp, Nannochloropsis_gaditana
agcgatctaaacgcgagcgtttgatcagggaaggaggatgccagtcactttgaagcctttctactcttaaagaatgcaatatgtagctccacgtgcttccaacacatattaaaaaaagtacacaagtatctttattttgtttatttagacgtattatccattttgagccattttttggcttaaaaggacatcaacatggaaatgtgatgccagtttccaatcatcgtcaccagccgctgaaagatactctgtcccggggggtcgcgcaggcagagatttacgactttaattggacatgaaggctctgaccaacttcaagaatggcacacgacgcgatgatcgtgacgaaggattctcacaattggtatatcgatgtggctgcaatgccggcgcaataatagtcgtcaagttttctctgaatcacagtcaaggagcgaacatctctgcgaataatttcccaaatattcttgtccactagttttcggccggcggacgcgaacgtagaagatgccatgtggatgtggagcaccttttcacacacgcacattgtccatcgagagcaagtcactttaaaagtgtcatggaaagccatgcatgtgccttcacacctttctttacacttttccgtccagtcacaggagttattttgtagtattaggagccacgtcgctttcttttcatcttcgaatcctacgtcacaatg

SEQ ID NO: 774 - DNA, 703 bp, Nannochloropsis_gaditana
gagaaaatcacattcttaggttaggaatattgaatagacgtttttcgtttctaccaaacgcgtggtaaaggggtgtatgatttttggcaagattattaattcgtatccgatcttgtaatgataatgcggtcgcagccctagtctaacttttatgatgcatgtcattgtgttctttggattcgccaaatgttgttaaacgaggtatagtaggacgcagctgtgcggttctcttgtgaacgcgcatgccggagtgccatcctgcatcgtggggatgatatgtgccagtaaatagacaggggcttcacattacatcttctgtttttatatctatataaatcaccttccgtccaaggcgatagggcggtccgcgttcattttgttctggaggaagctagcgagggcccgtgaccgagaaaagagagtatactcacggaaagaaaagagatattagaagcacctgtgctttattcctcgatttataccgctgcgtaatcgcttctggtggtaattccccgcggctcggtaatggatatctctacgaggaggctatcaagttgaagtcggcatttttcaaatgtttaaattttgagatgacctggctgggtgggcctgtcattttatttccttccggcggaataactgtaaaattaaacatgaaataaactcaaaactgtccgatcataaatcatataaggtataaatg

SEQ ID NO: 775 - DNA, 703 bp, Nannochloropsis_gaditana
ttccttccggcggaataactgtaaaattaaacatgaaataaactcaaaactgtccgatcataaatcatataaggtataaatgtcaagaaacgtgttttaccgtcccaaaattccaaggagaaagtgcgcatgtggttgggctttggcggctgccttccttgggtgtccgttcgtcgtcagagggcaaccttccgctacaaggcttctgacaattccatgcacactcgtagtacctggaaatcaacaaaaagcggaccctgtgtacggcctcactgaatgctaccatgctaccgtatgcatcgaccaacctgtagcctcggacgtaattaggcctccgccaaccatcctaccgtcgaaccgatccacgccgtcagcaactcctcaggcgctaggcataggaaaaagttctcccagagaagtctcgcagaatgaaagggatgtgggcggaatcgaaagcccctttttgggaagcggtgtcgaaagtggtaggtcaatttgtcggcagctatcattcattttattttaagttactatccaatgtcgtggcccttcattttactcctcatgttaataagtaactgaaataacagataaccagcctattgaaagagaagatataccggccttggagccagaaatgggatcgtcaaggtcgcgggcctttggaattaagccactgcgagactcaggagacggcaatatg

SEQ ID NO: 776 - DNA, 703 bp, Nannochloropsis_gaditana
aacgagcatactatcatcctgggagctgaagcttaaaccatctctattcatgacacaggtggggggtatggtggcactgcgaccaccacaaccagcttttccccctgtctacgatgaaataaacgtatgtccttttgaactcccccctgcaaatgacctagattacccattgccagagacttgcattgccaagcggcctgcggagccccgggatgcctcgttgcttttggtgtcagatgcttcgtctctatcttcaacagcagacactgtagacacatgggtctttgacgggatatttcgagagctcccgtcctttttgccggccaaatcccttcttgtcctgaaccggtcgcgagtgattactgcccgtcttctcatgcgtaaagagggaacgggagggaaggccgaggtcttatgcatctctcccgtgtcaccctcttgggatcctgcaatcgctttgacagccttgtcgaaccgaagtgtctggcgttgtatgatcggcggaaggaacataaaggcagggagccggcttgtcctaaccacagagaacggtctgtgcttgacggggcaggtggaggcccgcgaggggaaagatggccttgtccgcttttcttggacacacactgcgcacggtaaagagtcgcccccaacctttggggacgtcctggaggacgtggggaagattcccttgccgccctacatg

SEQ ID NO: 777 - DNA, 703 bp, Nannochloropsis_gaditana
gaacggtctgtgcttgacggggcaggtggaggcccgcgaggggaaagatggccttgtccgcttttcttggacacacactgcgcacggtaaagagtcgcccccaacctttggggacgtcctggaggacgtggggaagattcccttgccgccctacatgaaccgtgcctcggacacggcggacctccaagactaccagactgtgtacgcgactgccaggggcagcgtggcggccccaaccgctgggttgcatttcacccactcccttcttcaacagctgcggaacgggcctcagcaaatcgaaacctgctacctgaccttgcacgtgggggcgggcacgttccagcctgtcaccgggaaggaagtgggcgagcatgcgatgcactgggagcgaatccaagtccctatggacgccttagagaccctcatcgaagcaactgggagtgggcgacccatggtcccggtaggtaccacgtccgtgcgcacgctggaaacgttgtattggtggggcgtgcggctcctctctgcccttccctcctcttgctccgcccagcgaccttccaccctgttgtccgaagacagcgtcacgaacctgagtttgggacaatgggatgcttatcattacggagcaaaatggccaacgcaagcttcctcgttggtccctgccgtgcatgccctggaggctttgcgggatcgagccaagatg

SEQ ID NO: 778 - DNA, 703 bp, Nannochloropsis_gaditana
ggattgatggagtctcaccacagcttcctgcgactcggggttccagagcgtgcaccatcactgatattgcgtggtagaggacgatggaaaatcgttctagactaccttctgaagatgactcttttaatgtcatagccatgctggccagtttttgcagacatagctgacaaactttgagaagagcacgaattcgttgctttgccttcttactgctggtggccgtttctgcagtagtcacttgacggacgcgtgccaaaaatgtgtcccaatggtctttagatgatagggccagggtctcaatgtactttggtttgctcacagcgacgaggagctcttcggcgcctccctttatgtctagatgggcttcggcagacatggcctgtggcacgtattgggtgttgacagtaaggataactaacaatgatgggactggaaaaatgacatggcgattatcctaatacatgcgcaagcatacgagcgcctgcaatcaagccacatgcaaacttactactggtgtccatccaagaagtgcaccctttcccgagtgccagcgtgctcgcgctcaagttcgtattttattttccctccctcccttgggcagcacctggcgccagcccgtggacgtacggtacagacctcgatcgcgtctttttttaccgcacacaaggcgcaccataacgcaacgcaactgcacgcacctaca

SEQ ID NO: 779 - DNA, 703 bp, Nannochloropsis_gaditana
ggtaagcgccctcgtccgcctgttcaagtggttgttgcgccctcaataccctccccttacgagtacaaattgcagcttcaacgggagcaaggagagcgacaagatgaggcagccaatggttcatataaacgcgcccgctcaggtggcgctttgtctaatggcaacaatgcggcagaacgggcagagtttaagaagatgtggaagagcgtgatggatctcggagccatgcaattgacgggctacgagaaaaaagcctacgatgcacgtcggattgtcgagttgggaggcaaagcacccgcggccatcaagactccattcaatattctgatgggcaaacgtgcaaaagcaaaacaacgtgatgcacgccgtgacaatgacattcgcgaatcgggtgtggtcgtggcaaaaaagcggcaatctgcggcagcacttgcaaaccagattctagacgatggcggtagacggaagcatgacagtagcggcaagatcggtgagacgccttaccctgtactcgggaagatgaaaggtggaactttatttttgaacagggggaccattcagagagcgacgatggccaaacgggggggaagaggtggtgataagagaggtgggcgtgggaggggagaggcagtgggcagtgggagggcagctggcagggggcgtacagcggggaagcagagaaaagggtagctggttaaaaatg

SEQ ID NO: 780 - DNA, 703 bp, Nannochloropsis_gaditana
tgacactttccgggcttccccttgctctttgccagccagtcttcaacgcgcaacttgttgaacgaccgacttcaaccgcctcccctcccatgacatgaaatatgtcacaagcacaaagctttcacactaatcccactaatccccattgccagacgatatgacgcctgctactttcagcttactaccagctgagtgtcacgaccaaattctgagttttttacgctataaagatgtaagtgctggacgccgcggcgagggggccgttgtctgttaggagtggcgaaaagggcaggaggggcgtgtgtcatgacttactgcgacttgtgatcgttcatgtaccatcaactttatcatcaacagctatgttttaaagtgggttcactagaatcattgtggagtgtgctcgtaatcgtgcctatgttccctgtggtcatccatcgaagggccgttgttgcttgaagtacccgcttgccctcgacatccttttggcctgatttgctgccttattaacgcaagggcttttggggggctccagtcacttttatttgcgtgatggcaggatctatgggcatgagaaaaacgtgtagtggagaggcatgacgagggctgagttatcacctcttcttcaaccaatctctgaaatctcatttatgtttcttttcttccctctcccccgcaatacaagctggtgcgagtgtccatg

SEQ ID NO: 781 - DNA, 703 bp, Nannochloropsis_gaditana
aagcctattgcgagaagcaaatgaacctacagctctcccatccgggtcaagagaacgcgtctgtacaccacaagtgggtggggggggaggagagggaatgaaatggagagaggagacagaccatcacagacatgtgcagcggccaaactagagcagttttgtgcttccgccagcgatgttatgataatggcaagctttccaggaggaagcacgcttagttattttaggcatagctgtgctgtagctctcctatctatgcgatgcatggtgggtcgcggaggcaagtgctctggatcaacgccatggctctcgcctggatactggctttctttcttgatgaccttccgccttgaacgcaatgcgacactccactcataccaagctgccacccgacaggctcagaaggcataatataagagcccctggaccgccacatcaataaccacggtgtgcactgagaagagtgagcgcccgccacacatttattggcacaatcgacgcgcgcgcccaggtggggatagcgtatcgagggggaggaaacaagagtgggctgaccaggctcgtgggcgaaaaaatcgtgcagtgtcgtgagattggtcacagtgctctcattcaaggcactgttgcaggacatcgtgttcgtgagcgcaaagtgtgtgaaagaactcagagaaatactcctcagacggggacgtgagagatg

SEQ ID NO: 782 - DNA, 703 bp, Nannochloropsis_gaditana
aagggcgcgagaagcgcctttcctaccggcgtcggatggcgagatgctttacggcagtgacagaggcattgggagggcggaacagcgaggacgccggcgtcaagtgcagggggtgggaaacgaaagggaggaagaggacgaggaaatggtgggcgacgtggaatggttacttgacaccaggagatggactccaataggcgcggagattgattatactgcctttcatcgactgagtttccgagacaaggtgagcggggggggggatgcaaggactaggcgggggggggggcggaaagattgtcgcaagcggggctttttttcctctacgcctgcgtgttcctgtccactgttctagttttaacgtgaaattgcaggcgataaagctgggttgtcgtgttgcggttgtcttttcccgatgtctttttatcgtaccaccccgctccaccctaccctggggtcgcccgtagtgtgtcacccggaggccctctgaaaaacgagggtacagcgtaatttctcaaacgtcgaatcactcggtcttcatgaagtgttgacagagccccaggtcccccaatgctatgccaacgcctccaccacggagcaaccacgcccctgccccacctcctccgcgcgatgcgcttcctcaccaactcattctcctctttcctccctgcccaacagctccgcactctggtctgggttcaca

SEQ ID NO: 783 - DNA, 703 bp, Nannochloropsis_gaditana
tcagtgcaaacaccagatgggaaggttatagatttgacaaaggagctattcaaaggaaaaggaggaaggcgtataattattgatgtacctccacgacgagtgaagaaagatgaggactaagtaaagcgccacatcgtagaaaaagaagtcatcaatttgacgaggcattcttcggagctggcgtgcttgttgtatcgccggctcagttcgatacgtgctttttcctgtgtactaataaatttcttgaaattatattagggcttttctcttttacacaggtttgcttacagctagatacaactgctcacagatatactgtagtgcaggaagcaagaggttgtgcttcaaccgttaaaattttgatttgaagaacgtcctaaccgttcgagaccgttaagaaggatcgctccaacatgattgcattctactcgaggtgtctctgcaccaacatatttatctccatctgatccaaactaagcttcataaagatttttattcgtagactttgtatggtggtcgtaacttgtacggtcaattcatacatttaaattgcgagaatcttttctccatagaaaaatattgcgattgttcatgactagatggctttcgcttgagagcaataaattattctgcagaaccattcatacactcaacatttctgaatgttatgaagtatttggtgcagattttctgtgggaagatg

SEQ ID NO: 784 - DNA, 703 bp, Nannochloropsis_gaditana
ataaagctgggttgtcgtgttgcggttgtcttttcccgatgtctttttatcgtaccaccccgctccaccctaccctggggtcgcccgtagtgtgtcacccggaggccctctgaaaaacgagggtacagcgtaatttctcaaacgtcgaatcactcggtcttcatgaagtgttgacagagccccaggtcccccaatgctatgccaacgcctccaccacggagcaaccacgcccctgccccacctcctccgcgcgatgcgcttcctcaccaactcattctcctctttcctccctgcccaacagctccgcactctggtctgggttcacaagacacgcctcctgggccgctacaaaatcttccacaattacatcgagcgctgcccctgccgaccctgctctcctctcagtcgttcctacgcccgttcctactcgcgcgctctcaccagcatcgggcctcgaccatgcctccgggcgccactctccctcttgggtcttcagggactctttatccggacccctccttccgccgacgcctggaggtcagcggcggacattttggacggaggcgggggggaagggcggaggggggggaggggcggagacgacagatcgaacgcttaccttgtcgagattttccggctccaaccttacgcggcggcggcctacctgcgggcgctactgtactgttggattggtggcgtcatg

SEQ ID NO: 785 - DNA, 703 bp, Nannochloropsis_gaditana
catcttggtagggcgttgccttcttctatgtctacttgtggcatgctggcttcgtctggttgaaccgtctgatggtgccggcgcccgacgatctcaaggcctgggcgcagctttgggagggaaatatcagcgtcttgaaacgatgttggggacttttgcgacttccactgcaattcagcgtgcggctcgccgtcgcggtcgacttgcaaccgctatcaacgacagaaagcacgtgtctgcggaagcgaaagcctcgtctgacatattcgtgaacataacagatgggaggaatgcttttcaacgcggcatgctgcagactaagcgacaaagaaggtggattagcaagagaaagctgaggaagatgctcaaagagtgtgaggccagtctacaggaaagccaggaagccttggatgcgccgaatgacttattcgttcagatggcgcaaacctgctctctggaaatggctgcgggtcgatatttccttcgcacgccagacatggatgttgacacctatgttttctccgaaatgccctaccggtatgcatctgtcttgccgacaagttattttgttggatatctgttcgacgaaatctttgcggccgagaaaccgaacgctggattcaccttcaatgtgttccaaaaccaatcggaggctacatttgaggggccgctcatatccatggtactgtcttcgcagcaaatg

SEQ ID NO: 786 - DNA, 703 bp, Nannochloropsis_gaditana
acatagaacgtgttggtggatggttgggcctggaatttacttcaatgagatgacacgtttggatggcacgttgtagatgcatgggccagggcgactgcgtgggcggcaaaagaagctcgccaagacacgcacggcaaaccatgtcccacggagtaataagcaccaacctctccacggactcaagtcaagtctttgtttatcattcgagggcttaaagcagcacctaagacattatttttaactttttctgccccaaaatacatctacagtcccagctactgcatggctggcgtccgccggtaacttcgacggcctcttcttctttttccgatcgcagcaagcctgtctccggtggacaaggaggtaatggtcacgttatcctcaaccgcagcaaatgccgcggcgataagccaacagcaggctttcgacccatttgcggccgcctcaggagcagttctaaatctggtagcctgctgttgccttggggttactgccagcagataccgggtactcgaccagcaggccctctctgccctttcacgccttgtctacaacgtctttcaaccctctttgctctttacaaacgtcctgcaaattctggccaccccgtctcagactcggggcaccatttttcttctccctttggccgctgccgtccaaattgtcacggcggcgggcatctcgagagtgctgctccgcctgg

SEQ ID NO: 787 - DNA, 703 bp, Nannochloropsis_gaditana
cctttcacgccttgtctacaacgtctttcaaccctctttgctctttacaaacgtcctgcaaattctggccaccccgtctcagactcggggcaccatttttcttctccctttggccgctgccgtccaaattgtcacggcggcgggcatctcgagagtgctgctccgcctggtcggtctgaatccatttagcgaggctgggcgtgaggtgcggatctgctccacctttgcaaatgcgggccccttacccctcttgttcgtggatgccctcttcaaaaaccatcccgacccgaccctccgcaccagggccgtcgccttcatctctttctacttgctggcctggtcccccctcttttggaactacggctacggcatccttgtggacaagacagaggatacagggggaaagaaagggcaaccgatggagtattcctcgctggggacgcagtccgtgggagggccgcgtcttggctcgggcacgggtggcgcgggcatgatggtcaaaggcaatgggtccgccgcagccatggtcttggaagaaggcttcgatgggaaggaggcccatgcgacgaattggacctccccacaccagcaacagtacagccggcagcaggtgccgtgctcggagggccgcagcgacccttcacatgccctcgtcaggtcagcgttggagaaagcccggcgagtcgcacattcgcgggcgatg

SEQ ID NO: 788 - DNA, 703 bp, Nannochloropsis_gaditana
acaatcctatctgtagattgtagatgttcaaacatatattgagcacagacctggaaatgtacctgtttgctttgctttttctggcctccaatatcaacctccttcccctattcggaacacgtacccccgaggtcttagcagaagaaagaaaagtaacgtcctacgtgccgtggaagctcattggtaatttgagacgaaacttacaggtcgcacttaacatattatggacttccaaacaaagcgatggtgcaagggaggcggaatttttgtcatctagtgggggagcgactgtgatctttgcggtgccttcgcccagttggtctgtctcttcttagtagaagcaggttggtctgatcggaaccaccagccttcctaattcatgtcttcattgtcagcaagacaaaaccaagtagttgtaaggtttggacgcgaaatctgtcttttcatccgaacgcattttcaatcgcacaggtatttgacggaagtggaatctgtacttctcggcatctatattgaaatatacaagaaaaaagccataacttgcactacaaatttaggtacgtgtagtctatgatttgtatgttcagtctctggaaaattaaacgatttcgacgagaaagatacgttcgaacagctgcgaagtagtgagctgtttcagcgtttccttcaacacctcttacagagctcacctatatgcccgatg

SEQ ID NO: 789 - DNA, 703 bp, Nannochloropsis_gaditana
ttttacacgcgtccatggagaaggagtatatttcacgagaaaagtcaatgtcagagtcgcttgaaagacaagaaggttttgtcacattttcaatggaagaaacctcccaatgtgcgccagtgacatcacttgttccgacgtgcacaacgagatgacagcgtaaaaggtttttaaaatacagcgagttcaaattgagagtgattaaatgctgtgtgatatttgctccataactcgatcagtctacaactgtttcatttctagggctacacctcgcacccaaaccttttctaaagggccttaagcgacgacttcatcgagtaatgcgacgacgaatgttgcaaaatggaatggtgcaaattctgtatcggtgaacaagtcacgcttacgatatagcttttcttctacgtggatggtagcacagtagtgcagatattttttagtaacggattttcttttctgtcggtttaaaattccagtccccaggcccagatcttgcccaacgtgtccataaccagcaggggtggccaggtcgaagacttaccgatgtctcacttttaaaacgatattttctcccacatcaactctattttgactggggtgatttacttgactacttttcaggctctcaaagtgtgctaagggcaattacgtccacagccactcctatttaaattcctcttagtctattacaagcgaccacatg

SEQ ID NO: 790 - DNA, 703 bp, Nannochloropsis_gaditana
ggaattggaggacgaggagagtggccaggactccgatgcgatgcaatacgcagcggagcgcaaattgggccctggcacgctcggcccctatcgccccttgaccgtggcgcacaaggaggcacccccgctcctcaggaaaggccgtcgtgtccgacgtcgtcggtcgcacgcgatcgatgattgtttgctctgtgactttgctggatggatgcgtcaggacttgggcatcacgaaccagctcatggcgcgggccatcagcattggtatcgacgatggtgtgtcccgcctggtcaagctgctcaagccgcccgcggaccttccatcgacgggcgatttcttaggggtgtcaagcatttccacgcctgcacgcggtcgggtgcttttcaggaaatgggaggaggtgatccgtttcttggagaggtccgtaaccgaatgctggagccgtttgcctccgtccgcgggacccacgttggactaccacgtcaagcaaattcagtgttttggcagcttccttcgtgcgcagggttttgattttcaattggatgggggctcaacctgtcaatcgacgattggcctgacgcgcttggcgaaggcgatgtttgggcggacggcgtcggagctggaggaggagcgtaaacgagggaagacccaggagataggcaaggtggaagggatgaaatacgcactgtccgcggaaacgatg

SEQ ID NO: 791 - DNA, 703 bp, Nannochloropsis_gaditana
taggggagaagtgtggatgccggaaccttgggatgacatctaaattctattatagtcaacaaaagctttgcaccccatgctttagtttcaatttggtagatgtttacagtgagcttttcctcttctttaccccgcatgcctgcagcagatctttcatgtcggttttgcctagatcaacgatcaaaatttcaagcgtgccggcatttaaacggttggatgaatgggatacattcaagtatgcccaggagaggcaaagttgagatttctcagccacaatcagaatttatatgttcaggaccatttactagctgatacgcatcatgctgggctgcgactgaacctttttgatgagtgactgtcaccttttcaacgtgggtcgtacgtcgtaacggttggtcgtaacggctgagaagcgccacgcatgggccaagcacagaacatgcaaaatgcaggccagcttcgaccctctcttatgtttcacgttggacttttgcaaacacatcttttaaaaagtccaagggcttcgtggcggtattgacatgttctcaaggcattgatttgaacgaatattatcccgccggctacataatactttatggtggatctagagatgcgaaggacgatgtaattcctatgtaaccgtttcacgctgccatttatgtccttggtacattatcaacagtgttcaagcgctcataaaatg

SEQ ID NO: 792 - DNA, 703 bp, Nannochloropsis_gaditana
tcttcttcttcttctgacggtacattgtgtagcaaatcacgcccgttttcgtccattccctggcccacgaaatcatcgtcgtcctcccgatccgtcaagcgccatgacgatccatcggacacactctcaccgatgtcctctttccctgacgatgtcgttcttcccgcacctctaatgatgcgtttcttacctacatccgtttctacatgctccgtcaatcccctctgtggcctcgcgcaggcattgatcatgctcctatccctttcgtgcgattccaacacaacggatgaccccgattcttcatcatcctcgctctccccgtaatcaaattcttcttcttccgactcttccagcaagtcaatgatgaccgcagcttctttcagctctacttcatcttttcgagaggaggtagagcttaagctctcaggcttgctgtcctggtgtccaccgccttccatgttaaagagctttccaatctaagctgccgtcggtagtatacaactcatgctacctggcgggaataatgtgtcattatgacgtgaaaatgtgtgtattttcgtatttctcaggtccgtcaaccattgaaaagcgtggagctgtgaccaagttacctcctcgctctctgctttttccgcttcctcagcgacacgcacgcgagagaggcagcacactaagaaagcctcccatacatgggcatagacag

SEQ ID NO: 793 - DNA, 703 bp, Nannochloropsis_gaditana
cgcctctgcctcgtctgcctcccccccccccgttattcgtttgtcgagcaggtgacccggggagggagttgaactccatagtttccacaccttcaatctatctttgaccaccagtgttgccacgcccgtgtttcaggcttgttacggtactctccacgtatttctgccctccccgcctcccggaacagaaaaaagcaggtaccgtagggcacacaagtccgcgacgttctcaatgtcaatgctggggctggaggtaaaataattatactcgtccgaaaaagcgagtatttctcccaaatcccgtaaattgagaaatcctctggagtgaccctgcatgtgttcgagaggaaggccggaataatatcagtgaaattggcacggtaaggtgcttagcaaacggactcgctcatttctaccgccccggtctggcgaccaccacgccctcccctttctgtccgcccccaaaagaagaaagtaagcgcacgtccgcgttagatgaccgagcgtggcttaaaaccatgtaaattgcacgtgataatctaacaacgaccggtttatcgctacatatttgtggctttctggtggtatcctagcgtctcacttcgcttcttttacctcctccctgccttccgctaacttaggactctctcacgcttgtatcaccatacacggtggataccgagctatttggttgaccaagatg

SEQ ID NO: 794 - DNA, 703 bp, Nannochloropsis_gaditana
tttgcccgcaaccatgacgtcaatttcgaaggcggggcaaaaaaagtgccatactcttggggcattgttgggtcttctcttttgtgcagcgtcttggtcaattaatttcgtagaaacgaggcgtgagggcaggtaaagagactcggacgtgaactggttcaagaggggtaaggcgccttgtgtgtccgagagcgcgctcagcgtgtcttggtcctcaatgaatctcgatctgccgcgataagaagaaacacggtgagaccaaagccacacaggcgttcgtggtatgtctacaaccagaatgaccccaaagattaaggcggcaccggcaaaggttttatgttcaggactggcacgttcgagggggtgctcgctaaggaaaagaattcaaatcgaagcctcatgggtctagccccggcttacgcgtccacgcaggtcctttgctctccagtggcgtgtaatctgctcttgcatcctgcgcgaagtgtgttatgttccctacttgctggcccttagtttaaatttattttctacggggcattcgtttcgatgggtgtcgcttgctacggcacaggcgagagcgctcgtcaagggcgaattctcagcgcacataactcacgcatccagctttcttgcactacaatcgacaaaaggcaaccaacagcaattagaggagaacccgttgtgcttgcctgcttgcaaaatg

SEQ ID NO: 795 - DNA, 703 bp, Nannochloropsis_gaditana
tcccgcaaatgccgtccgcctaaagtcaagcgctgcagtgctgccggaattccccccaagcgctctttattgtccacggcgcttccattactgttgctcgcattgcaattccttgtgccgagcctgagactcggacggaaggtgctgctgtccctgatgtcgcttttgtacgcttgcgcgctgcgtacctgaatagctttctttaagtccccaatagtcgttgactcaggtggccccgcctcaagtgagaccgtgcgggacttgcccgtaaaggcaacagcgggcaacaccacgaagagctgcatgaatgccgatgctcctgtaatagtgtctgccgtaggaggaaatggtgattagaggcgaggtatcgtatgactcgcgcgacagcaagacttgggtcaaaatccttttccaacaaaaggcacccaatgggtttatgtcgcgtcttaggaggataaagtatcagtccgcatccttgcgcgaagttttcgacgcatgataatgtcgcttcatcgggtagcaggggcgttggcctccagccaagacagaaacatcatcaccgaagcaggcaaacgggtcactgctcgagtcaatttccgatctcatgacccccgatacattcctttccaaagcaacagaaggttagatattccttgactttctacactggcaaagctagcgacctttttactgtttgtagtgg

SEQ ID NO: 796 - DNA, 703 bp, Nannochloropsis_gaditana
ggccggtccacccctgtccctgtcgtgtcgccctccccctcccaggaaccaggaaccctctcacgtttcatcagcgtggagcgccagtcctccaaccccttcggaaagcgttgcagctcggccattaccggcaagtccgacagcgtctgcatcccgcgctttgtcggccaccgcgggatcacaaggagcagcttggcgggcacgggccgctaccgacccagaagtggcaccgattcgagtcgctacgggcccgcacaagatcacgtcgatgactgcgggcacgcactcccaagcaccgacagaatctgccgctggcggggggagtgggagcatgcctccgtcccgcccgtccctcccggcttggctccaaggaaagcgtcaagcagaggccgggcaccgtgcacaaggaggggagcaaaacgagcgccagaagagtaggactccccaagaaggagggaggccaaaagatggaaagaagaagagagtgtggacgctgttcaaacgaggaaagcgcgcctcaagcatccccgctgctgccgccgccgcctccggaggggtccgcgcgcccaccaccatggatgagctggacgaggcactgcctgtagacaggatggcaaagcgtatgctccgcctcctggagtcgcggccggaggcgttggaaaaaatttaccggaagagcgagcagttagaggagtggaggatg

SEQ ID NO: 797 - DNA, 703 bp, Nannochloropsis_gaditana
gtatcaattaagcactgttcaagaagagtaaggcagagttttgctacagccgtcaaagcacatggcctcctcctcagcggctattaatatggaggcgactatacgtatagacgcgtcgcttcaccatagagaaagccttagaatgaatgcatccgtataaacagctgatgtcctcaaacgccttgttgtcgaaaaacagatgatttgcctgatcacctctcttcaggccatcgggtggactcggcgcctggaccgcgaactcccggtcgttgtcttttattgccgcacattcaaaaagccgttactcgacctagcctgaggccacgtagacccggcccatacaggagatgccacatccgggaacattgtcacggtacactcctcatgcgaaggcagattcgaaagctcgagaatgtgagatttggggcacttcgttgacatcagacaatcatggcgcgcaacatttggatggtaggcatgaacggtactcatgaaaattgtgatacatcgctttgaacatgtcatgagagtaatttttcatgccggtcgcccggtcgcccagcaaagaatgtgtctcttacaaggtttgttgaggtgccacacaatccacattttacattcaaataaggctcgacagggaaaacgaaggacgcttaaatttgccggccaacaaaaattgaaacaactgcaggcctctgccatg

SEQ ID NO: 798 - DNA, 703 bp, Nannochloropsis_gaditana
agacatgtaacatttcattgttggcgtttgtactgtttatgctgatcgctgcattggggtgcggctgcttcgcatatgtttgcatggagttgttaagctcagtcgcttttcctggccgggaagcgagatcgagatcttcttgcccttctctctccctgctgggatgccacgagtgcatagagctgagatgttagaggcgaagaaggtgtcaacatatacaagtgcttatatcgtgacatcatcgtggtcaaggcgtgtttttaaccgccgtgtctgatatagcatagcttcgatgataactccatccccgtgaaaattgtttccgatgcattctgatagagcattatatttttacaagcgcggatgccatgcattgactatcattactatgcacagatatacgggtgtttgtaaggaggtatgctgataacggcctttgttcacaggcgtacgggcaaggctcgaagctgtacagttttctctcacacactacttccatctcacccaaactaatgccgcacacccagttcataacatggcaccagccgcccaaatcgtcacaatgttgggcgccaccttggcgttgtgcaacgccttcgtcccgcccgttccttctacttctccccggttttccaagcttgcggccccaaggcgtctagcggctgccggtgccgatggtgcttccacaaaagccccccccatg

SEQ ID NO: 799 - DNA, 703 bp, Nannochloropsis_gaditana
tcctcctggcgggagcacgatttccatcgtcttttcaaacgctgagaaaacgtctttttgagtttccagccataaaacttgcatcaacttttaatcgctagggcaaaagggcactgttcaatttcaagtttcgaacagcaaagggcttgattgttttggggtagtatcacagccccagttggctttctgaagcacgcgcagctgactgcaccggcactttaaaccacaggtacacgcaaagctgtacatgttcaagcctcaaaactccacgggctcgtccttctcttcctctccaatcctaaccaatgctacgggactgcggagggctaaaagtaatcactctttttcaactactgggtgcacggcctcaggaattaacgccataggtgggagcagtgcgcggggtggttggtacctcgaagacgacgaggaagacggatttgaagagaggcgagaaaggtcgaattcgttcggtgcggggggaagttgcagtgttgttcgctcgaattctcttccgttccaaaaaacgaagagcaactcttctttagccatgatgtcgctgactggcagtcttactcgcatcgggagcaactctggcagcaacagcagccttttgcgctctcttcattcctcctcgcggcgatggacgtcactgatccgcagtatggagcatctgtgggacagggagggagggccggggatg

SEQ ID NO: 800 - DNA, 703 bp, Nannochloropsis_gaditana
ctgagtccattcttgctccctccctcccttcctccatccttttttctcacacaccctctcttcctttccttcatcccttgccaggcacgactacatgtcgtggataagatccattgtgccgctttgtttacttctcctcctttgcacgccaaccctccactccgccttcgtactaaacggtcgaccatgtgtacggcgcctcagtaactcggtttcacattcaaagccaatcggtgactctatattcccactgaaggccacaatccctcccaatgatgacgctggctctttcaaaaagaattccggctcgagggaagacggagttgacttctcaagcgcatccggtcgcgacgtcgacctctctgtcggcgtgtggcctcgggaaaaccggcaattgctaggattgctggggggtttaggttttctggaaacagcatacttgacgtaccaaaagctaacaaccgatgacttgacctctctatgcacctccgtagcggggttaagcatgaggtgtggcgatgtgttgaattcggagtacgcgagctttttaggagtgcctcttacattgcctggggcggtggcttacgggactgtgacagcgttggccttatggccgatccttgccgggaacgagggaagccgagagcgtgcagaggcggacctcaacagccgagccccattgttaacggtcacgacgggcatg

SEQ ID NO: 801 - DNA, 703 bp, Nannochloropsis_gaditana
ttcttcggcgccatgaaataaatacctgtaggtattcgttgacctcccggccttcaggagcgccacactttcgatcgagcgcaaggctatctggagaggtcggtgctatcgtttctgtacgtcacacttgattcgtctcggcggtatgagtgttcctccagcaaattgaggggaggtgaccgaccgaaagcagggacgcgtcagcttttctccttccacaaccggcagtcgcgttcctacctgcagaaattttgtttcaataaaattgtatacaagtgcatggtttggaaggcgaccgataacctcaacaaggcagggacagccttatctgccgatagtctgcaacgagaactaccatggtaatcggataggaagagccgtgaaaatgcctgcattccagaaatgaggacaccattcaattatttctgtacactatcaactaaaataatgcctaacatcgtcgaaatcaccgtcggtgggtattaggtcacttcctgtggaaagcaacgcggacatgtcttggcgcgggcgggagcgtgaaggagagcgcgcgtgagccctcgctcaagccacgaaaacggcccatatcgtccctttttgggagccttcgttttccccgtggcacgtttttgggaggagtgttccttatgacttgccatctttcatgccataagagggcgatttttgcaaagggcttatgatg

SEQ ID NO: 802 - DNA, 703 bp, Nannochloropsis_gaditana
ctgtttttgcttaccgtatagaagtttttcgtctgtttagaacgatcagcacggcggagatggtcagccatctattcaatctggttgaaaatgaaagctgcggcgccctcgactgtatcgttgttggaaaagcgcatctgagggtgagtccttcaacgtagatcgggactttatgtcgatccccgttgaaaacgtgtacgtattaaaaattcgtgattcatcttgatttgattgcatacttttacgatgccgcatcgtagccagacacagtgtttctcatcaataggaacgaagcttaactatgcatgggcctacctaattcctccctgtcctcctcaaagaatactagaggacatacctactctttcaaataaattatccacgaacacaactcgagcctctacccataaagttaaggaacgcataaaacacacgtgcgcgtctccacaaacacagtgatttggcctgcggattaagcctaaacggccatccgccagtaacggtcaggccttaaccgatctcgtcatgactgctttctctgtcccagaactcacatgccgctttaccacaagctcgacacgagaaggccaaaacgtgcgccacaaagcgatgctcatggtttccaaaattattttgcaccacagccagccggaggttactgcttatcttctcccgaatagccccctcggcgaggtgcttcatg

SEQ ID NO: 803 - DNA, 703 bp, Nannochloropsis_gaditana
gtattacaacatctcctacctcaagttttggaaaagaccatgaaaaaaatgagttgggcttcgtgcttatacattcttcatctcttgtgtttgacgaagaatctagactgatttcctctgctgcggtgtttgggctgacttttgctttgaaatccctgctccccgctgctccgggtgtaacttgactgaagccggaaattctcgtactacctcgtctcagaaccataaatgccaccattgataccgttaacgcgaaccaatatgctggtgagagagcataactgagcaaccttctgttgccgttgcatattcggttgcgattgcttccacttcccactgatgacgggtctccgggagcgggatgcttgggattatcgtctggtctccctgtgttcttcttgcgtttccctccccgcctcttctttgtactcccatttgaagttgaaggtgcttgagtaactgtcccgtcagacgacgtcggcatggcgctgtgtttgcgtgtgggggtggtgcatctcttaaacgcgagaggtcggacggcaacgcgtccatatgggccacgatccttatccccccctcgctgacgacctcctccctccagccacagatcttaccttgctcttcacgcacccaacatgcaccgcattttcatgcctcttcgtttttatacactcgcaacactcgatcaggtcgtctactaatg

SEQ ID NO: 804 - DNA, 703 bp, Nannochloropsis_gaditana
aactttggagcccaggacattgctgcctgcaaggcatagggcgcaccaggcgcatgtaaatactgtccgccgcgcccgttcctccagcgagtgatggtgacaatccacgtcctccttatcgcggccatcaaataggacctcggcttgtgtcgacgagggaagcggcgccgcggaaggtcccagggagtaggaggtaggagcgccgccatcggcagcccaccgccctcgcaggtctcggtgcctcatggtcgtcgggagaaaaccaaggacatgaacccaggcattcctgtgtaagttggtcgtgaagaatgtttcaggcaagagtgatgatgcatccaaggcgtcccggtgcattccgctttgtagtaaatgcgagtctctcccagcataattctgcgtttcacacccctccgtccggtcacgtcaaatacaacatctcgccgatctccttgcggccgtgccaccgccaattacctcgttcaacaaggcctttccttgcatgcaaaatgccgaaatgttgattatgtggataaggttgtacgggggcatttttcctgctagactatgttccttaatccacaagccaagcttctgttgaagacaaaatgccttaataatcttatgcccatgcgatgataaggtttcgagcaagcggaacacgtttgtcgctcacatccagttgcacacttcccttccattcagg

SEQ ID NO: 805 - DNA, 703 bp, Nannochloropsis_gaditana
acctgcactacagcttcggcgacaaaggtggggaggcggtggaggccgagcaggtggaactcccccacctgaccttcccgctctcccgaggcatggaccggctggtcgtgaccccggcggggcaggaaccccctccgctggggaaggagttcaacgagccggacgagacgcgagtcccgcggcgaggggggaaagggaaagagcccgagtttgtgctggggccaatctactccatgtctttccactccatgtacctggatttctcccagtggcagctggtcaacatcgcggggcagaagtccatcgacctgggcgggtacttcggggacgcctcggtccacattgtcgtctacgacctgcacaattccgtggcggccagtccggggggcgcgcatcggcggtgcgacaagcggtatttctatcactgcgagctggtggcggctggcggcgaagcggggctgggagaggaagacacagacaggctgagcgcgaccgaggctgggatgagcagcagcggcctccatggatctgtcttccctggtcactcgccgggtgctcgcccgagccgcgtgcgctccagaagcagcgacgggggcggggaaggaggacgaaaggagaaagtgggcagtgttgtgggcgcagggggggatggtgtggagatggacgggctggcaagtaccttggacgcgggtcgtgacgggtt

SEQ ID NO: 806 - DNA, 703 bp, Nannochloropsis_gaditana
tcttgaagggctcttttttccgagaagccgtgttataaagctgaaaaggaatatcatttgtcaaaaaatttcttgatcttgcggtagatccggatgcagaaatggagctcatgctgaagactgtacgcaatcgagcctgcctgaggatatatagtccatatacgggcaagcatcaagatcgagtcaagccgagccgcccccagctacaattatcttctgatatctacgacagaaacatcacagaattcgtacctacggcagcgtcctatttgagtcgatgatggccgttttgaaggaggtacaaatccatgaacaattttcataagggcgaccaagcagatgataatcgagatagaccaaggcatcaggcggcggggaggctcatggcgactcagccccaccacaagacttggtccgcatggcattttcgttcaatgcgcgggaaactcgtgcgctggagtagcaacagtcctctaatctcctttcctgtgtgtaggtgccgtagaagctgtgagctatcgtaatgatcgtctaaggtcttggaacttttcccctacctcgatgcgcattgcttgttgaagtgcgcgacgtcgattgagcggagggggaggcgattcctgcctcttaggggcattttatagccttaaagcgcatcaacttacgtgtacaccatcatttaccaatgtagatcaacaagagcatg

SEQ ID NO: 807 - DNA, 703 bp, Nannochloropsis_gaditana
ttcgatgttgaaggcgcatggggcggcactgccgccattgtcctgggtgatctctcgatatccgtatgcagcgtacacgtccaggaacgctgctttgctcaaacgagctgcactcggatgaatagaggtcactgaaggatctgggatggcagccatttcctgttttttgtcatcccatgtgctgcgatttataagcgacgcatgtgtggggtgatgttgcctgtgatgcatgtacagaacgatgatacaatttgaggaaaggaaacactcgtcacaggtatggaaaccaattttcccctttaaatttcgtcctcgattacgaagagtcaaaaatgacccgcgttgaatttgcgaaccaagaatggggggctgcctgacttgctgcctcgtgctctccctctcgctgcctcgcgcgaagtctcgcgttcgattatgtcaccatgttcctggaacccctcaataccctctgcctttgctcatgcccagcactaagagagggagccttttgcaatcaagctggcctgtgggccgcgggcgtggcggaggaatatcacgaggaaaaggcgagacgcagcttaggagggcgtgacggctacctccggtcttgttccaccttccttggcaccgctttccctctcctttcctcttcaacaaagcacggcctcctcctccgttgtcacgacggaaccacgcagcacgtatg

SEQ ID NO: 808 - DNA, 703 bp, Nannochloropsis_gaditana
tcctctgcctcacgagtacgaagttcttcctgctgtgtacgttctgccattcccatttgctttcgcacggcagctaaaattgtttcttcaactttactggccgtggcacccgtgtagaaatctgtcttgcgacgcaaaaaggacaggaagacctctagaaggccatcgatgccttggcactgctgcgcaatgtttaaaagtaatggatcaaaacggccatcttccgtccccatagttttcttttccacgtatgtgtgtctgtgcatgggtggaatgtacgcgaccgagaagtgaaagacttgagatgaggaagcaaaaaaggtgtatcccgagcctcgccatttgttccatgcacgcgatgcagtgaggggtggctcaacacactttcactccatttcttgcagctgccgcccacaaaaagcgcactatctgatacttcacgtcttgccttctcgacctagaattgacgttccgcacgaaatcaatagaaatgactctatgtgcaagacttttaaagggggtgaaatatggctgctgttgccctctcgatctacaagaaacacaacaatctgaacagagtatgattctgccctctaactagcagatgcatgtatcatctctgcacgagtgcaccagcactaacttatcgatgtgcatccatccctgattttcttgttattgaccttgcacaggagagatcatg

SEQ ID NO: 809 - DNA, 703 bp, Nannochloropsis_gaditana
tcaagttatttgtaaagagatatttgtataccagcatggtacctgggcggaacactgaatggtcttgcttagacaattgcaagtgggtaacgggggaggttaaatatgaaatcaaggacacaacgagctgagtgtgaattcgataatgaacgcctgcgacaggtgtcgatctctttcgttttagactagcaagtgaagcactgggcaagagtcaaggcggtacgaactcgcagggacgctcgaggggggccttgtgtcgacaaggcgctgtgacggtttctttggcgtgtacggttgtttttcttcttgagcgaggaggcgaggcaaacccgccgtcagggccttggacaacaggaagtctgggatttttcagggtggaaaggacaagtcgtttcttaaagacatggcatgttttgatcttgactgtgtgggacgtatgcttggtgagtgatgccggaattggaagaagcacgctggcctccttacctttcttcaaatcgaggaagaacaacgacctctatggagcgccccaccttttttcatagtagtatgctaaataagcagagtttggaacgacgtgacatagttccacgagaaatggcatgtgcgattagttttttgggggttcatcgcactgatccaccctcctgcccacggcttatctatttccctgcagcgtcaagaagacaaatattcaacaatg

SEQ ID NO: 810 - DNA, 703 bp, Nannochloropsis_gaditana
accatccctttcagtgcacgccataggtgatgaggggtggaggagcagcaaccgttgatatgataccggccgcgccagaaatgaaggctccgctccaggcccacctacaacagatgagtggcagtagagtcagtctcacgaaaaattcagcaaaagattgttaggattttcgcagtgcgaaagtaaaacagaggatgtgcgagtgcaaacgtttacctttcgggctccaaatcctgcctcgctttcctctcccactcgcgcaatcccttccacttgatccgttccacgcaaacgaaatatccccaaatgtcagcctacaggcgactcgcgaacaggcgtcggaaagtaaagagactttctgacatggccctcctgcgatgctcacgtttttgtttctcggtacagcatggtgtgggaccaacgagagagatattgttggctagctcgtgaatatcaccggcaatcttttgcttgctttacaatgaagtctccaagctagggaggttgtttggtatgtcctttctggctcacccgccatcttcacgtatgtcgctctttctcttcgtgatctatctgacctggtacgacattgtcaaggtagtaatcctcacatggctgaaattcatgcttgcactcatttcgcaccatattctgctcactacagagacgtggtagcatagctttacgcctattttgaagaatg

SEQ ID NO: 811 - DNA, 703 bp, Nannochloropsis_gaditana
ggtgcgggcctaaccgcgaggtgagggtgggaaccgcaaggcggtatgcttattgtaaatgtagcccacctgtacggtatcgatgggaacattatgagtttcctacaccatcagaaatgagtgattcaacgcggcaaacatcagccaccttctcagtcctagcagatcgtaaaccgtgcttcaaacttcgaaagtctaaaggacgtgtacaccattaaaccgcgcgtacaaaatcccagcatgatgcactggcgtccatcatccctcttccgtggagtttcagatccttgctttcgagtgcacagcgagctgcgcatggtgttgaggggcgggcggcctagctggtagtgacgacacaagctctcggttcccgcaagactcaccaaaaacatttccgtttcgcaaaatgtgccggtcgatacgtgaaaacccgcatcacacacccgtgggcacccacagacaaatgcgccatcggaaatttgccacctttatggactcagaggcggtctcgacgggaaaccattccaccttcgcgcttccgcctccgatttgtgttcctgagcgtgaagtgatgcgtgcctccccatggaggccacgcgccgcgtgacaaacagtctgctccaagacattcatttcatttttagttttcgaacattcacagcttttgttcgatatacagcacatacagactcttcacaccatg

SEQ ID NO: 812 - DNA, 703 bp, Nannochloropsis_gaditana
gtgaggtactgatgtcattcaaaggttcaagaaaaggccttttgctggtggtgctggcacgaaagtcgcaattacttcccaaattgcgattatattcgacccattggtcgccgataccagtatcatgtaaaagtgagtgatgactatgttttaaaggcgagacgcccggaacgtctggtgcgacacgaatagaatccgagggcagcgaattacgtggcttgtcattgctaacggcatcattttcctcttcatctgtcataatactgcatggatagaaagtggaatgagaatgcggccaccaggatgcaccacactcctgtcttcccctctccgcgtcgagtggtagcgctcaggttgaagttttaaacggtcgagcggttgaaaggatgagaagatacgccccccacattgacttgaggctccgcatcttgggagcttacccctcacctgccgcccttgctctgcgacaagcgtttcattatgcattcgtctgttcctcatccctttttgccctcgcttgcatgattcatgctgtcgtatatggctgcaatgatattattattacaagatttacgtctggattgcacacaaacttccgtgtcgaagtttctagtgcctacacttaccatctcctaccttgtattccccttatctccgctccgatttgtacatcaactttcagacatccacactgtcaaatatg

SEQ ID NO: 813 - DNA, 703 bp, Nannochloropsis_gaditana
taccgcgcccgcggaggaggcctcgacatccttcatcatttccttcagcttctcctcttcctgacggatcttctcttgctgccgctgaagctccgctgccaaatgctctggatcatcgtgcgtggctgcgcctgtaccgtcgtcttgaccctcattgtcgccttctctctgctcgtcttcaccggggactgcaccgtccatcccggggtcctcctcctcctcgtagtattcttcttcctcctcccctccgccttgttcctcgaccccagcggccaactgtgcctcggcgctcatggtgcagatttgaatgttgcgctggtaagcctgtcatgtgcacaagagagtttaactaagattaaatgggaaaaaataggttctcgtagatgcttccttggttgcgtgcaaaagctactgcccccgcccgtctgggagaaccacacagccccactgaccgcaggcgcgtgcctgcaaagcaaacaccacacccacaagaaccgagaagcgcgctgtagtggattgaaaaagatgggacaggctggatatggccccgtgacaaactatgtgaccggagctatccattcctcgggccctccttccaaccctgagcccctcctctcgcctggacctcacggcataaggaacagtcatcttcaactttagacaacttaccccccacattccacgtccactacatacgtctcag

SEQ ID NO: 814 - DNA, 703 bp, Nannochloropsis_gaditana
acgccacgtcacaaatctcaatgccaatgcccacacacgcgcacgccactcagtcagtcgcaacacgctctcacctgctgctgatgggagacagtgtaggaggaagaaacaagcgatggtcgcacgagcgggttgcggcgtgttgctgtcggtacaaatgccatcgttgaaggaagactgcttaccagggccaagatgagcaccagctcagaggccgtagccaaccaacagcgcatattcacgacctctgatggcaatgcaaataacagcgaggagattcgtgcctgaagggtttcaaagaggcgtaagaaaggtgcgtgtggcatcactgagagcgtgggagcagccaagacagaaggcgaggcttgatagcacgcgtggatacttgtgcttgcgctggcttgttgactccgcgactctggaacccgtgctgcaagcattacatctcagggttttatgaaatttgagactcggtgtctgaccatttcactcaatcgtgaatgaaatctcacgggtccggggatccggagaattattggtgtcacacaagagcgcaagctgcaacctcactggcaacagccagaggcgatggaatgccctcggtcccagcgatgtgtggagcctatttccaacgattacattggttgttgtttcactttgagactcacttacgccgatgtctacacatgtgaactatcgcaca

SEQ ID NO: 815 - DNA, 703 bp, Nannochloropsis_gaditana
gccgtctttcccgaaccggtttccgcacatcccatcacgtccctcccttgcaaaatggaaggaatgcactgttcttgcaccggtgtcgggcgtttaaagcccatagcattacatgctccttggatccaaggggccagtcccagttgtgtccaacagcttgacgacaatgagtccgagcccgcgtccacgcccgcctcctgcactgactctcgtcctacgcctttaagctgggagccccccaccgcaggcgccgtgccaaccttagcttcctcctccactactgaccggggccgctttttgcttgcttttctaagtaccttcgaggaagtcgcgaatagtgataccatggttgccaagcaccggaagatgctcgatccaggggccctcactcctcgagtagcactaggattgtagcggtgtaccctgtgacctggcctgttgggcttgaaggcattacagactaatgtcaaaatgcttgtcttcaatggcactttacctgattacacacaatcagtaaaaatgtcgctggaaacaaacaaacgtagcgctagaggagaggttaaggcagtatcaaccaacctcctcctcgtgtggcaggcctcggtagaccgtgacgccgtacccagtctaaccacgaccagcgttatttcactcctcttgccatttacatactttcttcgcagcgatatcagacagatggctt

SEQ ID NO: 816 - DNA, 703 bp, Nannochloropsis_gaditana
aaaaaattggcataatgattgtttataaaaaagttcatgaccgcgtcttagaacgaaaagtttagaacgatttgttttactgtttttgccctgtcgccgcattaagctacccgggagtttcgcgcaaaaaaccaataaagcagcaaggcgggcaggcaaagccaaacgcctcgcatcacaggtgcgcacatgctatgaatgcaccaggccgctccatttcacgtccgtgtcactatcaggctctaaacacttcttgcgatcaatttcataaaatcatgactcggaggatcgcgggagaagtgaagaaagcgcaaggccaaggaatgcacagcgtaacattcagcggccatgcacgtcgtttccttcgcaaaatcagtatgaaaacggtgctgcacccctagaacgcttacgcttgcatttttacagacagatgaatggtcatagatgcaaggttagagccagttcgtttgcttgctccgttgtcgcacaacgtgacgcttcgaaaaccggtatataaccaggccttgctaggcaattgtttgctggggcaaacgttaatcggtgtacaactttacgtataaaacattgtttacccttaattgttttaaaatgaatgtcagccgaaacgcatttatttaattccactccttctatgccctattcccaggcccaaccttgctcaaggccagacgagctcaagatg

SEQ ID NO: 817 - DNA, 703 bp, Nannochloropsis_gaditana
agcacgcacaggaaagaaaaatccaggagcacgggctcgccacactaggagccatggctttgcggagtccggacaactgccgccacctatttggaatgggcgccgtgtcggtaatcttggaggccctggaacggcatccagaggcccgtgcaatacagcgtcaaggctgtttggctgtgcggaacatggtcagccgtgtccctgagctaggggaggctttcctcgaggcgggcgcagagcccttattgcggttagcgggacgataccaggaaagcgtcgatgaagcgtacgctgctttgcgagacctgaagtgtgacgtgaaacgtgtgatcgtggatcccttgacgggcgaaatcaaggctccagaagagttcggcagcgccaaaacttccttccggccactttttgatagcagcaacgacatcgaaggggcggtgcaagccgcaatcaatgcccctagtaattcctatcgtttttaaacgcgaaaataagtaaaaaatcactacctacaatgtccatcgcaccgccgcacgcgtggtctcgcatggccttgttttggatgctgggtcactgtgatggagggcaatccagcgcgtcttgttcgccgaccgtctggactcggtgcgattgtcacgtcctatttcacctgtttcacttgccccgcacaagcaaatctgcccctaacttttattcccttcctcag

SEQ ID NO: 818 - DNA, 703 bp, Nannochloropsis_gaditana
cctcccgaggccaaatagcggcccgatggggaatattgcacagaatgtacgggtcctttatgacccgggtaccggaaagcgcgctgttcgggcttgaagtgccagacatggacagtgccgtcctcaacacctgaagcgagctgcttgatcgtgggactgaacgcgaggctcaagacaccagctctatgaccacggaaagttcgctccaactctggtgtcacgagttcatcggcatctagcagggaggaggacgttataaccatgatccttcaacctgtgttgtgaatgtcgatgggaccgaaacgtcaaattttgcaacttagaagaacgctcgccgaggcgacgctcgaaaagtaagcgaggccccccgtgacaatgcttacacggacccccccaaaaaaaggacaacctatatttcttcggcacggccactcaattcatcagaggctcgtcccacacgcaggtgtgccagcgccgcttgcattggcttggaggaaaaaagaaggggaggggcagcctataaaatttatggcatacagggataccagcacttccgcaagcttgtgctgaactttgtacacaagtcaaaaagctccgacaccagaccaggaaatagaaaacaaggaagaagatatgtattcagcatccggcacaatttatctactaaaatttcgataggtcgaagcaaagttcaagataaatg

SEQ ID NO: 819 - DNA, 703 bp, Nannochloropsis_gaditana
tcttgagacggacgatgatgctgatgccctcaacggccaccaggtcaacctccccagtaatgcccacagcttggttctccttggtgtacccaaacatggtaccaagctcttgccgagcggcctccagaaccaaagctgcattctcctcagtaagaatgagaggctcgtcgaaattgctcgtgctcatgaacatgtagggcgtcagtctcattgtagagcccacgagggagatggcggtgggctttgcagggaagtaagttgcagagcgggacgcgcgtgccggcacagggatgaaacttttggtaactgcacacaacattgcccctagtacgagaaagagcgatgtcgtcgttgaacgaagcattggaagatattgaggccgctgcgtcctttgatgctgcaacgagaagcctgggcttgaggtgtaggagaggggtgatgcgcgaatacgtgagctgatcgaaacgggtatcgcacgagacacaagcgaataatgtgacatttttctcatttacagactcgtcctcattcggtcgcggaggtttgttgggcgtgaagaattgatatccaggaacacccccctcgctgctcgcctccccggggcgactccgtaacctcctgtccgttttccagattgaaattatcatgtgcgtacatcacagatcaggactaaattgcgaagatcttacaaagcggaaaaatg

SEQ ID NO: 820 - DNA, 703 bp, Nannochloropsis_gaditana
tgtgaagcttgccatgacaaatatgtaaggcgtatgttccttaactattctcttctggccgaggatgttgacacacacttctgaatacattttctttttcttctgaccaatctgatagctttgggagctggtttatttgccatatcgctggtcgccgggccgtcacgtcaaattcagctttacgtgcctccagtgacagcgttgctttgcgggtacgccgccttacctcacggggggttgggacaacggatagtcttagggactatgggggctttgagtgccggggcctttggcttccaccatctacgacgacgtcatccgatatgtcctgcactgtctcagggggaagaagagctggcactgattactggcgccagcagcgggatagggcgggagataagcttggagctagcgagaagaggcttcggtgtcattcttgtcgcccgtcgggcagataaactgcaggagttggcgtcagatattcgagcactgctggctgaccggaaaagtatggtccccattcacatcgtgccggcggatctaagttgtcccgaggcagcccggcgtgtgtacgagagcgtagtgcgcgaaaagggcttgcaggtgagcgccttggtcaacaacgccggggtggggtacaccgactcctttctaaagatgcccacggcgaagatcgaggaaatcgtccatttgaatgcattat

SEQ ID NO: 821 - DNA, 703 bp, Nannochloropsis_gaditana
cccccaaaaaaggcgagcgcacgcatcagcaacctggagcagtaagtcaggatggtgtagaaaaaagcggacccgaatcatcgtcatgatggatgttattttaattagttgtgaaccaggagtgagcgagggcagggggtgcacttgatccccgtgttccttgcccctggtaggatgagggaagacgcgagggcagaagtggtagaagtggatccaaaacgagagggagaaggccacacatatagtagctgaacctttgttccgcttcctctagacacgttgggtgtactgggcgccgtgtgcacgtgccccaatgcctgtgcggggtcgaccgcgtggccaaggcagtgtgtggttgaagctgttgcagagggcaagatacgcttgaggaaaaggcgctggtggcaaaattaatccgcagtaggcgaagaggaggagaggatgctttccgcctcccgtcactcgttggtggcctcttttctcttgtggccttgcctcctctcttcctcctcctgtgtgcgttatggcaccgtgtcctttttctctttaattcactaccacccacttcgaaagcgatgcgtcctcaccaacaattactcggggcactcccgtgcaagacgccttcctcgcattgcgggaagctctccgtggttgctcgcacaaaatcctcaccctttctcttgcttcctttcccgtaaaatgg

SEQ ID NO: 822 - DNA, 703 bp, Nannochloropsis_gaditana
agccttcgtgtcctccttcaccctggccattcaacacgaactcgagcctggaggcgtctcggtgacgaacctgctgcccggtgcgaccttcaccgagttccaggcgcgcgcccacgcccaggccgcggccgctttctccgtcccggggctggctatgcctgccgatcgggtggcgcgtgagggcgtgacggggatgctgcgaggggacagcgtcgtagtcccgggcctggtgaaccaggccttcgtgttggccacggctgttgtgccgccgaagctcctgcgtttggtgacgtcgctggcttggagtgaggtccctatatgactgggcacgactggcgatattgcgaggtgtgcagtgagacgaagcattggtacctgctctcaagcctgcgaaacgtctggtggactctcccattgcataggacgggtcaagtcctgatgtggtcaatagaaatcagcgttctggatggatcgccttcatgtttgtctcatgtcgtccttccggaaactgcaccgttgctttcagtcggtgaaatgttgtaatacaatctcatatgcaggtaccatcaggcaaatttgaaaagagttttgcgaatcgtaggcgacctatatttgggtcgctgcatcgcctgagcgtttgtattgacgaaagatttaaccagtgcaatttaagatatcggcatcgctacttttttactaaaat

SEQ ID NO: 823 - DNA, 703 bp, Nannochloropsis_gaditana
ctactcgcgacttaattcggtagcatgatagactcaacgttaatcatacatagcgaacgcaatatatgtgatggcactgcctgcgttgccatcctacccaggccaaacacattggagagcagctcggagacccctctcgtgcgcccacttggtaccctaacctcctcctgtcgaagatgaagcggctttgtcaatggtctgccatcaagctgtccaagtcgactcccgaaaatctcatagaggagaacctgcatgtgccaacgcatacagaactgactttagccgcaagtgatccgggattgcccccccttcctcctgggttgcagggtcgagccctggcggctgtccacgagggcgttttacggctgggcatgaggattgtggcagagccactgtcgcccgaccaatggaacctgcttattcggcttctgtctgagtcagagggggggaaagttcagcgctactatcacgataaagatcgccgactggctctaggcagcattctacttcaacgggcagccacgagctgggtgctcggcaagcggttcagtgacataaacatcgaacgcactagaacttacaataaaccatatgttaacgcaaaggactcccgactcccccagtggaactataatgtatcgcatcatggagattgggtggtgctggccagcgagccgtttcacgccgtcgggaccgacctcgt

SEQ ID NO: 824 - DNA, 703 bp, Nannochloropsis_gaditana
ctcgcaacaagcaaaggcgccctttaaggaagtcttgttatcctgtataaatgaaaagagcccgtgatgtgcgttaccaaagaaaagtagggcaggatacagtgaacagcatgaagtcatgggagattgagggagaagcaatgggggcgggtggttgccgacgcctctcgaggaagctcagcacatttagagcatttcgtgcaagtcaatcagtgcccaatgcagtatttgagcgcatagatgacatccgcttccatttgtagctcgtcaaacaatgaatcaacccagtttcctccagacccagggcgaggaagcaggctgggctgtgtggcagagagcctccggtgctctccacccaaacgtgctcccggcgccacatgcccccctgacagtctaccctggcgagcgtctcaacgcgccacttctgctcccactccacgttccgtgttctgtcgcgggtcgtagcgcttgcgattgcacgctggggtacgtttttaagggtactatgtgattgccagtgcgattttgttatcaacctagcactagccatgagctaggtggttaaatgatcgcgccaacttaaacttttgagtgcaacaagttgcatcgtactttgcagattgatgcattagaagtatgtccatctcacaggtaaagcagccacaagggtagcattacgacgtcttgggtgtatcccggcatg

SEQ ID NO: 825 - DNA, 703 bp, Nannochloropsis_gaditana
tttattgttgccgctgttttcatttatgagtgaagacattatacaattctgcaatacagatcataagggacgtgtgactgagggacaacaatcgccataattgcggaaatgtgctggctggagaaaaatgcagtggatactttacaggcgaggaatggtgtagaacatgccaagggtctttcgcttgcgcggagcaagctatccatgccctcgaatggtcaactcgttctgagctcgcctatgcagcatcgcagcttcctagcgattgtggtcatgaacatgcgttttcttgtagcgattgtggtcatgaatatgggttttcttggtttctgccatgtcaccgccatgtccattttatagcgcgccggtcaaaagttatgagatgggaacgtattgattgacagcgccaactgaaaaaaaacacggcatcgtctttatatttcctatataaaacaaatgaaagccatgtactggacgtgcgagggtagaggcgggatttcggctcaatcgcccttttccccgacgacgaagacgcgtcaagcatatttgcggctcagcgatgctcagcactgtccagcactgtctcacgcaaacggcatatgaaaagccggggtcagtcaacgatttgcctgcggaatatcatgctttagtattcaaaataaattttattaattactctatcatatgttgtccctttggtagg

SEQ ID NO: 826 - DNA, 703 bp, Nannochloropsis_gaditana
ggaaatgtccactctctccatgagcgaagttacttccacagaggaactatccccattgatactcagcgtctccactgtcgtgtgtgaatctacagtagctacttggtctccggcacaccaagcttgttgcacgtggcatgtggaatgcctgtggctcgtggccgtgtcggacctggcgggcggctgctccctcgggacttgggccgtcgcctccgaggacgtctctggtgccatatccagagcgtgcgggctgaggcgtggaataaagtagttgaaaagacgttgagatagaagcttcgctatgctcgagtaccacggatgcaacccaacaaggggtcgtggtgactttcaggggggaatgccagaaaagggcctgacaggggcggcgtcctcacgacccggcgaagggcgacccgggggctggcctgcggaaacaagtcgttgaagaacgcacaattttcattcgcgtcttgagtccctcccctaatgttgcacatttttccattcaacgcatcgcagccattccaatctcatcaaatgtcaactactgccacatcccgctttttttgacagatatacccccccggcccactgcctggcttcagaatgatgctcgtagtttgcaaacacgtgcaccaaagttaagaagaggagagggcagtcgagctcagttgtcgaaaagaacaattggacagcagcgatg

SEQ ID NO: 827 - DNA, 703 bp, Nannochloropsis_gaditana
cgaatttccgccgtactttccattcaatcgttggcacagcacaatgcttgcctacccggatttatcatccaggggtcgtggccagcaccatacatcaccttatcaccacgacacgtttatatgcgaggcgagtaaatcaaatgcaaggaatggtgagctttataaatcgaaaaatggtctgcgaaaaaaggtctttctttcaagtcactgagatcctctcgcaaaggcgagcgtgggcccatccataccgggccacatggccctacccttcgtccccatccccccgagccgccattgccccatccgcctccaggctcccgtacccccaccccacatgttggtacggcattttacgattgtgatcgcaagtgcagcactgatatcttgtgcagtcacccagacaattttccagtgggtgacattatatcgcccacatcccgatttgttttcggtttccccttttcctgcttctgaaaacagtcatcatgcatgtaatacgtttcctttctcttgaggttgattatacttgcaattataatatttggaatcccgacttttttaaattggtcggcatagcgcgcacagcgcgcttacgcatcatgaataatcgtagcaatctttgaattcttgtctcttcgagttacgcaggcatatcgaatactaattgaacgtattcccgaatttcgtggttgtcaaatcgatg

SEQ ID NO: 828 - DNA, 703 bp, Nannochloropsis_gaditana
cacttgcccctcagattaccggtagcgcgccattcatgggtaatcattttaaaatgtatcaatctccgatcccagcccaacgttggacttaccagcaggagcgtgcacgatgacttcctccgtggcgggatcaacaacaggcagccgtaagggcgcctcaacaaattttccaccaatgtaaagcttgagctgcaggttgttgatgtccacgagattggcggaggacatatttttcgggcgtactggtagttggcacagcgactgttgaggtcagcaaagagcaaagattatttggctggtaagaggatattttttggtatgacaacacgagtcgtcccggatggagacaagagcacatgatcccaccggatgaagttgttgtgacgtaaatttatggtttctctttagaatccatgacacgagaattcgagaggtagtatctcgacgagcgagcgacgggagcgaggagatgcaagcaagaagaggcgagaagttacccccccaagcgcaagggctcgacaattaccgtccgtgagtgatgaaccctcaaatatacacactccaaagcaacataggccatggacatgcgagcggaggatcaggtaacattccagtgtgaacgggctcctgcctaggttccataagtaccactcgtgcgccggagctcacatcacctcttgttggtctctgtcagcaacagatg

SEQ ID NO: 829 - DNA, 703 bp, Nannochloropsis_gaditana
taatacccacattctatgcctttgaagctcaatcatcttctaattacttggtcaggtgtcatccatctcgccactcacggtcccagccgtagcctggcccgctgccactgatgcttgtgggacatacgtttgccgaaggttggccatattctggtcttcctatactttgacattgaagctttggttgtttttaaacagcaagaaggcggaacgaattaagaagaataaggcgcgcgaaaaggtcaagaagcgttcgtgctcttccctcaatttttgggcgaaaaaaggaccagtgcccacaaatagacattgttgtaatcgctagttctcctcccctgacctcagatcgcgttaattacctgcacatgctgcaaatgccgagaagtgtcgctatcgcagactcgacgtcgacatgacaggtcgagtgataatcctggccattccccgccattcggctcacgatacccggaagctacgcggtcggcgatcatcccggaggatcatgggcgatgatcccccctccgtgggaagaaaacgcgagttcactttgatggagcatcctgaagcttctcaataaacggaagtttgtacagacggctgttcaccagatacaaagacattgtgccccgcttgttcttcaggtttctcaattagttttccttccttttatgtttacatcacataccaaccacgccatccaagg

SEQ ID NO: 830 - DNA, 703 bp, Nannochloropsis_gaditana
agagctcgcagctgtcctttccgctatgttggagccactgaagaagacactcttgatgtgtggagcggatactacccgcgcacttacagggacggaacaaaattccattgctctcccggcaaacgcggcactcctcttcgtcgtggtcctcgtctagtacgggctgttgcgagcctccaaagacattggttgatggagctatcgatgaatcaccaccatcctgcatccctttcatcgatactgctccatgtgtgtggtcggctggtgtctgtgccatcccttcctgagcaccagcgcccttttcgaggtcaagggggccgactaggagggtaggtcgaggggaaacgactgcgatcgggctgccgaagcgctctcctaggaccgaaactggatcgcgtctcgtactactacgcttgggccccaagctctattgcctgaaagtcatgtttgtggattcaagaagttagaccatggcgcggcgctcgcttcacctcgtcgtcgcccgagctcgcccccgagacggcccctggaaggcgagcccgtgggcacggggcctgccgccccatcctcaggacctcgtgtcacacagcagccacgcgcaaaggacacacccttgtgtgtgatttagtacactgccatctcctttcatgtcactcccacatatacaggcgattcgctttcagtccaggtggaagtcggtatg

SEQ ID NO: 831 - DNA, 703 bp, Nannochloropsis_gaditana
ccaaggaatttcaaagccgatggaatctgtctgtgtattttcatttacgcttcagtgaaatatcttcggctgtcgatcgagccttggattcggcactagatgtcctgcggttgatgcatacagaagaaaatggcgaaaaaggcaccaatattcagatgacagatctctttagatcaggtttttatggtagcaacatgtcgggggaacggcaagatgcataccaaccaagcttctgtaatcctattttttcgactgtctggtgcactatcctgagactttgggatcctgatatctttcttctgcccttaactgcacggttttttaagcttactctgcaactcatcggtcgctttcgcctgtggtgcaaaaaagttttcgataactatcgtattggggaaacaataatggcagcaaattacgaatggggcaacaacgatacaagtaatagtcctcgcgccaatgtcgagactttagtcaacatctcttgggatgcttggattctttgtcagacgtcagctcaaaaacatattgaaagacatgttctacttggagtgcatcgagcaagtactttggaccgaatttctaccgcagcttcagcagtttcttttgaattggcggacgaaagcgctatgaagcttcaatcttctctgcaagggggcctctctgaagccttgcttccatttggggctctggtccggaaggg

SEQ ID NO: 832 - DNA, 703 bp, Nannochloropsis_gaditana
cccactaaaatggcgaaaaaaatgagatcatttccgtgagctgtgtgacacctgcaattctttttcttctttgaatgattttttattattgtctaccatttttctcaccaaagctctttcaaactgtgataggctgtcgccgcgtgttcttcgcgtcgcagaggtgatgatatggaagtttgaatcacagctctcgcccgatcctactcaaccgccctcaactgccttcaacggaaatataaattcccctacgtatctttgaggaatctctacgacgttgctgactgttgcgcattgcaacgtctctgtagtgcttagatagtgctcgtttcttatatgatgaaataaatgtcctcttttcctcgagtacaagtcgtatcttgttacttgattttttaaaggaagttcttcaaatgtgttatcacccgcccgcccgttgagtaggctccaatgcatttgtcgcgattatttggcttcgatctctcgaccagtatcggcttcatcatcttgtctgtatgaatagccatgaccttaataagccgttcaaacttcctccgtttcccttttgagaacccctgtaaaaaccatttatccgcgcaaacgaattctgctcaaccactttctcttcaaacttccctccgcacacatctcatagcaggctgctgaccagtccattgttggcttatcgaatttcagcaatatg

SEQ ID NO: 833 - DNA, 703 bp, Nannochloropsis_gaditana
tccaaccgatgggtcgctcgtttctacagctcgcaatcgaaaataaggagaagggcttccgtcttccatgccaaacttcgtcctgtgggtctaggaatcagtgcacaaactttctcaaggcaatcggggttctcagcacacacacgtaccttgaggctggactcgggcgatcgtgcaaggcatgacgacaagggtgcaaaagcccgcacggcccccaggcctccacacgcgagccccaaagctatcaagcgcttcaccatggagacaactttgatctatatctgttgaatgttgatgaaaaaccgtcggatttttaaaatcggaattgcctcaatctgacgggtgcggcgatctgagctttttctcgtcgtgggctggttgatgttgacgttgtggagaggaaattttggttcgccctacttgtaaattatgacaacaccgcgcctgtcgtcatcatacgtcatgttcttgacaacacaatctaagcaggtcataagcaggcagttgagcgtctcaaagggtccatgaggagtctgatttgtagcctcctcaaggtgggtgggagtcctcttcaggggttcggttggccctcccctcatcacattcaatccaccatccacctatttccgtcctccaggggcacaatacgcaatgccaggggacgcggttggtcgcttctggaagtttgtggtcgacgagaatg

SEQ ID NO: 834 - DNA, 703 bp, Nannochloropsis_gaditana
gttttccatgcctagcagataaacattttcattcagcagctactgtcagaagcctccaatagcatcgcttaactcaacgtccgtgaatatccccaacgaaaatgcgaaaacgtatcatgccaccattttcctcagaaaggaggtcttcagcgccatgaaggacccctaaacctcacactttgaaactggtactaacctcctcacctcggcggcccatagcagcacgcccacctaaaagaagcaaaacaactgggttgtgttgcgttcattcaagttcagaatgggaagaaggaggatacgtctcacatttgaccccctctgaagcacaggagacaaacgagtgtcagaatctgcgctgcgttgagctcgcagggcatggtcggcactctcggcctcgcccaagaatttgagcctctccgcttgctcttctcggcgagcgcaccgaacgtattcgacttctcccagtccagcctccactgtccttgtcctcgcgccctttaatgactgcagccacttcttggccttcagtatcactgctattatcttagcgtccgtgtgcgatttttttaatttcagccttcgtcagcaggaaccgcacggagtacatcacagagagcaaagaaataaagaagcattataaaagccatcctattctgccttgggccctctggcacatcaaccctccgaccatctctgaagcatg

SEQ ID NO: 835 - DNA, 703 bp, Nannochloropsis_gaditana
gagaacctcgacggaaatagagattcttatggctcaacatgtgagcaattcttttgctgagcttgcaataatttgatgactcgaacgaagctcctcaaattatgctgatctgggatactgttcaaatgaacgagtaacctgcgaacgcagaccttgactccatccgacaccgtgtacgtcgccaagcaaagatagccggcgacttcgaggtttacggcgagagcctctccgcgtgggcaacgtatcttcgcgactgcatcttctcggaaacatcgtgtctcgatgaagacacgtcaccatgtgttgatggttgcactgggcactcgttagatattgcatgattgcccgagtgaaggatccaatttgcgaggcaggtggtaggggaagacgatgctaatgcatagagagggcagcatacgctgagtcctcgacaagacccgcctttctgagaaggaacagggattcgagtacagctcttcttcataattctgagcgcatctgattttgttcacgctttgaacatctttacatggacagggaagtctcagtaatcctgtggacatgtttttcaaggacttcgggcggtccacagctggtaggaacgcgcagcaggaacgaattcggtcaatatgtttgtgctttcattccactgctccggaagacacgtgacgagctcccgtgtatctctccttccacagatctt

SEQ ID NO: 836 - DNA, 703 bp, Nannochloropsis_gaditana
ccgtgatgcactgcgtggagcctgtttattgacacggctgtgcttctcgagcgccttcaggctgccggtccccttctcctccaggcccttcctcttgacctcgtgagttcggccatccggagggggagaatgcgcttgctcgaccgggggaggcggcggaaagggaggcaagtcctcgtcatcgtcaaagtccaattcattttcatcctccttgcggccctggtaatcaccaacgtcctcctgaatgctcataagacctgtaggcaaggctgttcgctactggaggagaagggtttgatggtgctgtttgtgtgctgcctggcggagcttaggccggaaagaaccatatacaactgtgcgaccagcattttcaaaaaaaaaggtaaatgtagcgaggagttgttgagacaagcgaaaaaagtaggctagatcatccagaacagtgcgcattttgcactccccccattccgcgatcatttttcgacagatcttgacgtcctactcctgaagcttggcaacattttcactcatgcccggggcatcctcacgtgttcttcatttcacagttgactccactgcatattaacgccagcgatgcgaaagacttgaggatacttgttgcaacctatttctcaaaaaggccggtttgtaccctgcgtgcacaagagctgctgtcacgagaggcagcaagtacggcaacatg

SEQ ID NO: 837 - DNA, 703 bp, Nannochloropsis_gaditana
caagcagtgcgcaggttacaccaccaattggcagtgattccattgcctttatgaaggcgctctcatgttttcggctagtgctgggattggtggcggtgaacgcgtttcgcttcacttacaagacacgtgtggccaaagcgaaagggagtcgcatgcccgtcttctcgttcaacgagaaatctactccagggaccacccttggcaccgagagcgacagaccaagggcgcaagggagtagcggcgtgcttcggctaaaaaaattgctacaacggcggctcctgtttgtggtcgagaccttggggggcatagaccgcgcagcactctatttaacgcggcgggacttagccggggacggattagagctctttccagcggcggtcttccccgcagctgaggatgactggatgataggtcatgtgggcgccatccaaccgaagaaaaaactctaccggaacggaaacggcgccactccgcccaccttcttcctggcctcaggcgagttggctgttcgcatttgctacggagcgcagctcatcgccgtgctggttgtggacgatgaggagcaccgcaagacgaggatgaaaccgacgggggacgcgaggggcgaaactgggctccagcgttcggctgtgcgcatgcaccgcatcgaggaggtggccacgcgcgttttcgccgccgccctgaaggacacccttgtgatcga

SEQ ID NO: 838 - DNA, 703 bp, Nannochloropsis_gaditana
gccctgaaggacacccttgtgatcgatcagcgagcactcgcgctcaattcgtcctcgtccacatttgtgcgcacggaggtactgccctttatcgggaccgtgcccgatgcgtcggaggggctcctgtctgggaagcctgcggatgcttcatcgagcaacgggagcgaggccgagcaggccgatgaggcggcggccgaggcgggcgcatgggcggtaaatgcggaggcatcgacgtcctctctcctgtcctcggacgtgaccgtctcggtgggcggcgcgacaaacatcacgtttgatctgcacctgctggaggacttcaagcacattttcgacgatattcagctcagcgggctccggcttgagaacaacacgaatcttttcatcctccaggtggccgctcctgtggtggctgcattggccctggagcccctcatctccctggttgacacctattacatcggacacttcctgggttccgtgtccctgtcggcctacggcatctccgagagggtcttcgtcttcagcctttacatcctcaatttcctggctacttccacaaccccgatagtggccaatctccgagcgcagggagaggaagaggcggcccgggagctggtgggccgcttgcttttcttcgcgggcatgttcggcctggccctgatccccatcctccaggcactctcgtatccactcatcaacctgc

SEQ ID NO: 839 - DNA, 703 bp, Nannochloropsis_gaditana
atctccgagagggtcttcgtcttcagcctttacatcctcaatttcctggctacttccacaaccccgatagtggccaatctccgagcgcagggagaggaagaggcggcccgggagctggtgggccgcttgcttttcttcgcgggcatgttcggcctggccctgatccccatcctccaggcactctcgtatccactcatcaacctgctcggtgccgttcccgagaactacgccgaggcagtcgagtatttccaagtgcggagctggggaacacccgcgctcatgctggtggcggtctcgaacggggcgctccgggggtacctggatacgactactccgctcatcgtggccgccatcgccttcatagtggactactccgtcgaccccgaagtcgtgtaccctgccgatcccaagggcttgggtgccgcaggagccgcgacggtcatcgccgagtggctatctgcgggattgttcctgaccaagtttgtgagtatgaagccgcctattctccccgtcctggacctcttcccgccctgggcagagatggcacccgttgtcaaggcctcggcgcaaatctttattcgcaccgtccttcttcaagcccttttggccacgtcctgcatcgctgccgcacgcatcgggcccttggacatcgccgctcaccaagtggcgctccagctctggataccgccgtctttcctgacgg

SEQ ID NO: 840 - DNA, 703 bp, Nannochloropsis_gaditana
aaagcgtaggagacggaaaaggtaccacgtcatgtgacgtgcccttaaaaggcaacacaatcgggaatgtgggaaaggccgcaaagttttcatggtcctcataaagaaattggagctcctcgggattattcttgcacctagataggaggcaatgcgagtgagagacgtgctgtggagcccagcaacagttgtgtcatacccgatgccgacggcgtaaagcaaaaggtcccgcttgttgtacgacacttgatgtggctcgccttcatggcctaccacaaggtctggctgaaccttttcctcgtcactcatagaggcttttcaaatacagatgatggatctccgttggaaaatggatgagcagcagcccctctcagatgccgtctgcctggtttagttgcactttgaaagcccgtgaagagcagatgcgggcagcgatgacctgcatggagttaaaagttatgagtcagggagccattatgatgtagaacagtgctttttcgcctccacgccatgaaacgctcgagtcccacctgccagtgtacgagccccaggaggctcgcccattcggtgcgagatcatctatgattgacgcagcgacctgaccacctcccggggctgcggttccgctgtagcatgcatagcatatcgcaggctcacattcactcatctactgcatgccctgattcatgctttggcgaagata

SEQ ID NO: 841 - DNA, 703 bp, Nannochloropsis_gaditana
  misc_feature (1)..(694): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaggag

SEQ ID NO: 842 - DNA, 703 bp, Nannochloropsis_gaditana
gacatcaaagtcatctcttgtcgaggctagactgggtcacataatggcactcccaacatgtagcggacttcacatacctcaacacttcgccgcctaagacgttttcgcgtgtgcgtccaccgccggtccgggcagtcgtgtcccactgcggcagctgcttcatcctggtcatcataatccgcatgcgatggaaagcaggcaaacgtccttcgaagttgcagcatatgaggcgaaatccaacgtgatgtcgatttctacgttctttcgcttttgcccttgcttttcagatcctatgatgaaatgttccacagaagtataaatgggtaaaaataaatttaaaaaaagctgtgtggctgcatatggattaacctcttccaaaaaagagatgttgagggaggcttgcgtttcctgcttctacgattgccgctcatggaacagcctgccggaggcgaaggggtcgcaatccatcatggaaaagcgtcatcatctcggtcggaccgatccccacagggttgcaatccatcatatggaggcgtcatcgccggattgggcaaggtggtagttgccttcgaggcccgtgcatgggccatgggcctcagacttgctacacggtggcttccacattcacgttgagaccgcgtcattgctcactctgacagattctaggcacagtctgccacattagccctgtccatcgacaatg

SEQ ID NO: 843 - DNA, 703 bp, Nannochloropsis_gaditana
ttcaagcaaaaagtgggatttaatcagctcgaaaactaccacctcatgcctacgccagttcggggtagtcgcagggaagtttgtacaagctctcaccgcgaatgcaaagacggtacaggtctcgtctgaacacgactgcaatagctctttacgctggtgtagaaacaaaaacgtgccgcacaacccatcttcaaaaccgattccctgatcagcgtgagagtgacgatgtggggaggctggtcgaaaagcagaggagagatgaagtgccgctgctcgtgtcacgtggagtcaaaggtggccaaagtaagctgctagccgtctgtctgcatgcgttttaaaagaaaacatcgaaatctgagaaggttttccccaaatgccgggcggctcagtcagcaacgcggtctggcaccaccgcccggcatagcgggagggagacgggcctgggaggctcttcgaggcccgcccacttgactgccacgctccttcaggcgtttccggtaaatgtacatcgacctcatcactatactgcgcgattcgtctcgccccttgtaaagagggcgtggggataggagcacagaaaactcggaattactgatagtacggcagcgccccgacccgctcgacctcaacctcaatccctcagaccgcctttttcttgcatttctgcaacgctctttctaaacgcactacagttcatcttatg

SEQ ID NO: 844 - DNA, 703 bp, Nannochloropsis_gaditana
gacgagcctacataccctgcaccgcctccctcccacctaccagggtcccaaaccgagcattttgcgagatcgtaaggaatattcggtcactgaaattgaaaatggtaacatctgtgaggacgccgttaatctcctgatagaacgtaagacagggagggggtagctcagaagggggtccgccggcgtgggggggtggggaggtagaacacgtggtaccttggtttcgtggtaggtggaggcctcagggggtcccgacgaggatgccctcatcgcagggctcgtatggactgccagcctgtgccgaaagggagtggatggatgcaaactggtgttcgacggcaagtaaaattgagtagcgtggctgtcctggcgagcagcgatgaccaagccggcgtggtggctggatctctcttgtgctgccaccctttttacgtgtatacggtaacacattgcaagataaccggttcataacgtcaaaaatatattgcacaagaaaatgaaatttaacatgagagttctgacggtctaatcttctcaattttcgtcttgcctgggcggtgcatggcacgcgttatacccaccaaaagtggttcaagtaacctcatgtaccctggacgcgtctttttcaaacccttacagcttcagcaaggccatgggttggacacggagaagaatagatcactcttgttattctgttcctatg

SEQ ID NO: 845 - DNA, 703 bp, Nannochloropsis_gaditana
gacactattgtcattatctgtgctcatgaaatactggcatcggtctcgtcccccgaaagagaaggagagcgcgcgccgtcgcgctacagaggaaggaggggaagcaggttgccgacagaggtctaggcgaagaaaggcgaagctccaagccatttgaagacacacaatgaaagcaaaggccagagtctgacccagcttcatcttttgagcaccagcgcacgccctctttcttttctgttcgggttggtagagtgcagtgagtcaccttcagtccacctcctgggtccgacaacgtcgctcgcgagcctctaatccggcataatatcctccaatggcccccagttggtgcaaagggtggaaacaagcccattgaagactcagccccgcaatggacaacaccattgctgcctagatggcagcattcatttctgtctctggtctcatatctatttcggagtccgtcgctagaatctctcaacggaaacggcgacaccctcctgaagcggcagcttgcggtgagtccgcatattggctcacatacataaacccgtcaccagcttgataaacccgattatccacaggtgaagtcagtgtcgaaagtaagatcgtgtaaaatacttggcgggactaggattctggcggagaggcggctgccgcgcaactccgagtcgtcttattcctgcaagtcttcagacctctcatg

SEQ ID NO: 846 - DNA, 703 bp, Nannochloropsis_gaditana
gcgtcccgatcgttgtgcctccaatagggaaacccagcacatttgcaagagccccctggataaagtttgcgggtacatgggaattaggggggaggcttattgttgaaggttttttggaggcaagaaaaagatgcagaacatgcgaaatggctctagaaatatttacctttacgataagggcactagtgaccgcttgaggggttcttaattccgatgggctggccattatcgtcaccctaggagtgcgtccaagcaggtcgcgatgggagcatatatcgtaagattaggtatctcccgagcaaaataaaaaaagaaatctggaactagcggtagaaatctggaactagcggtttccttcatagctgcgagcgtcgtcaagtcgagaagaaaaggaaaaatcctcattcgtgggagagcgcattacatcccgagacaccaagcgcggcaggaaagggctaccgcctgaccggctgggtggccgtgctcatcgctcgagccgggagggcaacatggcccacacccataaccacggcctgtgcagacaccgcggttgcaaacatgggcactcacccatgctcacacatgtatttgactcaacgttaaattttctttgcagggctttacagggttctttaatccttcgaaaagagagaacgtggcgccgccatcccaagaaccagaacacacggccgattccgcaatg

SEQ ID NO: 847 - DNA, 703 bp, Nannochloropsis_gaditana
gtgtatcagtgtaccaacaaatccaatccattcatcggactacacaagtgaaagaataaaatcatgtattatgatatagaaaggaactcaccaagtttacattttttcaccgggaggttggttgtcggagggggccgcacgcctactaggaaggctagtagctttctctccacagcgcttttttttttcatcttgatgctggcaatggaggcaataatcaccttacccgtgggctgaactcaacagcttatatcctcatgcataacagggggaaaggaaaccgctccggtgtttccctatgcaccggacctcatcctctagctacctcgtcctcgctttacttctactactagctaccagttctgaaccgttttcttttggctggcttttttcgaggaataaactgtcgaagaaggtatgcaccttgttttcccggtctcaaagcaatcataatttcacatatgtcaacgttttttgccattttacatcacacaagtgcgttgcataaccgtactctaggttacgcatttcagagctactagtgctcatatgtattggaaatctgcacaagctatagcagaacagcctttccatcaaattatggtgggctctattgtgtttttgctatgccctctacttttgcacgtgtcaactcacgtctctacatgcttttcctttgctccatttcctttcaacctccaag

SEQ ID NO: 848 - DNA, 703 bp, Nannochloropsis_gaditana
tgagtggccctcctacgccactggcagccagattcggggtgccgtcgccctggacgacatcaacagcaatgaggacatggtcagcattcctgagccccttcttctcactccggacgtagctttgaaggaccccgacattggcaaagtcttcgaagataatctggaggacttttcagatgaggacatgctgctgatcctcctgatgcatgaacgcggcaaaggggagacatccttcttctatccctacctagccaccttgccccgcctgcccgacaccctcctgaactggaacgaagaaggcttatcctggctacaggatgagggcctaagcttggaggtcttcttgcgggagagccagctgaccgctcactacaccaggctggttgaggagaagctgaaggcgggatggccggggctgtttggtgaagccccagacgacgcgtccgacagcgagagcaagggagccgacccatattccctggagaatttcaggtttgcctggctgactatccaggcgcgggcgttcgggcgacgactgccgtactcggccctgattccgctttgcgactccttcaaccacgcgaacgtcgcggtcacgtacaggctggagccggcgtccgtcgctctgaacagagagggcgggaggcagagagaagaggatgtgcgcttggaaggacagatactatttccctgtcctgattcc

SEQ ID NO: 849 - DNA, 703 bp, Nannochloropsis_gaditana
tcgcaagccccgacgcagcgttgcccgctcacccacgctgcacctttgtacccacgctgccgaggctgctcctaccttgcgaagtaagccatagcgaagcatcctatcgtgcagttcacagtatgttgattagatcaatgatgcctgtgagaacgacaatcgcaggtatctttggacatgtggaggagaggatgcaagtctagctaagaggtctccagccggagggcggaggatggcacctgaacgtccgagaaggggcacgaagtattatgagcgctcttggaaatgtcacggagcatcttataaaaaccaaacgccctcgatacaaagagtctcggcgtggtatatcgctctggggcagtaatcctagcgacgacataaagcaggcttgcgccggctcccgttctcctccggcgagcacgcgaagaagtgagccccgcctcctctacacgtgcttcggggactatgcccgtacgaccaaccaggagactatcgaagccattcgcgtgctcacaaacctccaacttctaatgcgctcaaaccgttttccgtcgccctatcgtccaattaaattaggcggtggcgcgtcctgacctcactcgaagacggcgaattcaaagcactcctagttcagtcacgacgtctctcctaggctgtgaagtattctactagcccgcagccccccgtttgaatcttaatcatg

SEQ ID NO: 850 - DNA, 703 bp, Nannochloropsis_gaditana
cgcctgtttgaccagcggtgagaaaggagtatacaaaatgtcccaacaatctcctcacctcaacagccccttccaggaagcccggttcgtgatatagcagctctgacgcaagtttcagcacagcagactgtgctatctcgttcgagcccgttgagtgcttctcgtcgaccagttgaggatcctgttgacctgtacaattgccacgctcgcccgaaggaaatggcgatactgaacaagaggaagggcactcttgcagttctaaaacccgagacaggaagagaatggggtccattcacctgtgtaagtagctagaagaaatatgacggtgttttccgtgatgtggagggggagaataaattcctgatgtcaaaaaagcaaaaacaataatgtaatgcagcctctagaggtgtggagcgatcgtcgacgacgacgaggagggaggttcatttgacgctgaggaacaagagcaatgtcttcactattacttcttcgaaacggacgccattgacagcacagtgagcacacaaggatggcgaagcgctcccgatgccctccaaacgccacacgaggcgttgatggcgcttactcccttgtcagcaatgccatggcccgcgtctcggggctggcgaggcctttggacgacaggcttgcgcgcctggccgccctcgaggtccgtgcactctcaaaaaagctggcctggatg

SEQ ID NO: 851 - DNA, 703 bp, Nannochloropsis_gaditana
tgggatgttcaaaagcttcagccgccactgatgctcccccgtcaccgtcaagggcacgcagcacccgtgctgctgcagggcttcctcgagcgcgccaagtccgggcagctcctcgctgtacatcgcaggtggcagtctctccgccccatctccatccatcttgtcggctctgcctccgtccagcatcacgtcccgcgctgccatctccctcaactccccccatcgggggctggcaatcgcctcttcaagggcctgctgcacgcccccgcccccccccaggcccgcacgagacccgcctgtcctcccgggcccgtcgcgtcccacaggagcaaagtgcctccctgggagcctttggcggccaccaaggccacaaagtcccccggctcgtcgaagagagaggcgggcggcatctcctccccctcctccgcgggcggggggtgggccctagacagcgacagccactcctgaccccgcaggcgcctccagacctggtgcacagttcgggggcccatgttatactcctgattgatccatgcccacgagggaaggcatttctcttcccgccagcgccagagccgcagaattgcctccttgtccgccgcctcgaacgtgaagctctccgaggtcgcctccacctcccacttggccgcctcccacttctcccccacgcccacgggccccgccgcgggccgccgtctcacca

SEQ ID NO: 852 - DNA, 703 bp, Nannochloropsis_gaditana
aggccctgtgagagagagcaggcaattgttttcgaggcagtctccgatctcttccgcccacttatcgtagaagaacacacgaatgcgattactgggcctcccatttccatctgccccgtgcaaggtgcagctgactactgtcgttgccatggaggccagaggtccgttgtcgagcggccctcctaaaagtcctgcggtacccccgctcacgccttcctcgtcccgaatacacgcccgcagtccttgcatgacatgtactttcccctgaacattaagaagctctgtggtggcaagatttattgatgctatacaggttgcgacgccttgagtgttttttgcacggagcataccatcccgtttgccatctgcgtcatggccaccgactacgtactggagttgtgcagcgccagacatatgtcttgccttccttcgtgtcaataaattgtaataatgcgagcggatgagttttgaccggaggaagttagcattggggtttctccttcgaggccagccttatgccctgctagcgaaagccctgctcgcccatgaggacaaggtacacagggccggacgtgcaatagcctaggggatgctgtgtgcatgcctggcatcatgccattcatttcacaaaagcctaccttccattgtacacgcacgtcacagcccagcgagacagtttgcaggcccttgtctgagaactatg

SEQ ID NO: 853 - DNA, 703 bp, Nannochloropsis_gaditana
ttatccgcagtttactaccttttctcctgaaccctttttttgcaaagctatccacgccatagcactgttatcccagcctagtagatttctcaacctgccctgacccggatgatatgggctccattttgaaaaagccgttaccctggcggtttcgtctcaaagagccgttggtgctgcctgtgcgttagtccgtgcatagtgacgtcccggtgggcacccatcaaagtccgtcacagcaactttacaatttacttcacctgaactcgtagttgtacaccaatcaagtggactgttcattaatcgctgttcactcgacttatcttttggacctctttcattttggctgaggacccacaatctgctgcacacgatatccgttgcaccttacaccccataccaattcttccgcgattcattctagccaacgctcccccgcattaattatttctgaagcattacaccatatccttagcaggtcgacacagagttcgtttgcgttggctgaagaatcccaggaaacagcaggtgaaacgtaattgaagcttacgcgctgctaaaagaggagagtaacgggacaagattaaaaatggacccacaaagtatgatagcttctaaagtcacggacggccagagccagataagcagctgtcaagatgtaaacgaaaatatcatcagcgctacgacagcgggcagtatgaaaatg

SEQ ID NO: 854 - DNA, 703 bp, Nannochloropsis_gaditana
caggaggtacctttttatggtgcgttttcacgaagggtgcaccgtgaaggactattttaccaggaattgacctccaagccaaagcatcggccggatagcatgttacactttcgcttgaagcggcggggacgtactgaggctctagctgggcataaattgaggtcactaggcaggcaatcgcggcattaatacataatatggagctgcgcataagcaatgcgcgtgaaggcatctcttatccaagagcaacctgtggtccatgggtacgcgtgcgaaaaattggggatcagaacatggctggaggctgagccgggagggacggtgttggactaggaggacgcggtcgaaacccgcagtcacactgccacgcctctgactgcacggcaataaagatttgcggtgcgtgtcaggcccctggacatggcacggtcgcgagcaaaaatttcaggaagaagcattgatcttgcagaacgcccgtccgtgccgagacgacgccatcgtaaggatgaagttgtcgccatgggcctgggagagctcgaggcgagcccggacaagcggaggggaatcagcgacttcacccactgccactgccttgctcgttatctgacgtctaccgcgagctcaacattgacgttggcattcgccacagcatgttgcatacagctaatactggtaaatatttttttcatccgttcgtgataca

SEQ ID NO: 855 - DNA, 703 bp, Nannochloropsis_gaditana
tgagcgacgggacggcgacagaggagcgtgcggtgtaacctcctggcttcgtacactacctgcaggatagtggtgcagagcgctctgttaccgtatgtatgtgcgagtcggcgtagggagagcatcgattctcgtaatatatagcttagataatggtataatttgctcgtgcccctcacaatcttcgtctttcaactaaggtcaatcgtgggcattcacccgtgcgggggggggtaatggcgtagcccacccaaaagttgaaatgctttcgtaaaacttacttattgatgaaaaatgatgctgctatatacttgggtatgatatttttgcgcccaaacctttggagaaaatactgaaattaacacttatcaaagggagagtcgatcgtgtgatccgatcggaacagcacgtacgtacacgaggaagcatatgcataaaaagaagtttgagcgaagaagggttcaaatcatacatagggagcggttgaaatagatgcgcttattccataaaaggattttcagtacttgagaaggatgattgcagcaaatacgacgaggctgtatcacaaatgcctcttcaaagttcatctcctggagacggacgtatctcactgattccctccatataatccctttttattgtcgagctttaaaatttctgccattaacaacttatcatttcgctgtcatatcctatgtctagg

SEQ ID NO: 856 - DNA, 703 bp, Nannochloropsis_gaditana
cgcgtctctggttgccctcaaagctttacctcctagtcttctcccttgtttttgtaggagtgacatctcctgagtagcgacagccgcaccaatgcgacctactcgggattcgcggttggaaggaagaggcaaggctgagaaaggagggcgggggcaagatcgaagtcgcgtgcctcgtgaactagaggctcccaggcgaaagaagagcgaggagcggcctgcacacccctgccttccggcactgtccgcgaagggggctacgaaatgactcacagaggagatcatttgatacgtagcaactgatgtgccaggcaaacagtgaagcatacagggatggggcacaaggtcgcggtcagggatctgaacaagcggatggggggatgaactcgctcctcagcccctcctcagcaccagaatttgatgctccatctgcagcatagaggccgtggttattactcattccttgcctacttccatgggaagtaaacattgagcgaccgtgctgatcatttatccttgctggacaaggagggagaggtcgcaaaagttcctttccccgacttacacacccttgcgcttcaacccgcatttgcgcgcaaaccgacccatacacgccacagatttgagcatccctacgacgaatattagcagagcaccattcacaaccaaagcacgctgcggtgataaacccgcaccaggcatg

SEQ ID NO: 857 - DNA, 703 bp, Nannochloropsis_gaditana
tgcggcagggacgacatgcagggaaagagtggcgcgggtcgcgatgaatcgtgttcggtctttaccttttttggggtctccgcggtctgtcattacgcgcacattcaccacattccctgccgtcgagaaaacttggcgcagcttctcgtccgtggtgctgctgcttacgttcccgataaatatttgccatttggagtcgccggacatgatttgattgacttgtatggctggaaggcgacgctagttgactaagtgagcgggtggggttgttgcttccaggggcgcggctccagggtggtacgagactccttggccctagaagtctggcaagcactacacttggattcgcggacactacgtctctctgtgactttggagatgaaccatgttgacattggtcgtgagagaaagtggtaaggcgtgagaaatgcgggcatgagagtgaaatcgagaggggcagcgtgagcagagagcgaggacacctcggaggcgagaagagggggggggacgctgcagtagccgcccacagcctctacgacattttcattgcagtggtcaaagcggggagacatatcgctttcggcctctaccagaagattgtctcacattatcaaccttactctccatcattctcgtgccccctcctttgttgcggaccccaggccatcggacgacctccccgcggggccagcagcttaggatg

SEQ ID NO: 858 - DNA, 703 bp, Nannochloropsis_gaditana
gctttgagtagttctgcccaaactagatcttctaattttcgctctgccgctgcaaatggatcgaccctgtcgtctccatctcttccgtcctgcctttgactcgcagtctccttctcccaaaccatgtttccggctgaccagcttgcacacctttggcggacttcgtagatggctatttttttgcaagcatgcaaggcaacttcacgacaccttttgtcgcctattgagtgcctggtttataaatctgtgtaaggaaggcgtaatagtgtgacagtagccacgcacgtgacacccggacagcgctagagtagtgccgggggggtaaagactcgctcgtgacgttggctccctcggcgagacccgttcctgcttccatttcatcgaggacaagtaagaagtcgacctgatggtctttcgtgatcatggggctttatatctgtgccatagcattctctcgatgcgtgtcaacggagtgctttatagcgtctgttccttgtataaaggggcttcgctgaagcctgactatgatggaacctcacggctgtctcatcatcacctgccagtgcctccccctactctgttgcctttgataaagcactcggcaatgagggaatggctgctgctaccagatgcagcgcttttccttggagttgctggcctttgctttttagaaagagtgcggtcgaaagaagactccgatatg

SEQ ID NO: 859 - DNA, 703 bp, Nannochloropsis_gaditana
caactcggctgtttcatttgcaatatcgaccgcgccagaaagagaacggaaacgctggcgagggtctcaaggcgggacgggcgaaggaacgcaagaaaacggagacaaggcaggtggggcagctctgacggcgaaagggaatttgcaggatttcttaccgagggaagacctctgtactccagtatctcccagtagtcatcggtcaacaagtgtcggccatgcctcggctagctccggtattgcttcctcagatcatacactgaaaagttgttcgatagagagacaggagaataagagtggtggagacgacaaggacgcgcagttcacatgtcaaggtaaatttggcaggaaatcagaggcatcccgcgagaataatcaagaggatagcaccagcaatttaactctcgacaatgcttcaccgtgtggcgggagtcgacacgcggaaggagaagatcccagcgatttttactaccttctttcacaagcctctgaggggcggcaacgtcgcggcgatcctgtctcaatcattaagagtgcgccaggcacggctatgctgtctcaaaatacatatacatgccaacatggtgggaaggccagatccccagcaagcgagaagagcgggggaggtggtagcaccaaggagaatggagtgtcggagtcggcatcggtgggtggcaatgctgatggagctgtggaaaatggt

SEQ ID NO: 860 - DNA, 703 bp, Nannochloropsis_gaditana
cgcacgatctggagaggacattgacgaccgctttaaagtctatcttcgtgcacctagcaggaagagcaacgacttgcagccctcggccgaagccctgttgacgaacagcatgctggataacactcaaacctcagcttttccgtcgaaggtgtctgcaaaacagccgggtgaagacgatactatggaaaatcgtgcatgcagccttaccaggataggtttcgatctggagaatccgccacacgttgaacggatgcgttttgatcggctacgcattctttacaagcgccgttatcagtttcgacacgtggccgtggagttttttgacgtggatggacgaagtttcttgattgccttggagacgcccgctgagcagacccaagtggtggatttagtgcttgatgcgccgcttgtcaacagtgttttctggagcaacaaccaagatggagctttgcaaaagcttgggggaggcggaaggataaattacaagcgtttcatgtcccattggcggcagcagctcactacccggtggcagagtgggcggatgaccaattttgagtatttgatgcatttgaatgcgttggcgggccggtctttccatgatctcacacaatatccagtttttccttgggttctgtctgactacacgtcgccaaccttggatttaaataaccccgaagtttatcgggatttgcggaagcccatg

SEQ ID NO: 861 - DNA, 703 bp, Nannochloropsis_gaditana
aaatgaaagacgtacatttgccacgacgaacaagtcagtcacatctgatgcgagccgctcttgcctacatatccatttctttttatgacagagaaaagttgacaatgttcgaaattgcggcgggctgtcacaccgaacacacacggacgataaacgaatgacagcatcctcgtcagacgcccgcttgttggcccacctgttggtgtgtggatcccaacgatcgttaaagctacccggaagtattctcgggcgccagcccgacccaatgggcagactgcgcactgcattatcttgctttattacacactacccgcgtggggtagtcagttcctctacccgctggtcaattattctctccaccttcttttggttagtctcaagacgaccacgagtagtcaatggatgctgctcctcgtggtggtcctccactggtgacatacctttctcttgcttgttatatagatgccgccgcaccgagtcacacaacaacttacacaccggacaggccaacatgctttttgccgcacgctcagcggctacttcagctttacggcgtggtctgggccatccacagcctcatttcgtgcgacatggggcaagacgaatgatgggaggaggggggcactccccagctccgcatccgtcgcagcccaaacaagcctttctgtttaacgagggtcctggcccgcgaaaagtagagatg

SEQ ID NO: 862 - DNA, 703 bp, Nannochloropsis_gaditana
aggcaagattagcaaggatagaggagggcaaggacgtagagtacgggcacatataccacaagcaactcttgacgggaggctttgtccagcattcggccgcgaatgctgacagcccgccggaggcagaggaggaggaggaggaggaggaggactgacgtccactttgtgatagaagagacatactgaaagcacgtgggatggtggaaatttcgggaatcgagggggacacggcatttgcaaggtcaatacggccctttggttgaggcgcggtttcttggaaatttgtttagaatggtgggaggagagcagtaacacgtgaaaataaaaaatgtgagaaacacgttgactttgtgtgtggcgatggccaccattacggccacaatctggatttctttgactccatgagcggctccctctggggcgaccagaccgaccgttccgcagagtcgatcctcacgctctatggcgcataatgaggcggcactaggacaacgtctcatttccctaaccatgcctttgacaacgaatttggaagcgtaaatattttaacataagtgttatgttcaatgcgttcaagtaattggtattgacagggtatgcaatggtcaacagcgccaacgtaggagatctaaacgatgcaagtctcacgtacttattcaataccttaaaaatcgtacagagacaccacatcaaatgcacaatg

SEQ ID NO: 863 - DNA, 703 bp, Nannochloropsis_gaditana
tctgaccatgaagagatggctacaaaaccgcagttgctatcttgcgaatggcctaagatgatgcagactactaccagtagacagctactgtacccccccggacggtcagggtgctactaggaagccttcaatacaacaatcaaggcaaatgtgacaataaagacatttcttctcaaagtcatgtcaaaaaaagcggctcaatgcctgatgccttcaggtgtaagaggtgtgaggggtgctgtataattactcgcgtgccctaatttgtatgcttggcctgcggtactgcccgactcaagctgatctccacatctctctctccaagccaggtgcaatgaaagcaaataaagaacggactcgaccatcccgacatcaatcactcgtgaagtagggtattatggaggacagtaaagagaccaggacgccctctgaagctgtcatacctccctcgcctttgacagggacggacatcggccttaagatccgttgcccccccaaacaggatcgttgtgctttttttcttaagagaaagttgcgcttttgcacggttccaagacttccaacttcaaagtggtgtggaaatcatcaacatttggaggcaggatatgagaattgtgccgcagcagcacgtagcaagacacaagaaaagcggggtgggcaacgtcgagtgccttgtcccttagactcgaatcacactgtgtat

SEQ ID NO: 864 - DNA, 703 bp, Nannochloropsis_gaditana
tcaattgagctcgccctggacagagcatatttttatgtaatgaaagtccccgtccagtaaagttcaggtattccaaataccttgtaccagcagtacagccgaatgatgttgattgtcggggatgccgggttgtaaggtttgcactgatggtcccgccagcggataacatgtctgctcggaaaaaaggttgcaagacgaacacagaatgccaatagacagacgaatcttaaaatagcaagaaatatgttttgtgcatagctgaccgaagtatgcagaaagagcgatgaattgggagggagtgacaggcagagaagggagagggaggaggtaccggccgatcattcaaattttcaaaaattgaaaattccacgacagacgtcatttcccttttcaaaaaggtattaagagcactctgtgtgacgacgtctgaaaaacctttgaatggaatttgggcgttataattaaagttgtagtttctgcaaccttggacttgtaagggtcatggttgcgtttgtttggcgggcttaacctgctacgacactagcaagttgaactcagcatgtcgatgcccgttcgatcttgcgaagcgtacgacgcgacttttgcccttgtacatttcactggaacctctgatgtagtgcagtccctgacttagattcttatctctttttatttctcgcataatctgctccatggaagcatg

SEQ ID NO: 865 - DNA, 703 bp, Nannochloropsis_gaditana
tcttcaacatcgtcagcaaagctgaggaatgcggacgccttcatctgtgcagtatcaaagccatttagccatagtaaaaatctgagtagcctacaattccctgctgatatgtgctctaaatggctcatgaggtgcaccaaggtgagttgtgcctcgccagaaaaagcctgccatgatgtacgcaactggtgctttaatggctcacagactccctctttgggctagagggcagcaacgcttgccgacaggtgggctggaggcacaaggggaggaatgtggtaccatcgctgagaggggcttctcaaacgaggctcctccgcgaccgccccttttcccctgacgcatggtgcacttttgtcgtggagagaggcctggcgtctctatcaggcaagtgaatatacgtgtgtatggttgtagatgaagcattgtgccgagtctgccttctggacacagctttttcgcggcacattctcttggcgccgtatcaggatactaccagtactttcttttgaggggcttgctgcagggccttatttaatgcacttctttgaacttgtcaagaccgctcatacatttgtgacacgttccaaatacatcttgtacaaggttatcggtagctcatcagcattcctaggtgctttgccagccgtccgggcggtgggcgaccgcgctagatcaggagagcagtagcagtcgcgcaatg

SEQ ID NO: 866 - DNA, 703 bp, Nannochloropsis_gaditana
gagtatgcatcgtagatgacggacgggccactggtgatacttctgtccctttttgtgcggatgagaggctagctgagtggagcaatcgaaaagacgcaacaatgtagttggagatggtttccatccgaacgacaaagtacgcgaaagcgaaggtttccaccccccgaccgcctgctacgccgaggggtgggtgaccgaaggcctgctcaaagcgagtcaagggcgtgagggaggcgagagcggcgacgcggagagggagaagggggcgagactgacgcgcccgcgcggctccttatcaccggcagcggggcagttcaacgccggcacgagaatctcgatgtggtgcagtcgcgtgataatttgcactgcacgatgccggcaccggccagtactttcgcaccacatgtgtggtggggcacgcccgactcgtttctatcttgattcacagcgataggagggactggcatgcgtggcattccgctaaggtctccgtcacgtgcctgccctgcgaaaataaacccacaccggctacatctttttccaagtcgtttaacatatttgaatgtacatcatttcacaggaagggtcggtttgtgggcaacacacgccataattgacacgccgtggtatttcaaacccctagcccttctcggcggggcgccaaacgcagaaagccgattcctcagctactggtataaaaatg

SEQ ID NO: 867 - DNA, 703 bp, Nannochloropsis_gaditana
ttgtgtttttccatgcagccgacgttgttttttttgtttttattaattcttttccatgcttgacattatttttttcctcactcatcgctcttgtatcttgaaggcgcataaagacgcgaagcctttcccgcgcacgccatcttaaagcgagcttgagcgacggctgtgtgcgtttgaaatttatgggtggccatcacgatggccaatgctggcattgatttgtaattctttctcctctacgccacagtgcaatgccgtattgtgaaactgatatcgtggctgcattcagcagcagcagcaccactgccacaaatgcgacgctgcgcatcaagaccaaggcgggaacggaggagacggtggagatgcccatgccgccgacgcatatttgtcaatacgtgcctgccccgggcggggcagtagggtattaaatcaccgctcgtgctgacatgttcgggacgcgcgcggacatttggctccgtaacggtgagtggaaaaagggagggagggagcgatggcgtaataggaaaagtgtgggggagcgtcccagccagctcgccggcttcgtgtgcagaaatgactcactttttctatatcataccatgcagtcatagacaggagcgagtgggcggaggctgttgaccccttccagcggggccaggcccttatccggcgggcggcagagacagtccaggcgctgggcatg

SEQ ID NO: 868 - DNA, 703 bp, Nannochloropsis_gaditana
ctgaatacaattgttcgtatatactatgtacactgtacaatttgttaggccaagacgagtttctgacgggaagggtcttggccaccacatgagcacaacggatcgatgggtgcgcgccaccggtacagcggctccaaaagagaattttgcgaaaaattgacaccaccacatcgtcatctatgcgaaatatacattgcgtcgccattgaatgtctgtcttatgtcgttgtcatcggcttgacttacaacagtgttgatgtcccacataaatgcgtttcacaaatgcgctcccgtgggcgtccgatgtgaccctgcggcattcattggctcacagtaggacgttgcttaaataatgaattcagataactcatcatcaggtattacattcatgcatcacagggctagccttggcgcagaggtgatctacgacgggtctggtaacgaaacagcccccaagtaatgagaatgatggcgaggaacatgccttccactacctttcttgcccgcgtgtactgaagtgagaaaggctgcaaatcgtaagcaaatacgtcatctgctcgtggcaagtctctcgcaactttgggtggccgggtttccatccacaagcatcgcaactttccatcaacacactttcgtacgtcacgacagacggagccttttgactgcttggtcgtattttgaacaaacatacgaactagtttaca

SEQ ID NO: 869 - DNA, 703 bp, Nannochloropsis_gaditana
tgtccgcgccggcctagagctaagttcgaggcacttatacacgataggaagccaaagtaccatagaggttttagagcgttgtgtcaacaatcaagggcttgctcgcctgcgcactcgagatggatggatctcggagatgctgaatccactctctggacagcgagggccgattgtcgaattggttcccctacaacaccctctcaaatttcgaataactttcccagatggtgccctggttaggagtggaattgaactaagctctggcgttgtcggcacgatacctgcaggccaagagatcgtggtgacggaaaagcgtttttcagacacgccctcctacaggtgtgtacctcgcttaaagctggcggatggcttgggttggataagcatgcgaatcaattctcctccgcccagtgatgcagatgttgttgagctactaggcctggcgtgttcaagggaagtggataattatagcaccatgttcgacggccttgtgtcggtgcatggggctgggatgctcgacggagaaggagacgagagtatccatggatatcaagatggaggaagcccattggacgtcacgagtggcgagcggagaggatccctttcgatggatttatctgtatctgagccgcagccggtaggcaagaacagacatacgcggtacgagcaacagcggcatcaacagggccagattgccgatatg

SEQ ID NO: 870 - DNA, 703 bp, Nannochloropsis_gaditana
catgtagataggagcaagggggtgctagacagcggccacaattaggcggggaaaggaaggggctttctgctaaatatatcagcttcaaaatttcaacgtaagaggaaaaaaatgcccacacctcctgtctagaagacgacaagcattgtccagccttctcaatgccatagcgtccctccacttgcatcggcgccgacaaaatatgcacacgatttggagggccgtgactttccctcctgggaaagcgagcgtgggcgaagacaggggcttgcatcttagaggaccgtctttgctggcccgtctcatgtgctatgccgtgggctttgcataaaggagattcaggccttgaactcgtggatgtgatggatagccagtgtttttctttaccggaaggtggcatgcaggaagcaaagagagtcgaagaaaagctccagtagccattcttccatgtccagtggacaaaaacccctggccgcgttcctcttttctgtgaagaatgagggtctgcctcgatccctactctgacataagagtgttcatgttcttggacacatatttccgctatagctggcctgagttgtggcacgaagttgtgttccattgaactcacaccgggatcctgtatgccacgtctgatacctttcatctcccccatcacgaactgcagtgagtacttgcagttgttgcaaagtgcgaacgtatg

SEQ ID NO: 871 - DNA, 703 bp, Nannochloropsis_gaditana
ggcttttgattggtgttcctttataagaacgcagcacagactgatcgagggtcggtgcttcgagcgatccttttgtaagttccaatatgtggcagtaaacgcaggggtaaattacaaatttcgcgtgtcaattgggaaaagtatattctcgtactcaaacgatacatttcccagttcctaagaaatcatggaattgggtgttcgctggccttaaagacaggcaatcctgtggtatcgagaaacaccatctgcgtcctgtgagagagacggcacaatcgcggaggacaggggcgggtcctcgccttgccgatgccatgcagttcagtccttcttgttcatgtccttcaaagtggtttcgacgcaactttgcgcgggagcactgcaaactaataaaacatgggagaatcgtatgattattttgcatgattctaatttcagtgcacttttaccctccaggtatacgacgcgtaccatgctactatgggccaaaatattgtgaaagttgttcttctgctgcttttacactcatcacaggaagttttttacttcaggtttttcacaagaatcttgaaaatttagaggattattctgtttcgatagatatcctttgcgattcgtggaagggacagcattacgatcaggccccgagcccatgctctgtagagccggataggtgtctggcaaatacctcaagcaggccatg

SEQ ID NO: 872 - DNA, 703 bp, Nannochloropsis_gaditana
cttaactgcaaacgattgagaaaaatgctcgagatatcatagaaataagcacaaggaaataactctggcatatctacggtacaatcttcttcaagaataaatgggatgttgtactgacgagcgaattagcctttcgtaaattcctctcaagatgcagacggaggagccgggcgaagtgtaacgttataacaatgccagcattaccccaccacgttcatgtcgcgctttttaaggtcgtacttgagataaaattttgtattatcatcacgcagaaatgataaggacggtgtaggctgatcaacagctttaaaatctgggtcaacgggacatcatgatgctttacgttccgtgacgtatagtatcccaccgaacgtcagaagtctcccatgacaccagacaacacatccaacaaccagacttggcgtgccagccttcttggacatgtccattggcacgttccgggagatttaaggccacaaatcaggcacataggaggcaaagaggcctgacgatcgtggcgctggctcacttgcagttctagtgttcagtgcaagcttcgctgacatgtacttccatggcttacatgtcaacattcttacccctcccatccgtctctatacagtttcctcccgtcctttagttgtcaggtggctgacctacaacgtagagcttcttcttgctcattttttgggtgccttcgatg

SEQ ID NO: 873 - DNA, 703 bp, Nannochloropsis_gaditana
agtctcaccaggacagaagaaaaagaagccataaaacaaaaggaagcagctctgatcctcttacctccatccaccctccgtcatactcagcgtcaccttgcagtccttctgcacaaacctcaccgccggctctgtcctatttttcttcccttttcccgccattctttcccagccatggcaacagaggtagcatcgcgcatgtcgacaccacaaccactagaagtggacaaaaatgggcccttggaatgatactcctaaccctccttcctcgcgtagccagaaaaactctccatagtattgccagcagcatcccgaaaatgcagcagccttccgttcgagctttccgtgaaggacctgccaaaagcgtaaacttcaactctatgggggcccgttggcgtcgattcctgcaggggactaaagccaaggccgccatggcggccgctgtggcatcgtttgcactcggcgtgtctttgagcccccccgggactttccaaaggtatcacaccgtcggtgagatcccgggaagagtgtttcgggcacagaccgtcctggtcggcaaggtggtgcgcgtcatggacggtgacaccctccgtatcaggcacacccctttattccccctcctgaacaaccatccaggctcggggcggctgtccgaagagaccttgatcatccgcttggcgggcatcgacgcgcctgaactcgg

SEQ ID NO: 874 - DNA, 703 bp, Nannochloropsis_gaditana
tggttcaacgcatgcttgacttcttttcgcacgtcccttgcacggcctccgaagccgccagccgctttcatgccgtagagcaccagcagcgctgagcgatgagaccaccgacgcgtcaataatgaagagtttacgtgatgatagattatgggcagagaaccgggcgtccatgcacttggaagaagagacttcagccgcagacgtgttgttcccgcaataggcggtgtgcatgcgcctgcggttacaacccagctaggattctaaacaaagaatccctatcccaaaatcacctcatgtctatgagatgcggtggcagctgttgtgatgggaatttatgaatgctgtctgagaaatggcaacatgtgagtggggggtaatacgtacacgttagagtcgagcgtggtgggcgagacgagccgtcaaagtcaacgcaatgtcacgatatgcaccaccaagaaccccaaaacgtaacgctatagacactaaaggtggatatatacactaattggttttcaggatatccattttatgggcttaaggggggtgatggtttgacataagtgccttcattacctcctgcttgttgaatctcctctgtgggagtggcctttcctacacgacgtcccatgagctccgatttcacacattctccactttcctcaaaccagaggattgattttctcttcttctaggtctgaagatg

SEQ ID NO: 875 - DNA, 703 bp, Nannochloropsis_gaditana
tttctcaacattcttcatggctttgatgagtacaggcttcagagatagtgaagcttacactcctgtatccaatggtcaatactttttttaggacatcagagccctaaattgttttgacaagaatctattgcatctacgtgtgacaaaaattaatgaaattataactgtagtagcaaaaaatgtttgatcaagtaacggacagaattatcctgggataggaggttgaggtatcgtcatagtcaagttcttgtgtgagcgaccaggatatgcacaaaagccatcgaggcactgaaggccatacggaacacatgcctatgcgtggaaataatcctcattaacgacacgagctgcggtttggagagatatcacccgtggcgacggctcctgtgggcggccctggggcgctctgttccaacctcccccctccgaaagcgttgtcaaacttttctcgacaaacataacatgcagccgcacccttgatgttatgatcatactttgcgctaatcaagtttcacgtatagaaatttgaccttgcgtggatccctcgatactttcgtcttccataatagttcgcatggcggtcaggaagaagcgtgtccgtaggggcatgaaaccacgcctgccaccgcggttccctcaagctacttatcacggacaacaccgacaacaagaagatagcatgaatgtaacttcagctgtcatg

SEQ ID NO: 876 - DNA, 703 bp, Nannochloropsis_gaditana
cttacgagccgctttagacaagtatttggagagacgctggaagcccgtattaattccggcaagtaagggcatcctatttaatggctttgtggggtttacgatcgaagcaaattaccactcaatcctcgcgtcaactgctgctctcttacccaacacttttcgtggctcaagctgttcgcccttcccgagttactgtgtccatggaaggcattgaaaaggtgtcaacatggcgtgcgcaatagtcaacgcgtgcattcgatgccatcatgtcccgcgtcgcggctccatataacatgaacccactatcccgccactgcctttccctctcgccgcacgtcagcctctggcgatgacgatagccgggggttagcacgggagtctcgcgtggcgcctgcgtctctgctcctgcgggcttcgggcaagaaggagggcgcaggagggaacgaatcttgagagtacgctcatatcgctcgtttgaaggcgtgcgtgtgcgcgatagcctctatgcgtggatctctgatggctaaaggggggggaggtcgaagaggaacactgacgatgtcccacaccaacatcatccgtaggcaaagaaatcatgccattaagaaaaaaattgggcttgctactggtatcagcatgtggactccatacagctgtagggtttatggctcaaaatcctaataaagtccttccctcgaccatg

SEQ ID NO: 877 - DNA, 703 bp, Nannochloropsis_gaditana
  misc_feature (670)..(670): n is a, c, g, or t
atctaaataggctagaagacagaataagaatcccgtcgacaacgaaaagaagacaatcctagcattcgcggaaaattgcgaggaagggaaagcagctaggtgggccagggcgtttatgattgtgacgagtaggacagaccgcgaaacagcacaaatcaccgcacggcatgcctgcaaaacatcagttgacatagctaggcacctgtgggggtagtgtatgtgtgaagtacaccgacacatcgtgagatgatgctggtttctcaagcattgtaatggtagtcctaggggtcttgagacgcgtcgggacagccatcatcatacatgtcatatggccacagttatcgtggaaaaaagtcacttatgagataggagcaatactaggaggttggactttctttgttcgatttcctccttttttttccctcctttaggccgcgcagactcgccggagccaggaggttttcttgggcgagtacaagccatggtgcagagcagtatgtgacatggcctgcacgcggcgcaactttacatcttacgaccaacaattggtgctcatcgcaggaaaaggcgttctcgtcgtagaaggaggagtgtggctggcgctatttcacgaggtctccccacctgaccgggcgttcaaggtgggcacgtaaacaagactcaaactgcngttttcatctgcgcgattctatcgacttgcatg

SEQ ID NO: 878 - DNA, 703 bp, Nannochloropsis_gaditana
cgctctcttccgcctgagcgcgattttctcagcctgtacttgtccttgaccatccaccatcattccatcgtcctcttgaatgacatcgctttcatacaactgactaccattcccacttctcgtcatcgagtccacgtcatcctctgcgatggtgtccctatgtagagctcgtaaactatctgtcagctctcttctggccgcacgttggcgctgaaggaccgacgacctccgtttgtctcgcgacgaggaacttgatatgagtttactcttagggtacggacgctgctggggtgacgcatcagttaagtgctgcattatttggggagacgctgcggaataggagtaagactagtagcctgactagcttgacgtgcagggggtggggaggttagcagagtcaagtggaatgcacggacacttctgtccctgtcaggcggccttaatgttgataagtgtaattttcctcactttacttgacgtatctgggccaaaatttcatgtgagcaagaagaaatgggaaatactacaggtctgaatctcactgttacgaatgaccaacgactcgtcggataatggtacgttgcagtgaaagcaactcatatttgccttctttattgatgcccatcgcatccagacaatcagcacgcgtcattatgaatcagccgtcctggtcacaagcatgtgaggctcaatttctgggatg

SEQ ID NO: 879 - DNA, 703 bp, Nannochloropsis_gaditana
acgccacgaagcgtttgaataacacatgctcctgcattgctgcattttatggtcagtgatgggtggtcctttgcttcgaatcgatcgccggtccatgattgtatgtgcccaggcttatgattttggcccccacgaccgaactacgtcctggggctgcctatcgggtcccgtgcacgccacgaagctcttaaactactcaagtgtattgcggcattttacggtccttcagggtgccgtggggacgggtggttgtttgcttcgtatcgatcgccggttctttcgtatcaaatataggtatctagtagtcaaaccaacccatcattacccttacccaacagcacgatgaatatggcagacgccgcgagcacatactcaggcgtgaccgaagaggaggctcaagctggtggcgaccggggcaggacttccctgaccatgacaggcgcgaggacagcgtcgacgacaccgacgaagacaccggcggcgtggtctatgtcccatttgtcaaggccagctcccatgtggtccccacaaataacaagaaattcaatgcgattaagtttccggagtccaagttcgaggagcagcccgacctcctgggactgctgcttgattaatgtgcgtcgtgcgtttctctgcttggacccctcccatgcctatcccaatgccacatacccctctcaccaccaccacacgtgcagaaatg

SEQ ID NO: 880 - DNA, 703 bp, Nannochloropsis_gaditana
atcctccggctatgggagcgaagggcaaataggcctgctttcgttttaaaactgcggataacagttcaacgagttgccattgatagtttgagagggcataaaggtgatcgtggctgctagaatagcgcatgaaatgtttgcagtgggtctcggggcttgaaggaagtgtagctgaggaggtcgagcaagcagcgactggaacaggcgaggaagactcggcgagcagaaagtcgttgcatttgccatcttgcggctcaactcgttccacaatctcaatcacgtttcacacctcgtctctggacaggactgcctacatccgaccaatcgcgttggaagcagcaccaggtgtctggaaagcttagcttgacatcgcctgaccgctttagccgtgtcgggccccaatccagtgacgtttacttccccccgtgtcgttcgtctagtgtactctcagtcatcctgcgtcattggtctggtgccaaagcacgtgtttggtatgctaccatcaagtgtaggcagaagtagccgacgtggtatttcatccggtgcttggttgaaagccacaaaagtaagaccgcaagtattgtctccgcgtaaccagcctccctcattacgcgcacaagggatctacagacgttcatggtcgatctacagacatgatttccgtcaactcagctccaacgctgtcagcaattctcctcaaatg

SEQ ID NO: 881 - DNA, 703 bp, Nannochloropsis_gaditana
tgaactccgcgcagtgcggaatgagttgaaggtgcgtcgatcgacggccatggccgcgctcatgcacgacactgccacccccgcctcccgcggcagcgtctgcctggccccacacctgatgcccggccgttgcgacgattctgtggtctccgctctaacgcccgcgtcgggcatgcagaatggggtggatgaagaagaagaagacgaggaggcgggttgacggggcggatgggcgccgcgtggacgacgtggtggccgtggttagtacactcggcgtggggcacgctcccatttcagcggccatggacatcgtgcctgttccctgtgggtcaaaggaggaggatacgcctcagtgcctctcacggaagcgcaagctgttgcccgtcgcctaggtggttgtaatcatatcctttgatggccaggctcaacacatagtccaagcgagaaccctgagatggtacagcgatccgacatcgctgcgaacccttcaggtcgtcctcgccttgctgagcgttcacgtggtgcggacgggtctggcacacatccaattcaattttcccgggtaagtgccgtccttcattggtagggtggtaccggactcaatgtcacatacgtatgcacctaatgctcaatgccatcccacgcccccacccacccccatcttacagcgggagcgtagcagggcggtctggccttcgtcatg

SEQ ID NO: 882 - DNA, 703 bp, Nannochloropsis_gaditana
agagagacacgtacgcgtgcttcccgccacagtgattttccccaaattatttacctggtgtcgagaattggctatcgcagcgcaagaaaacatagttactgttatcaagtttgtcaaggacaggcaaaagcaagacgaggtgcctttgcgagtccccaaaaccatttccaagaggctcgtctgcacaggtgctacttctaccaaggagcgacgggagctaaattatcgaattcccagtgtgatttaccagcccagtggcacttggtaaatagcacaaatttgagcttccttaataaaggaggacgacctttgagaactgttcaatctgtgcgtttggggatgtaagaggcagtaaggagatgagctgaaggatactctaactgacgcatggcgaggggggggttgagcttctcgcagcagcgatcacgtgagaggcttgaatatggaccgtaaatagagtaatgtagcagtagagccatgattaagaggttccaagtggttgaagagtttgttgtagaatagctcttgctaagtttttgcattgagacggtcgatatcgaggagtttgacgattagatgatcacaggggctgttgcagttcacaagcgcgggtggccctgagtttcttccacttgagggcagattgccctgagtatcctcctcctgatggcgttctaaccaatatttgctcaccaattgaatg

SEQ ID NO: 883 - DNA, 703 bp, Nannochloropsis_gaditana
accatggagtcagagtgcatttgggagggcatcagtccttcagcttgaagaagtggcagtgaaggtgtctgctgcccctggtattgggattcgcctggcgcctgcaaaagcccgccccgctgaaacggtagactattgtgtctagcgaaagcagccaagataagcgccatgaaaggcaaggccaccaaattgtctcctctggtcatactggtgccttgaaagaggacgcagcgtcgatcgttgcggaatgggcggtaagatgattcaaagtcttcccgcgctcgggaaacaaggcaacttgctagacaggcctatgtcattgtattgagagtatggtgcatgaggccgacaaacccctagtggcacagagacaccgtggctgtaggaccgggacgggggctcgctgcaactcgccgtatttcgacgcgcatcggcacggacgctacggccagtcccctcgagccagggcgggacgattggtacatgcgctaccatccccccgcccttcaccggtcgagcgagatcctcaccccatatctatcatcgcggcttgactgagttttctctgcacggcctcatgtctttttacgggttgtcttaggcctcgttgaaccgacctccccactctcccctcctactactcgggcccgtccagggtcagtgcacagccacagaggggccctcgtccagagacaggattatg

SEQ ID NO: 884 - DNA, 703 bp, Nannochloropsis_gaditana
ttttcttatcatgagatgcccgaagacccctaaaaagtggccttcgagcgctcgaggctgccggggtgactaccccctggccgacctactcaggtcacatttcgacccacctgttggttagcctagagaagacaccgatctcattgctattctcaaactgaagacgcgtggccatcgacgaaccccaaaaaagtagaccggctgttttgatgttcaagagaggggctgtgttcttaatatccatcaagggtggcgtgggcccaccgatcggactgcgttttgcgcgaagcgtcagctcacgtttccattgcactgcgataagcaaccatctccaggcgaaaaggcgcatgtaccaccgtcgtttcgatctcggaggaagagaaaggcacatgaacaaaaagcgttttacctcctggctatggctgccattcacgcgagcgatgagcgacctccccaccctggagtccccgttcggatgattttctttttcgtaccgcacccaggtctcgctctaacctgcgctcacatatagtcattgatccgtatattcgcgatattggaatccagcgaaggagggccgtaacaatacgttaggtgcaccagaaggacagtgccccgccggccctggcgaacggccgcttcgctctaagacctgcgccatcgtcacgcggaaactttagagttatagctcgacgggaccatg

SEQ ID NO: 885 - DNA, 703 bp, Nannochloropsis_gaditana
aggttgtttcaagagtatctaaagcataacaagacgtttgtcatgcagaactttgcgtcatacatttaggctgagaaatgaggaacgcaatgaaaatcagagggatagggcgggctacgctccagagacaaatacctacaatacattgctatgcgctagaaatccaaaaaaaaacattttcttaccgcaatatttcgaaagtttcacactaagcaagaggaaaatgacatgtgcgtctttaaatctggccagtgtagggcgaaatacgtaccgcaagagcccgctctaagtcatcaagcagatcccctaaatcttgtcgagtttcaggcatgaattcaacgaccgacgggaaggctgcccccctggaattatggagatggcagcgcgtaaaaactgaagatcagtgacttcatgtgactgcccggacttcctatccgaggaagacgtcagtctccatgtagatataaaaaattctgtaagaatacgcgcgaaacgatgaaaagctcgtgacgccgtgtagttctggagggtactagtgtatttgggtgcttaagaagtgctcgcctcagctcgccaggtcggctcccacggctcccacgggagctctcgctgtccgttgcctccctttttttcaaagtctgtccgacttttccttgatccttcgcttcacatgtggtattgaattcctctgcacacaaatatg

SEQ ID NO: 886 - DNA, 703 bp, Nannochloropsis_gaditana
tgatatttatggcacggttttgtagtcactcgcaaagtacaattgctgccgtcgaggcaaactcgatttctctaagggcgtcgatctctttgttccacatgcacaagatgattcatttcaaacctacttctttgcgtcgttacaagcgtaattctcgtaccattcctttttataaaaatggcgctctcgttgtctgagccgtaaagatttttcattcgcactcaggcatgtttgccagcctccaagtgatagttgacctgttgggttgcgatgatgtgcttttcaaacctcacagacttgaagttgtcaaaggaatgttgagacaagagatttgtttaatctttgcatatcatgaacccttaaaatttttgttattgacgtcagcacagcatatactgaaaatcgagtgttcccaagccgccccatctctcctcatatttcgcctttggcggcattcttcttgtggcgccaccatgactacatggacatgtgtgtttcaaaccgtgtgcaagccccgcagaaaattcctttgtgaaggatgacgtgtttcacattttttggtccttgacgcggtctaagtcatgttttctcctcccaatttcatttgaaacaaggtgttaaaaaaaaagcggtcgccatcaacacccctctactcggacttcagaaagtgggtacttgatgatcacaagtgcgtgaagagatg

SEQ ID NO: 887 - DNA, 703 bp, Nannochloropsis_gaditana
agctcaaccttccgttcctgcaaaaattcaggattgaagcggccaaaccatttcttcgggggaagacggccggggaaatgtggaaaagaacgacacagggcctcgtgtaaatgactaaaatcattgaatcgccggagtatggaccaagactggtcgccgagggtgaccaagatagtgtagcgtatgaagcttgcttggcctgtgaggaggttagtcatggccgaggggattcagacggtgtatgcacggctcggttttgcgagaagaagagatgtcactatcactccttgagatacaatgctaaatcctaagtcgacacgaaccttggtcgtacttgacgatgatggcgtccatcacaacatgggtgattgcgggacgaaggccggggaggaggcaacgatactaccgacgttgcttttgagccctcgactaaggcgtaagaggcagcaacgagtggccctgaagtgggattcaatgctttgagtagagaagtgtgcgttaaagtatgccggttgcatcgaagaaaggacttgcgggaagcagtacaagtggaataaggagggagatcaagcggcgaggcggccgagaaatttctgcgaggttgtcgcaagttgctgcgtaacacaaagtgcttccccacacggcatcgacctccggtgttcatgcactaactgaacaaattattccttggacaggcagcatg

SEQ ID NO: 888 - DNA, 703 bp, Nannochloropsis_gaditana
acgattacatgtagaacaccactaaacccctccttacctgcaactggccctttaatttggccatacaattgggtatgtagaagcgcggagctgggtctcccgcgaatcccattttcatgcggtcagccccgttgtccagtaccagcgtgacgaaatccccttcattttgaggtctcgttactatgtttgtgttgttcgtattttggtgccctgagaaacctgtgccagaggctccgctggcagccggtggtgccatcgctcagagtgccggccccccgggatcctgtgtgagtccctgcgccctgtgagccccgcaccacctaggaagtaggacgcatttgaaagctagagaggggaaaacaggaaagaaattgagacagggacaggacttataagctacacgaaacccgtcttcatttcgctggcataaagcaacggagtagtcagagccgcagcaagggctggttctccctagctccgtagggacatgaatgcttgcggtggactgctccttgaccgcgccgcgtctttttgacttcgttctcgtgtgtagacgtcatagcccccttcacatgttatgacaggcgtcctgtatttcctctttccgtactggaagatgaacaaggaagcaccagcacttttaccttggatgctcacacctccctttctgctcaagtacagaattagcgacacaagcgcaatg

SEQ ID NO: 889 - DNA, 703 bp, Nannochloropsis_gaditana
ctatttgtagaggtaaaggcccctgtcgcatggcaccgttgattgtacgcagcaaaagcgaggaggtgctccacttggtattccaaagccccaggctgatttccggccacagcgacacgtccaagtacagccatttcttcttcttgcttttttctcgccaataccagcagaatattattatccccaccaagctgccaaccctgaatagggtcagcagcagccccccaatcgaaattgaaattgacatggccggcggagttgcatcaacctctcagccccgccccgtccctcctgactctgcctgtgacgccaagctctgcggcctgcgtgcaagggacagaatgagcaagcagagagcaccttcagcagcgcgtaaacaaaatgctttgtccggttcaagcggtgttgcagcccatgtcctaactctagtttaggagtgggagggcgggctcgagtcgctggtctcgctatcgcttcacaccaggggcccaacccgcaagtgccacggctcacgccagtaccccccgtaaatcattcacaggaggacgccggagaggttgaggcgtcgcgtcggaagggaagaaggagacgacaggcctgtccgccagccatatcatcgaaatcaccgcttattgcgtgcatttctcatttcgatccaccatagaagctgccgagggaacgtcacgtgctagaccgctctatg

SEQ ID NO: 890 - DNA, 703 bp, Nannochloropsis_gaditana
ccatggttggcgtgcagatatattcgagttggtgtttctgttacatgaaaacatgcacgtgttagtacaaattgaagtgacctggtgagaagatcataacatgcatcgtgtgggaaaaggagggtgctccttcgtcctcgtgaggccttcgacccagtatgagtaaaaggacaggcttcacacaatcactcatgcccagcacctccacggccttttcaaatccatgtagggtacatgaaataccgaacgagccgacgcaaaagagaaatttactggtccgccgcacagcgatggcgtgacttctgtagacgaagaggcgctcgagcttctcgggcggttgtttcctcccattccagtgcccgccggtaaaacaacgcggacacgcgatggaacaggcgagccctcccaaatacaactcatctcaccgcctttccattcaacctgcccgggaaaggggggggctgggcacgcctggagggagagagcacacatatttcgcgaaaaggaatccgctttcccaggcgcccgtgcgagcgaggctcccggtccacaaccacggcacatacccgtccctgcccacgcctgcgccgcgtccttgctcttgctgtcatagggtcgataactccatcatcctttctgcctttcgtctgattttaatacgctaggaaacctagccctccatcattcgtggtagcgcttgatg

SEQ ID NO: 891 - DNA, 703 bp, Nannochloropsis_gaditana
tcacgcacctcggtacattgggagatctgttcgcacgtcggctccgtcattcgccaaccacgtgggtggatggggactgccaggatctgtaatatccagcagcgggcaaggcttcggattgcggatgcagaaggtcatgaattcaagagcgtgttctatcgggaggatgacgaggttggcttgcacgaatccagggcagcaacctgccgtggtgcctgtgtggcgccccccccgaattttctggcgtaatgccgctggagtatcaaacgcatttggtgtttgcataatcatccactcgctctctcacattacgagaagtgtcatccaggcgtgtcgctctctgtgtgttgcagtagcccgagctcaattagtgaagctacgacaagcgcacgcgattatggacaaaaaggtaaaatgtcataatggctaatgggttaagttctgggcccagtcgtggacatcaaaatctctctctttcatgtaattccagcttagccgacccaggttgggtattcgatactcgccgtcttatcggaaggagcggattgattttaaatatcaatttcaaactttcaacggttcataccctttatcctcgatctgttcacaaactcctacatttgcgcatatagttgggggcatgacagattaaattttataaatatcattattaaattcttatgtaggtgtgatggagttcttg

SEQ ID NO: 892 - DNA, 703 bp, Nannochloropsis_gaditana
tgatacaggccatctattgcaaatagttgatccgctatcagttcaatattaacagtcaggcggttagatcggtcttgaatgattagtctcttttgatgagtgtcgacgtgaacacaacgcccggtcacccgtactgatcgttctcgtgtccgccggtagggttcaggagatcggaccagctcgtgcaagaagacaatttcgccatgctggatggacatgtcggtggaagccatagttgaattgtacctagtgtagatgcacgatgtgaattggtttttgagttggttctcgaacgagatcgcagtcggctagctgtaccgcacgccctcaagcgctctgagctcgaaggaggagccctcgccccgtccgggagcagtcaggctcaccagaagcgagcagcccacgtcacttctcttgtcacgcggcaccaatcagttcggttgtccgtctccatcttttatcaacgatcgcatcgatgggagcgattgcggcaagagacgtagcatgtttgtctatattacctgcaatagcgtaagctcggcgacaagtccgcccgcgggcgtcgcgagcttgaaattgagcgaaacgggaacgcacagcaaaatctctaggttagaaattcttgatgacaatcaatgcacatttctactgcacaggaagaaagaaagaggctgcttgaacggatttcgaagcgtgcatcatg

SEQ ID NO: 893 - DNA, 703 bp, Nannochloropsis_gaditana
ggcgcaaaaactcagcgtcaccatgctcgatgacaggtttcagattatcttgagatacttcttgaccactccacgtcgggtattccacttgtatcagaagtctacaaaagcaagaacgccgcgcggtgtccttcgcgggcgagtttgaggtcgaccacagacgcaacgggaggtccgggggggaaagagggaaggagttcccggaaggagcagagacggtgatagggcgaagaacatccgatgaagagtcgattccatccatctgttcaatgagaagaatgagaaggtaggtctctgtcagcggcatttcaaggcgtgaaatcaaattgcgattaaacctcacgtagaaagcagtaaccaaaggatggggcgattttggtagggcatcgccgacgtcgttcaccagacggcccatccgccgcaggggccgggcccaccggcacgattgaccgcagtcaaggccgtgaaaaggctaacttcatgccatgcacttttgatctgaccctactcagccgtatagttatcatggagattgaaacagtacagaatcccatctatatcgctgctcttgcatcttacaagatgtgcacccatagactgctgtcgcctcgtgcttaccacaccgtgttcacacccagctagacctggcaggtttgtttacagtgagtcacttccagacacatcgaaaaaactttgcagaatg

SEQ ID NO: 894 - DNA, 703 bp, Nannochloropsis_gaditana
acatgaagtcagtatgcaacttctcgttcccacataacccgcgacgaaagagcttatgctgtcatgcttttgtagtggcgggcgcatggcgagcctggctgtggctagagacgaacccgtctagcgatgttatctcctccccctcaagccatctttttatacattcaatttggctgattctgtctgattcgcaaccatgtcacgattctgacgggaagagatggacggcgggccatatgtgttggattatcatgcgacttccggcctttgcaggcctttcctagtctacttgtctctcgcgtttggcaaggcgatgatgatcttcgtttaatgccggtacacaccctcattacaccactcctcggcaacaggcatccctctgaacatgacttggctgggcaagagtcgccgggtcgttcacttgtgcctcttccccaatggattgcgcgccggtactgggaagtcgagaagctctttgggtcggctcctggagcacggaccgcttccggcctcaccagtattcccgcacggtagaagaagcattagctgcggcaaaagaagcagcaggatttcaacgttccctcaggtatcgagactagcctgtttccaaccaggagcagccccgctgtcctctccgcagcgtttgttcagctccttgccgccgcaccaagtggtaggcctccccgcactctctcccaccatg

SEQ ID NO: 895 - DNA, 703 bp, Nannochloropsis_gaditana
gcggcgggcggcctcacttccgtccgtgtcgtcctccaggcgtcttttatcttcacctgtaatgcctggagcgccgaaatcagttccgcagcgagagggaatgtgcgacgacaatgctgcgagaagagggcatttggggaagctgaggcggatcaggcggatcccgtttagtgggcgaaacggcagcaagtctatatcgggagacagattccttgtagccgtgctcatggtggccgtaactttgcttgccaccctctggccgatcttgcgggtgcaaggcgatgtggccccccttctacaccagcacgcagcgtccgtccaacaactagggcaggtgcgggcggtgagacgagctgccacggcccagccgggggcaaggacggctacgaaggacgcgggaaatcgggacgcgagcgtcgtgatcagcaccatcgacggcggtgtccacacggtggacgcgtggacgggtgagctgaagggtcttttctactccggcccgcccctgtactcctcctccttcttcttgggctcaggcacgggggagagcagcgggggaaagcgagccaacgatggtgtgaaggcccgggagagcaagtactttgtcatgcccactctggagggacggatcgtgagcgtccgggacgatgggagtcaagaggtgctggcgccgaacattctggaacttttggacacgcccgtcatg

SEQ ID NO: 896 - DNA, 703 bp, Nannochloropsis_gaditana
aggctgaaaggatcaagtaacgagcagctcgccaggcacaagtcaaccctcatatgtcaatcgtgcaattttgacgtgtatattcatgttattgggtctatttacaaagttagatccgaaagaaaaagtaaagtgcggttgaaatgattgctccctaacggcgcactttgtctaagcccgtcctaacccaagcaagaaatttctgtaaggaaaattccggggcccaaagcccgagatcccgaggctccgagcctggggggaaggaggaggacgagaaacatcatcacgcaggcttcgagtgagtggaggaagaggacgagaaatatcatcatgcaggcttcgagctattgaaaccgaaaaggaacgggatcgtgagaagccagagggacaacgcggcggcaccgctcacgcctcgcttacgatacctggtccggtgttggtcgacctcccctttcccgtcaaatccaatctctgaccacatccccacacactacacatgaacaaacacagagggggccctaatgtgtcatcgtggtggtggccatcgcatggacgtgctttgtgaccttgaccatggcagctaaaaacaaatgggcaagggctgccgccaatgtaggtgtgaagaggagcgctccgggccccaagggtagagacaggagagactctaccagctatggcgtcggggtcagacgtggtcaagatg

SEQ ID NO: 897 - DNA, 703 bp, Nannochloropsis_gaditana
attctaagcttccatgctccgggtgaaaattccccaaaacactgaaagcaacaaaaacacacccacaaaggactcctgagcattcatgtgcaggctccacgggacgcagtatatggcccgcggccgacgggcttgtatcagccccctgtcaggctgctattgctcatgctaccactcggaagcaaaagacagtttctagccaagccaacgcgcgagtcgcgttattgcttgtccatcatcaacgtccaccgtccttcccgcttgacgccctggcgtgcgcggtagttgtcgtgtgcatgtcttgcaagtctggggatcaacggcttcggaaattttcagggggtacggtcgctctggtcagcaccctgccgcccccgtcttgccccgtgcttaatcctccctctccacgttcaccattcccaccgacgcaaccacactgatccctcaacaaccatcacaggagacgaagatgtctgctagtctgggctatcaagccgcgcgaaggctcatcctgggcggagccaccaggtacgacttaactcgagcggataggaaagtcccctcattgagagatgcggggctgcgcatgtgcgcttgcggggtcacttcttgaactatccattccttattcttcctgccatttaaatgtcgtctgactcatcgtcgccctctctggccggtggcttttcccaactccaggatg

SEQ ID NO: 898 - DNA, 703 bp, Nannochloropsis_gaditana
ggggtcttttgctctgcttgtcatggttgtggtggcgcttggcatggtcctggcggccgtggccgtcgcgatggcgcggtggaggtcatggcgaagggcgtggacggcgtggctggggggtgaaaggcccgaggagggggcttacgcaggacaaggggaagcaggggccgtgggactcgatcttcaagagaagacctggcacgcacatgcgcagcctggcgtggattgtgatggctccgaggcgaggcaaagtacgagtccgactccccggactccttcccagctatctccagcctcggagagcaagtcgatggagggccagccactgcagcggcttcaagctatgcaccgtggcgttggccttcggtcgtcttggtcctttgatacggcctcggaaatcgtcccccatgccactccacgatcgagatcgagtcgagacgcgcgggcctcttctaccgctccggttctcgtcccgccgcagagtcagatcaacagtggagcacagctgctgacaggcacgacaggtcctgcaaccacagcaacgggtgttatcaataaaatgaatacaaaaagggaacagcgtcagctcaaacacgccgtgcccttgggatctcaaaccgcgccaaagccaacgccaggactggacgtgcaggctcaaaatctatccacggccgtcctctccgacgcggagggaaatccgatg

SEQ ID NO: 899 - DNA, 703 bp, Nannochloropsis_gaditana
atattatcaagcttggttggaaaggttggcacccgaagacttgctcgcagcggctgtaggcaacgctgcagcgcttgtttcttcgggcctttcgcataagggggaagatatggggactacgtggcatggagacaatggggagggattttcttccacgttttccggctcggaagccgaaagcatgctcagccgggggggcgggggattgagcgctctgtggtcgaggaaaagagggagagggactcgaccgaaagccttgtctttacacggagacgatggagacgatggagacgatggagttgaccggggggacttggagaacttggtcagtggcggaagcggagggggctatggcgagggtagtgaagacggggtcggcctggttgagccagagaaagggatgaaggtaccttattcgtcatcagcgcgcaaagctttgaacggcacgaggcgtcatgatcttaccccgccatgcgcaccaaacgggcaggaaggagaagagcgggacggtggggaagctgacagtcataatgataggggctgtgagttagagacaaaaacaagagggagagtgcatgctagcgggctgccgctatcgaggcgcacggcgtcaatggagtctttcgcccggcggacagcgcttcaacaacatcagggaggaaaaggaaggggagaacaaggaaggcgggaaagcgttgagatg

SEQ ID NO: 900 - DNA, 703 bp, Nannochloropsis_gaditana
gacagcatgcacgcggttgggctgacaggggcaatagacaacgtcggctgtcggcgaaggggagagcgaaaagcgcgcatggacttgatggcatttttctttttttttttaaatatccactcgttttgagcccttcgatggcttttcctggccacactagactcgtatagagtgttttgacaccctggacccaaagagatgcgaatcccacccacccaccactagcccatcccgtgtagccgggagccaccggatcgaatcgaggtggtccagcagggccccctgtcggaaaaacgtatttcctttcttccccatgaagaatccgcaagcagaggagaaacgcgtcctagtctatgaacatgttggaaatcccacaaatacggatgaaatatcattaaatggactaacaatttatcttgcttccacattttcgtttgtcttggcgcagttacaaggtgtaggaacccgagccgagcccaacaatttgacaaaataccgaacagacgtgcgaagaatgatcgggcgcgaggagcatgctccgacttgtgtcaagcgggttttgataaccggcggtgcgggacagattgcatatgctctattgcctcacttgatcagtggacgagtctttggcccccaagtccgcttaatggtgcacttactcgacatagacggtactgagaatgcattgcgtggtgtgcaaatg

SEQ ID NO: 901 - DNA, 703 bp, Nannochloropsis_gaditana
gtgtttcccagcctggcgaacatgttacagaagaacgtatttgtcaaaacgccgcgactcgaaatagaaaagggcatatcaaatacagtgcaaggtgtttcatggacaacacgtactctttcttttcctgtgcagccgcaacgttctccggaagcactccctcttcttccttgctgcctgtctccatccctgtctcgtcgctcatgtctccaactaattagtccacggttcctgtgagtgcgccacgggggatagagcgctttgccatgcgtgagttgagaaacatggtcgcaatgtgctcaatgcaatgtcctcaacagaggcgcagtgcgcgttgggtgacgatcttgagcggtttgcacatgattaagtggtgttggtcagcgaaagaacaacgatggagaggatcgatgcgacaccccggtcacaaagatgttgcccccgtgacaacttggttgcaacaccagtaatgacaccatctccgcatagctctatcttccttttccttgaatcacgcgtgtatttttattcgatcccgctgcaaaaggtgaagggcggcattctcgtcactatgttctgccttggaaagacactcttccaagcttgctcccggcatatttcccgtgtacatttccgcgcacaagcactctgaattgcgaaatcctccatccatcaatcaccaataaatacaggctgtatcatg

SEQ ID NO: 902 - DNA, 703 bp, Nannochloropsis_gaditana
cccagctcgtcgactgacatgggatcgaaagtgaagtttgagtgaagcagtgagaagacaggtaagaccgcgacagagtacgtgtcaacccaaaaaacgacgtcgacgagccttccctgtcgatcttccgcgtgcaatgcattcgttgccataaacgtgtgatgattttgttaattccccgtcagttcaacatacaaagtgaggcaaaaggcacagtgtttcttgctgtgcgagggttgcatcgcgctcgggaatgcagaatgcttccgagagcgataccccgtggaaagttaaccaaaaaccccacagcccgcacaacgtactcacgcacaagcgtgccatgcattcgtacgttgtgcgaccgtcgcagaagcaccaccaaatattttccgagaatttgcgaacttcaatggtcatgaatattaattgcccgatgatttctcctcgcatccaatattcatttggcgtcctcgaactcgcgagccgacgggcgagggaaagtggaaattacgtaaacaaggaagaggattaagcgatggagaaacgcgctgcccgtccaatgctccaatgtgacaagcgggccttggcaaagcttgcggggctcgtaagaagaaatcgtgccaccgcacgcagacgtgtgttgagtgttactatcctgtcaaactcacagcacaatccgtccaaacctctgttggtcagaatg

SEQ ID NO: 903 - DNA, 703 bp, Nannochloropsis_gaditana
aagacctggagacgtagctggaggaggcgtgctagagacactggggacggtagaatagggcaaatgtccacaggaaagcaagcactgtgatggtacaaggacggaggataatagccggaaggcttgctgcctgcaacagggtatcgcgacactggccgcctgcgggggcatcgtggacgagacggatcccgcccaccgattgacgaaatgtcttagaagcatgaaggttgtcctatttatatttcatgtcgtacgggtatgatcgaatgagagatgccaaaaggttgtaccagtccagggtgagaaggagagccgcacgcacacaaactgggggcccgagaagtcattcgcacatccactatcaatgggacagtcaagtgtgcgaactgcattggctcgagaatatctcacagggtctatcaaagtttccaaaatagtcttcaacaaaaaggaggtgatggcactcttccatgtgttgttcacctacggctcgccagggccggtgtggatggacctcgagcttgagaccttccataaagcactgtaccaacaagtaaaggttgctcgttctggtctgggtgcatgggtgtcttcgttgatgcaaagaaatgcatgtaatgttttaagggcgcaaggacgctgtgtggtcctttcatacccaactttgcgtgctgttcgatcacttctccgttcacccagaatg

SEQ ID NO: 904 - DNA, 703 bp, Nannochloropsis_gaditana
gccactccgtgagtgacggcggccacctccctccctcccccggcgcctctcatcctccccgctttttgactcccgtgcgcgctgctgaagccttgccgaggcggtggccgcagcgtcggtcatggaaggcgaatctgtggaagagagagggtcggaagacatggccagagaagcatttcgcggggaccctctctcagaggcccgagaccggctgcccgtgtttcccacccttgcctccctcggacccacccccccggacggcccatgttcctcgtccttcttccgccgcctcaccctaacctccaagccccccatcaggtcccggtcgagctttagggccgacacgaccgctgcctctgtcccgaacataacaatggcgaaaccccggggctcttggctcgtccggtgccggggcaccgccaccgacaggacggtgccgcagtcggccacgaagtcccgcaccatttcctcggtcacatctttgggtaaattgttcatgaagacacccagttccgggcgtgccgccgccagcttcaaggggtcctccaacacctcgtacaaggccaggctgcgtttggcggccgcggccaggtcgaacgtgaaggtgtaccgccgagaggaagtgcccaacgcgacctccgagaccccagagtggagggccgctcctttgaaaggctccaggcgacgctcatcgagaaagctc

SEQ ID NO: 905 - DNA, 703 bp, Nannochloropsis_gaditana
gtacagagaacgaggtcatacgtcgatggctttcgataggaacggggtggctgacttacaagttgtttccatctcacacggctagctgtcgaggccccttggagcgtgaacagtggaccagaaggaagccggttccctgaccaattttcgagaaaccgcacaagatctggcgtggtatgcgtaaaagtgcgagaaataaaagcgtgaggatgaatttccccgtgtttcaatgtctttgggtggtattcaagccgggccgctggcagcagcacggcgaagggggtgaaacgggccaaaaggcgagcaatttaattcatggacccgcaaacgtggcaattgatcttgcattccgacctttcgatccgttgggcccagacgtgccttgacggcatcacagcgtagcggcgtgagcatttggaaacaagtgtgccatgctgaaccattcagtgagaggtttcaaagccttgcgtcttttcttgtgggcccgtgtttgtttctcctcgactcccacctgggaccctcaacaacatccgcacgaccaaaaatgctagtaattcacccgcaatcctcatttataagttataaccataccaacagttgacgaacacatctgcatggaagctgagtggtgctaagggctcgggtgttcattgttaattccttcacaagaaacccctagggcttggttattaggcgcgttatg

SEQ ID NO: 906 - DNA, 703 bp, Nannochloropsis_gaditana
tttcgaaagcgtgcttagaaagtcgtactctcctgtgaaagccgtgatacgcgactccaccaggcgcctggcggtcgcggctgaatcgtccagcacccttacggaagctttcttatcggggtcaaaaacccggcggtccacggcactggccatcgccagccgtctcagatcaggtaatgctgtggcaaagtactcgtcgtgggccaggtggtcgttcgacgcttggaatgaaaacgagaaggaagaaagcctgctgggagacttgctacgtgttcatgtcccgtcctgtgttgcaacttgaagagcagcacgccagtttacgaaggataaaagttattgttatgttgtgccgatggatttgaaaacaggacgtgacttaagccatttcttctgccagcaggtttgtcgtacgaatgcttttttccgacttggcgagaccggtcgcagcacgatggaatcgctaaagccaatcctcttaccattaccgcgcccgtcttttggaagcatgcacatattcatttacgcatccaactgcgatacaggcgcccctccttttccgctttagtccggctggaatttgttggcggcagaaacgccgaggggcgggtcctgattgctagcctgcttattgaaccggtacatcgtccaaaaatcaaggccttcaactatccgtcgttcatagtacaactccatcgtcagcatg

SEQ ID NO: 907 - DNA, 703 bp, Nannochloropsis_gaditana
ggaagatgcatcggaaaacgccatggacggcgggggggtgtctgctaggggaggccagaaagtggcttgaagcaactgctcgactccagcaaattatttatgtatcgctcaagaaaacgagaaataaccgagccacatacgaccgcgtgctttcgacctcgtcaatccgttttgacatttttacgggcgtctgtgggtctactcatgccgcataattattctcacccgcgccacacacgcgaatttaggagccatgccaagggatgaacctgtcgcggatgcgtcgggtccccaaactagcacgacagcgccttctcaacgagaagccccttcacagccctcccaagcacggcctcaccgacgaccaaatcgcagtggcgaacatggttctcggcgcacccgtcagccacgcactgccgttaggatgtatgaacaattgatctcgggcattattcgtcccccaagacttacgtaccacttcccccgcgcattgggccccacgaccatttccttctcggatggaacagaatgccatcgcacagactttgaggtagacaatcaccgcggccagaagctaggctgcagcctgtggctacccagtggcgcaaaggcaggaggaaagtggccttgtgttgtctatcttcacggcaattcaagtagtcgcgttgaagcagtccgtactcatgtgctgaacgcggtcatg

SEQ ID NO: 908 - DNA, 703 bp, Nannochloropsis_gaditana
ttccaaaggttatttttgcaggttgagtgaccacgttcaagcagtggagcccgagcgagggaggaaggcatcgctagaacaaggaaaaaccggcggaagtccgcctttagacactgttttaatcactttatttggtgcgcacacgccttcagaaatactcacgttggacaccacatcacacagctcgtacttcgtctatgcgtgacatgccagcgcgtgtctgtcctgcatcatgagggaaaagcagctcaatccttcgagaatgccctactttgaccgaaagcgacgaagacgtgctgccatggcatcacaaaaatactcacaatgccctcacactttcaaaactgcttggctatttttcctgtacgcgatcgtcgggtgctatttatcccacacatgcaccgcatttcaacctccctcgtccggcctcctttctcggcggtggagtgcccgggagtcagtgccctccgaggtctcctccgtcgacaacgctccgcccacagaaccagtcccatccacgaaacccacggaaccagtcccatccgcgaactcgttggcagagcctgctgtaccgtcttttttggcggcatggactcccccggtcttgcccgacctcagtgcgttggggggtagtgtcagctcagccgcagagggggcaaactcgacgcttatcggcttgttgcaagtcgcgcaagctgcgatg

SEQ ID NO: 909 - DNA, 703 bp, Nannochloropsis_gaditana
ggatgtatcgcttaccacgtgggagtctgtagtatacgcggaaggccgagagcattgccaacagacacgtcgcatcctgggcgggttcgagcgattgttgaaccgacctcgcggtccggcgggaagaaatgcttctgatgagaccatacccgtgatgtgcacaccctcgatatctgcagaatcccatattggcgccacaagaagagaggcggagacagcggaaattgccggaaactcggcatttgcaacattaggcaccagactgtgctgctttaatccccgcgacgtctccctttcagtggcgcacgataaagagttttgggtttttccagtggccgaggcatttttgaaataaagggtggtcaccttattgacgcacctgtaaataggaatgcattaacataaaatgccgaccaggcgagagaaaagcatcccatgttggataatgcctcaagtggaccaaatcacatgaattctgttcttgtgtgtgaagaatatgttctacttcgatcgaatataccagttattgtgcatgtagaagcctatccttgataacgaaaaatgaccaatactgcttccatttgactcgcttaccatcctctcttgttcccctcactcccccactactcccaggtgaagctctctacattccgaagtcgcgattgtcaggtcttcatatgtacatcacccgtcctgatacatg

SEQ ID NO: 910 - DNA, 703 bp, Nannochloropsis_gaditana
acggcatcggccatttgatgtgtgttgagcagaacgtcctcattgatcggctttcggggagggaggaggttaaagagcggcgtttcctcgccttggcgactaaatcaagtagaatgccacagctacaatccggtttttcgtctgtaatcacacgcatcaaaggagatgtaccatgttgcggcatcaggttgtgttgaaatagccttcactgagcagcctaattgagtaactggtgcgacagaacttattttccttcaaattaagagtatccatgtgcacttctttgagaagtgacatggcttttcgatgtgctctttgctctcgaagaaatgcggagactgatattttgatcaggagtaaatgtcaaaaatctattatcggcgcaggttcacgacagcaagggatgctacgacgcgggttgaggcaacaagggggccatcttgctttctattgccaaatttccaaggatttcagacgaagcgaaactcaacatgatgttggcgacaaacgatataaagctctccataccactgtggcggcatccgctggcttggacgacatgagaagacgtgtctgtggttttccaaagcaagaagagaaggcgttgaattggccactcggtcgaaataaggagatgggaagaagaaaatttacctcactaccaagtcctgagacagcttcaaaaggggatggaaaaagaatg

SEQ ID NO: 911 - DNA, 703 bp, Nannochloropsis_gaditana
atttaatttccaccagcttctgacaacgatagtcctcctttcgttgctattatcgcagttccacttcaacattcttccacccaatacttcgacggaaagcagctatatggagcctctcacaagaggctcaagtctagcagaagcctcatgtgtctgcttgggaagtgggcgtttcttgcgggctgttctggtccccgccgtggaagctgctggcctcaaaagcatcgtattccagacccgtggtaattccttcctatccatgatgtacggtccgcgaaggagcaagggaagctacgaagtagacacggtggagttcgacggacgtacactgaccactagtcaccctatcattgcggcgggtacattgggaactgctgaggggcaaaaagcctgggcggccctacccgcccaactgccccatctgcgggtcattggcgtcggtgtcacagaggcaggcctggcaccaggcaccgctgccatgaaagatctgtgtcaatttctgtatgcatgctttaaggcagacatacaagggccgttgagcatcatcaacacggacaatgtacctggcaatgggcccaaaattcgttctttcgtaacggaacctacacagctttcaaaagttacagcgttgccggaaacttcgaaggaaatggaagatttcctctcttttcttgataataaagtggtgtttcacagcacgatg

SEQ ID NO: 912 - DNA, 703 bp, Nannochloropsis_gaditana
ggtcttgaaatgtgggtgtggacgctgaagaggctgcatttgagctttcttcttctgtttttgagcgatcgaaatggccggcggtagaaaatgccttgaacgctctgaccacaggcgggcgacagtcccgacgagtcagaactctcgtctgtggctcttgagtggacgcagaaaaaagacggaccagcgtcgcacaccgacgatgccccctggcaaacgtcggtaacaatcgtgccccttgcatgacgcaagacgccctgtgttttccccgatgggttcgaatggtgggttaagacagaactaaggatggggaatcggaagtcgaaggtaccttttccatcacagctagttagcgagctccgaggttgcaagcgtgagcttctggttgaccctgttttgtagtgtacaacgacgcctaaaaatgctttacaacaagagtggctttgttgaggctgtgtcaatacacttttgatttttcgcggtgttatttggctgtcacttactttccaggcggaaaagggcactggcctctgtacagcttcaattgcggttccaacgacagaagatgaagcagaacatttcaacaactgcgagggtgctctccgtatttttcgctacaatcgacattgtcgaatgctttcatgccatatcatccggctccgcagccaaaagcattggaaatattgtgctacactcgtctcca

SEQ ID NO: 913 - DNA, 703 bp, Nannochloropsis_gaditana
cacaagcaccggcaggtctgcccacagagacaaaaaaagcggcacacgcacaccatgtgggttcgaccctttttttcgcttgtttgtggatttatcatgtttctcattggcttctccttggtcttaaagtgtcacgaagctggctttttccgcctcttctcaacctctcctgctggaaaaggcaagttgtctgacccatttttaatctacatcattagacaagggggcagaagagggaaagttgtttatcaagagtatgcgggtgacctgccctacgctgccgaccatagccatgatggtgttgtcggcctcgaggatgactcagggttttctggtaaaaagtgggaggctttcatcatcatcgctccctgtgacaaggagatttgccgtcacggtcgagcctaaatcgtcggcttctccagatctttatcagtgtcaggcggggtttaccgaggatgagaaagaagctgtattctctttcgaacgccgccttaaggactccggtattgacgctgagggactggagcatgccctcttttggccacaaggagacacagccccctcccgaggtttgaaaacaaacctcaatatacctttgggcaaagttttgataaaactgcctcgatcacaagcaatttgtttggatgaaggagaaagtactcccttcccacaatgggttccccaaaagcaatggaaaaaaatg

SEQ ID NO: 914 - DNA, 703 bp, Nannochloropsis_gaditana
ggtgttgtacataccttgcgctgtaagtcaaaaggaattgtttgtgatttccaaggcaaagagctttgacgagcgtccatcatggccttggcttcatgccaaaagccttcgtaaatcacgactggtctattggaagacggagcaggaggcgcgtcggaggagacggccgataaaactgcgcgtgatctctcaacgagaggcgccaaaatataaaatgcccgcgaatggctgatcgtaatgagaagtaagattgtcagggagcttgaatgtggcacatggtggggtaatatgaccatgacggatgacgatgacgtgtcgcttcagccttcctgtacgtgatgcttgctgagttagaaagccaaccgagacaatgctcgcgacgacgagagctacaatactcctcagttttgcacgaagcgactgaaaccatctcaaaacgagaccagtccagtcgggaagtgtttttgggggggtcgccgcctgcgctcgcttacccctctcctctccctccctgcgcgggccctcgctcttgctgcctgatgtgtctcgggcaaaggctgctaggttgacttcctaatcggacgttgcacgtgagttttcgaccgtcgcttgtatgtccatctcttctcttccccatggtaatgacatataccaactgtatttccccgtgttaactgatgtatttccctttggccctcctcag

SEQ ID NO: 915 - DNA, 703 bp, Nannochloropsis_gaditana
gtgcacctccgccattttcaacgattttaagcatcacttacaagctttgggcggcaaatgcagacagacacgccgggcaccaaatttgagcgtgcgttatgcgcggctcacggcccacagccctccccagaatttgaactttcggcgataggacggtcggcgccgggagcagaagtcctcgacgattagggcgctattccatcaatgcggagaacatgtgaaaaagaattgtcgtccgtgcgcgtgtgcttgtgggtatccaacaaattgtactgatagctttccggcctccgatgaattgcgcggtagatgtgacccaataaacggagccgccttcgaggatcccagacctgaacggacaacataaaaaaaaaaccaaaaagccctacggcgggtgccgaattttgcggagcacttgctcaatggtcttctttatcgaggttaacaacaatcaaaatggattatggctgcacgtgaacacccaaaaacctataacaggccactcttgtgctacgagcggatgctgacttgtgtcgtaacgcaacgtatgaccttcaaccgacagtctcaccccctctctcccttatcgttgcttcaggagcggggacgaggtgggccctcgcgcagacattgataaatcatcgtgcagaagtaagcagtaggggaacagggtccgcattttgtttcgtggtcaattgcgatg

SEQ ID NO: 916 - DNA, 703 bp, Nannochloropsis_gaditana
acgggaagctccgaagttttggaaaagaaatcggaggaaaggcggcgttgcttcgtcgagtaagcgcgctatcctggcagacagaacgagcggatccggtgctaatacagggttcaagagctgcatcgtggagcgggccatctcctcgtatgttggggacgaagggggcggaggagcgtcatgtggagttatacttgccaatttcgtagccattgcacggattaggagacgttccacagcattgtctggtctaggggggggttgaggcctaggcggtgatggtcgtttgctcttcaccgggaccaccatggagacagatgaaatgacaaaactcaatccaagggtgacaatatagatcttttgcatcctatggagaatattttgttttctggtttagccggacgttgtgtattgccgtgcacgttgcctgcaacgtagggtaacgagagggaggataaggatcggtctgtcggcacggtatagtagagagtatacaagaaactctctctagacagcccgcccacgaattaaagaacagtcagcacgtccttgtcattcgattcctctacacacagtagctggaagtcaaacgagacgtgtttctgaatgttcccgccaccctcctttgtctcgcatcagatcccagttaaccagtgttggttgaggggccatgccgcatcgctagttcggggaagtctgaatg

SEQ ID NO: 917 - DNA, 703 bp, Nannochloropsis_gaditana
gttctcaaccccagcatcgtcctgcgcgggggtgtgctccgaagccaccggatgacccgccgcatgggaagaaaagactacttcttgacccctctcttgagtcccatggaacggaagaacgacttgagacaacggtgccatgacttcatcatgcaccaaagcattattgtcatgaccttggacgcgaaaatcctcatgccctgtcacgaccaaggaaggggagaccgggcttccggggaaggagggcatgcctgcaacgaggcgttgcgagacgtgtggaattccgtttccaaaacctgcgcgtggtcgtagaacagggtgtggatcacgagagctgctgatggaggactgaacaggagacgatggggcggcatggccctctgaacgacgggcttccgtcccgtttgtcaattcagtacggcccggctccggattcgtttcaggagccatgatttttatgtagcacctgttgtggaaaacgcaagcatgtcgtgagtcaaagcggtacttgacagcagaagatggttgcttctgtcatcaactttggccgtcaacttgcaggcgaagaccctctgttcctgtcgatctcgctcattagacaatcgatgggtatcaacgatacgatcggagtatcaacgcatcggctccttgcggcatctacttgggatatgcgcactgacatttttttcctcccaggcacatg

SEQ ID NO: 918 - DNA, 703 bp, Nannochloropsis_gaditana
agcgatgatcgtcctttccctccgcgcccggatcaggcgcataaaggcggggactcccggaagtagattgcaaggaaccgaatgagagggattcacctgggctggtgaaaatgatagcatttgaccttggtcgtgcacggtgtcaaagctaggaaagcgggagacgttaggattgggcctctcgcctccccccatggggaaagtttttttggctgcttcggaataaatgcagaattcgatgtgcaaagtccatcgtgcaccccgatgcacccggtactctccatccacgaccctgtgggttcgaatggacgaatgtacgcaacaccatgcgtacattttttcgacggatggattttccacatgcgccggcaagaaagtagaggaagagatgctggatctaccaagatgcacacattttgactcaaaagctcacaacacctactaacatcatatgctattggcacagggatttgggcaagtcgctgctttagcaatttgtagaatgctgaagtgacggaagagtgaatttttttccaagcatacaaactgaatttcacgcgggaaggcgccttcaaacatcacctgctggaaacaaatcctgtcattccgctactggtccaccgtgcccctcacgacagatagcagccccaaagattgtaagccatcgtcaatttaatcgatctgaaatcaaatataaaagatg

SEQ ID NO: 919 - DNA, 703 bp, Nannochloropsis_gaditana
gcgtcttgttcccctgactgtattttttttgagctgatgaaacgtgcttgctcccgcacgaggctggcgcgctccctcctggccccattttgcgccgaccaaagtagtagggacgctcgtcccagtgcatgcgcgtgacttatgcgatgctccacgtccctgtgcgtaacttgtgaacgtgaagatggtccacagggtggtgttgagagggtggtgcatgtaagtttagaggagcgctgcgcatcacacggcttgttcaggcgccgctcacttcatcgcacgtctccgtgtcactcatctcgactatcaccacgacatgacacaccaacacaggcaagccacccacaagtcgcacccaactcaaggtctgcaaacttgtgcatgcgttcggacgcgctcagattgagaagagacggtgtgcccgcgcgttccacgcccccctgtcatcattaccaccatcaccatttccagcagcatttgcgctatctcgtctacccgctaacccgggacctaagaataggagccattagcactcaacgcagcaagagaggggatcgccatagataccgatcgagtggtcccaacccgggcgtgtgagcaaccatcattaaacattcgtcgggtaacgcacaacagactcggcacacctcgatatagccactgtccaggcgtcaagtgagcaccacgcaccccgtgaaagatg

SEQ ID NO: 920 - DNA, 703 bp, Nannochloropsis_gaditana
cgacagtcgttgaatgtcttgatatgtcctgacagcaagtctcatttcgtgcgtgcttgataacaagatgatgacatagccgtgctgggcatttcggtctctgccaagctttcaaaccctcgcttgtttgcggccagggggcgccctacagcaacttactgcaccctgatctgattcgtttcacacaataatcgtggcgtttgatccatccattgtttggcatcaagtaaatcaaatgaataagtctgcttgttttgaataatctttaatgggtaatttctcaaatatttatggaaaccatgagatagattgcctatcttttttgtgttgtgctttagcagcttttgcaaggatgtcgtgaggttaaaacggtaatcgttcacaaatcctgatcaaaaattaagcttagtacaagtcgtacggaatttctcccctttgaatttgatgccggcatgttccgctcgataagtggatgcttcaaaatttacgtcgcttcactatgtctgtagcaaagatatcttgtcacatgattcgtgtcaggtaatcataatgccatagtggtcagcaattttgccttgtggtcagtttggagaccataagaatccacttatttatcacttctctgactttcgtcatcccttctcctcataccaatgattttatgtatcagcctttcttatttatcaaagccgctttaaagatg

SEQ ID NO: 921 - DNA, 703 bp, Nannochloropsis_gaditana
gcacatgaaaatatgggatggacatcgtgtttgagcttatatgactttcacatggcccgaacgtgagggatccccccaaaacattaaagagctatcaacaatgctgatgtacgcttctctccctccctaccttcaccctgcgcttctccgtgttggtggcatacattttgctccagtaaagtctttgcactgttgatgtaaaaatggtgagaaaggaacaagcaatttaggcgacaaaactgcagacgagcgatcgatgcagctttccagtcatgcgagtggacgcgaaatgccaacatactttcttcccatgatgcgacatgcgacatcatataaaagtatcgtgcatctggaacatgcaaagccacagcgtcctgccaggaggacgggcgtgccggggactgtaaagtgacttgaaacagacgcgaggtcaattgtcgtccctgatctcgatgttgaaaagctggggtttaatttgtgttgattgctcaactcgtgacagcgtatctcacgtgttttcatgggagccaattttcaatgcgcgtggtttattatttgattcgcagcgtgaagaccggggcctcacactcccctctatcacatcctcttaccgcctccgaagtttcttgctcctccctctccccgacaccctctgctcaacaaaagagctttcttgtgcttcaacaacttgttcacgaccatg

SEQ ID NO: 922 - DNA, 703 bp, Nannochloropsis_gaditana
cacagtacagatttttgtactatacgactcgtgatcaaaaatatcgtctcctttccttataagacgagcagatcaacttggagatccttattgtatttctcattgtcgtacatgggaggggtatgtagcccccctctcccactcgctagccccgttggcatcgccggcagcggcacgctagcgtggaaatagatcgaaaccacgaccagtgtcgtcctcgcaggcatgcctcgtgagacctgtggatgtcttcaagaccgcttcattacggcgtctttggattttacaaagggcctccctggatggggcaggaaggagtatcttcctaatgtccccccaggttctcttgttgccatggtggtggcagctaccacgcacacgtccgcaagtccctcacgcccacttactgtggccctacgctctatttcacctttcaaacaggaaagatagaagttgctttatacgtaagaaaggctctcgtttccgctgaagctctggccctgccttcttaagtcggttgggtcctcgtcaactcaggcaccgagcactttcgcagagagcgtaacctcgggcttcaagaatttgcatttccgatgagtgcaatctgtcacggagaagtctgggacgcacatgcccacttcttccatgcctgtttcgtggaacaagtcctgagtacgtgacaaatgttaccccatcttagtgc

SEQ ID NO: 923 - DNA, 703 bp, Nannochloropsis_gaditana
tccgagaaagggacggtccaatcatgggacgacgggcgaggcaggggggaggaaagacaaggcggcatccacctacttctactatacgagctcactaatgtattttccctcaattttgttgatttatttgggacgcataccattaattgataggactgcttgtatgtgtcgggatagtctagcgtcaaaatgcaccccaggctcgcaaggacatgtgcgtgacgttacgtgccgcacgggatcttcgcgcaatttttaccattgccacatacgccagcccgcaaagacacgcatgtgcgtgaaaactacccaaaaagttgtacacatatgccttagaatttaagctatgttttcggatgcaatgaagatgggatgccggagaactcccatggcaagctctttcagcaagaccatgggtctgccgttggaagcacgacagtaccaacatccttgcaaccgaacattgcgagaaaaatttcttgagggacgtacccatagttatttcgtgaggaaggtcatgtctcttacctggtttttaaccaacacatcagtaacgcgtaatacttggttctctaacgaacgttttttgggtcaccacacatttgacaccagccactaaactgaaacccaagccgctgaaagacgctttctgaggagctggtgaagttaaaaaacacccctcgttggccccaacaccgggatg

SEQ ID NO: 924 - DNA, 703 bp, Nannochloropsis_gaditana
gataatgcagcattagaattgcctttgttgatacatttattctacttgttgtgtcaagtaactcggaaaggaaatcattttcaggcaattttaagtgtcagtggtgtcttaggcaagccgaaggggaaaaaagcgacagctgacggccggaggcgcgaggaccatggaagtcttgcaatgcctcgagcgctttgtctttatgtacaagtgcgcagccatacaagcctttagttgctacatttacgtgtgtatttgtagcttatatcgtgcttgtacgtatgtaaggttggtgcagttgtattgacgatggtgtgcaggccttaaaaaacaagaaataggtttggaagccactgtcaaagcagacttgtgtcggtgtcaatggctttgactctgctgcgccaatctgcagatgctgtgggcataatatcattgtaaaagatccttgatggtagaagacagggcatattttcacggaccacgttcgcgcctccctctacaaggcaagacgaccatagcctcgttcgtatggaagtcttcctgtgtctgtacttgtcgatgcacatcaaagttatgtacaaaggcgatctgcaagctcgttgggattctcagctctggctcgtctttcgcagatctgcgcctcgttgatcgccttgacacctttctctcacctccacatcgaccatccccctccagtcgcatcatg

SEQ ID NO: 925 - DNA, 703 bp, Nannochloropsis_gaditana
gttagttttgtgaagctgtgtaacgatttgttaccagaaacctcttgttaccaggaaacctcttacggatgccaattttgggagaaatactttgaaatttaatagcatgaattcaatagtacaggctataatttacaccgtgtaaagtaggcctcgtcacggtgcgcacccgtttagctggttgtccatcacaacgccagctgctcccctatttgtcgcaagcgttatcgaagtttcacgttcgaatttccttgtctagtagagaaactcaatgtcagatgtcggtgaggtatcgcatttgtctcaagcaggaggagcaatcaacgcagatttagcgctctagaaagatatcaaagatgttgcgctgcaaacaatgtgatgattcagttcagcacgtgtagagtgtcgcggtgtgaatgagttcaaaaggttgcgcataagggcccaatggacgtggaacaccggcattgaagatcgctgaaaatgacgtcatctcctcggccacgcaagcattacttatcttgcatgtccgtgatgagactcatgtctgtactcaggcatgtgtttcatcatctatcgtttttgaccatatagcagactactttcggagacgaggctgtgagatttactctgacggacagacccctgccatttcagtactgattttttttcgtccaggtgataacatcactccttcagcatg

SEQ ID NO: 926 - DNA, 703 bp, Nannochloropsis_gaditana
cgtgctttgacaagatggaaatggactgccaaatgggcgagggccccgttcggacatgtgagcggggaccatacgtctaccattttgactgtacgtcaagacccggacggagaagatggagggaatcagagtgtgacagggagccttcccgttgtttcagtggcggttgtcgggacgtcgagactggtactggtgggcattgcgacgcaacccaatgtccgtttttttgccgtgtgctcaatatttatctttccccgttccgtccctttcactgtacagccttcttcaaggggccgtccgtgccaagattgaacccgtgcgtgatctgtttggaactgatcgaagaaggcgcagatttaacgtcattattggggtgcgaagatcgtcatcactttcatgtaagtgcaaggatggggggggggggggatgtaaaagcaatgtagaaggcatggtgtgtcaaatcggtggaagtcggaagggccagacgacgaattctgagcgtgtgttcgggatgcagggataatgtgcaggatgtcggggttgggatgccacaagccgctttacgaaggggaggcattggggtctggcctcggcgacaggcagatagaaaactaatgcacaatccaacgtgttcccctccatatgcctcctaggccaattgcatcaattcctggttggaacggaatgccacctgtcccacatg

SEQ ID NO: 927 - DNA, 703 bp, Nannochloropsis_gaditana
ttcctcatgagggcggaacacctcttgattgcggatgaattccccctcaagcagcaggaagtctttgatccgatccaatttcaacagtctgagcttgcatttcgaggttggaaagacctgggggatccgaacggcagccgaggggcccttacgacggcgacgccggccactccgcacggcgggccgaggttcgaacttcttcttctttgccttgtcctccttcttctgatcaccctggcctggcagttgaccgcctggtggaggcatgcctcctggagtcccttgccccattgctctggcagtacaattccatgtgtgttaaaagggggagaggtgaggggcgttcaaggcgtaaagtgagctcaaagagagtgaaaacccatataccagggccacaaatgcttcaacgatcaaatttcagttcgacgttgcttctcttcttcaccatctccctgcggctgggtgcgtaaagcaccttcagcgcgcgttggaagagagcacaagggaaagtctccgaagtcctccctcgactcgctcacgcccgcaggcgaaggcccaatgcgccccgcatcagagacccgaacacccagactcacggtccgaggtcagcttgcccgtgctccattcgatagtgtgagctcacatacgaatcaaatgaacacagctgcatcattgaagtgctcgtttctggtcagcaggtatg

SEQ ID NO: 928 - DNA, 703 bp, Nannochloropsis_gaditana
gaggagagcactgaatcagagaggggagagagatcttccccgcccgtgcttagcacgacgcgaaatctgtcgctccccgagaggaaggttttacggtcacgcacaccatatttccatcttcgtacgacattgtcacacactgtgcaccgtcgtggtgtggcatagggcgggatgcagggggcaaccgcgagggacccacgggacgccatcgaaagattttaggctgcggaccgcgagactgtcttcaatgtcatgccagcgcgcagaaaaattcactctatacgcacacacatctctcgcaggcgtaaggctacctctctacctgctgcaaaagtccgctgtgcggtcgctgtgggatttgtcaagaggaccaattcgctcgtttgctgcttaccgaggtcgaccaatcagctgcacttctgtcaccatgtgccccctgcgcgtgtttttcgcattgcttcagctccatatcctatgtgttttcggcttgggagggtacgcctcttctgccggagacgctcgggcaaccggccgcaactgtcctttccggggctgggcagtgggtaagacctctgcaaacacagccacgagttcatgtgctttcgtggcaccatccccgccttctcgcagcgcagccgcgctctcatcgaccacaagcgaggttgcggggccgtcatcggaagggggtttccggacctccatg

SEQ ID NO: 929 - DNA, 703 bp, Nannochloropsis_gaditana
gatagcgcagcagcatgatgatatgggattgcgaggacctgtcaaggaaggctgggtctgagcgcgacggaacaaagaagccctgtgcatgaaagtgaaggcaaccggaaaaaaagtattaagtcgtgccgagaaaaagccgaacgatatcactcacacaaactgtctaaaacatgttcaagccatgtacttcattatcttgaaggcctcccgtcgaagtgtaaaactttaatttgcattctgaaaatgcgcgtgcctgagctttctcgcccggggtcgggatacgccccgtcaagccgaaagctgccgtcccgttcccgagctatgtttcagtgattcaaggcaacaaaactcacaccctttgtcaccattcatatgaacagacataaagggtgccatggcaccatttcattcgtgacttctgaccctagcagttcgcagaacttcatcctccttctctcagtcgctgttccatgaccacttgaccccttctggaggaggaatgcaccgattattgcgtagtccagctgcagacagggcgtcgtcaaccggcacaacacaattgtctacccttgacactctcaaaagttctgcatacccacccatatgcgggaacctaagcagcgaagtatcggggggtagctatgtggtagtcgaggcttgcgtcaagacgggggcagtcctgctcgttcttctttacatg

SEQ ID NO: 930 - DNA, 703 bp, Nannochloropsis_gaditana
cgcgacacgacagggaggtggtttggtcgcggtacgcgtccatgtccagggtctgtatgggggaggggagcatttcgtgctgtagctagcaagagaaggaaagagtcggggagaatgagactctgctagtgaagaagtcgcctatacacgggaatggccaggcttcacgctaaagaagaccaggcctgagggtaaccgcggtcattcatcatgagagagtgaattgcgccaactgcggacacagcgactagaaaacaaacacgggatattgtagaattatctagcacgctgcaattttttgcaaaggatagtctcacgcagagaggttgtccggactcaattgattacgtggtcttcaagtcacttgggcacttacattgtgggggtctgattctgcgggcggtggcatcttggacttgcgcctactactagacaggtataatggttatgtgagccaacaagcgaatacatttatcatgtaccggtctcaggcatttgtggcaccgtggtagggtagaaacctgttgaagttttgttcccagcggcacacggcgaggagatatttgcgcccaagcgatttccccgacggaagcacgaaaaatcaggccttcaggtgcaacatctctcccacactatggtttgacgtggccatttcaccgattttacgcaggacggttgattcaaagcatccgagacaaatatg

SEQ ID NO: 931 - DNA, 703 bp, Nannochloropsis_gaditana
cctgcggcgtgcgcgaatattatcaagagcgcgtcttcatctagaaacttgcggtcttcgtatcactaaagtaatacagcaaatgtctttgtgtgaagggccacatgtcataagaaaaatggcctttgggggccgcgtactcgcgccggggagctagaaatatgccgaaaggggtgtaattgaatgcttcttttccagagctctggacaggaacgatgaagaaataattcaccgctcacttaatcaccatctatatgggaggcaggacaagttttagctcgccgcttccctgcgcggtttcttctcggcgtcggctcatgggcccgtatatgggctcgcaaactattggctgactcgccggagcggaggaacgtacgcgtcggcctgggcccagaatttgaattcaatgggcgcacgcctgaacatgctgttggtaatgtgttttgtaccctccagcatcacatatggtggccaagccccacatgaagctatatgtgtgctggcacctttttctcgcgttttttgctttgcttggtgcccagttttctggcactccctacatgctcactccgagaggaacatgcacttcctggtacagtcttctccttgtttgacaaattcctctctctgcctttctctttttgatgacatacccatgtagacaaatttcatcttttcttcttcaaccttcttcgttgctatg

SEQ ID NO: 932 - DNA, 703 bp, Nannochloropsis_gaditana
tcatcgaattgtgtccatctcccattcataaagacggccgccttgccaaaggagttctcgttctgcgcctcaccggaggctgaggccaggagcagaagcagcagcggcagcacgcttatgttcataccagcgactctcaattctaccatcaccgcagaatgtccccacctgtgtatcatgggatgagagggatgattcgaggaaatgtatcgtggttctaaatgtttgctagcaaggcccatgacttctttctctgttccaatcggcgatgacgaaatatattcgggcgacgcaggacaactgcatgtaaaagacacttaaaacccagcgctttatggatgcaatgtgtcaatatgagcaggcagaaatcagaagccaactcggtcgctacatgtcttgtgaaaacatgcagaaattgttcgggctgctccgccctacggccgtggcttaggcgtgtccgctaggattatgtaactcgcgccgtatcctcgattgacttgaacgcccctaacaacttcatttccgtatgacatttccagtttttgggaaattcaacccctttaaatgcggagcctgtggtatctgacatgtgtctgcaatgatcaccatgatatgatccaggtggagtttccggcgcactgctagtatctgctgcggacacattctacatgaagttttttattcgccggctctccaagttatg

SEQ ID NO: 933 - DNA, 703 bp, Nannochloropsis_gaditana
atgatgagttttcaaagtaggggctgccacgaagcaggtctctgactgcttgactcagagattaccgacgccatctcctcgatgtgcgcatgccaaggttgatgccgattgagtgtacatctctcatgtaaatcatgaccattactgcgcctcgattgagctgtggcacctccatgcacacaagcatcaccgcctctttcctcctctcgtccggctgctactttggatacgccccttggcaggaaggaaaacggcatcaaagccttgcaaaaccctaagcaccgtcgtgggtccgactccggtcacacgaagaggcgtgacgagggagatggcagggcagtgaccccgcgggtgacggtctcgtctctgtcgtcaggcgggcatcgcttggcggcctccttgctcgctcgctcgcccaccggggcgtgcatcatcggggacaagcatgacagcgcccgcggccccgtgggacgagtcctgcccctccattactccgacgtgtcatcgagacatttactggtggctgatattacgggttgcatacggcagaagtcatgtcctgccaccccttttctcgctcatcccccttacacccacatcccctcttccctccgcttccggcgcaggtatagcgggcaacaccggggcacagagacattgggattggatagccctcacatctgctattttaagtatggagatg

SEQ ID NO: 934 - DNA, 703 bp, Nannochloropsis_gaditana
gatgccgagtctcttaggacaagccaatccttacttggggcccggggtcgtgttgatcgctcaagcatcgaggcgcacatgccacatgctaatccgaacaccctgggaaccaaaagaatggttataggcaaaggccgcgttcctgcctcgaccggcaccgggagacatgagagatgagccagcctcgggcccccaacccctccatgtcccgcatcttgccttcagtcattctccctacctccgtctcaccaatccattcacttccccgacaacgactgtaaatgcggtggctggcggattggcggcgcgcccctgagcttgcgcggcactaacagagaggaagggcattccacgcatggtgccctctcgcacgccccgcctcgcctcgggtccgccggtctccctgtgctgccgccatcccagcgcgaccgcttttgtccacctttttgtcgctcacaatagaaatcctgtgtcttcagcatgtaaatgtgcactaaccaatctgtttctgctcgtctgtgaggcctaggcaaggtgtagtcgcccattacagcggggcagacttccatccactaacctcttcccccctcggccctaccttgtgttctttttattttccccgacctcaggcctctttaggaggagctgagcggttgtattgtaatttcacgctgtgcctttgttatctcgagacattaccatg

SEQ ID NO: 935 - DNA, 703 bp, Nannochloropsis_gaditana
gtgactcacatccagtaacggacaaattgctcctcgccgcacactggttccgagccgctcaatttctatcgcacgtcggatcgcatactcttcctgtttccgttatgcaggcacattcattctgttcaaattctcaaaagggtagcacgacgatggtatgaggagacctaatgacaaagatcaggtacctccgaattatgtgactcaaaaggcataatggaaacaagcggccctgccaacgataatccaagacgctcaaacaattttctgaagaaatgctgcatagtgtaagcaaaggtagtggtcgtaagattaaaacaacaattaacagaggatataaatcttaatactatcgattgtgatgaaatgctgtttttgtagcatgggtcgcaacagaatgagaatgacggaaaaagggcgcgaaccgggcgtgagagatttttcggtagattttgcgttcttcacgcaaaacggtggtatcgaacacttctcatgccacttctggaagtcagtgacagtggtgatccctcattgacagcacttcgggcattctctgctagctgccgagtcttgacaatctgtggaggtgcccgcccgcccgatcgcccactcgccaacaactgtttgccgttcttcatttcccaccctcgtatttctttctttgtgtacaactaagagactttatatcctgtacagggcgatg

SEQ ID NO: 936 - DNA, 703 bp, Nannochloropsis_gaditana
gacttgaaattttagagcctttagcggcttcggaaggggagtgaccccaactgcaagattaaccgtgcacatgtgcgcctattcagaggcatgggccgatcggttgtgaaaggaagtcaaggtggccatatttgtctgtcaagagccgacttccggtctcattagcatatttcgccacgcaacaatggatatctattgaatattatctgtttttctgactcgttgcaaggagtaggcctgcatggtttgttgcatagttcaaccgagcgacagggaatgaattgcagcttcgtttactggatgtatgccccttctcatcgcactttcagaggttatagggatgccaaaaccaatcctacggctacccaaaagtcgctgcttaagcctcagtgtttggatctccttcgtcttctgtgcaggggtgtgtcaaggttggttcctttgttgccgcgcacgcccgccgtatttaatgttacagcgcacccgtggaaacgtgcactgtctgcagggtgggggagggcctgggggggtcggacgggttgccggtaagtattcgtggacggagaacgagtgggaggtggaggtcaccgtgcccgtgccggctcggacgcgaaaagaagacgtgcttttcaaagctgccgccacgagtgttaaacttgggctagtgaatagcaccgagctcttgctgggcggtaaattgatg

SEQ ID NO: 937 - DNA, 703 bp, Nannochloropsis_gaditana
agagagtaaccagattgggcgcgacccacagggggagccattggacggcccaattccagaagtgattgagcacacgatccaggaatgtcgaggacccggagacatacctgtaagtggccacgccttctaatgctagctctgagagaacccaccttggggtacgtttccaaagtgtgcaccaagaaatgtgacaaaagtgcatgaatacacgcctcgggggtcgaatcccgagccgctcccgcaacaacaaagtctctccaactctgtctccctccctacgaagccagtacgcgggggacggcagataacacgcaacccccaaccactttcatgtcctacctgctgccgccccccgtccgctcagtcggaggctggactccattgtgcgggcagacactttcgcgcatggcaccctcggctgccctcgacccgtgccggctctcgtttaggccttaagcgtcgtccaggggtgttgctacggagtagggatgggtaggaatgggggcgatgagcacgcgagcagaccgctcctgtcgctggcgttcgagtccagctgaaggcgagcggcaggcattaaatcgtatgttcccggcgttgcggctcgtcggacattggattcaccgctgtagttgattcgcagctcacacatatacatttgaacagacaaataaaaggctgccatcattcgttgcagccttcgatg

SEQ ID NO: 938 - DNA, 703 bp, Nannochloropsis_gaditana
atgagcctgctctgctagcgcgaggagtttcaacagtggttccctcccgagtcagcatcctccacccattcacaccccggacaaagttatgccatccataaatcccagcaggagttcgctttccaaccttggacacggcgattcacctcttacaccccaaggcgagaattggatgaaattcgggtctcacttgacgacagcgaccccgaaacatcgaccccaaaaggcccactttacgcgtcactggactctccgccagtccccccgcttaaacccggcgtgcgagcggtcatcctcgcagcatcacgcgcagcggccccaccggtttgaatttagggagacaggaccccgcttaattctccgtggggtgttcggtgctgtggccccctcgtctcgtggcttgtgtcgcggctacctatgccacctttctctcacgactattattgctcacggcgccgacggggaggctccctgggtcccggccttcactcgcacgttttttctacggaaaggtcacttcgccgcgcacgtttttatcaatgccctattcattcgtatttctacgtgattttacacgcacgtacaatactgccaccgctggtcaggtggaatgtttcccaggtgatatcgcacaactacgctttttttggtgaccgccgcttcagggctgctttccggcgcttttcgattcaaaaggaatatg

SEQ ID NO: 939 - DNA, 703 bp, Nannochloropsis_gaditana
tggaggagcgagacagtgaggcaattcagaaggatatgggattaagtgaacacacgcgacgtcgtacggttccgatgatgatggggggcgtggtgatggtgctaaggcctttaacaggtgatgtgatagggggagaaggggtgggaactgccgagcacgggccgtcctgggcagatcgctggtttagggacctgtgggaggaggctcctccttgcgaggttgaggaatgggagccgcctttgttgactgacgaggcgcatggtgactgacaacaatactcaaaatgtgaaataatgagaagctaaaaggcacgagggagggtgcctattctccgggctggggtatgtcctgtgtgtgagggagggcaatccatccatctgccgagcgacgtgtccgacggccgcaacgagtcagcacgtcttctggctacacgcttcattttgccaacttgaccgaaaccttccagcacacattggccttttgcttaatcttcttctgtgactgtcgagacggtgtcatacatactctattccacgctgtccggcatctcgtggagcgcgttgaccgttgcttgcggcttcggctctgtcgtcgtagacgtgcgtgttcttggtgttttcccgcttccccttgctaatccctcacccttcgtttttgcttcgatagagtagatttttgatactccacgcagctacccaacatg

SEQ ID NO: 940 - DNA, 703 bp, Nannochloropsis_gaditana
aaattggagcatatggctacgttggggttgtcatggctctgaagtgctactccacgcaaggctacagattgcgttcgtgaaaagaatgaacacacgtgctcagcaaatacaatcatgcttagttcggacgagattcatacaaattggagtttctttccacgaaggagatgagaggtaaagacggcgcggccagtccttcctagcaaacatgacagggtcacgcatgagccccaaccaagcacgacttcttccacgccccccctcacaatacgcctaccgcgccgacaccattcttcccagccctttcgcgaacggcccgccaccgaagcttgcactctttctttttacctcgcgcgagtgcgggcttcaggcatgaagggaaagagagaccgcacgatgccgtcggggtggaaaaggggggggtgttcgggaccggcgagggcatagggcctagggcgggagcgagcaagagaaagctttcccttggaagacatgctcagggtacacacatcactgagaacactgcatactcccgcatactgattgtacaggtcaccgccatggtctggcaggaagagtggttactctgagggcacggcggccaagcgacctcctcccctcccagcccctgcccctatcccgcgccggctccgccctcagtgccccggcacttttggtgacttaggcgggcgcaaacaagatg

SEQ ID NO: 941 - DNA, 703 bp, Nannochloropsis_gaditana
tacagagcaaatagctatcgtcgaaaattcatcaaagcagtgaggagagagcagcggtgaacatggcacaaggaaggggaggctaaacgcgcccgacacgggatacgaccccatctcggtgggagggaggatgactacgccactgcgcctgtgcagaaatctggccaggaggactatgtcatggcggtacaacgccggtgagatttgtctgcgaggtgcatcactgcgtgctggagctggtgcgtactctggccgcgggctgggccctatcctccccaagtcactcgactcggcgcgaagagggtttagcgcctccccctcgccgccgcccacgggcacaccgtccgacctcgcgccggtgtcccaaatcccacaaatagaccccacgacgtggcatgcctgggtattcgactccatcccagtccgatccatgcaaacgctcctggaggtgacgcacgaggccacgggattgccgtggtgggcctccatcgtcctctccactctggccttccggctggccctgctccctgtcgtccgctaccaagcccacgcccttgctcgcctggcccgggcggcgcccctcgtcctcgctttgaacagagctctctctaagcgcctcgacggggtccgcgcgggggattgggcgggcaccacagcagtgtgccaagactacgccgccggcgtgcgggccgcgctcaagctg

SEQ ID NO: 942 - DNA, 703 bp, Nannochloropsis_gaditana
gcttctagccttcctttttttcgcgggcgccctgatcggtcaggaccactccatccttaagccttgcccccgaaaagccccgactggtggggaaaagcgtaatggatttccgcactcttcgggcattatctggggttgcatagggtggtgtcgtcgggcaggcagggtggtggcccatggcttgctccacacggaggccagccgagccgtacgcatctacgtgcgctcgaccattgacggtggtggtgcgcttagcaacaaggtttcaacgtggggccggtatgccgcgcagtccttcttgccggagccggtcgatttggagggagggagttcagacccctatcaggagaaatggagggaagaggccttggagccttcaagcgcagaggaacctaaaaacagcgagaataaggtcgaagatgaggaggacatagaagagcggcgatcatatcagcgacgacgccggctcttgtcgggtcacggggtgaagccttggcccaccccgtggcacctcggctggtactgcgttcagtggtgcggcggagggaggtccggggcccgcttggatgagcgacgctgcttcccaacgatcgtcagcttaccgtggacccttctcctcctttccgccctgattcttctcgcatacacggcggtctcagtgcgggcctacgtccttttcgctttcattatctcctatttcatg

SEQ ID NO: 943 - DNA, 703 bp, Nannochloropsis_gaditana
ttgtcatgtgtggtagggaaacggagtgtcggtcagcctttgtcttcccgtctttttccagtgctgcgggtaaaagcacagcaaaaaggcggcgcccattggcaaagacacaagcatgtcagcaccagtgtacacagccaaagcttccatagagtggacgccttggcaagacagcctggcagcaggccagccattcctgaggcctgcctctcctccacttacgagggaggcctcagcgaaggtcgttcatctacattgccctgcatcttgccccgccatccatcttactaatttcgcttccttccactgaatccaacccacccgtcccacataaccttcgtcccggtgcttcgggagggggggcacgattgtccggggagtgtgagtgcagaaagaggggaggcactggtacggtgtcttcagagccgttcatcgcggtgggccttccgccccgggcgctctctcaagaatgaggcttaaagcccgggtggcatctgggccgatatcaagtcgcgatgttagtggccaggccaagggagtcgctcgtgtatgtggcaagcaagtgaggtccttatccatgcatgtccatgaagcatgattgcttgatcgatctagaataaaataacttttctccccattgcgcttttaacgatgtagctagtagctaatctctgttcgactgacgacctccccactggtcatg

SEQ ID NO: 944 - DNA, 703 bp, Nannochloropsis_gaditana
gtagattggaaggcggaggaggaagaggagaatgagagagagggagaggaggaggaaagatgatacggttgatgaagagggatgaagggagggaagacgaagaataaagtgtgaaggaggactgtcggaaagaagcctttcatagatcaaggatcctttcacgaggaggtatgcacttgttgccggacatgcagaaaggggagagcatgggccgggcggacacgccctctcgtgcactaggaaagcaaaagaaaaagcacactcaacgaagcgtaaaagcaggcaagtcgtcaaaagcataacatgacattttcaaagaatttaaacaccttttggtcctcgtattttcagcgtgcaagacggagggggacgccggcagtctctggccatgcgctgcaggaagaggccgcttgcgggggcctcgccgcagttcccgggacctcaagtgacacgcacctcttcttgaaagtgtggaacacgatgcagaaacgtttgcctgtaccacgtcgttatattttctacgacgaagtggatgatggtgtgggcatgttatggtggttttcggcttggattatcacgccgctgcctcgattaggaccccgtccagcattagaacgatcttatctacgagtttgcgctctccccccctcaaccagactttcgaaacatttccagcggccgtgggaggcggcggaggctcatg

SEQ ID NO: 945 - DNA, 703 bp, Nannochloropsis_gaditana
ttaatatactatgattaagtggatgagtagtgagaaatttgttgaaatgttgcgtatattccatgcattccgtgcactctcgcatctcaataacctcccaccctgtccatacaatattccgtaacttctcaggatcatggaagggaaaatggaggagctgtcgcaacttctgggactctttaccggagagcttttagagcaacagggccaagtagaagaggttcatgaagcggctcgaggcacgcacgagaatttaggtcacgccaacaaagagctcttggcgacgctcgagagaaacagtaaagccagccagaccatgtttagtttcgtgctcatgctatgcattgccctccttgtgatcgatcaagtaatgccctgatataaagaactgtcttccgcccggctcgccggcagtgtacggcgacggcgcctgcgcggcctgactttcgcttccacacgttctcgaatgcgcccttgttccacgaccgcgcgcaccaaaattgtacgaggttgctttcgtttggcacgttcagtccacactccaaagtgcaaaatgtgtgaattcccttcgtcaaaacgtcaagaaaagcatttttttgtataactcggagtctctttcgaatataccccacagctgccatctcatcaccttggctcccttgcccggggctacgccttgtgattcaaaaagcttgttacaatg

SEQ ID NO: 946 - DNA, 703 bp, Nannochloropsis_gaditana
ctgtataatgcactgcaaatacagataaaacaaatagcggccccagaaccttaaactacctcttgatgctcgcgattattaggatagttgtcgggagggtgaataaatgacagaaagagatgagagtaaagcttatattttcagtgaacagcaacgtcgtgcaatgtcggatatggcgccttctgacataaaattaagtgctgaaaagcggagatgcccaatcatgaacgcggagagcgaggaaataagggcgaagtgaggctcatacaaccgccgcgatcgtcttgagaaaggagagtgcgggaggatcgcagtcagggaacgtagtacatgtttatacctttacttcgacggaacgtacaagccctcgcggtccgggcggtcgccgcagcctccgcttagagcgctctcgacgacttgtgcgcattgtctgccctgatctgctgtgctcgagcttatgttctccagaggacgtcttcccggctagtgcagacttcaggaagagcttgacgatatacgcttgttgtgtatatcatatttacatgccttactgctttttggtcgtcggtctccttctcgaaggcgcggcgtagctgtctttcatccttcctcccgccattacacattttacaggggcgtttgagcaccaaattgagtgcgtacaagcgaatttaagctaggaacagtgtgaatctgtgcgatg

SEQ ID NO: 947 - DNA, 703 bp, Nannochloropsis_gaditana
ctgatgttgtagtggccatacatagaagtgcaggccatctttcgacaaactgcgccttcaacaaacttgcagtcccgtctatcaggaaacacatttctatatgttctcaaccactacgagcgtataactccagttacaaaacagacctgaaaactagtagctctctcagcctgaggcccgggggaggcagttaggacaagacagagcaggagaatcacaaaaactgctgacacccccggactcccgaaatttttgaatcaacgactcttcaataagcatgggaagcattgcaaaaagagttacgacataagtaacgatatcaagcgcagcgatagcggaaaggaggacacaagcagcgccgtaagagcaagccaccacgagacgacaaggagacgaactttccagaaacagacttttaatacaccaaaaagtgaattaattgaaaacattcgaaatatagaatcaatagagtgatttagaacttggtgatagcggaaggaaagttggtaagatagtttaacagcgctcaagcataacgtatcacagagcgacgcatttcaccactgagcgatgatcgaccattatcgtccgagaaaatgtaaaaacgcagtatgggagattgacagaaccaagcgagcacgaagacatggcatcacgaaaaaactgaaaatctaacctcagttaattttcctgcattttccag

SEQ ID NO: 948 - DNA, 703 bp, Nannochloropsis_gaditana
gatgtatttacagaaaccgctccactgtcttctactgctttgtaccattcaaagggttcctcctcccggagtggtcgaaaacgacagactacttgaactgattgaaaagtcgcttcgtcctccggcccattttgttgtttggagaggagaagcggcttgggacacacctttatcttttgcgaaggcccagtgctttccaaacagtcaccatcctgctgagacagtaaggttgttgatgtccgtgcaggtgctgcattcataaagggtgacttcgttgaagagaaattcttgtccattactgcccgtgaaggcttttgcaagtcgcccaaccaactctgtcgacgcgtgccgagggaagagacaactggagacgatgagcggcgctgcttagccgcgggaatcgtcatccttctgttttttattaaaggatacgggaatcaagtggatgacaatcttgggaggcttgttttatagtctggggaaaagagaaagcgagagagggacgtacggttagtctcggaggcgaggtcgaagcccggtctcccggactttcgcgcaattcccatcaaagcccccgggaatggacacagatgcgtgctcccttttaagtccataataatcacctcagcgtctacccaatcgcacaggcaggtcaccgaagggggagttagattttgtgctgcaccacttctctgtcagtgac

SEQ ID NO: 949 - DNA, 703 bp, Nannochloropsis_gaditana
cactcaagcctcacggggtcccacatactcctgccacataatctagtgacgctgtgatttgcaccgccgcgcccccgccagtgtgtcgagaaagcaagcaaagcaagcacctttcctgtagacatactacccgcaggacagggggggcagtaagcattttggacctcgaaggccacatccttgtccacgaattagaagtacggcgtcttcaaagataaaggcgtttgtcaaacgctcatggtctagtgattcgtcgccttctcccgccggaaccaccaccaactccagggtagccttgaactcaaatattttccatcgactccgcactcgtagcacgaatttcaataccggtgcatttactaaaaccgaaatcttgcacgaaatttgcggggaggagcagcaagattgtgaatctatggaaaaattagtactactgtctctagcaaagatccgaaagctggtaagcaatgcgcggaagcacaagacacttcgagacgcatgcgacacggttatcgagcatctccaggctaaaggattgcgggaagaggcagtgaatagcagcgctcatgaaaaagccgacttgaactatgagacagttcagcggctggatccacacggctacaccccacgcactgacacggatgcggacaaatttttcgagccatttaagttggcctgcgagactaaaatccctaagatcatg

SEQ ID NO: 950 - DNA, 703 bp, Nannochloropsis_gaditana
gtatgaaactgactcaacgacgacgacgacgaggatttcatgtgagtacagaaactcgaagacatggtgagtaccggggtttgcaggtgtcctcgacgctcctctcgacttaagccctcggggtcaaagcgtctgacacgtacttcccacagccaagtgacccctgtctgccatgtcatctttattggcagtattagctctgtactgacatttccagggagtccacctacagcaactgttccgtgtacatgcccgacataataatttcccccctgccaaaattacaattattcgcaagacatctcgcagtgataatcatgtgatatgactttataagtagatatggatgaatggctgtaccttctacatcgtaatccgtacgtctaatgatgaaggcctattgtaagtgctcaggtcaagtaatgagacttgtgagactttcgtctgttgtctcatccgtatttaattttcttccacgccatattttcttgaatcatgacagagcatgcggttttccctctctttttcaaccatagcgacactcagcattgttcagctcgcctcctgttccattcgtggagcgagtggattcgtttcgtcaggagcacccaaaaaactattctggacgcgttcagctagcttttccgcagtaggtgcccgatcccgttcaacgacggtaccttccatgcttttcagtcgcatg

SEQ ID NO: 951 - DNA, 703 bp, Nannochloropsis_gaditana
attcgcctacgccttgaatgcctgcatattcatggttcatcttcgcctctaatacctttttctcagcacgacgcacagattccaaaacgtgaggtttccccttgtcatcccggtaggccccgaccccaagactcactttcttgggggatgtgtctttattgaaagcgtccgtcaaaccaaaaatcggatccgggggtcctaagggtatgttcgcaaaggtggagccagcacgattcgaagcagcgaaagatggtaaaattttgcgcaaggctaaattcgtgtgacagaatgctaccttctgaaacaggagcagtgaatttgcatgtgccattgtctagtgctgtgccgatagattgattgataatatcgtcataagtaccggtcaatagatactgttatgtttgattcttcatcttcattgagcttgagctatgtgcatagaaggacgacattgtaaccaaatgcttccactgcgtgctgtttattcgccccacgggacggtttgcattcgcgtgctcctcctcatacaccactgtctcgcttgccccgcctatccctggccttcctcgccaccagcggcaacttgagttgccgtgcccgcaatcgcccgctcatccgctcgcctccctcgctcaaacgcaagtaggtctaagtccactagcatctcatggtagcccgcctaccggcatcccatccattgaac

SEQ ID NO: 952 - DNA, 703 bp, Nannochloropsis_gaditana
ctctcacaaaggagacccgagcatgagcatggtaaatgtagccgatgttgccttgatttctgaaagccgatcagggagcaacgacggaaatttttttatttcgtatggcatggaacaaaacggtcgcttgattcctcttcctgtcccccactcgcctaccctatcacggccttccgatgcgtcgcgagtctccacaccacactatgatagccgtgcaaacaggtactctagtataatgtgggtcatcagaaagcagagtgaagtccggtctattgtacgaaacgcgaaacgaaggctgaagacgttattgcacactgttttcttgccagttgggttcccgtcgagcgtggctccggaatatctgcgatatcagcaatggaatgttgtacaggatttaagcacttacttgcgtggcattttggcaacgcaggctatactagaaggtgtaggcgtagggcgggaaggggctacacccttggcagcgacactccaatggatcacacgggacggagcgtctatgatgagtggactcgtgtttacatccttcttgagcaccaattttggtgtcaatgccaaaagctggcgtctcttcgccgatttcatggttgatattggtattacactagatatgttagccccacttttccccaaaaactttttgctatgcatatgtctcgcctcggtttgcaaaagtctctgtgga

SEQ ID NO: 953 - DNA, 703 bp, Nannochloropsis_gaditana
atggaggctgatgaaaatgttttcaagaaggacagcatgtgcgcacgctcctgccatggctgatagaaatatcagcaatcagtctcgaggaaagcatcgcgtgaagtgcaagaaatgtgacaaataggaaattgaaaattgaaaccgatatgtatgcattgcgatcttgtagggaggaaaggttacacattctgaggtggttctatacatggatacatggtgacttcaagtacaggaaaagaaaaaagacgatgtacatttttctggagccgcgttgcgaaatcccgaaagcacttgaccagaccagtgacggatggcaatcctgtcggctcccgcctcccctccctccccttcgctccttgcttgggcctgccctcctcaatctcgtcgtcctttgtgccatcttattttttttcccgcggcatgtcgtttaagtttaccttcatgtcgttctccacgagaactctaactacacgtcgctcttgcccgtcttccgaggtcgcactgaattcataatttaaaaagaagttctccaaactgcatattgtaaggcaggttacactcttcataccactttcaaggatcgagagttagttagcagcacagaggcaattggaaggacggggcctcttttagtgggagcattggctcaatgtacagtcgtgatgccatttctgtcgcctctgcctcagtatctggtaca

SEQ ID NO: 954 - DNA, 703 bp, Nannochloropsis_gaditana
gctcccccaagccctctctgttgacattgctccgttttgttcgccgtctcccattagagcgcagtctcagcactgatgacggcaacactactcacagcggtactataaaattggacagtcagcgccgcgtcttgcagcgttgtgacgagttgcaaagctatcttcagcccatcaatgaccgtttgcgagggcctctggaaaaatgtagcgacaaggcacctttgcttccgttcgtatttttgctgggcaatcatagtagtggcaagagttctttcgtcaattatgtgtgtaataggcccatccagacagcaggtgtcgcaccgacagatgacagcttcaccatcatcgctcccggacccacggatatcgatcaggacggcccttcgaccatcggcgaccccgacatgggctttgcaggccttcgccactttgggcccgacctgatccatcacactcagctcaagatccgcgcgggcttggcgacaaccgaattcatgctcgtggattcaccgggaatgatcgacagcccacatgcctccgcaagccagccgagcccctcctcgctcatcagcgcctcagacaagggagataatacgcgttctgccagaaatcacttggatcgcggctacgactttcaaggcgtctgcaggtggttcgctgaccgcgccgacgtgattcttctcttttcgaccctgataaaccg

SEQ ID NO: 955 - DNA, 703 bp, Nannochloropsis_gaditana
ggcctctggaaaaatgtagcgacaaggcacctttgcttccgttcgtatttttgctgggcaatcatagtagtggcaagagttctttcgtcaattatgtgtgtaataggcccatccagacagcaggtgtcgcaccgacagatgacagcttcaccatcatcgctcccggacccacggatatcgatcaggacggcccttcgaccatcggcgaccccgacatgggctttgcaggccttcgccactttgggcccgacctgatccatcacactcagctcaagatccgcgcgggcttggcgacaaccgaattcatgctcgtggattcaccgggaatgatcgacagcccacatgcctccgcaagccagccgagcccctcctcgctcatcagcgcctcagacaagggagataatacgcgttctgccagaaatcacttggatcgcggctacgactttcaaggcgtctgcaggtggttcgctgaccgcgccgacgtgattcttctcttttcgaccctgataaaccggggactacaggggaaacgctgtccatcctgacccagtctttggcgggtatggaccacaagctctacatcgtactgaataaagctgatcaatttagaaaaatccacgactttgctcgagcttatggctccttgtgctggaatctgtccaaggtcattcctcgaaaagatttgccccgcatctataccatg

SEQ ID NO: 956 - DNA, 703 bp, Nannochloropsis_gaditana
gcttcctccaaatgatggtcttatagcaaatattgaacggctgcgactctcttccacagatcgctttcggaattacacaaacttattttaaattcgtttctcagtggacatggggtcaatttggctggtacatacatccaaaaagcaccgcaagggagtggtttttgagggaaccgttggacacgctatgggccggcggaggcttccgttcgcgccaaaattccgaggaacgtcatccatccctccccttgttgctgttgctgttctacgatatgatactactcaaatttcaccccctcctttcacatgtgcacagacaatgaggactctcagcttgtacctacttcttggaatcattttacacgctgttgaggcgtcgcgattttctcttagccctccggcattcttcaatcggttttcagattttgaggaggagtatgaggaggaggaggagggtcctgggctggggggtttgcccttgaaagccttggtgggcgcaagtgtcgcagcagttggaggtgttggtgtatcgtttgctcgacgagcaatcaaggccaagcagcagcgcgtgtcgacaccgaagcaacaacgctctcatcttccaagcagcagcaccgttggaagcagcactccgtcatttgtcgaaagcggcatcaagggtggcaagagcgatcccaaaatagcacgcggtacaacaacaatg

SEQ ID NO: 957 - DNA, 703 bp, Nannochloropsis_gaditana
gtccctggattaagacgcgacagcgtgttggtggacgtcaaagcgacttgataaaagaatccatgcgagcggaaaacgtatgcagcgggagacttgtacttgatgtcgacgtcgcacagggttatacgccgtgacactacttcctctccgtccatcgcctctcctcgcccgacttcctcttgttttttgtgatcttgcgccgtattatcaccagtcctgtcggcccagcgtacgctgaaaagtcgcgatgttgtgtcgactgtgactgaagccatcgtctggcatcgaataatgcagctagtctggcccctgtggagtagcaaatgtgcacaggcgtcagattcagtaggtcaggtagcatgtagcacgtaagctggccatagtgtggcgccgcgtttcgtctcgcgcctaagcacccaaggtgtccaggaactcatgtgagagaagtcgagcaggtagagagaggcgtcgccgatggcgagctccgtcatgggcgagagacgggcgacgaggcgggcctctcgcggcgcaaacattagcacgtcgagaagggaaacgcgatcgtcacagcctctctatctgtgcataggcctacacaatcataggccattcttggcctgatatcggtgcgcagtcaactgcctgggcgatcacggggcggcccattgctttcaacaagctattagtcgagtcctttaccatg

SEQ ID NO: 958 - DNA, 703 bp, Nannochloropsis_gaditana
aaccgggcttcccacttccgctaattgcttctcgagttcttccccactcactttgagcacaccactctcccctgccatcatgaggggcctgcccttgggaccacttacgtaacgcactgtatatatattttaaaaatgccagtgtgcttaagaaagagcatcgctcgcaaaattggtcctcggagtgatcgtcatgagcacgtaggaagatactacatgctccaattttctcctcaacaaaaccgagcgcgcaagcatcacgcaattaacaggcatctcccgagatgaccacttctcacctgacttaatctttgaaacagatgtagggacaaaggcttgcgtgagggcaataagcaccagaaggccggctacagaaaggcactgcttcctcaacagaggcagtcggggtcccgtcatcggctacggcttggcttgcgagttgatagacttgaaggcgacgatcccctcgtctgcagagtcatgtgaatgaagttgagagcctttcatgagagaactgaggtggtcagaggcattctcgggcggatattgtccccgaaggctcgagcgtcatcgcccgttgattactccgtgcctgatttcgtctgaggaaggcgatatgcgagaggcaacatggcggtcctcaattgcttacaccacacgatcacaggtgacctttggtaagatcctggtttatcagcagatg

SEQ ID NO: 959 - DNA, 703 bp, Nannochloropsis_gaditana
acgtatttgtcaagcgacggaacttattcctgcagaccttcgacgagcagggtgaacttcaagaagaagagagcacaagtctacggcacaacgctttcgaggttaaaaacgactacagtcaacattttcttcagactcgcgaacgaccccagaacttcattagggatgtaacggttgaggatggatttgctgaatatcccaagctggcaaagttactttctgcaaagcagcacattgtcgagacccgcaaaacgcctgcgatgtatgtgaaggccgacctccgaacatttgatctgcggagcctaggcaccaaatttgacattatatatattgatccaccttgggaggaatacacgcgtcgagccgcgccctttgtactgaatggcaagccgtctgtgtgctcggagacatgcgatgcgtctttgcagctggacgaggtatgggggcacgaagatttggagtccctgcctattgacgaaattggtgagttgcctagttttgtgttcctgtggtgcggttcaggggggcgcatcacagaagggtcagcgcaaggggccttgcacgttgaagatggtaggcgtttgcttaagaagtgggggtatcggcgatgcgaggagatttgctgggtgaagacgaacaagcattgtcaacactctcagccagaattatccacctccgcaacaagcttatttgtacgtaccaa

SEQ ID NO: 960 - DNA, 703 bp, Nannochloropsis_gaditana
catttgttggcggagacaagctaagcaacttttccaagcttggaaacgcgcttctaattcgctcatgcattccaaagtacttgctttaacccagaaggtgcatcaagttaccaagccgtcaagctgtctgtgcagctctgcgtcgagtaatttgcgggctcagtcactaacacgactcggcgatgatccaggccgggctctcgcgattcagtacaccatcctgtcagcgtcttcacacatgttacacgacaattcaatgtttacaggaactttgatgcaggaaaactgccatgatatccacttgtcactggcgtccgaaatagttgtggctgcttgcccgaaagatagagttttacgggtgatagacgtagcaactgggacaacgtactcaacctttggagatacagccgcttcgggccttgctcccgtccgcggaacacaaacatccgaaggattgggcacagggggcgactacgtcatttcaagtcaactttttgagcaagccctggtttttcatcgctggggcaaggctcagccgctgttgaaatgtcgggtgtcagagtcagtggggcccgtcgttactacaccagacggattcttcttgctcgcgggggggcgatcaggccaaatttatgcgtgggagatagcttcaggttcccttgtagcgaattgggatgcgcactacaaggcaattagttgcatg

SEQ ID NO: 961 - DNA, 703 bp, Nannochloropsis_gaditana
tcagtccaatttggtttcactctaccatgagctgggaagacttgacagtctcttcgctttttcccgcgcctctcgactccccccacccatttaacctcctcgctcgcttctccctgttggagtcctccgagggacttcaagaccctcgcctccttgttttctatccctaattaattgggatagcgccccgcgattgcggcggacgccgatgaactttgaggctttgcgtcaatcacaacaaatggcttgaagcttagtaatcacacctgtcagaagtccatgttttaggggcatcccgaatattatgtgttcagagagatatgacgcggctatccacgccggcagttttttcattccctgccatgacagagaggtaatattgcagtagaaacggagataattgctacacagtatgtgagcttttttaagcgctcggtcgaagatggaatggatacaagccaagagtgatcagcctcatgcgaacgatacatttctttcacctcccagatacgaacaataattagaaaagaagtcgtgactgcagggaggcgactatcgaaaaatgagtggagatatcagggtactttatgtgccagcaaagccatgaaaatgaaatcttggcctcataacagtatatctcatgcaggattctgatttctaaccacataatgtagcattttgacgaatttatcgaccggagatg

SEQ ID NO: 962 - DNA, 703 bp, Nannochloropsis_gaditana
acacgagccgagaaattgagaatgtttggcgttttttcttcggacatgtgatgggccgcggattggaataattgtcagtcaagcccagtttgagatgtgcgagacaagtcaacgaatgtcgagtaaaaaagaagtctgttatcttgtcccaagttaatgctgctcgagaggagaagttgacaaggcaaccgagcagacggctttctcctccccctaaagcctacgtgagaccatcgctgcaacttcttgtcctccgctgctagctgcgcaactcgtaggcccctcgcacactcgttttgaaatttgtgcagaatgcgtccatgagcccgcctggagctaccactcggctttgcgcgccattgctccgtggatttcattggtgcgttttgtaatgttttcatttcgctccgacaaggcgattcgcgcgctggacgattcgatcatgggataatatgcctccggcatgtctccaaagcgagagaacggacaagcctgacgagtgcagtttagggaaaaaataatagcgggccggaaaaggtacctgacgtaaagttggggtcaaaatgaaggattgagacatttgcgataatactatgaattttaaaagacgtaaatgtatattttaagggggcgaacctccaggtaccccatagccctcccatcctgaaggccactcggagctgtcttgggcagcttcgccatg

SEQ ID NO: 963 - DNA, 703 bp, Nannochloropsis_gaditana
gcaacaatatttcagagcagttcgaaaatatttcaagcgtggcctgtgaaacgctgacagtatcatgactggtggatgtgtcaagagtttgacgaagaacagataacaggatctgcatttcttgcggtggccaagactggagatgtgtctcactttctacatggttcaaaaagggcaccaagatgctacgcagtcgatatatgtgctcagtctggctatatgtaggcggaaattgttcccgtaagctcgtgaaaaaagcaattgatagggaagtagaatcggaagtccttgttgatgacctgcagttcgatgacaggtgcctcaccaatcgcgacaaacgccgcgaagcttccatgacagaaatgctgtggtatttgtaccggaatgtgacggagtatgacgaaatgtttacaaggatttagttcttctagcacgccgcctgccggataggcacatcacgacgacgcacgcgacgaacagcgaacatactagtagtatgtttgcttcaattaccctcccacatctcgacacatgactttgtggttgatcgcctcttcttcagctgtaaactctcaatcatatggacaggcatatcgtgcgatgcttgacgctcttcagcacacatttcggcatcacttatcggggagcttggaggtgtgtgcagccccaaaatgagtacccatgtcgtaaaaggtgaaatatg

SEQ ID NO: 964 - DNA, 703 bp, Nannochloropsis_gaditana
atcagctttgctttgaactgccttggccgccatcgacgaaaagagtcttcgacgccccccgcttaatatgtcttccgtagtatttgcctggtaattcagcctctgccgtcgcgagacgttcataagtccgcgcttcacacaagaaatagcacaagacatgattcggacgattttcctgccactgcgaaagctcgtgatacgccagggcctgccagaagattcccgaatgcctatttacagcctatgatgtatatatttgaggaaagtggtacaaatctgctcatctaatgccagttatagcttcagaagctgccacttgcatgtgggagaaggcaacgggaacaattgcgcgaaaaaagccgcagccagcccccgcccaccagccgcggtagacccgcctgccagggctgtgtgctccgtctgtctcgggccagcctttgtggcataagcaagaccattgctatgtgacagaagactagaatttatacatgataagtgcaaagcgtttgttcacgtgtccagaggctgctgggcttgctggattgaaggcggggccgaagaactatccgtacttatcatcacgcttctctaactctgtgaaatccccggtctaaacagtaacattggcagcgtttttcgatttgtagcattaaatcacttcaagagggcctcacaggctccttcatatagatttcagaccatg

SEQ ID NO: 965 - DNA, 703 bp, Nannochloropsis_gaditana
agtcaacgtttttcaggtgctgtcggtccaattcttctcgtccaaccatagagaagtccatatccatgcggcgcagcagatcgctcaaatcctggacacattccttatggacttgatgacgatgctttaagcgctcccatcgtaatgccagcggtgccttgccttgagacttcatttgcaaatacatttcataaggcgtatgttttacaacaagtaaaagccttctaaagtggccaacccccatcccacgacggtagggaataaggcgggtttctcctctagcgcttgaggcccccaaaactaagaggatgcccaacctgctcgctggtgctaagagttgaatctgtcagcgaatgcgcacgcagaatgtatatttaagagggccttgcatgcagaaagtaatatcaggtcggcattatggtgcgagcgtgtacgtagccacggcgcatgagcgatgagccagatgcatcgatgctgggggtcgggaggttagttcaggcttgagtacaagatttgcttggtatcgatgttggccgctgtatttctcactggtcgtaaagatccttctaatctgcacttatccggaatacgttctgcaggactgaaaaaaaactttgtcgttcggtaaagtcatgagctctgcgcttgtatcttcctgcatttccgtctgtctactcacacgtgtatcgacgctcgtcgtaca

SEQ ID NO: 966 - DNA, 703 bp, Nannochloropsis_gaditana
ggaacggacggaagagcgctgaaggtcgatgagtccgctgcgctgaaggagaaaccctcgatgtacgagcgcgtgcttagatgcttctctaggtcaccgaagcctttgctaaaatcaaacttagagggcattgtatctatgagataatattcagaaagggcatctgtcagtccaacttattgggtgggagaagacgggaggatcagagatgcatggaacaaaggcacaacaacctcctgaatggatggctaggatggtgatggccgcgacatctcttatcactttacccagccgagcataattatcaaaggcgacgtcctcaattgtcgagaaaagagcgtgcttcgcaagggggcgtgggactgtcccgtccacttttgagcaggtggctagcccgtggggaggggggcggcgccgccgcggcggagagggtctgggcgctgggggagatgtgtggcgtgctggaggagtggttgcgaggtccccttcttcaccttgcccacgacccggtccttggtctggacacagcaaatcaggccaaggccatggcctgccatgcttgagcaggacggcgtaggccccattcgacgggccttggctcacttcaaacggcatcctgggtgcatggccatccgtgttcgacagccgtcatatgctcatgctcaccgccccatccctttaattcgacgtcacagaacgcatg

SEQ ID NO: 967 - DNA, 703 bp, Nannochloropsis_gaditana
ggagtgggtaagaagcgataatcgtcgacgtccgcatgcacgctgcacgtctgaattacaagtagaacgaccaggggcaacataaaagatggcatatctgccaaagacagaaatccagaaacgcacgagtaccttctcatgctcatatctaatacctcctttgtctcagcgacatgttctcttgatgaccaggaaggcacaccctgtcttggtgttttgatggaatttccgtcatgagcggatcagcacttttcctcgccttttcgatgcaatcctgccaatccactcggctctcgccatggcataaaatttgtacaaccttaacgtgtcgcatgtgcttggatgaaaatgctataagaacgcagcagcggtcgtgcaaggccagcatgggaccttgagcagcacgtgggccgcgcgctcgccggaaagtcgcctttccggcctgcgtctcgcatcaggggcgctttgtaacaaattgtttggtgcttgcgttcccgcacgcgaagcgcttggatggcaacagcaacagcttcccttcatgaacacgactcaatattactcgtccgacactgttgctcgcacaggtcatcctcacaggcgacagggtcttatgcccggctaaggagttccggcctggcaccggcccttctcacgttctggttcagcgtagcgcccccgccctcaattattgtgtcgcatcatg

SEQ ID NO: 968 - DNA, 703 bp, Nannochloropsis_gaditana
ctttcctgtgcgcagataattgttgagttgaaattggtttaaaaaatctccatagagagaaaaaatatgcaattcacacttctcttgcaccacaggctttcctgctcaccacgccctacgtgaggcatgcttgcattagcacaagcggattccggacaacataacataaaactgatctagtgtttagaatagtatagaatgaccacgttgaatcatgaaggatgatttttaacaccaagtgatcatcgtcttttatacacgacgaaagagttttcaattgtcacgcttaattgtgcaatgcaccgtcggagactccttgtaaggatacccggaggcaagtgcacgagaacctcgctagggagcagaccagcattacagcaagttgcgagcaagtggtagaagcggcgagcagtaccaaccatgagatgcccctcagtgttttcacaggtacgatttaagtgcgtgcaaaacgttttgatcacattagtcgaacgaacgagccgcgctcctgcaaactcacgtgaccatttcgtcctaggcttcctgacctagaggtgtgaaaagcacaaaatctcttataactgtttcttttcaggaataggaaagcggggagagaagcacgtaggccgcaatatatgcaatcgttagggttgtgtatcttttaggctagtattagatagctgcagcgtcggacaaggagatg

SEQ ID NO: 969 - DNA, 703 bp, Nannochloropsis_gaditana
tccctccactgagccgccataggccgggaggttggtcaaagggcctgcaaggctgctcgcgcgttgagcttttttgccactgtccgcgttccgctacatagcacggagtgttgtgtacatgccatgtatacctttgcacaattacatagcgttgagctcatacatcatggaaatgcttgccgtgatggatgaccggcgccctttttgttgcttccggaagaaggggcggggcgccttgccctctcgcttgctgcttgctatatgagacgctgcgcattcctgctcctgctttctcgtcacaacggaagcaaaccatggcagactccatacagatcaccacgaacagttcaattaactttcttccacgttctcctccttgatgcggacagggcaaaccaactcgaggggctagggcggaactttacgtagcccagaccatcgcccgaaagttgcgttcgccacttttccctccttcctcctagtcggtgaatgaaaccggaggagactttgccatcgcattagagaaaggttatttgcagagttgttaatagaaaatgacataccgcgttgtggcgacagctagcgatagcgtagtttcgacatgggagctaacgcgcgaggctttgctggagaacgggcaaatcatccacaaagcgacgaagcagcctggcacgaccaccggcacggtgcactccatggcttg

SEQ ID NO: 970 - DNA, 703 bp, Nannochloropsis_gaditana
tagcgatagcgtagtttcgacatgggagctaacgcgcgaggctttgctggagaacgggcaaatcatccacaaagcgacgaagcagcctggcacgaccaccggcacggtgcactccatggcttggaaccacactcagcaggtgctggcctgtggtacagaggaaggtgcgataacccttatgctcgagtcgggaaagacgttggaggtgctgaaagaggcggacgtgggcgcgcgggttccccccatgcccattacttccttggcctggggtggacgatcccggtacctcttgacgacgggacaggcacatagcccacacctatgggacctgaaaaggaaggagcgtgtgatggcgttcggcggccacgaggctcatgtgacggccgtcgccttcgccccggacagcgagcgagtcgcctcaggcaaccaccatggagaggtcttgttgcacaccctggtcgcccagcagcccgttaaagtccttcctcttgagctcagcgactcgaaaggcgggagccgagagccgcgcacgccctccgcctgcatcgccgccgcagtgcgctcccttgccttctggagcgcgcgggccccgacactgttggcggggcaccgggatggcgtcgcgcgcgtttgggacgcggggacgggggcctgcctgacatccctgcaggggcagcaccaggcggcgattagcgctgtcatg

SEQ ID NO: 971 - DNA, 703 bp, Nannochloropsis_gaditana
cgctgccaaggcacctctaaaggtaatcttttataaagaaggcaaccacatcagttgggaggaacaaatgcgttgggaggaacaaatgcggaaaatcaaagagtttggcgctcaaagggagttttctctgtccggaatgactgaaaaggggacagggataccctttaagtgttcaaaaggaatggacgagagcagctacttggccataagcgactatagtgaaaacttcgttgacgatggctttcatgagaatcaggcccttcaaattcaattcgatgatgatacctttaaaatgagctcggaaattggcaaaattcttaaagaggtgaagtctcacttgccctccatggccaagaacaaaagtctcacagagaaaatactttggcgcacttataatgatgtgggagtctggtttggattgcgtcatattttattggggttggagcattggattgggactgtgccgagttcaagcgcagagcgtgacgtagaggagggtgtcttggcgcgcaaacttgccctttatctgaaagaagtcctgccgaaagctgtaaaattgcgacggattcgactgctggaccgcgtggagaaacttattcagtgtctccatgagcggtggcagcaggacagggaaaacttcagggccttagtcttcgtgcagcgtcgaactacctgccgcgttctttatgaatttttaaacatg

SEQ ID NO: 972 - DNA, 703 bp, Nannochloropsis_gaditana
ctcggtcatgtttacgtagcgtgcatcagacggagccttggcagcctcgccgcctgcggactgtactttgctcataccaggctttgcctaaaagctcggagggagcggtaggaaaggagattgaggtgaagaagccaaccgtacctatatcgtgtaatagcaacaatgtcgacccataaagcaaagtggtgtgttacaattttcaggttcacacgatgtccacaacttttttccgcgcaagcagaagtagcaaagcagacctgaacctgagtgcacatgcgtactcctactcgacctcccgccccccacacctcgcgggcggtctgctgtattttctcgtcatcccccgcgctgtcccccccctgtgagaccctcaatcgcatgtcatgctcgcctccgatctggatcagccaggcccccctttgtgccgttggaggaccccaaggatgagcatgcatggccctgaggagttcgtgcctggagcattttagcgaagcagacgatcgatgaattgatattcctttgtgcttgacgtcccacgtttcgtaaagcgaaaccagagcacattctcaatcacgcaagataccacacttctctctcgcagcttgaaaaagaaagcgggctcagtggacgccgcattgtgcggaacacagagccggtggggaagaggttcgtgactcggtagccgcttaccctttccatg

SEQ ID NO: 973 - DNA, 703 bp, Nannochloropsis_gaditana
tttgaaatccttttcgaagtcctacagagaccaatctcgtcagtgcaattggagaggttgcgcacccactggatgagggcttggagtgaaaacgcagattcaaattgtttagcataatattttagcgttatgtttgatgtgatgaacaggagaaagtaccacccggaggtcggccaggtacatgacggcataatgcacgcgcgaccgtttcaaggcgaatgagaaaactatacacatgcgcaccttccctgtcaatagtctccggagttccccgaaaagagaaggcgtacggctcgcatggacacaaacgtggcggcttcgggccgcagagccctcgctctccctcgccgtcttcggccggcgagcaccggcatgcctcggtctcgacgcgcccgaccttgtggtgtgtgtgctggcttgggcaaggaggaagacgaacccgctcctttcttgtaatttcgttaatgctttacgccagctggccggccaatgcgaactggtatcctggctggagttggtatttcactcgaaagagggaaacagacactcttccacttcataggtcgcgtgacttgacctgtcaccttgacaaggagtgcttaattaaatgcatgaacgcatcacaaactgtatccccatgttgatttcggtactatctaggtttttcccaacagcgagcacaggtttagccgctcctatcatg

SEQ ID NO: 974 - DNA, 703 bp, Nannochloropsis_gaditana
tcacaccggttgttctggcaaggctccatgtcccgcgttactttgacaaaattttcaaattctccccatccgacagcactgtggtaggtcatggtagggtgaaaagccaacatgagaatcatctttgtgatatttttcacatgttggaaggttttattcgtgaatgtgtgtgagtgaattttaggcttgtgagtctgtgcgtgaaaaagcttataaaaatgatttttttccgcatcgatccaaacgcgaccattgagacccgatgattaatcacatgattaaagaagatgatttttcagggtgactatgtgaagttctgctatgtcgcaatggggttctgtgacagtgactgtcacgtaatacgttcccacctcggtgggtgaatggatgccatacactcacctcgccgacctcaggaactttcccaaagaaacttcttagaaacaatgtggcagatgccagtttggtcacttacggtacccgagtattcctgcttccatggagtgcggagaatcatttgaattctacttgaaaagctgttaacttcgcgtatgacagatttgtcagagaattgaggtcattaatttctccgtttccaaggcaagaggcgacgaaatctcacactggatgagccgggagatcagtttcatcagtaaatttacggacctactcgaaaacattacaacaaaacagcgtaaaaatg

SEQ ID NO: 975 - DNA, 703 bp, Nannochloropsis_gaditana
tctggtgccgataaaacccaatggagaaattgattgggtactcgtcaagacactcgcccaaagctctccttctcggcatttggtgcacggacgaggagattactggccccttccatcttttgatgcggcttctattcacaacgacctgctccttacgtgcagcccgctgacaggtcgaccaaaactatggggtccgattcaaatagttgagcagaaaactttggctgaagaacgtaaagcgagagcggctcaggcgactgcttccgcacgtaaaagaaatttgttagaagaagataaggacggaacagtggggaatccttctgtcttcgagatgtctacagccggcaaaaatactatgccggcggtggacaacgggttgcccgggaacatcgaccaaggtccacgcaagaagctgagaagcgggcaagatcgggacattatctcgttagagagggaagggtgcagtcaagacgaagtggagaatggccctgcagtaaatgatgttagcagaggcgatgctgtggaacgaagagctatgcaatcggatgatttgctaccgcacctccatctgtctgagtatccggttgaaatctgggacagatgcgaccagcaacaacccctgatattagttgaaaaaattttggatagctcctatcgttttcgtgcattatcacgcgacggcaaatttggtgagaatgatgat

SEQ ID NO: 976 - DNA, 703 bp, Nannochloropsis_gaditana
aatgttatgctgtgaactagcattcagagcttctacatgcactctcttgtgcatccacccgtgcgtccaaatggagtggaaagggaatccctttacaagcacccttacgactgaaaaaaggaatcatacacagcatgatgcttttcatgctggtagatgacttcgtgatgtgtttgacagctatgaagctggccgtctccacggagcacgacccctcgtagagggtgaacccgtcctttgttagtaatactatttgaccgctatggcggcatctcctttcaaatgggtttaaaaatgctaaaattcctattctttccaaataaatgggcggtgtacatgatagagatgtctgccgtcccacaaatctctgcgacacaattttaaaaaaattcaggagtttgcaatggcaacctcaagtcgttcgcgtgctttcttctgtcatctcctctagcagggggagaatggaaagcggaagaaggggagcaataggcagacttttcatccaaacgtaaaaattcattttttgggaagagcagagttttccagactcacgtgcgcggaggcatcaggaggttgttgttaatgcgtcgccatcccttccttggagaacttcaatctatgactcactcgccctcgtcacaacacccctaccatacatgctaagcagctgtcaatggcgaaccaaggagtcaagacaataatg

SEQ ID NO: 977 - DNA, 703 bp, Nannochloropsis_gaditana
atccttcgcgagatacttcgtacgtcgggctcagacggccgaggggtcgcaagcgcgctgagggaaaaacaagtagcactgcttatgagatgggctgattttgatttgaaatagtctagatcctatgagacgagcgttgattagattgtcctcaaggacctcttccatagcagattcgtgaactctaacggcatttccccctggtagctagttgttgctggctgtttctgggcttggcactgcttctcattttgaacctttcatgctccctgccgatcccttggtacattgatggctccatattatgtggcgtgtgagcaaaagtgtgcttacggcaaagcacgaatttattgccaatagctgggaccaggttgaattattgaaatagggattcttggcggacgactggggttgggtggtgggtgatagcgttgactttttgccttagcgcaagtacggtggagcaaaataacatcacgcccaaatgatgccaacatggatacaaaatgacaggtcaaggggctgaaggctctatgatggccgcgcccagccgtctaccacgaagagttgcctcgctgtcttggggcgcaactatgtctgccatcttggctgcggctgccaccttttggacgcaaaaggcagttggagcgacctactcagcaaagtggaacaacatcaacagacctcggataatgcgggaatg

SEQ ID NO: 978 - DNA, 703 bp, Nannochloropsis_gaditana
cttcgtcggtcaccaattcatagcgctatatgcatttggtaagtgtcaagtacgcttggaaatggacaaaggggcctcgggccgtcctacacaagggaacgtactatttgtccatacctgccggttgcctcgtcaccgttgtctttcatcaagacggccatcctcaagcatcgaattgtaatatatactcgctatggtccattgaaaatgatagtatggaaccgcttgtccgagaacatgcaatcggaggtaagaagcggaaggcgaagtatcataaccagggaaatgtacggcaaatgcattacactcttgtaacgcacatttatgttttcaccgattgccatgccgggacacatgggcatcatctgccggctaggctcgcaagttcatccgtccttggtagacgtgcggaatctgattggtggcaatcgagagtggcatcccgtggtcactcagtacgctgcaggtttaagatatgggccgggaggctagctcccgccctccagccccgcagcccgccgcatgcgacctgtctactacccaccattcttactcacgttgccgtgcgcacgactccacaggcaaagtaacgtgtcgaatcaagtagagatgcctcccaaggtgcgtgcaccgttaagggagggatttcttacggtcaagtgatcgcctgtcgatacttctctcaatcccaccttagctgatg

SEQ ID NO: 979 - DNA, 703 bp, Nannochloropsis_gaditana
gatgtgttgttcatggtcatgtatgttggcaaagaaaacgccaacaaaggacggcatactccgcaagaacctccccagggcctgaccgcctttaaggagcaaaggcgtcgcgagagcttgtgacacaagttagctcatgacaataagctttgttcaggatcttagatgtttcttcctttacacggaaggttgagaaaatcggtctcatctcctgttcttcgcaagatccctggcgctgcagggagcgtagagcggacgaggggagaaatcgccaagcccgcggcccaaggaggaggcgccagcgtgaactagaaagtctgcgagaagccaggtagaagggctcaatatcgctcgtttctgaatctttttgccctgtaacacgaagacttgacaggattggagcatggacgtgacagacgcatggttggcggcagtggcgagtgctagatggacaacaaaggcggcctctcctggcttcccctcctcgacctgtgtaaagtcccgcacagcttttgcaactgcctcgacttcgacttttccaaataagtcagccgacgccactcatgggatcataacagacccttttacgcagcaggctcgtgaggttctggacagcattcggaccaaggaagaaatattaaaaaaaaatcggggccgctacgtagatccgtatcgatatgtgccgtcgagggctgcaaacatg

SEQ ID NO: 980 - DNA, 703 bp, Nannochloropsis_gaditana
ttcccatccagaaacggaattcgggtcgacgcgctccatgaggacgcgtgcaagattataagcagtggtcgacactgtacgcatattggccagacaggccactatgagaggctttgacaagcgcggcaaaggtgggtcttcgagaggcacagtaggggaagaagatggtgatgctgccaatgaagcgggcgtaggaatcgcgtgttgctccttcccagcgcacgatgaggaagaagaagaatgaaaaatgatatacagctgtgcgcaaaagatcaagcccagtaaggacagcagctgggaggagggcttctgcttgcttgcccatcttcggcccatggtggcactgtcccgtctcctgacggagggaaaggactttaagatgttggtgtatgattcttaacgcaagaatgtgcgcttgccagccaccagttagactctaaagtagttattggctgacaacatcgaaaacgcgcgcggtaaagtaaagacatgacctcatcgcccggaacccgcctcgtgatcatcgaatgacgccagggcagggaccatggcttccccgcaacctgcctgaagcaggggacaaagtatgatcctgctgcctcgatcctccccgcaatattcgcaactgccgcctaattttcttcttcggaacatacaggacgggtgaatggctggtgtgacggcggcttgtcctttacaggcc

SEQ ID NO: 981 - DNA, 703 bp, Nannochloropsis_gaditana
cagcacacgtaagccaaaaattacacctgtaaagtgaacatccaggatgggaaaaaaagaagttgagccggcaaggacggcaattgtggtcggctgcgacacaggatgagacaaattggatagaacactcgtctcgagccgctgccaggtggtacctggactgttgactgaacaaatgggggtccagctgattgtagtgaatcgacttgagatgcatgcatggcttcagatcagctcaaaatgagagtctgagtgacatggggcatcgaagctgacaaacgattcaattttacttcttcctttttcacagtgcttctcagcccgttgcccttaaggcactcccctgccctttcacgataggtcctatttcggatccaggcacttggcaacagcaagactggtcgcaatgtctctcaagcgactctctgtgctgacaggacacacagacagagtgtggcatgtatcctggagcccgtgtggcagatacctcgcctcttgcgggggcgacagagctatacgggtctggggtgcgccgaccctgagctctggaccccgcacagaccaagacggcgacaaagacgacaggaatgaggaagaggcaggccaagaagaggggggcggcacttggcgtttgttggctacattaggggatggacagactcggacggtacggtgctgtgaatggtccccttgcggaaacatg

SEQ ID NO: 982 - DNA, 703 bp, Nannochloropsis_gaditana
atgatattggttgcgcatcgacttgaaggttgctaattgcggagtgggcacatgaaagccggaggggaagcgcaacaaggtagcgacgaaaaaggcgcagaattttagatggcacgcgcgcatttttccattcgtcaacaccacttttttctgtttgtgtgttgtcagtgtgtctcagtgagggtgcggcgtcggttgcgggcgcctggcgttgcaattcaaagcggtagcatcgagacagcatatgacggccatggctaagacgttgtcctgcctccgggctgcttgacgccaaggaaaaggctgcagcgtgccctgtttgcggttcattgatggaaaatgcacgcttgagataccaaagcaatatggctggcgggttggtccggtgtcggggaggattggatgaaaattaagtattgctgcctgtttaactctgttgcttctttccctccttggcgagaagacgctagcgttggaagcacccccgtaaaaacgatattataaaacatgcacagcaagtcaaactgcctggcacatttgatcacgtaaagtgacgctaagctgtagacataaaagttcttccgccacgacgtatactctcttatttttccttttatccaggcatcgcacaagaaatacgacaacagggtcggcagcatttccagtgaaagggccggtaccgcatacatatcgcatcaaaatg

SEQ ID NO: 983 - DNA, 703 bp, Nannochloropsis_gaditana
cttcccggatttcctgtcgttcaaccccaatctcgtactgcccagcctctgcccggagccgggcctgagatgccgacgcccatctttctgacgcggagctcctgggaaaaaggattgggcgatataattgcgtgcgaatcctccacgagacatctgtcatcaagcaaacacggggtacgcattgaagtgccggttaaggaagggctccagaaatgcgaggtactcgacatgacacgcggcggcgtgcagggactggcggaacggctttcgttgtatccccagcaagaatcgcacagccgagcagagacttcctgcatttggaatagtgaccctttggcggcgttggatctcggagtggtggctaccaaggcaaggagcgctgcagttgaggaggaagccttccttcctcgcggctatgaaggtgcccctgcagtcgttctgaatttgcatgaagacacaatggacgaacccgaggagagcagcgcgggaacagaaacggagcaggaatccactgcaggtggatactccccgatgcatgcgagtcgcctgctgcgcattgtcaacgactgccccggtccctacgtgctgcgggaagtcctgatcttgcccaaggatgagaccacgtctgcgtgttggatcgaggtggaagtaggaggctggatattttccagccagagtgggcgcatgccgtggaaatgttcat

SEQ ID NO: 984 - DNA, 703 bp, Nannochloropsis_gaditana
cccttccaacctgtgggaatggcgaatgttttgcgatacctccctcactacttcctccccgatgacatccggcgggcgttcctcggctttagggcggccaagttaagtgagcgttcagatccctacgctctgtttggcatcgtcaaatctccgacgactgtgttggaatattgcaggaacatgcgggcgatgctctaccttgaagaggcccaggcgggggaggacgtccgcaggtacgacttgttcggcgtgcccatcacctaccgcgaaaaatcaaaagataaaccgaacacaccgctggtggcgaccataagtgtgccaggggtggctgaaaagaggcctccccttgcgtacggcgattgtgtccgtctccgtccaagcagtctccccgcgatcggctcagggcgacgcgtcatggtggagatgcgagcagtcgtgctggagacgcgcgaggaaaaagtcaagattttactcccgccaaaattcccaacgagcatgtttccatccgactctcgcttccacatacgctttacgtacgatcgatatggatttcggttcctgcaccgggcactatacggtttcagcacgccggccccggccaggaggatatttccgaattttttctttccgcctgaggggggcggaccggagggcggggaaaatgagcaaagaggggggaagataagagcggtggcggtcgatg

SEQ ID NO: 985 - DNA, 703 bp, Nannochloropsis_gaditana
ccgttgccatatacatggacacccgtcccctccctcagacgctgcctctgtataccgttctgtgctcctcccctgtccccaccgacgaccgttgccgtcgaggcagagctcctttgcctcaatggtgagatcgtgtgaacttgagtgtgggggggcatctcaaagccggaagcgtgattggcccacagcaggcaagtagcagcggctgttgctgcagcgcggaagaggtgggaggggcagtctgaagattttctttttgcccatccacgcgggttcgatgtcgttgctttggacgacaccatcctgtgcagttgtgtgtatgggaatgccgtgtaagagaccagacatggccggcttcaattgaagggggccaaaacgagcgagggggcggagctcgtggcaaggggaggcgagagaggtatcttgccgggggactgggccttctgttccagtgcccgcgccccgtgacctcactgcacgacgtgggtgcagccagtggtataaatgcgaggagtaagagcgtagcatgtgaaattcgtgggtcatggctgcgatggtggattgtgattgtcactgacaggaggcatccagtggtgcgtgtcgtttttgctccacgccagcctcccctcccatgacgacctgacacgatacctcaaccatctcccctttttttggcgcacaggagcaattattttcgagtatg

SEQ ID NO: 986 - DNA, 703 bp, Nannochloropsis_gaditana
tcagatattatgactttgtaatagcatcaaagaatacttcaaggacataatatggtgaataattatattttaaatcatttgaataccggtgcggcacaaatttaagctagcagtgctcaaaaattggcttgatatagttacgaggaccgaccgaccgcagtcccgtccacgtgtggttgaggtcggactaaagggctttttggtaatggcgacaacatatttggggggacttagatctaggccacgaagccccggcgcgaacatagcgcgtcactcgcatgtggccattttatttaaaaaatgtgcctgacagagattgcccgccctaaaaacctgccgggatgaaaaaggcaagagagagtgcggaatgtgcaatgcccgaggtgagaggtgagatgcgataatgtggggtgggattcaggcttgattcgtggcctctggaaccaatcgtcaatggacgaaaaacttgaagaaatactgcaggtgatcgagtacaactatttttcaagcatttgtatgagcgtatcccggatttatcctcttaagggcaatgaatcaatctcatactgaagcctcctcccaacctcacctttgcgtcatcttaccttccgtcattaccacacatttacaatcgaaagacgacagttgacgagcattgggtctacccagagtacgacaaacgctccaatccttgtaatacatg

SEQ ID NO: 987 - DNA, 703 bp, Nannochloropsis_gaditana
gacagtggttaccaaggacatgtccaagagcctctttgataaggtacgcggtgttggagggacgcggatgaggagggatacagtgttgggagaaaaacaacgagcaaggcgtcgtgaacaccttgggtctcatgccttcctgtccattccccttacagttcaaggacagcgtatcgaataaggtgcaagagaccttcagtcttaagttggaggagcccgcgcccactgcgccaacaccccctcctgcggggggcggaaagaaaaagaaagggggaaagaaagacaaaagcggtgctgccgcttcagcggcaagcgagtgactttaaaataggatgtgtggtgggcgagaacgattcgacgcgcggaggacgtttcaggggactgactatcgttcggagggctgttgcataggcacgcgaaggaggaggattgaggcacttaagcaaattgcaagaaggtagtcacaatgcgctcttaattgtggtggagtcgttatcttttgaaagagaacacggaatattgataatatgaatattaagtttttgccacaaagtggacggcggtcccggggaggttagcgcccaggtggtgcgtttgtgttgagtcatttattttttctaagtcttccgagccagtttcattaattgaccatcacttgttcttcatcaccttcttcgacgcagagatattgcgtcccatcatg

SEQ ID NO: 988 - DNA, 703 bp, Nannochloropsis_gaditana
gggccttcgtcgtatccacggccagaaccaaatcgtccacctcctcctgtatcgatgttgatttcgagttggttttttaaaacgcagcagggcagttatcgaggactcttccgcattaaaaggatatcctcctgggttgcttacctcgacctcctcggaagccgccgcctcgtcctggagggccacggccaccaccacggtgcataggcggtcgcatctctttacaaacccttggggtggtttgaacgttaggaaaatgacgataggtgtcgtcaactgtggtcaaacaagaatgcgaagcgaggggctacgtcaagcatcaagccagccgtccccgcgcaaccccgtaactgtgtccaccacatgcacggacgaacgaaatttaaagtacagcgcggtgaaccagtaactcattggaaaaagaaaatggtcagtgtctgtgcttgattcggcggcaaaaagcagcacaatgacaaaaagagaagaacgacgccttcgacctcctcccctccactgaacaccttggcttgccttgatcgcatgcgcgtcgtcttcttccccgcggctggcgttgatatggcgccatgtacatgcgcgtcacatatgaaaatattgattctgtttcatttctgtcgcttttcagattgaaggcctaggttttggtccttggtggccgcgaggatcttcctactagacagccatg

SEQ ID NO: 989 - DNA, 703 bp, Nannochloropsis_gaditana
cttgagtaaaaaggcatagcacttggtttcactaaacggatcagggggaaaaggggcatgcggcgcggggtcccgggaacgacagggaggacgagaaacaccatcggcacgccggctgttaatcacacttgtaaaataggcgtaccacatacgggatggcccttggctttggtcgctcagttagcctagctggcgcgttcatgtacgtctcatacatgatatacgcccaaggccgacggcatgagcgtctaaaggcgtgcatgcggcgacggccaccactccgtcgccgacacccaaggagcaccctttagggtactccttgggaacaggaggcactcccccgagggaattccaccgctccattcaataatatattatgcactttctaattgaggagtattcgtttggattttatcgactgatggtcccgaaacgcatcgtcgggaagacagcatactgccttgtcccaaggagactccttgacgagcgtccgctctaatttatctcttttcctcctctgtggtgcggaaacacctatatcacgcggtgaaaacgaagctcacacacaaaattagtagtaaaatgcttgccaaagcagcttgccacaagctgtgacgagaagacttaatttctgatccaggtgaacgaggcagtagtaagtagcagcggtagcagtggcagtgcatttgagacggacggaatg

SEQ ID NO: 990 - DNA, 703 bp, Nannochloropsis_gaditana
ctttttaaagaaaaatgtctacctgcagcaagatgttttgaagattcagcttgaagtatgtaggcttagagagcaatacggcatcgtcgaaatttcaatttcctctttttcgagagctcaacgtacggtgggacgactaccgtaaccttcgagagagcttccctttggttttgcaggtactgctttttcattatcgatgccttacttactccgcattgtattacaaatcgtaatctctgtctgcacgtcaaggaagtatagttgtgctactaacttgttcttgaagggggtgcatcgcaaacatccagggcaatcgataccagaacgctgctctgtcgcatgcaggctatgtaacatggagcacctacacctcacgtgtagcacaagatattctttttgacccgatcgagtaggaatgacttgacggcataacatcgaggccaacctgttaatgggttggagtcgatacgatgtctggcactgttatctcctacaccatgcgcatccaagcccgcgttgttacgctcatacctgccaaatatatatttacataaaagaacagggaaaggtcatactacgccttaccgaagttgcacgctacatcaacctttatcttgtgttgcgctcgtacgacactatcttctgtaaaccgtacagaggcctttacgcgatcacatctagctcaagacgtctgtttaatatg

SEQ ID NO: 991 - DNA, 703 bp, Nannochloropsis_gaditana
atgaaaatcaatagaggcttacctgtttgttgcaagagccaaatgctactcgagtcagcgtctgattttcgtagtgcccatcgaactctgcagccatctgcttcattgtgtcaccttgttcctcagcgagactgaacagatgctcttgcaacataaaagtggaaaatatactcaaaacgagcatcagaccaggcattcgtgatgacatcactgcggctgccatgaagtaaggacgcccttcttttctacggcgacgaccaccagacactatggctgcgacacctgacgagaaatatgttcgagatcagtcaccatttctttgttgccggtgcgagctgatgggctctggctgccagaggcctggcgaataaacaacattcacagatgggcttgttgagtgagacgagaactacgcgaggaaaaaatttaaaaagccgttaccatctcctttccccttcacatcagcaaacgcaggcacattttccccacacacgtgcgttgatattttaaacaccgcgtttattttagaagctggagcatatgattcgacatttaacacggcttgatctatttaaggcttgcttctgaaaggcatctcggacccgctgcgaataattccttgcggagactgcaattcctatttccttccttcattgccttgcggtttctacaaagaaaacaattgatgagagctcataaatgt

SEQ ID NO: 992 - DNA, 703 bp, Nannochloropsis_gaditana
ctcgtcctccctccccgtcctcaaaccgcctccggccccctcctccctcgccaccccctcgcggcggcccaaattcccgctctcccattcccgcccgacgatacgagccctccatccccccaccctgcttgtcttccctccaccgacgattcaagggcgcaggctccggggtggcgcgtcgcccggggagggggcggtccccccttcccccgccggggcgccttccttctcttcctgcggcttgttctcctccgcagaggaagcctccgcgcctgttgccatcaaatttcccgcctcatcctccttccattcctcagcggtggaaggacccccctcctcccgcattcccaccttctccagctttcgtgccaaaatctcctcctcccgcgaagccgtgtccaccggccgcgccccgccgaagacactgcttcctgctatctcactcatcctttcccccgtcgtcccggcgcttcgaggcttcaaattcagacgcggcctttcggaagggccgtcgtgcgcccgtcgggggggcggaatatcctctccgtcccccccccgcccctggccccgccagttcatgggggtattatcgccccgaccctcctctccaccccgctccgacggtgtatcgcgttcgggcagacgccgacggggcggcgcacgttcaagatcgtcgtcgacccccccccaccgcgggtccatg

SEQ ID NO: 993 - DNA, 703 bp, Nannochloropsis_gaditana
cgacggcgagcagaacgagccaggagatttgaagaagggcgcaagctaaaaatgaaggctaaagaagagctagcaactcttgagggtattcgaggccgcttaatagagggccttgaggccaaaggtgtggcaagtaaatatttggcccatatacgcagagcaaagctcacaccagtttaaaaggaattataatagatcccttgccagcggaaaagagttgacagaaaatcaaaagcattaggcagattaaatttcatacataatcatgatcaaatggttcagcaaaaaatctacatgtttacttgcggatgatgttcaaggcgggaggtcgaagcccgttccccgtgactcttgagtggaacgagttccccgtagcataccctcacgttccatcgcaaaacaacgacaaaaattcacactatggatgatttgccagtgcgtcgtcgttttattgtatcattctcatatgtgccacgcctgtggggcatggaagctgtctgcctgtgtcaatttttttcgctggcctatcgtctggggcgttgagggatgctactagtagtactacttcaggaacagtatcacggagctgcggagctcaatctaggagcattccgaggaacgagattgagaatcgactcgacccatcacaaccaccaatacaaccagcatagttagacagagctcccacacctttacggccatg

SEQ ID NO: 994 - DNA, 703 bp, Nannochloropsis_gaditana
tgctgcggctccggctccggctgccacttaggctccccttgctccgcctgttgccgttcgtcggtgaagtttcccagctgttcaagtccgtattgtcttcgtcactgccgtcgctctgcctgccccccccagtacgccgccgtttgatacgccccaagctatccacgctctccacactgctgctcctgtcccttttgcaagcctcgtgatcgccaccctgttcgacgtcttcttcgactggtggagactgaagcattgatggtggtggcacattttcaggaggcttggagtcgccacccacggcattgctggaagcactggcctcgaatgtctgcatgcctcccgtccgctgtccctatacgcacctgcgacgacaaacgttcggtggcaaacgcctgtaattttcgatgttggagaagggagggacacgacgatgaggtgtttccaacccatcgcgccggggaaggagtggccatgggatctgacaacgtcgctgtcctcgctggctttcaccaccagccagtctgcaacataattacttgaacctgcccatataccatcgtacccatcgacactcacccaaccttgccaagtttttgcctatcgttgccacggcacatacacagggtactgcaaagggaaatttggacctggttttagcaagcaacaacaaggataccaggacgggaggacttggaatatg

SEQ ID NO: 995 - DNA, 703 bp, Nannochloropsis_gaditana
gacgatccaaccgaaggggcttcccaccgacaaagtgctgagataattgaacattgcgtctcggcaagccaaaaacctccccacctttgcgccgtccgcgcgggaagtctcgaaacgaatcatcactgtatgattgcatcttccaaagcatcggcccccgatgcgtgtgagatcaggacgcatcacggacttgacaaaaagccttgggaatggctctatcctggaaagagcgagggggatggggaggtcatcataccacgcaccttgcgtcaacgcgcgatgttgggcccttggttcataaacagcccgactgtaagacttatagcgacgatatgatctgttcgtgcgggaaaatatagttaaagaacctcgtattgtcgcgcgcgggtcgcaaattgcgcattgatgggtgggggcgcgggtcgtttgccgcttgcctctgaagtcgtcgctgaagacgcacaattgagaactttttttccagcctgaaactagcacaccattccacgctgcacaggcatcttggtcagattctacgcgagttaggttcggacgaaataggcaagcgcacgaaactgaagcttagagtgaagtgggatgagatggaggatgaccacgaaaactgcttgtgtggcattcaaacccccgtgactgatcgccgcccctcccaccttccccgactttagtgacaacaggaataatg

SEQ ID NO: 996 - DNA, 703 bp, Nannochloropsis_gaditana
ttcattctttgatatccacacgttcccaacgtgtctgtgtcgatcgatattgacctgcgatggcccgtaatttatgcatcgttggaccagttcaatcgtatcatctcatggctcgatgactttctgcgcttagcatcttgcgcggacgtacctgtcgtcgattcctacgctcgtgtcaagtacctctaattgcaataatttcgagaaagtgatcatgcattagcaatatgcatcacattcgtccataatacgtgtagttttttttgcattttagtttcgctggttccgatcgatttgaaggtcaaggaatagtctttggaaaaaagactgatccgaccagagttacagatacgttagggattctggcctgtaggtctatgaatttacacgccacacgctatcttgattgcatctaaagagtatcgagaccagagatgtgaaattaggcttgcgacgtaggtgtagtgaagagcagaattatcagcacccgtcgacgacgtcgtccacacacttagcaagtggagatgtttgctatttgaacaatgtggtccgaagacattttaaaaatcactcaagatacctccgttcatgcaaatctccattttttccctgacgcaggtggaccattgacgaagttgtctcttaaggctgacgggaagccggattcgccatctccccctcgtcctagtggtcgcccacaatg

SEQ ID NO: 997 - DNA, 703 bp, Nannochloropsis_gaditana
gttgtcaagcagaagagcagtaggaaatgccaacaggactttagaggtacggagagatggaaggctacaagccacagttgctttagacctagggacgaggatttacgttctcttagggagaaatttgtaagaactgcgatggaaagcacagataatctgattttgacacctcatcagccagtcgaacgtttgaatagagtaccttatttattgacggtgtagtgaattgatcaaactagtcgataagtctttcttggaagaggaactggacgagatacccgcagagttcgaaaaaatagaacgaacgcagaattgacatcaataaaaacgcaccgcgaccacagaatttcgcattgaagcgtcttggcttcgcatttctagtttctccttgcccagcttgatcatttaccctcctagtaccctcgccatcgcccacacgacgtcacgctctcccggtgttggtcggtgctcagcgcccgggcctttgaaggtagttttttacgtgaaaggccgtcctgtcttgcttaaacagccaaacgatgaccttattgcctcgttttgaaaagggtagtgcctcagcattcaaaattgaaattttctgtttttatatactcacactcaactagtcgctcttcacattcccgctccatctcaagtctggggtttattgtaagacacgcaaagcgttagcaagatgtgtgga

SEQ ID NO: 998 - DNA, 703 bp, Nannochloropsis_gaditana
ttttctaaaagggggagaaatggaggaatggctggctcgtaagacgggaccagctacagagcagcacagcttaattaaagcccttcatatttgcacagtgctgcatttttcccgggagtatggctttggccttgcgcacagccctgcatgcatcataagtgttggtcgtggccaaatctttgccatgtcgtgtatcaaattgccgcccaaaacgacagcacggaagaattgaatctctcactgtacataacagggaaactatttcgtgactttggacatggcggcgtcccgcgccgctgctgcattgcagcctcgcgggcctacgagcaagctagtgctagggtgtggatcaaatgtagtagacaaattctatccgattcgtaggtggcccaaggaagggacgaaaggctactttttggacgaaagtatctgtagcgcccgggtcgtgggaggtgtcacactgaatcacctcgtttgggctcgtgccttgggcacgcccactggattgttggccctacagggaacggatgagaatggtgtggcgatcaggcagacgttggacgacgtaggtgtggacacaagcgccataagggtcagtgagaagttttctaccagcttaagccacatcttcccttctccaggggccgaacggacgatcttgatggcccccgcatccactgcaaatttagacgcgaagacaatg

SEQ ID NO: 999 - DNA, 703 bp, Nannochloropsis_gaditana
cgccacaaagccgacttcaggtcttcatagttaccctcgagcactcacctaggatctcatcgacccagatggtgcttttgtcctcgtcgaagcaagcgtaaccgagcttagttcctttccttgccaaagccatcgtcttgccttcataagattctatccccgatgcgttttcttgttgcttccagggcatgcctccgacttgacaatgctccccttcgtcgccatcttcgtaccccccatcttgccttttttcttcgtcaacacccctcttcaagtccacggacttaccacggctccacgcagctttgttttttagttgcatttacccgatttactttacatgatcatcggtttgtcggcacgtgtgttggaaaaatgtgagggggaacggggggtacaatgggtgaggaggttggaggggcgagggggttcgagggcgacgccacgcccgctcctctttcagtggaagtagcacctgactcctacgccatatccgggcagggctgtccaaacaggatgatggaggcgaatatcgtggagaaatagcaacgaaattgttgaagccgtaaggcattgatcacaaggcaaagagtgcacgaattcagcttttggtggtaggagtaggtgagggcaggaggttggaggtgtcgcgttgttcacttgtcgggcgcttatccataccagacagcagcatcaagctatg

SEQ ID NO: 1000 - DNA, 703 bp, Nannochloropsis_gaditana
cccagcatgtgtcagccctcagaatgatgattgttcgcggttcatccttacgtacatgatgagtgtggccttgatgcacgttgtagaggtccgcggccgcagtcgagtcaattctgcgagcggcagcaaagacttctgcactggagagaaggtatagtagtcccagactcttggttattatgcctccacccatgttcgcggtgctggaggaacgtcgaggaaagtgagatggcaggttaagacggtgagacggaagagaacgaagagtgctggctcgaccgggcaacaagcgcggaaattccgccccgggcagaaagtaaatccacaaatgcagcgactgtaccgccaaaattcattctaaagaagcccacaagcgcagcatgccatttcaatggtaaaatttggcacatggcccccattcgcggcgtgtgcctcgcttcctctctcagcaagcctcgccttcccccctgagggtggccatcgagccaacaggtccctctttcacgtcaacatcaacccccacccctcccaacccgtacttgtgctcggaagtagacgctcttagccttgaaaaagctcctttctagacaagatccattgtaaatgcacctttttttttcttctgagtacagcccattcagcttgattcaagcctccccacccctcaagtcattcaatccttgttatgtcatcccacaggatg

SEQ ID NO: 1001 - DNA, 703 bp, Nannochloropsis_gaditana
cctcaggctcaccctgaagttcaggaaggtctattttctgacttacgacatcgaaaggcagcacaacacctgtcttcgcgtcggcccccaatattgctcggacttcttcaagcttcttggcattgcctgtgacaaaggtcaaggtaggcttgggacatccgttgttgcctgatgatgccattttgaaaccacgagtcgtcctcgacactcggcgcaggggtgatgaggtgctgagcaggaggcgacctgatcgcaaaataatggtgctcacaggaggaacgaacgcaccagcggcagaggaaagcccaagaatcagcagcaggaaggacgttaccaggtgcatacaagatgtacctgttgtattgtggaggttttcatgtgtgagcagggggaactttggctgaagtccacagcgatggtatcgcgcggcgaggcggcgagagcgcttagatagcctcagatgagcggtgcctaccgtccctccttcaacacctcccacaggaagcgagaatttcatcttttttacgttcgctcagtgtctcaagcttttcgttatatctatactatcgctacgtgacggtaggtacgacgtggccctgaaagagattaaagtgaaagaataagagggatcttgcctggcacaaaaggaggagcgcaccagcagcacccagagtcgaactttttttggtcgagacggaccatg

SEQ ID NO: 1002 - DNA, 703 bp, Nannochloropsis_gaditana
cgcgcggatcgtcacatcgagtcgttctgtaaactttcccatccacaatttttgataccaaaaaataactcacacctttctattgacgtctgataatttacacaggttacccccgtccgccgcagcccgtccgccgcagcccgtccgccgcagcccactctccgcagtcgcgcagcaccttcccgcgtccgagtttcgacctattccaccacaacgacacgaagatggttcattcaaagcgcaaagctctcgaagatatcactgctgttgccctttcgggctcacagcctttccgcgccgcttatgacacaggcggaaaacataaggtacgtgtaccctgtggcttatcaggggaccgttttcctccagcttcttcatcaaaatttctccttaccttcctgtatcctcaatttaacacattcatatttagcgtacgtgcatcgacacggttaatcaaacatcaaaacgtcgagttccagacgctccttgccgagtcacgcgtcgctcttccgctcttgctgccttctctttgaccactgacggaccggctcaggatggcaaagccactttccgccgcctgcattccacccggtcctgtcccaatgtcgagatcaactgtcccgtcccggcctcctcaaaagtgaaggatgataaggatagcgacgcagacctccacctagcatgcaaggaggccttagccatg

SEQ ID NO: 1003 - DNA, 703 bp, Nannochloropsis_gaditana
tcccggcttcttcacttacacggcaaagggggcaaggcgacagccatacggacagtggaggagctagcaggagccttggaaacccctgtcagcgggctgcccaccataaatgcatgagatgccaccgcaagcgagacagctccgaacacagcgcagtaggtcttcatagtttaggggataaatgcctgaatcggtttggaaaaagaaaaagataagacagaacggtcatccacagtctggtggaaaagagacacggatgctgccttcacaaacttttgtcgcgcacgcgcgccaaggaggacgcgctcccgcattagccgctgaggctccatgcaggtgcgcgacaagaatccagtcagtggggggcgggaaggggaagatatcaaggcgaaagcgatcatcatgcccttggacaccaactctgccgccgcgcccacctccattttcctctattctttcccttgcgccctgcgacgaggatttgtcgatgttgtggcgcaggggatgcagactggtgatcctgaaatggtggagtgtttcttcagggcgccgtctctgacgcagacgctccttctcgagggcgggggccctcaggcgaaaacgcccgtgtcgatttggtgatagcatctctcgagaaatgctcacatgcgcttcaatactttgcatgcacagcctttggctacttacttcgcgagtgaggatg

SEQ ID NO: 1004 - DNA, 703 bp, Nannochloropsis_gaditana
cagaaacacatggtgggggacgggcttgaaagtatcgcatgacatcagattgccccaatctcagttcgttggacacctgaaaataaatccgtacaatttttaaacgagttactaccaaagcgctacatgatcagcagtcgcgcattgtcgtgcactgaatgagctggttttgccatgtgaccatacccaggtccgacacccctcttgtgtcagtataatcccacgactgacctggattggagaaaagggacaggagatgtgcctccaggactcagcgagccgatagcagcgttaagaatatgatgttgctgtgcctccaatgacagagactgcctggttccacacaaataacaccttcgacgcccgacttagcctccgccctttccttgtcctgtctcctcactcctacgtgcgcggtggaaaatgtaagtgagcaaattgtctatgcagtgcgacacaagaggatagcacgctttcagatccattctaaagcaatggatcatggtccttccttctttttggaggcgccgtgtaagccgcaaagtcgcggagcagctcaagggagccgcgcacgtcacggcagccgttagaaaccgttaagggaattgggcactccgtgttcgcctacattttcaaggaatatacgcacatttgagcactgacatcactgtccacattgtattggtaccaccatacaggaatg

SEQ ID NO: 1005 - DNA, 703 bp, Nannochloropsis_gaditana
aggcacacgtctgtacccaatacattctaatcagaataaaagattcatttcttgctcatgttagttcttaaatatatagagacacgttgcgtattttactttcaacttagctcccaacggaatttgcatgtgacgaagcgtcgctgcgcgagaggcagttgaagggcaacgcaaggtcgacaggcgcatggatttatacgccttcccaagcagtacgaggataatgccctcccatgcaggtatttacaagatggcaactcgttcaaaaggacgtgaggcccgcaccaacgtgtgaatggtcctcgggacgcgggcacgacataaaagcgagggcagggggggggcaaattcaaatcttaacggctgacagagcccgggcggagaaacaacaaagcacttgttccgaaagtttgggaccttgagcttgatcgttgaccaggctccgggtcccacggaaaccctacggccaaaggtcttgctaatcttcgcaagtttacttgccttttgatcgcatcggctccagtgtgaggattgtctcggtggccttttcagcatctctgtgtttcgacagcttgacgcgtagttcttgtgcgtcctcgtggtcagtgcagttgaacacatacggatacgcacgatccaatcaacaccaccattaatcacatccctcgtccaacgttatgctctactcggacagcttgtcatg

SEQ ID NO: 1006 - DNA, 703 bp, Nannochloropsis_gaditana
agttttgccccccaaacgtcaatgacagtgaggagaaaaaaggaagagagtccccatgctcgtcgacatacctgtgatagagcgcagtcatgaccatgtagccagtggcggggtccgtgtaggtctcctggccctgcgccaccgctgaggcgtgtaagtcctcgatctcaggcggcagcggtggctttactggtggcgccgtagctgacgacgccggggacatgggcaaaattaaatacagcgacctgaacaatgaagaaaatatatgtttcaaagcggctcaaatcgctggataatttcatgtccgaggcgtgtagaatatgacacaggttctccgtgtccgacggcgtgccaccggggaggggagacgagggcgacagctcaagtgcccagagacaaggcctcgtccgctccctccacaagacgtaacaaccgcaaaaaagaattactgacgatgacgacaactaatttttctgcagaagcctattctgtcggggcaattactgctcggcgcacgcagctgatatttttttcgtctcgtttatcagctcccatgtcttcaagaggcctccggggccctctactcctctcccatgcttttttactcctggaccttatcaaagtctgatgcagtcgaagccacagcgagacaaatttttacaaaacagagaaagcagaggagctggcttcctttttgggcatg

SEQ ID NO: 1007 - DNA, 703 bp, Nannochloropsis_gaditana
ctcatactggtcttcgtccagcacgtcgtaaacgttgtcctcctcctcgatgaccagactctccagacgactcttcttcccttcccgcgccgccctcagattttcgcggtcaaccttccgcttcaaatccgctgcggtcaccaccttctcgcggcgaggtcgttctgccattgctgtatcgttgaaaaaatatttatacagccataaatcaaagctttgacttgctatcaggcagctaagaagagtttgggttcggaggaagaagaaagaaataaagaaagggaaaactcatccccgtcgtacggggcgagcagctagttaagatataaagagtgccaatcacatagcgcgccactttcgcttcgggccattttcacggggaaacgtgccggagactgtgttgtttccattcgtgccaactttttccctcgctttttcccgcggtcacgtcgtctctggcgagcaggccggcgttgcccgttcctagagcccgagccgctggatccgcccctgcctagcgtcccagccttcgtactcttaacgacggacagagagcctcccgataacctttacgtgtatgacgatccactcatgactccctcgctccttatttatgacagccgttaagctgtcgccggttcccctgagcctccacgaggagcgaggacgtcaggaccgcggcccgcggacgatattgggaatg

SEQ ID NO: 1008 - DNA, 703 bp, Nannochloropsis_gaditana
tctccctcatgagtccgcggcttgtaacctggctctcttcccttcatttccatctcccaagggccttcgggccttcgttgtaggcctgtgcgcacttggaaacattcgtggagcaacaagcggatagcctacagaagaaagcaggattccgcgaagggtaagcttggaagcgcttttgaaatctccgcccctcgggaggatgtaatggactgggaaagtgctgggactttctcagcatttgatgcgtctcagatgctctcaatgatgtaatgatgagactcaggcctacaagcatgtaaaacaatgtgtaagggatcgcctgcggagtgttcgtgcgcgtgcccctccaaagagtcgggtgttcatctcgggcgccattcgtgaccgagttgaggagttccccccccaaaaaggtacaaattggccacagtcctttttttatatctttgcacatcaaacaggaattcatctttgtgtactcatctgttcttcacacccagcgtacattgtccttgtgacagcaacaccttgcttccagacagtagcaacagcaggagctccgtgcaggggaagatgtggcttattctagtgcgttgctggtagctcgcagagttgctttacattttgaaaaggaacagctggtaggacagggatattagtttcaagtggaaagtaaaccaagccgagtttccgtgtttgcatg

SEQ ID NO: 1009 - DNA, 703 bp, Nannochloropsis_gaditana
gagcttcgccaggaccagttcctgggcatgcaccatcagagccaccaccacgccctccaaggccatggagctcacgagggcggcggtcccttccctttgcccgagcgcacccactcctcccactcgctcgccacctccgcgcactcggagggttcttcctccttgcatctctactacgacatccccccctacccccgccctctcccatagcggctcggaggggacgctcgagagctacaacacctcttcgcccgtccaggaaggacattttgggggctccgccctattggagggccccacctcctctctccctgcgcccccgagtgcgctgctcgaggcggcgcagcaccagcacctgcagtccttgggggggatggggggccagctctctcaccatcagctgcaggggcgggagcgggacggcaagcatgctgctcgggcggcctcctcccctcgccatggcggcgccgagcgacccccccgacatggcccctctcccatgagtcagaccgctgggcgaggccagcaagccccctctgcccaccaccaccaccaccaccaccaagaccccgagagctgggctttactgcacgtgaacgaggccgagcccccccccccctccgctgcagccggtagtcggggcggcccggggccggggggagctgcccgtcgtggcagcggcgcatcctccagcccggccatg

SEQ ID NO: 1010 - DNA, 703 bp, Nannochloropsis_gaditana
tttcataactgaagttcgcgcagtattcttcgtcaaaacaaagtattaaaacacctcatcctcatcgatcagtgcactgaagctcaaacatccaataacgtgtaactcctcttgagcgccttgtcatgataccctttgcttgacacggccacgtgtcaggaggtgaaatgatgcttttgcaccgagtttaccagcctccgcttcactcggtgctattgtcatcagcacctccgtcctccttgatacgccgtccttcgttgaccaaccgaaacttccttaaaaaagagccgacctcgcccagtgccggcctcgcctgctcttcctcggcaaggcgcagtgtttcctcatccccgccgtcgaatctccccgtcaattttttcactcgaatttctcgctgtattctttccaggctctctctcttttccctatcagtgatcgccgtgatgacacgtgcccaaaatagcgcaaccaccaaggacatgattaccaaggaaaagagcgctcccacgtctagacgagcctcaaaactcggattaacgggtccaaaatcagccgttgtttcggcaattaatatggaactccagacattacaatgcaagtgtgctggggccgggaggaagggccgggtggcgcgtgttgtggcaggtctgccccctgatcgaaggactgggggacgggagagaggtggcacaaaggacggatg

SEQ ID NO: 1011 - DNA, 703 bp, Nannochloropsis_gaditana
ataaaaataaaatgaagcggcggctgggcccttcgcgccaaatttgagtcctttcagtcatgctccggcaccggccttctcttgcctcctcttggccctcgtttccccccttccgcaccattccccttcgcgcccactttcactgtgtcttcttttgggaatgatgtgcggcctatcgtatcggacgaacgagttcgagaaaggacagtacagaactttgacgccatttccattttcgaggaacactaagctatgaagggctaatggacggccctgaagagatcttctcctttcctcttgggtgagacggaccctggcaccattgctgtcctgactgggacgattttgtggaggcatatatgtaaagcccacagaaatgcgtttgataagtaggtgaccgtctgaccatggcttgggactttcaaagaatgactgttttgcgtatgaaaaacaagtcgagacaaggtggccatggtggagcgcattacatggctctgaatgagagcaggtgcatgttgcgtgctgtggaaactcacaacactattgtgcaacacaatgatcgcaaaggcgctttttgtcttcacggtaggaatcgactttctcgaaatcatatcattcgtcaccgctttttttttgtctccgacccctcctccttgaccacagcattttctaaaaccatctccgccatcgcgctttaagcatg

SEQ ID NO: 1012 - DNA, 703 bp, Nannochloropsis_gaditana
tgacacccaacgcagaggggtggatgttggcgtggtccaagcgcgaaaaacgcctctactattttaatattaagacaaatgtggcagtatggactgcccccccaggcttaccggccataaacgaggacacgtaaaatgagctcgaaatcacgccagcggtcgatcaaaagcaatatgcaaggcccgtttgtggctccaaagtgaattttctgcataggctgatgcctagctatgtcatggtgacaatatacgacgagatgattctctccggcaatgagacgttttctacggctcatgtatcagccgccggttgcactagataggaaatcgtcgttgattagatcttggttgcccgatgcttccctagaaaaaggtcaaagattcttcccttccctatataggctttgtttcttataatatacgagatagctgctgacttgtcactgttgtggcgtgtagtgccctcagtccccgcccatggcgctccgcgggcaggccatctcctcttagcatattcccgctgttgcaaacttcatgtacgacatgatacgagcaggttgctcgcacaaaagccagagacccaaagccatgttcctttcaatcacatgtctacgatgaggctctctattctttcgtcaatttttgcgttaccttgctttcactgagattcattccttcctaaccgacctcctcgtgccgcaca

SEQ ID NO: 1013 - DNA, 703 bp, Nannochloropsis_gaditana
acgtagaactgtccgaggactgctcgcgtcttggcgtcgtctacatggtggctctcaaagagcggggtcacgtccatgccctgggtgagttccaaccagtgccggccaccgggatgagaggcgaggtagggcgctaagtcgtagactttgccatgcacgacccattcgtgagccgagtgcccgaatcgctcgcgctgcgcctcccccatctccttcatccaggcacgccggcaagagaacaaagcatttcgagacggcaatgcgcggtccatttggtatagcgggattttgcagagctagcagtcctggcgaaaaatatgcctttggtttgacgttcccactgctgcacggctgtatgcgcaggtccttgttgacgtgtgagggcaagtgagaggaatctgttggctgttttccaccctccaggccaggtcgcccacttggaccaccaaaatatctacgacgagaagagcatgaataagtccaagtgctgagaaggacatatgacattggcggtgggcaatgctcgtcgcttccactcagccttcaataccaccccttccggtctttttcttgctttttcatgttccagtcgccgccagtcggcccacgtgactgcccgtgtaacccccgctttccacgcgaaccctgcgtcagcgtctcctggtcacgtttcatgcgcctctcgcacgcatttccgcgtcca

SEQ ID NO: 1014 - DNA, 703 bp, Nannochloropsis_gaditana
acagcagtcatgacctctatgaggatcaatcgagcaaaagtgcgctccgcgcgggctgaagcgagagacaggaggtcatgtctttcccccgctagtgtagacgtcaataacaggcttttcgtgctcttaatctagattttcaaaacctggaaggaccgtaaaatatggttgatgctgtcatgttggttgatgaggcatgaacacaaagaagtatggtggcgacatgacggaaggaaggtggcaggaagggaatgaacgaatgagaacaaaggattaaaaggtactagctaaactccgatcctgatgaagtgaaacaaaaaaacaagcttgcgacattgaaatctgtcggtcgtcactgttttacataatattcgatgaccagatatatatgaggcgcagaaggcgtgaaaaagagtgtgcaggcatttcggcagactgcctgacaggggatgatagaaggcgaagacaatcgacaggtcctgtgcaatgaccgcttcatgcttcccgcacaacacggttgaatgacttcatacgtcagcgtgagcattccaaacatcacggcttgagtggccaaccagcaatctattgatcggatttctgaagctttaacaaagtaccatgaaagcgaacctcctggtaccacattctaacctgtcgtctactttgacacccacagctgtgtcgatcctagtgaaatggggaa

SEQ ID NO: 1015 - DNA, 703 bp, Nannochloropsis_gaditana
ctgccatggaagtgtctctgtgtagccgccagctcaatcgcggctcgacatcacgtaggcttctctgaccaaacaacgatgcatggctgatgcctgcgcgcttccccaccccgcaggagcggatggccgtggaggagcaacacaggagccggagcgcggggaaaggcggggattcagacgtgcaggtcatgcatgatttcattcggaagcaggctgtcaaccaacaagccgactatagcgtgagtaagggcaggagggggagacaccgcttttgcctcgtcctaggcgaggcggagatcttcgtgaccgagtcatttttccagtcgcttcctctgccgatgagcctctgagtccctctgctttcttaccgtatttctgtgtcaatcgcccgctttccgcacccatcccaggccatcttgcaatcggggcgggggaaagtgaagagacagagggacatcgagccctcggcgtgaggagggcgccgaccaagtggcggggaacgaggacgggaggtagtgagacgggcgctaatttaaaaaaaaagattgtacatggtgtcaaggggaatcaaaagctgggagggccgtacacgcgggcttctcgcggtctctcttgactttcttacacgcctgcttcccgcctcacttctctctcgctgactagctggtcgcctgagtcagctcctgctcgcctcccccccccc

SEQ ID NO: 1016 - DNA, 703 bp, Nannochloropsis_gaditana
atgacatgtatcgctctcttattctcttccaagacgcgcagcatcgtctccagctcagcatcaacctttctcttcccctcctctgccgactccaccaagcggtcaatcgactccaactgctccttgacgtgggtctcagctctcaccacgacatggatggcggcgtcgaacatgtgggaaaaggccatgcccacggccttgtggaagcttgccgcacaatcttgctccaagagtgcggcctcctgtgtctgctcgtccttgaagttcggatgcggccgcggctgctgctgctgctgtatatcgtgagcactgaaagacatgtcaatgtctgcgtccggcgtctcggtgagcgttttgggcagttgcctgtgagaggtggaggaggaggatctttgaaggtcgtgaacatcattagacttctgaaagcaactgactcatgtgcttcaccgggcagcgatctctttcaagatgatctcattaaaccacagcatgtttccccatacttcttctgcgctttccttttgcagatcctaatttggctccaccctcacaaatttcgcagtccaagcattccttctcacgttttgacattcatgttaaattacatatatatattcgttccagtttcctgactgaaatacagcctctgctatggcctgtcaggcgcccccttcttgtctcccgctaggcggacaccgcacat

SEQ ID NO: 1017 - DNA, 703 bp, Nannochloropsis_gaditana
tgccatgtgtccatggcggacgccacaacccgcggtgttcggcgaggggtaagcgaggagggacagaacgcgtcggagaaggggggaattgcggccatctggttttcctcggtctgtgacgaggcgattggcgtaatctcggcagcagtcttctgtacgcaaagccgtgatggaccactgatttgtactggcatgccagcttggcctcgtgatggagcaacttgtggcatggtcgtgtcacttgccatgttgctggggcgctcaggttgaactaaagatatgcaggcccggtgaccaagatcgcctcagcagcaactgaaggacactccacacggcaaccggtttgaccgtaatattgtttttcctgcttctcctcgcggtcgaggcgacgtggaaatccttgatctttactgtttttaatatgtttccatacaccgcgtaacacctggcgccatgtgaatggttcttgtgatgcgctcgatgcgcgcggtggcgcagtgactgtgtggacaaggtacgagtcacgcatctttctagactccttgttggaggcggaaggcgaaaaggcaactggcggacaaccatagtccctggtttctggtggatactctctcctacctttgaaggtcaaaattgtgccacatagcaatgacatgttaagtcatcacatgctaacgtcatccgttgatatatatctactcaa

SEQ ID NO: 1018 - DNA, 703 bp, Nannochloropsis_gaditana
cggtgcagtttgtgggtagttggcaggcagaatgacgcgtccgtggtagatgcccccctcatacacgctgcccggaggcccagccaccgagaaatgccattcatgcagattgcctcgacagggtgccagccgtatatgctccgtgttgttgctgagagagcaattgccttcgccggagtccataagcaccaaaccctcagccatgatacccctccattcctttattagacgcctgtatgacagggcgaaagaccgcgggaggccaggtggactcttcttcccccctttgttcggtatgtgaagcgcataggatggccgatgaaagaggaggaggaggaggaggagagagaggagggagggcggactaagaagtgcagcactcccccgccaccacatctttgtgaggccgatagtccgccgggaacctgtacagtcctattttggacaccgcatgcctgtctgatgtggtttttgacgtgaagtgagaaacttagcaactattcaaaaaaagggaggtgttcaagtagccaagtgaagaggaagggaggggcctcattgctcgacgctcgccctggtggaaggaattcctcgtttcaaatcggccgaggtgtccctcttcgacggacatgagagttcttggattacacattcgtggattacttacatgatgcatgctttcgtccgtctcttgaactttcctcca

SEQ ID NO: 1019 - DNA, 703 bp, Nannochloropsis_gaditana
ggggatgtgaaggaggaagggcggctgcggggtagcttgggtcgggttcttgcacaacagtcatcacagagttttgtgtggtgaacaaagtcattaagcattctgagatcgcttgggcggaggccgctgcaggggcttgatctcctacttgtcttttttatttctttcggagatattctccttcgtgctatttttcgtactgtaagcctcctctcgtatgagactctttgtgtacttttctccctccctcccttgctccctctctccctccctcgctccctcccacgagcccctcatctcactccgcctgtcacgagtctggcaaacatccttcagccccctcactgccatcaaatggtgcaaggatgcatccacgtgacctcaatgacgctagttgagatcacgcgaggccataagccgccaatcgaggcgcagacagcttcacggtggcctcctccttcccccccgctcccccctcccccgtggctcccagggccgccctatcccgctttcccttgcgctttcgcttctttttcttctcgcctttctcttcttgacccggtcttcccgcccctgacatgccctgcgccgtcttagcccctggccccttcccaacaccatccccttccttccgcccctcctccctccccttctcccgctccgtccccttccccccctccttcccccccccccgcccgggccc

SEQ ID NO: 1020 - DNA, 703 bp, Nannochloropsis_gaditana
tgctcctcgatccttggacaccgtcccgtttgtccaagacctgtgacgtggtgagaatgtgccggtgcgtcaggttatatgcagagggtgggccttgtcctcttgcaggcttcgttcgccgcttgggacttcttcaagcgagtgacgacgcgtagagacggtcggttggcctgccgggtcacgcgaagtccacgccctcaccacaaccgccagacccaaactcggacggcatacggagtgatggagccgaccttccacttccccgcacgtcgtgaaatggaagggcggcggccgtccaggagaagaatcggtcgtggcccgtcgcctcgagacgctgtcgtcgggaactttgatcgataaggccccccccctggccgaaatgaagtcacgctgtgtgctcgacaacggacgaacgaaccacgcatttttccttccctacgtgcgaggaaacatcatgtcactcttcacatcatagtctcatcccactgccatctcctcctttccctggcacatttttcaaaatctcagacgcaaccatgggagagacccgggcatgggccaagtacccatgctatagtggactcctcctcctcgtgctccttctcgatactctttcgtcggccaccgcggacaaggaataccaagctcgcttgcgtaggccagcctccaatcttcctagctcgtaccccgaagatcctgaaga

SEQ ID NO: 1021 - DNA, 703 bp, Nannochloropsis_gaditana
gaagtccacgccctcaccacaaccgccagacccaaactcggacggcatacggagtgatggagccgaccttccacttccccgcacgtcgtgaaatggaagggcggcggccgtccaggagaagaatcggtcgtggcccgtcgcctcgagacgctgtcgtcgggaactttgatcgataaggccccccccctggccgaaatgaagtcacgctgtgtgctcgacaacggacgaacgaaccacgcatttttccttccctacgtgcgaggaaacatcatgtcactcttcacatcatagtctcatcccactgccatctcctcctttccctggcacatttttcaaaatctcagacgcaaccatgggagagacccgggcatgggccaagtacccatgctatagtggactcctcctcctcgtgctccttctcgatactctttcgtcggccaccgcggacaaggaataccaagctcgcttgcgtaggccagcctccaatcttcctagctcgtaccccgaagatcctgaagatattttcgtgcaggcgctgagtgcccagtctgcgagggcgtctctccactacttgacgtcaattccacacatggctggaacgccaggagatctgaagatggcccaatacgttcaagcgcaatggcaatccttcggtattgaagccgaaattcagccggttcctgcgctcttgtcctatccgcgc

SEQ ID NO: 1022 - DNA, 703 bp, Nannochloropsis_gaditana
catgtcactcttcacatcatagtctcatcccactgccatctcctcctttccctggcacatttttcaaaatctcagacgcaaccatgggagagacccgggcatgggccaagtacccatgctatagtggactcctcctcctcgtgctccttctcgatactctttcgtcggccaccgcggacaaggaataccaagctcgcttgcgtaggccagcctccaatcttcctagctcgtaccccgaagatcctgaagatattttcgtgcaggcgctgagtgcccagtctgcgagggcgtctctccactacttgacgtcaattccacacatggctggaacgccaggagatctgaagatggcccaatacgttcaagcgcaatggcaatccttcggtattgaagccgaaattcagccggttcctgcgctcttgtcctatccgcgcgaggacacgcggcctagcttgactttggaagacggcagcacaaagtcgacgctttttgccgccactttgtcggagccatttcttcccgaggactctacttctgacacatggcttcgtaatcatacctttctggggtatgcgcctagtggggaagtgaaagcccccttggtttacgcaaattttggtcggcccgaagacttcgaggtgctagccgaggcgggcgtgatcgtggaaggaagcattgtcctgatgcggtacggcgaatgctt

SEQ ID NO: 1023 - DNA, 703 bp, Nannochloropsis_gaditana
tggcactccctcctccatctcatgctagaacacgtcaaaaaacacatcaggcatgcaatggctgtgggagaagatgcccacatagaaactccggcacaaaacacttttttcatgtatgtcaatttccctgattatcctccgctattcagcgccataccttagcggcctcagcataggtaggcgataaatgggtcagaaagcgcacaacctcgttcgggtcttccgcaggttcctcaggctctggaggggcagcaggggcctcggcctccgcggcagagacggcctcatttttgctttcactcatcttatcgtgtttcgtgctctaatccagatttgtgcgcacggatgcggtgttagttgcctcctggctctcgtgagagtggtctgatgtgaagtggaacgagaggcgtgaggaaccggataactcgagccggccgcatgcccgccgatacactcccgtcccgcgacgcgatctcgtgaacgccgggcacagtagatatcattcacagtcctgcacccgcggaagccagggagaaacgaaatatcatcgacgcccactcttggcggacgcatggcagcgaccgctctcactatctggcgccgcctcgcccaaacggccttcccttggctgccccgccccaaagtcaggctttcgcaccgcccacgcgtactgcctatctcctgcacgaaacaggttaccatg

SEQ ID NO: 1024 - DNA, 703 bp, Nannochloropsis_gaditana
aatatgggagcacacccggcgtcaaacccaaaacatgggagcatctcccagttaagtccgcgagaaaaaagcgagctattctcacatgtgatttagccactcctggcaatgtaccgctgtgaggcacatatataccctccacgctcttttatttgtggaatgcatacattcccctcctcatcggccctgtcgttgcctcgtcgttccccgccgcatttttcttgctcttcctcttcgtgtctcaacccagcgtctgcagagaaggaaaagtgattctattttttcataggcatttccctccaagcatgtgtcgtgatgtgacgctttgtggcaacagcgcctttcgaggcgtactctagctatcgccatgtacctgtgcttcacttagcgatgtgttttttttgtcgcgtcgtcgccgggagtttaaaacgtggggggcgggcaaggcgtggaacgagagaaagaaagggcgaagatgacattttccatgacatcgtaggggttctaaaagccacgccctggcatgcgatttcttattatacccctcacgtcatgcacaccctattctccatccgtgaaggtgatttcgagggcctctgtgagtgatttaagtggggagccagcggcaccgggtcaaataaccccccccctcccacgggggttcttccactccagtcttcacttcctatttgtccacgccatg

SEQ ID NO: 1025 - DNA, 703 bp, Nannochloropsis_gaditana
cgcgacagcacccatgacggacgtattatgcacaacttctactcttattccctcggctttggctcgtataattatgtccgtgtgggtggtagcgcaaagaggatcacctaccaccaaaaagcatacatcggtctctttagccggcatgtagatccgctctgcttcactttcaaccatatttcgatccgcaatgacaatagactttccaaagacagtttcaagacgctctttaggggttcccaagacagatgtgtaagcctctaaaaatatgacttcgcttcgttgcactgccttcagcccacgcacagttatatcatcttcatcgcctaaacctaggcctacgacgaacaaaaccatgctgcttgcttcctatatcccaggtttaacgtgagatttaacgtgcaagagcctgtatacgtggaattcagacgttcgagggtgaaagtgaggcgtcaatgcacagaaaccaagcaaggggggaggttaaggagggaggaggttgttttccttgtgacacacgagccggccaccctttttactgtcagaccacccggctactctaaaagcttccaagccttgcctgtgcatttcacgtatgcatttcccgcgggcattaaagtcgataaggacgcgctgcacgcagtgtgttccggcctcacttttttcttacatcctgacatcctcagttcctcgagccggaatg

SEQ ID NO: 1026 - DNA, 703 bp, Nannochloropsis_gaditana
cgctggtctattccattcttcatccgcttcttcctgaaagcagcacggcctctgtacgcccctattttttgcttcaagtggcttggcctgcgtgccatgatactttggcgctccttctcactcttcgtcctcccctcggtgccctacgtcgccctttttacattccgcgccatctacatgctcgccgcctgcgccctggtcactgtcgccttggatgagttgatgcatccactcctagagtggacatacaacatattttataaaggccataggccgcttcctgacctgtcttactacaatctagcggaggcgtggtcgaggaaggggactgagggggcgggaggttatacttggcgggatcggttgtggacgttttgaattaatattgtacacaaaatgtaaatactttgggaatttaatgttgttaagcttgataagattttttcccctttggtgtttatcggcgacacacgtcgctcgaagattgtttgggctccccattgtgttagtcatgcctcgcccacaaccgtgaggtcgctgaggaggatttgttccggtcgccgccttgcgcaccgtagtgtgtgcatttcatgctgctttgcgggaaatatactggttttgtacgcaaaagcgacctaagttgctttgtagtcggaaagacagcgctcactctcttttttgaaacacccaatctttgcagatg

SEQ ID NO: 1027 - DNA, 703 bp, Nannochloropsis_gaditana
acgaagaagccaaaatatctcccttcgaaaagccctactacctcctccctcgagtacacccttgtgaaaggccggtttgttgcttgaatgagtcgctcaccatctgcatctctttgacttttaactcaccccacattgcggtttctcatgctgcaggagcgggatgcccctcgaagttcgttaccggggtcacgggccttcactaccacgccacgactaccaggaactccagcagcaggaccatatgcaggccggtcgcgttcacggccacccgagcattttcgcaaatccttcttgcactgatgagcattcctcttcacagggtcaaaacactttgagggacaagccgcagcatcgaacggtgtcccaccaaaaatctgttcagtgcatcgtgagagacgtcagaagcgcgacgtcccatgcaatctcgcgtttaaatgacggttcggacgccaatttgtcgcctcattctcacactgctagctctagtgatggtatagcttgcggtggaaacggcgtctcgggagagaatcgacaagcctctctcccagcagtattagtagacaaatacgatcaccacgatcctcctcagtttaccgggcagccgtcacaattcacgtcgtctcagtcccacgcttcagatgaagactttcgagctcgatcaccctgctcctctcaacccgcttacgctacgagcgagatg

SEQ ID NO: 1028 - DNA, 703 bp, Nannochloropsis_gaditana
ttttacgtggcttcacagaatgttggatcatgggcgggtgatgaaaagtgcaaatactgtctgttgtagatcatcgacctcctgctcgaggctcgtgtggcccggggcagggcgaagatactttttacgaggtcacttagcgccataaaccaaacacatacgagcgtactcgacgtatgaggttgaggaggtgcgcatgcacgttccaaaccatctcactgggcacgaatcgtgctgtgccgggcctgcaatcaccggggcagggagtgaaaggaagagcatccaggtcatcgcctttccctctcttgcatgcgcgccacgagcgagtacgcaagcttttccattgttcaacaagcacgtttatgccactcaaacattcgcctgccatggggacacttatgcccgggtatactgtattagaggtcgcctcactttttgtcagaattttaaggtcgatgacagcgccttataaggagggccacggccatttcgatggttgagttgtcaaagcaggccaacgagctttatcagtgacgctcagcaaaagcttactacaggtcatgccacactgcatgatctttcacctatccgtttacttacgtgacaagcaaatttcatgacatatttctaggcatcggtggcctttcctgtagagactttcatttcgtgcctttcccgtggttgaagccggctcgtcaacatg

SEQ ID NO: 1029 - DNA, 703 bp, Nannochloropsis_gaditana
gtcagacacgagaaggatactcccacgtcccaggcgtaataggacagctcacttgagtctccctactttgtcctgatgctatcggggcaaaagaattactttctcacgctcaaatatttctttttgataggattaggactcgcagtgtgatctggcggtcttcctcttgtgacgcgctgtttgaaggctttaaatgcgttccatcggtgcaaaaaggcttggctcaagcacccgcactcaggacttcaccacgttgttggcagtcttttgtgtattaatgaaggtcacgacgtgtagagcctggcattattctggtagaattgcgacaagtaggcagatgctctcaggcattggtcccttgttacgccgcaaatccttcatcatacatcctgccacgtcaacaaagtcaaggcaacacatttccataaccgcaaacgccgccgctgaaggtagccggggtagcgcggcagtcgcacaagatttaaagaacaggtgaagagattactgaatgaaaaatcatggtgaaaataattgcgcaagaaaggacaggggaaagccttcgcagagtgcgcagggcatcatgtttcccacaattaattgtttttgggccctttttgatagcagggagacgcaaaaggagagacagggcaagttagatttaaaccctccgcgaggtacacgagacttttatccggaagacatg

SEQ ID NO: 1030 - DNA, 703 bp, Nannochloropsis_gaditana
atcaatctgcttgcgcatctctccggcttgtctcactttgtcaagtaaagcttcagtttcttgcaaacctttctcaactatctgacgcaccatcgacccctctgacaagtggcttgtaagacttttccgccactcaatcaaaaggtcgtacgcggcccgggttccttcgcacggttccatggctggtttttgaaagttgttttcccgtgggtgtgagttcaagagtgacaatgtccagtaaacaaaggttcaccttgcatcacatgcaggaggactcatcgtgcctcgctgacgagcaagatcaacaacgatgaaaattagcttggatcgacgcatctgaaatttgaccatcatcaagcaggttttatcttttcaaatcgacgcatgtcttttgacttcatgtcaagagcatacattgtcagcttgccatttttgtttttcttcgtgggctccctatttcccgtcgctgcagcgcacgcaatcgtcagcgggcttggacacggcagagaggcttggccgcttggctccggactaggtttcctccgcccttcacgacgtttaggtggcaagcgcatttatcagggtggtcgttcgggacgattagcgatggttgcgggtgcaagcacggatacagacgagtgggtcttcgacgtttgtttcacagggaccgggcagtcgagctcagtgccgttgcttaagcatg

SEQ ID NO: 1031 - DNA, 703 bp, Nannochloropsis_gaditana
ttgtcgacagggataagggatgggtcgagggcctaacgcaggcggcgggcgtggtcgtcgtgagttcgtggcccgtggaggagcgggccgtggggggcgcggggggcgggggagcggaagagctgctggtggtgggcgaggaggcagggggggcggtgaaagcggccgtgtgagtagtgatagaggccgcggagggagcagtagcggaggcgggggcggggccagtgggaggaatcctggtggaggcggcggagcgggtggcggcagggacggggcgggactgaagaagaaccatgtggtgatcggcgcggagaataagcggttgatgctggagcttttaaagcagctgcatttgacggatggggacggggacgacgggatgggcggcgccgagctcctgaatctgctcctcaaagaggagaagcgggtcttcctggagaataatctcgtaaacgcggcgacgaagaagtccgcggccgtgcgacaaaaagaggcgcaacgccttgccacccggggccggtcgtccagggtgcaagtaatcatatgcgcatggcaccacccagagaccactcagaagcgggtggtggtaggccgcgtccccaacctgaccacgcttttcgaggcggcccgtgacaccctcttcatcaaaagacccaaggcagcctttgtcctggagacggggctgtatctctcggacaccatg

SEQ ID NO: 1032 - DNA, 703 bp, Nannochloropsis_gaditana
gcggctgaggaagttcctcttcagtcgtgtgagacaaagtgttggatgacgacgcgaggacttgtttctcgaatttgtcaatgatcagttgcaatgcccgtacgcgcgtgaaatatccgcgcttgatcaggggtgacattcgtggtaccgggggatagtttgggcggaagaagtctatataccgatcccggtagtaaccctctcgcacgcacgctgccttcccgttcagagcttccatagcagtctcttgcacgcttgtgccaaaagcacaagcggaggatggcccgtttggagagacagagtacgaaggagctgcaatagcttggaagttgggtgaaggtgggagggtcgggggccatgtttcagattcttcctccatagtgatagagtaggccagcggtagttgaggggaggtggaggagctaactcttctcctgcgctgcggccacaaccaagtcattaggcattatgtgtgggcaaagcaataaaatgctaaccatttcttaaattttctgtgatagttttgagggacaatcatcgagctggtcaggaaaatgtctgccagaaaatgcgcgtcgtctcttgcgatttcgagaggcaagcggcggggagtctgcgggagatgggcgggggaagcaagcctctctgcgtctttcatttagactatcaaaccgtaacgaccgtggcctgccactatgcacag

SEQ ID NO: 1033 - DNA, 703 bp, Nannochloropsis_gaditana
tattcctgagttacgaaaaatagcatcgtttccactcgtatctcgctcacgtccactgtgaagagtaaagaagcaatgcgcgtttgatgatgttcaactgtttattttatagcaacgttccttttttcttgttctaccctccttgtacgcctccttacaatgtcgcctttatctggggggctgtacggtgtatgggccctgcagtaattgcaaattatagcaacaaatgatcatccttctcaacctaaatgtcacaaatccttaaataggcttatttaattatgagaaggcacttttttgggttttttgcttaaaatttgacctgaactgaagatgttatgattgaggttgcccaagcataacctaagcctctaggcctgctattcataagaaggggaaaggtgttgattcgaaatggaacaagaagtattacatagatatttttcacggaagtgcccagcttgcctgttggaattatgaattgacttgcgtgaaagagattgcagggatacactttcccacattttttcggcagcaagggcctggtcgctggcgaagccgttaaacctggccggaaccaggaccctccaggccgactgattgtctctgttgcccaacatttctgcctacaacacaacaattacagtacaatgcttttctattagatcaagacacaaaatggtggtgttcccggcgacatatg

SEQ ID NO: 1034 - DNA, 703 bp, Nannochloropsis_gaditana
aataatagggcatcagaggatttgtttgagggggaggatggcgaggaggacgaagaattggattttgatgggttttaggctaaaagctgcggcgtccccgaaggaaaaagcacccctagattgtgatttcctcttgtgtttgttgtactttttttctcccgaccaagcgatgtgcagtacatgtcacattttgtggcataataagggcacgaattattaagaaagagggtgcttgactcgcactataacctctgatgcttgttctttcacggcgtacgaagcgtcagcccctgcaaccctcaacttctcgaaccaacttgtttgaaacaaaagtacccggagagaaacccacgccagagagtggagctcccggtgtctggtcatttgcgtttccccccttcatgaattgaacgaaaaaaagaattgtagagaaatattctttgtggtttctaagaaaagtattatcaaagccgtccggaggattgtttcctcaaaaggtcaaggcaccaaaattcagttagccagaggccagccgggaggttcgcgacaggaagaaggaagtagaaatatactacccatacgtttctgacgtgatgagcgaacaacggtcgatgtacatcgaatgacagtatcttaacttaacacctcaaatgagtgccttcttctatcttaacctgtgtcaggggcaccatttcgtctcatg

SEQ ID NO: 1035 - DNA, 703 bp, Nannochloropsis_gaditana
aatgatgcgtatagggatgctagtcacgggttatttaaaaaaacaggagagataggagcaaagttgtatggcgcctgaactgatggcagtttccagtcagcgagcaaaatcagtaccaatcagattgagataattaaggcagccttataacgagccatatcttggcatgattccggtaagtatcaaatcgtgcaattttcgtggcggcttgaacaaagcaagtcgggtagcgaggcagcagattaagtggtagctacaactacatctttacttttgcgtatgcggttaaacacgtgtgatacgaagaaattttacgaatatatgttactccaaggaatatgtggtcgaaggcatatttcttatagcataaacatgcgtctttaaaaggcgctcaacggaggcttctgctcctcagatatctcaagttggcagagtcacgagagctcgccgtgcacgtgcatggcatcgccataatttctcatctttttttccaaaagtgctttatgtaaagctctcaatcgtccacacacacgattacaaataaacagggcgtgattatggaagtcgtattcgcaagtatgtgacaatttgactgatttatctcagaaacatcttgataaattccaagtctccatcttcagcctttcttttcgagctcaaagctgagctttcctgccgctctcctgctgtgatagccgacatg

SEQ ID NO: 1036 - DNA, 703 bp, Nannochloropsis_gaditana
ctattggaaatatcaccatgtctaccgtaggcgaggatgtactccccgcaacaagctctgcaagtgtgaaggaaagcttatatggcgtttgggagtcagcaatggtggcagaagtagaggtagaagggctcgatacgtatgatgaggacacagacgaggaggaagaggcagatgtttcatcgggaaatccaaagcgctcagcagcagaacggaagcgatggcgtaatctgcagaaaaaacctggatggtaccgtcgtgtttcgcggtggatgagcaagggcaataaaaaacgccttcgcgcgttgtggcctgtgtacggtatcaaccccccccctggcaagtgcctatggacattcctacgctttttggctcgacaggggaagtgacgaaagtagtggtagatgtaggatttggagatggactggcactcgtaaataaagcccttgagctgcaagaaagcgccccagaggtggctttcctaggctgcgagtggcaccagggaagtgtgggggcagccttgacgcgcctgaacgacactggtgtgacgaacgtgcgcgtgctgcgtggagattttcttcaccacctgagggcaggttggtttgggccggatgctgtggatgaggtctgtgtttttttcccagacccctggccacgggcagaggatcacgaccgacgcgtgataaattctgcttctgtgacaatg

SEQ ID NO: 1037 - DNA, 703 bp, Nannochloropsis_gaditana
gtggcacgagagggcgagactcctgccaacatgtctgtgtggccttgcatacgcgcgcacgggagaaagaatcaatcacgcagagacatttgcacatttcttgtcttttgtctctcagctctaatgtgagttcacccggcaatgatacacgcccaacggctccctggccgttaagcataggcgttgacggcacttacacaacacacctcacattttaacacaacatcaaacgcgtactaattttgaaattttatacagccacatgtcacgcctgtggccaactttggtggccaaaaagcttccgcgtacaggcaataaatggcgcttccacatctcatcaactatcccaccacttgtcctctttcgtcggcggctgggtacgcccaaaaaacaagcgggcttggtcgcttcaagtcgcctattatcacgcacctgtggtcacaacgagcaactggcaaggaattagagatagacgttcgttctccgacggagcctgtagagcgaacccctagcgaatcccaaacgtctgtgacgtatgagttcactcgggaaccttttctgtctcaaagctacgaaaacccttggggatttttccggaaaggaaagctcttggaagatatggacgcactcgctgggaacgttgcttttaaacattgcgaaaaggacggcaaggttccattgcttgtaacggcaagtgtagata

SEQ ID NO: 1038 - DNA, 703 bp, Nannochloropsis_gaditana
acgagcaactggcaaggaattagagatagacgttcgttctccgacggagcctgtagagcgaacccctagcgaatcccaaacgtctgtgacgtatgagttcactcgggaaccttttctgtctcaaagctacgaaaacccttggggatttttccggaaaggaaagctcttggaagatatggacgcactcgctgggaacgttgcttttaaacattgcgaaaaggacggcaaggttccattgcttgtaacggcaagtgtagataggattagactttcgagcaatcctaaattggatcgcgacatggagatgacggggcgagttgtatggacagggtcttcaagcatgcagatagatttagaggtgcatgcattgcctgatgccaagccttggataagtgcatccttcacatttgtagcccggcaccctcagacggctaaagcaacggccatcaacaagttgaagccggagagtgccgcagagagggaaacattctcagcagtggaacaaaaaaatcaacgccgtaagacagtgcgcaaggcaaaagggacagaaggcagcccgtccctaaaatcgggagcggtggacgtagagaccatgataaaattgttgttgagtcaagcgcgccctttgatggaaatgccttgccttgcggaccctacatgcgttttggtggataacacacgggcatcgaactccagcataatg

SEQ ID NO: 1039 - DNA, 703 bp, Nannochloropsis_gaditana
atgcgtaagtactaaacgcgtagatcttgcccttggacctgagcatgtaccgtcaagaggggtgcatagttagtcttcgctgctctagaacatatatttccgtgatggcgtctgagaggtgcatgccttgcaagtatcgcttgaccatgttgtggaaaagaaggatattgggtctcatcccgagcaccatgcttgttcgcggggtgtgtgacgacatattgcatgcccgctttgtttgggttgaatgtcaagcaaagtggcccatgtcgcatccttctttggacaacctgcagctttgacaacacaaaacagcatattccaatgattattccgacagatcatgcatgcgacatgatcaagatatgagtggatgataagtccaaccgaatgataaagcttcgaggttctggaagagagagatttcgacaaacgtctgcaagcgtgacgccggagtacccgagcgacccgatctcgccacccgggatagcaacaaaggaaaacagatcactacaaccttaagcgatgcatgaaagggcccttaacatcttgtaagggaccccacatggcacgtatccccccgcggcaagctgcccgacagcatttctcacaaatttggcggcaggaaagtgcgtggagatgctcccaacggacgtcgccagtggcgccatggacggcgagattgccgcaggcggcgtgaaagggc

SEQ ID NO: 1040 - DNA, 703 bp, Nannochloropsis_gaditana
cgctcagtccgtcatcgattgcgggggtggtatccatgtctcaaaccaaagtcgaggaggatcagtaatgattcgcgcaaacgctcggaagagtgttcgttgctcgtacgtagacacaatatattaaaatattatggtaggagcgctaatgtgttaattgatcgtcataatttacatgagcaggtttgatttcgttttaggccctgaaagttcgcagagcgatgtctaccagcatgtacaggattgcgtcccacgagttcttgatggctacaacagcaccattatggcctacggacagaccggctcaggcaagacgcataccatgtttggcatagattctgcttccatgaagtcggatgaccagcgccaaaaaggtgtggaactgtccaatcaggcgggcgtaatccctctcacgatgcacgatttatttcacgccataaatcttcagcaagaccccccccggagtgactctggtaagggatcaaaaataaacgtatactgttcatttgtgcagatatataatgagcagctttttgatatgcttcgagatggtggacgggaccggcctttagaaatacatgaagacaataaccgggacatatacgtgcaggggttgtcggaattcagagtcaaaaatgttctagaatgtctggccctgatacgtataggagaagacaatagagctattcgagaaacacacatg

SEQ ID NO: 1041 - DNA, 703 bp, Nannochloropsis_gaditana
tcagccctgaccaaagccctaaaaatgacacgcagaacaatgtgaaagggtgatcgtctcatatcgatcacatgcattacagtttcagctgcttgcttgacagtggactccccgccctatatttgcccaagtgggcacgaattcttccgcgagcaggtgaacatgcattgcctccggcgtccgccctcgagtcttccgtcgcccgccagccaggaagtctgcgcttacgttcggcttcagccacccattgcaggtgtaggggtgggcacggcgtgcttgcgatttttcctaatactgtttcttcctcgttgcgatggcgtggcttgtggtgcgagggattgagagggacgggcaaaaaagaagccatcgccccgagtgcatgaacaacgctcaagcctgtgtggatacacctccatccatctcgtcacacacattcttgtcgagccatcgaagacatgctcctgcgtgtgttcgtggagtgagcgtcggccagcgtgcggggggagggtcccgagggatgggatcgaagccgaagacgttgtggccttggcgagaccccttccgcgggcgctgtcttcacgtcatattgcatctttaccaacttaacgcggcaggtcaacccacggcagggaagaaattcgtctcgaagacggccacactactgtcgcacactggaggacacccttggcgctcactcaccatg

SEQ ID NO: 1042 - DNA, 703 bp, Nannochloropsis_gaditana
gcagagaccgtgaattgtatctgccgtgctccatcaggcaccgcccaacatatgccagtcgacagcttcctggctgtagaaaggtataaaatttcaaaagtgaagcgtttgtgagcgaagggacagggaagttgtagatttgtgggccacagataaagggttgtttcccagccgccgcttcagcaagtcatgtatctgcctccctcccgggcgcatttcgacctagatgttatgctccctcacctgtccacacccttccaatatatatttaaattacaacagggactgtgtgctgcagtactcgacaacgaggaccgtctaccctactggaacgggggccgttttgcattttttcctgtcagctctcctccttctccatgtgacactggtaacaacctcctgtgggaaaatgaataacaggaaaatgccccccattgccacgagggcggcgaaggcaatcggtgcatcgacatttatttccgccacaagtgctcgaagacgacgtcttgtctccgtttcggctaagatagatgatgaaaatggcagcgcgttgatggaaacctccacggaagcttcctcatcaaggccctcaaatcccttggaatccagcatccatgtgacaacaagcagaaccccaacgcgccggctttcggaaaatttttcatcgagtattaactcatcagtcgagacagtgagggcaatg

SEQ ID NO: 1043 - DNA, 703 bp, Nannochloropsis_gaditana
tttcgtggtgccaaacgccagccattttgtcctgatggaggacgtggacagggttgcggagttggtctggggacacgtcttgcagactgtggggagagaggcctcgaatgaagtgtgtggaaacaagcgctcttcgttgtgattaaaagtgcggtgtaaaaaaagcctgttcaagaattcgatgtatcacaccaatgggcatggcatcgagaaatcgacttggcacatcggaagccgagcttaccaatgccgtgaactagggggacttctatattgctcgatttcccccggtcccgagcccgcgccgacctgacgatagcgatgtgctcacaatatttagggaagctctttcaaaggcacggtggaagaagaacacgtcgatccgaaactggatccgcttcgacaacgtggtcgcactcatggctcctccccttcctctccgaccctcacagcgggcatgatcgccttttcccttgggcggttggaggcaccattgctgcttctaggccttgtaggattcatcaaggcccatgctttcgtcgcgccttgtcgtcctcgtccgcgctacgagagcgctgccaggccgttgcgccggtgggcacgagagcatggggcggaccaatcgaaatctcccattgtcgaagccctctccttggccgcagcacgcatcaaagcacctttcttttttccagggcacaagatg

SEQ ID NO: 1044 - DNA, 703 bp, Nannochloropsis_gaditana
gaaaagcagtgttcgcatggcaataagaattcagtatgccgtgtgtcgtgtgcctatgtggcagtacaaatgtgaagaaaaatggatcaatatggctcccagttcacaaagaatgctcgaaacaccctgccgggtacaaagtgatctcgaaaaaccttttcacctggaagaagcacacacagtgggagtgtaagggcgtagcggaaatgaaatgtggtggcacggcgggtacccatcgggcctggcgaggccgcattgcaggcggcgaaggtaacctcccgccggacacaaagctagccgctctctccttggtttttggcacccacgcatcgtgcgtgctcttatgtgagcaataactgtagcggagacagtcttcttcagatgtatgtttccgttcctcagccattctgcacatgtcgggcgcagattcgcattggctaaccgagtaccatcaaaagttccaatccttactgctaccacggcgctttccatcaataaaaatatcctactctacgtttatcgtcatacatttataggtggcaaacgccgactgatggtaaggtccctcccccggccgtcctgggagcgtgcagtgctcctgatcgcggggttcgcagtgatggtcctgccccggcctgccctgccttttatgttcccgggacgcatcctccagcatcaaagcatcacgagaccgtgtgaaatg

SEQ ID NO: 1045 - DNA, 703 bp, Nannochloropsis_gaditana
atcacgtctgagacaaaatgcccatgacctcgcaaagctcgctgcgggtacccgtagtcttctccaccggtcaagttccacaccatcacggtcttatcgcgcgaggaggaaagaacgaggttggggttgtcggcatgagtggcaatcgatgtcacccaacccgcatggcccttcaattccgcccgcaaactgagttggtcacccatggttgtgcaaaggatgctgtaacgtaggaaggagaaagatcgtgcttctgcggtcaggcataattctgatgtgtggtgatcaagagtttcttcatgtcttccttcttgcagcctaaccaccaatcaacaacactgggaaaccaaacatcctcacgccaatattaaatacgaagcaattggttatctatcattacaaatcagaaatccgacacaacggtcgtgaaaaacttcgcacagaaggtactcgtcatttctaacactcggtgcggaagacctcgctgagagccatcggatggtcaagcgctgcctggccgcaggccttctcgtgagggtgagaaacatcaaggagaaaatctgagctattcggagagggcggagaaacatcaaggagggaaattggtctagcaacggtaacccgaccgagggcgcgttcatctgatttatcgttcctgcacgtcttctgtctttgtaccacatagtttaacccttcaaccatc

SEQ ID NO: 1046 - DNA, 703 bp, Nannochloropsis_gaditana
ttcatgtgctgttgttggcgggtgggtcgtggatgatgaacatggcgtgactgtgcggcttggatctccatgacgcgtcgtgatggcccaatccacgtcgaaagaacgttttagagatgctccggttcggacacgaagaccccgtcacagctgggttgaataaactgattcctcccggtgaagggcacgctcacactttgggcagggcgacacggcgtattttgttgcctgtctttcgtcctcgtggcgtgtcacacactcgatggcggctcatggtttgggcgtcagtgggcttcgaccgctccatgttgcaaaagtgcgtatgacatgcctttggcagcaagcgagaagggcgtcggcagacaatctggcgtctcagcgcgttttgatgagaaacacttgtttatgacccagccgaacatagtggtatgatccttgtgaagcacttattgtgggatctgttttggacaaactcgctctgactgccaaaagtctcctcctgggacttggcaccacccctgcaacacactcgagaaaggtagcggacgaagtggcgacttttttaagcagtgaccttttacttggtctcacagactttgatttaagtaccactatgtctgtaatactgaagccttgcgttcattcctatcacccgacagcatcagagcacgtcaccttttcccgtgttccagtcgttcgaatg

SEQ ID NO: 1047 - DNA, 703 bp, Nannochloropsis_gaditana
  misc_feature (576)..(576): n is a, c, g, or t
caatgaagccgccctttggccctgtttacctgattgtgcacctttcgttgtgaaatgcgtgggcggttttgaatggtgtgcaaagtgttgcaaacattgagtcgagtgccgacgcagtggcccatttcagcgacccggccttccggtcgccttgaatagaaggggggggctcgtctaggggcgaaacctatggcgaatggagtgtaaaacttaccgcatctaagaagtgcacatcgcccaacactctggctcagagggtggacagatcacgtaacaatgcacctcatctcggtcttctcgtttccgtcacaggcgcttccttcttgccgaagtgttgtcaagatacttgagcccaaagagcgactagatcttgcacgatttacaagagccccatttcgggtgaaaatgtacttgtcctacgaccgatcaagaagaaatggtggtaagctgctcgcagtctaccgatctttcgtcctgcttgttatcttcctctgccatctatcatccgccttccagccctcttctctcgtgcagtactcggggaggtcgaggggagacattctgtgtaaaaaaggntcgagtagcggcagtggaccaccagcatcaaagggatttggatttggtgctaaaaaggaagcaaagggagacaaattcaagtacaccggccgtctaaagcctggtgtattgagtcctccccgagatg

SEQ ID NO: 1048 - DNA, 703 bp, Nannochloropsis_gaditana
cccaatttgaacatacgttgctcatcactccgagtggtgtggaggcgttgacaggtcgcctaccaacctctccgaagtttttttgggaggtctgacgaaacaaatgtggtgtggcgagaatggccgcacgaggagaataaattgcagatgcttccttaaaaatgaagaaattaaattttgattttcaagatttttattttgggtgctactttggtcttccctcgtgttttacaatcgtttttttttcctgtaagcatctttcaaacttacaagacaggagcttcgcgtgcgatgacatcagtatttcccccgacatcttactatgcttgaatctggtatttccggcactcttattaacataacttgttaggagatcggcgggtgagaaaatctcatccgcccctaaaaacgttgcgtttgaaaagtcctcggtcgtcggctggcgatgcgggcacacaccactttttttatttttatttttcactttgcaataaagtaccttaggatctgtgcctacgtagcatatctcgtaatgtcatactttcctacttctcttgattaatttgttacagcgttcccttggatatggacgaaaagggtagagtattgcaaggccgtctcgatttttgtgaaagaaatgttacaacgctccggcagggggtcagggctcttttaagaaatcacgatgaaggatgcaatgtga

SEQ ID NO: 1049 - DNA, 703 bp, Nannochloropsis_gaditana
gcacgaggagaataaattgcagatgcttccttaaaaatgaagaaattaaattttgattttcaagatttttattttgggtgctactttggtcttccctcgtgttttacaatcgtttttttttcctgtaagcatctttcaaacttacaagacaggagcttcgcgtgcgatgacatcagtatttcccccgacatcttactatgcttgaatctggtatttccggcactcttattaacataacttgttaggagatcggcgggtgagaaaatctcatccgcccctaaaaacgttgcgtttgaaaagtcctcggtcgtcggctggcgatgcgggcacacaccactttttttatttttatttttcactttgcaataaagtaccttaggatctgtgcctacgtagcatatctcgtaatgtcatactttcctacttctcttgattaatttgttacagcgttcccttggatatggacgaaaagggtagagtattgcaaggccgtctcgatttttgtgaaagaaatgttacaacgctccggcagggggtcagggctcttttaagaaatcacgatgaaggatgcaatgtgacaatggacctttctcaaaaggttcgcgacacggctgcacaagagcagttcatcgatctgcaagaagacctcatcgcaatagccgaatgtaccaagagattagcagaagaacgcaggacgattatg

SEQ ID NO: 1050 - DNA, 703 bp, Nannochloropsis_gaditana
acatggccgatctccgtcagacggcttcgcctctcggcacccttgcaaaagatgatcgaagagcaatgctcgcacctaccacacttcccacaccgaagcgtagatagctgactttgacagtgctggcatgatttactataagaggtctgtctggacgttgcccttatggcttcaagtacatggctgcgcatgtaagtagtgcgtttgccatgatcgcctgagtcttcttcatttggcaagaggaaatcaacttttttaacagccgtagtccgatgcgcgatcttctccctcgcaagcttacggggatctcgaggcacagaggaagcgagcgaggaggcgggcaaggcggtcggggcaggaaagcccgaaacggtattgcaagctgcaacaggagcgagggaaaaggcagaagggcctttttcataggaatcttttctctttccctgtctacctattgcagcggtctgctggatgcctcgagatgacggggaaaggggcggggatactaccggagaaccaagttcgtcggtgtcttcttccagatttcgctcgggggaataaatgacacaagcgttgtcatcatcatcgcacgcaagagtaggggatgttttgtcaaaaacgtcgttcatgggcttcagcatgcgcctcctgtcagtttccacacttgtgccagtatctttacttaaagccatagcagtgaggt

SEQ ID NO: 1051 - DNA, 703 bp, Nannochloropsis_gaditana
tgtattcatttaaatgtaaaaagccagccccttccgctcactcactaacaagatcaaaggccattaagtttccacaattaggaaaccgccattataatcaccacaataatttgctgtctagataacggctttacccacaaatttacatgtaaagctgtgtttgatgccagtaaaggggctttgcgagcaattcaccggactcccctgcccaggtacgacgcatttacaaggctggcagcaggcacgtttgccgacagaggccccaacttccatggagagttcgattgaaacatgttggcatgtggctaagtgaaagtaaaggcgtcatttccgaggcacgtgacacgatgcgtgagttatgggtgttgacgcgagtagacaggggcccttggggcgaggcgaatgaaggcaagcaccctatttgaagacaaatgaatgcgtccccaacgacatcactgtccacattcttcctcccttctgctactacggagacaagcgctcaaaacctggcctcaaccagcctggaaaacaaaggacttgacaggcatgaatttctctaccacaccacgtacaggtcctctggtccttggcgagcccgggagtctcagaggggtgcaactcaattactcccccaaatagaggacattaagtcacagcttcgacaattttgacgtttctgacgcgttacagggctatagtaatg

SEQ ID NO: 1052 - DNA, 703 bp, Nannochloropsis_gaditana
cagaattccccctggtagtccattttctaaccttgctctcaattccacgtcgtcgcgttggtaccgcggtgccgatcgcaatgaaatcgattggaggatctgggcgatgaatcgctttgatgaagcttggcgagtgtgcttccaaaagccggaagatctggctgattctgaaataaatgttatgcgccaccaacatgccatgatcatgacaaatatcgacccactcatgattgaatagtggcgagttgaggatgtaagacccagtttccatctaatttgctcaacaaagatatataagtaatctgacaacgaatgaattgtcctgtgctgcggtactctaaaaatgagggaaaatcatgctcatgtttcctgtatatagagttgaccaacgcaattattggtacagtaagaatgctacagtacaatctagagacattttttgctgatatctagcataagcatattatagatcgacgatcattctaaatcatggcggatgcaggcaaagaggtcgtacgtcgggctcgccgattgcacgtctcatagttgcgaagtcccgcgcctacccggatgtaacgagtaccccccgacaacctcctggccccgcccacttggctgcgcttacaagcgagctctcgagacgggtcaggcaatttcagagcgctttcctcatgacactcgtgtacaccattcattttgtagg

SEQ ID NO: 1053 - DNA, 703 bp, Nannochloropsis_gaditana
gccaatgctttgctgcagtggttgaatgcaatggatcaggcggtcaagaagtaaagtacttgggaaaccccaaatcgagcttgaacggcggataaagtcataaaataacgtgccccactgtttgaataagactcccccttctcaactggtaggaaaatgatgaaagattttttattttgttacaaaaacatatcgaaatgtagcccttgtcgtaaactgtttctatttggtttttaattgacgagtgcaacacccgttcaacgatcgtcaagggagcaataaatcaagaccatgctctgagaccctcttgaaaacatgccgcaggacgcggacggcatctgtgcaccctttttatccccgtggtgtcgttccgcttccaactgctgccagtggctgactatctcgccaaatttgtacgttaaaggcgcttgaagagcccacccgtgctaccgtggagaaaaaaatggcaccattcttgggcggtgttctgccctgcaaaccccgagtctatatttctgatgaattaaatggaactgctgcggaaattctgccgtgagagtacgcgcatatttgcaatggttgtgatgggtgctcgtgaagaagaaacttcacacagaaaagcaggctacagttaatttgtggacggactaccccattcataaaacctctaacgcccatgaatgtcctcacaggttctagcatg

SEQ ID NO: 1054 - DNA, 703 bp, Nannochloropsis_gaditana
acaaatttcctcaggaaagctgtattgccatgttatgttcgggttattgtaaaggaaatcacttgacaaacatgagggccaccattgccttgtaagcagcgcaatttctgcacaacgcataggttctggtcatgaggaaatgggtagttgagccagcgttgctgtcgacaccgccatgattacgtgtagtctccgctgttcattgacagcttggaagagaaatgtccaaaagtgtccatatgggagagatatctacgaaagatttgattgctgtggaaagtggggtctttgcgttttcttatgaagttgtcgttcaagtgggccgccgacgtcaaccctgcaagcgagtgcaacttagctttccaaaatgtgactgggaaaagaatcatcaagatgtcaataaagcatacagctagacgatacgtagcgtccccaacgtatgatgcgcccgcctctactttctttcagggaaaacggggcaaacgggacgtagcaatgctcgctgtgaggtgggttggagtgggcgaaggggcgagagcgtggggctgggtaaagagggggatcgctcaagattgacaaagcatgcacgaaatacgtccatttcattgctgcgtcattttgggacaccaacaggtacaacggaggcataaacgacgcagctactacagtggaatattctttccagaactgtgtcccgtctatg

SEQ ID NO: 1055 - DNA, 703 bp, Nannochloropsis_gaditana
atggcttctgctcgactttcaatggtggcgagacggggcgtcgtcgagaagatcgggcagtcgtgttggcagtgctcgtacaaacccagacgcgatccaatacaaacttgaacagaggtcctccttacagtttgaaatgcatatgtataagtcttgagtgatgatatgcatacaaagaaaatagatgatgattgatgatacggtggcatctgcacgttgcctccgcaagtcgacatgctaggcttgactaacgggagccgagggctagcagctctggtgctgtattactcttgccgcgtacagcactaagatacaaagtgacttgtaatatagcgaaatatatcatagaaatcgagtgtaaaggacaaatggtttacctgaggcagagtgcacgacggggaagagacgttttatcgaacaaacgtgtcgtttcgcgggaaaccgttactcccccgggcaacggttcattcaaacgggcgtttcaaattctccccggcatgatgagtgattcagcgcccgtgatcgaccccaccactacatttgatcataccatttgtgctccactcgtcgccttacccgtttctcttcccttcacgtacaacatggaaacatgatggctttcttgaaacatctcgaggcgggctcaaatccaaattctaaattccacagacagcgatcaaacacacctgctacaagtgagatg

SEQ ID NO: 1056 - DNA, 703 bp, Nannochloropsis_gaditana
agtcggaggctgccctgtccatgtcaagaacacaagacaacgagaaagttcacgggggttattggcacgcacggccggaaccctgccttgtgggcgaggggcgtgcctggcgctaggacacttggcgtggtgaagtgcaatgtaggtgggaagctcaagtttcccagcgtagcacgtgctgtgacacacgcttcagcgagccaagaaggagagcttctgaaattatttggcacggggttgtcacggcatgttacaaaacacctgaggcttgaccgaaaagtacgaggcgtgggtaatccgcatgcgcgtgggcatatttgtgaagtcgcggctaccgcgggaattaaagggaggcccggcgggctcaggaaaacgaattttagacattcttcctcctgtcatttctgcatccgactagctcgtctcagaattttcgtccgcatattaacgtctacccactacatttggtcacagttccatcatgacatcctccacaacgaggataaaagtattgcggcgacggccttccggaggtggatcgatgtgcagagcattgccccttctccgcgcggtagtaggttatgtcaccctcctctgccttctgctcgagccttcctccgtcgcggcattcgccccacgcggcctctcttcccaacgatgtcgcacggcagttcctgtaggtagtggtacttcccaagacatg

SEQ ID NO: 1057 - DNA, 703 bp, Nannochloropsis_gaditana
aaagaaccatgccagcagaaaccaaaccctgtccacgacatcattgaccccaacattcccctgtgcgtcgcacgcggaacgtggtggtgcccgctttgttccattttctggccctctgcagcgcccggatcgctcgcgtcgaccggaccgtcagctgcctcttcaaaatgcttgcatttctggacgcgtactgcccccacacgatatatgcggcacgacggtggacatttgcatggtacgtggcgctctagtaccgtctttggtcttacgacctgtcttctgtgggggttgtgcgagacttttcctgtaaagctgcttactaccaagatgggagatcaaatgcttgccctggcgagcggctggatggactcgtaccgcccacgtgcatctttaacgaagcggctgggtcgaaagagacattcactccgacctttcagagagtcccaaatgatgagaatcgcctttcgtcgctgtgagcaacctcttaaagcttcatagtcagaagcaagcgcgtgctagcaatagctggccatgtgccatgaaagaatggttttctccccctagaagcgctcgctcttccttgtttgccgcaaggagatgactgatcttgcaatgatgtattggctttctaacgttcttttgtatatctatcacactaggtgcagggaacgtgggaacctttgacgaaaccaaattcgaaatg

SEQ ID NO: 1058 - DNA, 703 bp, Nannochloropsis_gaditana
gcttttccatttcttgactcaccgtgttgttgacctttgcgtttgccttgctggtacgaatggaacaaacgcgaatgcgcagctcaaggtggccgccgcagccactgccactaacgtcgtcctcatgatagagattgagggtttaaatactctggcagaaaattaaaagatctaaggtacaggaagtcataaatgtaagatgagtacaatcaagacataccccaggatcgggttaacctacaatatttgcaagcttggtgtgcgctataatgccttcccagaccgcacgcaagatacacaggggccggcctcgatcgagcggatcggaacggatccggggaaaggaggtttctgtcccgctgtcatttcccggttgttctagcttgacgaagaaattagaacataggagagggggaaaacagcgtttgcgtctgaaaacttgacgtaggtaagacttgatgagccaggaggtgcgtaattctttttggggacagtatttttagctgtcttaatgcttttatgtgtctttctttgtctgaataccaagaaagagtgcggtcctcacagactccttttattatatttcgaaatcctagctcacaatttatggacacaaattgatgttctactcaatttaaataatgccctcttgttcactggggacttcttatccattatagatttcagagactccatcgaaatg

SEQ ID NO: 1059 - DNA, 703 bp, Nannochloropsis_gaditana
ggccgggtggtaataccaggagcaagctaagcatgaagcatgaccggtgtaaaaactcaatgtagcatgcacgtatgcaatattttcttcgttaatgacgcatttttatcgaaacattaaaaaaagaaatcgggcattcaaaacaaggatgcgtttttacctcagtgtgacacgtcgagttgtccaactgccgagcagaaacagtcgactggacaaaaaaacaggtagaaacgacgccaatacttttacacagcatgattgaaaaatccactcgtctctgccccatatgacccgcaaaacgtggcatgcctgtgtgcctcccccccttgtccggataaccaagaaaacgtggggacgtgacgtgcccccgctccgagcgagcgggcataaggagccgggcggggggacgacagcgatgagggagaagatatgacatgtgactcgacacaggtcgagcccggaattttcacgctcctgacggggaacttgggttgcgtcctcgtggaccttccacatggacgaggctttccttgcggacggtggacggatttcgtttcgatggacgcactgccacgcgatatcacaggacatgagagtgtgtcggggaggagggctttgttccatgatacgcggactttagatctcatccgcactgttctgtttcgactcaccattttccgccacatacgtgcaggcagccatg

SEQ ID NO: 1060 - DNA, 703 bp, Nannochloropsis_gaditana
gctgagtcttcgtctatgacagtacaggaagctattctcgccgtcacatcgtccagaggactgaatgctgtgccccgaatcgtcgatcctggaataagcatgacagtttcttggctctgcaaaccgtccggaccacgaatctcatccgttgtctttgaacacttcgggagacaagtacaacttttctcaggacttgcattgatggtcatcccaattgaaccagatgtcgtgtcctgggaactggacatcacaacaggtgcagctggcccaggcaaagtcaagtccggccctatgttgtacttctttacctccgtctgatcttcccggcggcctcaaggcaatcccgaaacaacattcactccaacctacggggaaagacagcgagaaacacggttggtaacgactccgcttgagaatgttgtcctgtgtaccgtgacagggccggaaaaggttcacgatagggcacgaggcaggaactgagacgtccgttacccgaggtggggaggttacccctcccctgccaggttcaaagaatctgtgacattgacgacactttcctgatcctcccgaaagactcatttattcgtcttaattgcccttagccagccaataagctatctcgtgcccccacctggctcctgattttttgtcagcttgcgctaagcaagaaaaaggacttgaacaagcactacgtacggaatca

SEQ ID NO: 1061 - DNA, 703 bp, Nannochloropsis_gaditana
acgacactgcagtgattagtgattatcatgtgtgagaattaaatcatcccacgggaacgagtgtctcgattgcgtggaattctccttcccaactcccatttgttttaatatccattggaacaacaggatctcagttaatcaattatcgatctctttcgacgtcaaaaatgctcgttccatgatgcgcacatacatccccgctttcatgctttaatccgggccactcccgctctttacctggcccgcccggtctaaaggaaagcttcccttttccggcggctttgcctgtatgctggcacctccaaacgggttcatgttgaccagggcccacttctgttgggtgatcaagcatccgaagagattcgtcaattaaggatcagcggtcaacctttcacaatgacctcccaacacctagagccgcctgggtctggtatcctcaaagagagagattcctttcaagatcacatgctcgactctggggatatcagtatcttaggaaagactctctataagcgtaaattccattgtacgtggaccgccaattttgtgtctctcgatgctcagcgcagtgcatccagcgcaaatctggtgtcgctgaggagctcggtgacgcatcggagatgatcgtcatcggatgcgtcctacaccggacctcattgcaacaaatatccttcgagaaatgctcattcttctccactacaca

SEQ ID NO: 1062 - DNA, 703 bp, Nannochloropsis_gaditana
atccgactgatgttggcaatgggcaaatatctgtcttgttcccggacctcctccacgccggcgccaccaacacgaccccctgcctcgttggctcccgcctcatccatgcgcaccgtctgatatccgtgcctcacctgtcggtatcaagggccgagttaaggccgtgctggagtgtaagcggggcggatatcaatgcatccagaggtttcttctaggaggcagtctgcgcatcaagtagctgccctgcgtgtgatattcaccgtccttattccttccccttatcctcacgaagacaacgtcatcccgagcatgaccatgctgtggctagtgcaactgctcacatcatccatgcaggacggccccgagcggcgagaacgcttgtagttcttccccaaaggtggagtgttttttcgcttcggccgctggagctcgccgcttccatcctgacgacgcctcgcccggcccttgaccacatcttccattccctgcctaaccttggtttggaatcagactcatgcacattggacgatgccaccatatacacgtttcccggtctttgtcaaattttctggctttgtgcaagtgtctgattgtcttccactgtgctgccccgccaagccggcaggctactcttggttctccgctctgttttttcattttgtacgcgatttacttcccttatactgtacacagcaacgaaatg

SEQ ID NO: 1063 - DNA, 703 bp, Nannochloropsis_gaditana
cacctccaccttcttgggtgcttgcggcaggtcttcatcaagacactcgtcgaggacaggaaccgattcggctgattctgccgtcgttgcaaaggtctggacgtgttgaaatgccaatgcacaaaagagaatcacatagactattctgcgcaaccgcatgttcatggtaatttatccttttggatgacgatgatgatgatgatgatgacgaaaaaatagcaaagacggcccactggaacacggaaaggctcgcgaggaatgaagaacttacacaacccgctccgccacccgcgcctgtggtggcaaaaaagaggcgtgaagagttaaaacactgcgcccggagccatggtgcaggcatgcaagggtgtatcggtgcaaaaagcagaacataggaccggatggtcccagcaacccaggctctcgccgttgccgttacatttccttcttccttgaaggcggactcggaccacgcggccggggatggcctatgctggtggaggagggccatttggacgcagactttcgctctgacattgtcgtatgagaggcaggatggtttgcaagggtcccaatcggcaaagaattcctatacgggaattgttttctcctagactttgcgaaccgattcgatctgccgaaaccttttgaaccttattccttttcttccatgctcgagacagacatcgttaccaccaggatcatg

SEQ ID NO: 1064 - DNA, 703 bp, Nannochloropsis_gaditana
ttcaccctcctcgtcttttgcctctacctcatctgcctacacttggattgctgcctacaaaattgaggagctctcccgcttctcaaatcttcaatctttgcatttgaattggcaatcagccttcaactacaacagcgataagactattgcacattccatgacatctcctgccgaacacacagcgtcttcctttacgcttcaggcttcaacaagctcgaatctgagcgcattggacggactcggctggtctcgtcctcctcccgcaacggcttctttagccaaattatggacggtctggcatcgtcctggaacatgttcagacaaacctctcttggcaggtgtggcgggtcttccagaatgtgatgaggctggtccatttttgctggctgacaaatctttacgacaggaggaagaagtttgcaacctcattctgcgagctctagaaaaaaatcctgttcgccacagcagctctgctacccaatacgaagcagacggagaagagaaagtagaacgtgtctcctgggtcaacaatcacggccatgatctcctccccaaatccagcaaaggcttgccccggccccttatgcatcgactgaacgtgttgcacaagggggcgggcatacttgtgcgggacgcgcaaagcagggtgttcgtgcatcaacgatccgcacacaagcggattttcccctctttgtacgacatg

SEQ ID NO: 1065 - DNA, 703 bp, Nannochloropsis_gaditana
gctgccggcgatgagtcggctcgccttgggaatgttggcgttttacgcccctatgtacgagattttccccactgaaacgactgggatcttgcagcgcgttgtccgtgaagacatggctctctcgcgctgtttgatcaatcaaatgctggccgagttccaccgtctttttcaaccgctagcgactcctctttcttctccctctactctgcagcagcaacggcatgagcaccatcaagcgttcgctccttcaggcctctcctcgaacccaatcagcctccagacactggcatgctgcctttgtgccctttacaacgtaaaggacagcctagaaatggagaggctgaaagaaattctatggggggaaggattgggtctcctttcttccttgctggacaagtttggtggaggcgaacaacgggcgacacggcgtcaattgctggcgggtcagtcgttcttcaaacaagccgtagatcccttgctaagggaaatgctgaagctgtgtgacagtttgcactcacgcatgtcgatggtgccgggaaaggagcagtcatttgcattattgcagtctttggtagctgagggggaggaggaaattgatgatgaaggtagagatgccgggaatggagcttactcaaggagggaaagcgtcggcgagggaggaagagcacggcgccggaacggcgggaggaaggagggaaggatg

SEQ ID NO: 1066 - DNA, 703 bp, Nannochloropsis_gaditana
ttcctcctccatctccccctcctcctctacctcctcctcctcctccccctccattcctcactgctcccaaaccgacaccaattttgttgtagctataactgccataacggccagcgcttgtcagcttggagcgaaagaggtccgtttcttgccccactcgcgcggtcaggccgtgacgtttctttttcgtttgacgagagctgtcgtgcccgccccactgccttgctgattcgtggtagccgtggccagcgtccgatgaaggattgggcctaggacctctatgcattcctacgcaatccactggccaccttgaagtgtactgcttatgcttgcggcggtactaaagaagagggaggaatcccagagggaggagcagcccccttcgacgaatgcaccgtggctaatccgccttcctgaaagccatgaaccccataaaacggctccctgtaattcgtgacaataaagagggagaatcaactcgttaggtgcaacgtatttctggcaagtttgcgtggccggtgtggcaggcgtgaccggacttgcgcctcgcagcagtggagtcgtcgatcagagcttgtggtgacaagaacaaccgccttctcgttcctgatgaatttcctccctgctcacatgcacatagcagacgcaaacaccgactgcagagctcactttccgcttgttgtggtacagttgtgtcgccatg

SEQ ID NO: 1067 - DNA, 703 bp, Nannochloropsis_gaditana
tcaacgtccaatccatccactcgaacggcctaaagtattcgagcgtacccacaggagtaaaagtcattctcatccgtccgacatagagtcgagttggctcgttttctccccggcgtgacattggagtcgcttggcgagctctgcaggctcgggaagctcaggatgcgggaggtccaaccccgtgtcgaaacccgctgaggtcactctcggcccagccagccaggcaggcgggccacttcccacgcgccgcgggacggaccatgagaccatttttaacggttgattacgctttcactttattacattgcagacgcaggcatcctacgtctccgtccgttactgtctttcggacatgatcattgttacgcggctcctaatcattttggccgtgttcctcgcgggtaagaagccggaagagggatctgctacaactttaatttgaacaacttccatactgatgtcaattcatacatgcagccatcgaggcttttcacttttctggaaggaatgatggattccctcgtcgaattcatcggtcgaacacgcatactaacgacgacaacggattcgagagaaggtccgtaaattggaacaaagttagctccatcacacaagtgaacattcatcgatattttctccaacttttctatatttggattgtagagagcttattcacacagctactaccgccctgggagccatg

SEQ ID NO: 1068 - DNA, 703 bp, Nannochloropsis_gaditana
tttcttcgcctgcttccaaacttcccacccgtgttgctgtttcccctccccgttccactgcctccgcccccccgtcgcccctgccgcttaaccctcaaaggctgtacgcttgctccgcttcgtatccgccaagacgttggtgttcgaagggactgtggcaagaaagctacagttgtgtggaccaggcaaaggaggacaaagacgaagaaaagttgtggagtggaccgcttcgtggtggtgcccctgctgaccattcgcctatccgcaagcagattaagaaatcgcaagccgtattcggggtccgcaagtggaccgctatatcaccagtttcacgatgtactctgcctaccattacggtgtgtggtgtatttacgggagtggaagcagtcatgatcagattgttggcaagatagggcaatgccgggggtgaccgccgaaggcaaagtcaacgtcaagtcgctcgcagtcagagccgttgctatgcctggcccaggcataaccgggtttcccaccagcggtgagaacgctgtggtgtcttcgcattggcatccctttatccatgaatgcttgtggctgaggaaccagatcggtgattgtatttgggaaaatttattactcatacaccctcccacccacacgtggatagggtgagaaggagccgctacttgccctcgtccaacggggctcggctgcgacgacaatg

SEQ ID NO: 1069 - DNA, 703 bp, Nannochloropsis_gaditana
tttgcggtcagagctccgaatccctctccacaatatccttatctcagcagtcatatactagtacgcatatgaacatatattatggcaagaacaacccttttcgcgctcccaatgtgacgcccgtcacctgcatggccgcagcacgccagtcgtgacagagggcaatccagggactgggaagcttgaagtgccggccaaaccctgaccagatgcatcggcttcctctctatactggcgcttttggcacacgcaccgattaggctgcgtcttgacaagactttgcctctccagtctgtgacgttttacttgcatacggcggtgctgggtgcataggcaaagagtctcttctgtttgctgttctctccctctttttttccgcttgcccacagtggtcgtcctccgattgttctcgatgaaggagggaagcgcacctagatttgtttctatacgaaagttttcttcaccattcacctgcagtttctctccgctctggaaaaattgtatcgcatcgttccttcaatttgccttgcagctgcattttgagacatgttagcaactcccaaaaagtgtcgaaagtgctccgttcgatacttgaagttggtttcatatcaatctgctgcctcgccctcttcagcccttcatgagcacccgcttacttcgatcgtgccaatacacacagccaaacaaaaccactagaaccatg

SEQ ID NO: 1070 - DNA, 703 bp, Nannochloropsis_gaditana
tctatgattatggatgttttgaaaaatttctatcgcatatacatatatcattcctacgagaagggatgtaaaatatatgatgatctgttgctccgcacaggacgcacacacgacatgtttaggggatggatgcagcttcggggcaaatcgtcttatctcttcaaatttgatccaaaattgcgtccgctagtatgcaacagctaatttgaatacaatttctaatggaatagtcttcgttctaggctagagcacttgttattgaacgcgctgaacttcagacttcccggaaagcttcaaacgagaggtggtttggcgagttggttatgaacgcgagtaccaattaatttctatcatattccaggcaaaaagcgagattatcatttgataatgagttttgaaacagagaaagcatcgcacttttaaaagtatttctcgcacacttgcatttatccatctcaaacgaggtagaaacctcgaaaccccaccagagaggaggaggcgaatagaacaaaatggggaagagaagcaatatttgacagtagaactagctttgtcatcggtattaacatactcatccaagtatcttgctcaccctgaataattttcagtgtatgccgtgccattgattcttgtagggggtcaagctaggaggtgatatgctgaataatttgatgtgccctacctgtaccgtataacaggtaag

SEQ ID NO: 1071 - DNA, 703 bp, Nannochloropsis_gaditana
cgatcgtcgcatgctgctgcatttccgccactgctgctgccatgatagagtacgcttcaagtttaccaccggatgtactgttgcggttgtcgtttgagtgtgagcgaatgctgaagagaaatgatggcagcatcagaacctcactctcctaaggagtgacaaacaatcaggatgccaggcaattgaacgcagacataaaaggactcaaatggcattccgagcaaccaatacaatgctattaattcgtgtaatgtgtacgagcatcggatatggtcgcagacatagtagaacgggagacgagaataatgaggtatgcggaacgtgatgcaggcgccaggggctttggagtcggcggtgaaagcttcctccgcgacctgtcacactgcccttttgccatgaaagtgtcacggaaaggcaaatagggtcaacacacactctcatccgtgtgaccacaaggcaaatcatgcgcgagggttcagcggtgactcggcgaccgacattcaattcatatgcacgctttcccgcgtcacacctccggcgttgctgctgctgcggcttgttccaagtgagggagggggtgccctacaacacacgccaatatgtccaattagagcggtgtaatggaccacttttgcatgcaccgtctcgctcatcaaatgattacctcatgttatgccacaggttagccctatagccggatatg

SEQ ID NO: 1072 - DNA, 703 bp, Nannochloropsis_gaditana
ttacgctacttcggatcgtggattgaataaaatggatcatgaggcattcctttaaagatcactcgaaaaggtaggcgacttgacatggttgttcaagaatccaacccgcttattctcggagcctccgactctgttactcctccagcttgtctccctcctggtggtctctcgtcgacgaccagacgatcagccatcctcccgatcccgttttctttcccgcgcaaccacctcctgccccctacatcaccttcggcgtctttcatctggtgcgtgagaaaaccactatagtaatgtttaagtgtggtgcattggacaagaggcacggggagtgatccaaggtgtttgtgtcgttagtgctgctcgaattatttcttggccgcttggctgtcgctcggcttttgcgtctggtcgcctccttgctccgtgtcgctacttttccatcattacctcgctactggcactaccaattcgagctcgtgtgacttgtgacccagcatgtttttttgagcgtaagagatattacgttgtctgctcttaattttggttcagtcattcgagcattgattttctcggaataatttaagattagtcccctctaccaattagctggagggaaaacaaaagcaactgctaagctggattgctctttgcggaccatacatagtgccggggtggatcgtcactgccattgcacagcgtcatg

SEQ ID NO: 1073 - DNA, 703 bp, Nannochloropsis_gaditana
ggcgggcctggcgaggccgcaggagaaggagatgaccttccgcgactacgacttgggccagatcaaggcagccttggaccgattctcgctcttcttggtggggatgaccttcctgcacttcaagatgaagaacacgtacatgatcatgtactgggggtaggtggcggcctccctcctcctcgtcctctctctccccatcgctggctctctctgtgcccctttgccccgcacatgtctttccccctcctttctgctcattaccacatgcccccctccccctccgggtcttggttgtcaacaccctgccgcccccccttcctcccccccgccctccagcttgctcgggcccctcatgctggtccgggagccgctgtttcaagtgcatgtcttcgggatgggggagacgggcatcagagagagacccttcgggcccaaggaggagccggaggcggtggaggagggcgagggggaggaaggaggggaggaaggggcggaggccgcgaaggaggcgaggagggaagatgatgtcggtgcaagggggctggaagaggcacaggagaaggtggagggggaggaagaggtggagggggagggagaggtggaggaggaggaaggggaagaagagggcgagggagacgaagtggaggggggagaggaggtggcggaggaagaggaggtggaggaggaggtggaggaggagatg

SEQ ID NO: 1074 - DNA, 703 bp, Nannochloropsis_gaditana
ttccgttcaggacatgttgaggtggcggcctctgaagacagtcggacaaaggtggtccgccgcaaagcacgccgtatcattcctctcagcctgtgttgtcgtcaaagtatacagaaaaaaattatgtggtcggtataaattggtgggatacattttttttctttgccaaataatcagcccaccgagaggtcgaccgagtctccctccggagcttcctgacgtcttgcgcgagtcttctcttggtgcctaatcgaaaaatacaggaggtcattgtgctgacaccgacgttgtttcgcgtgtcgcgtgcattgtaaataaatgacgacaaaaattgtgaggagaggatgcgtgtgtgtccgtataattagtccttatggaactccaggaccacccgggggcaacttttcttcctctcttcgctctttcttcctcgtatcacaagaagcgcgtttcagcaacacaatgatgcctttctatgcacgaagagctcatgaaaaccgacgagatattttcttactcaaatgatcatttcatgatacaggcctaggaagtgggagcaggaagcctggatgtgccttgtggctgaaagggaaaaattgagaacccaccaccagacgacgagaggtaaatgaaatggagcacgcattcatcgatgcttgtgaccatgcattgcaccccgttattaatcatgtacaattgaatg

SEQ ID NO: 1075 - DNA, 703 bp, Nannochloropsis_gaditana
cctgacgccctgaccttgagccccatcaagtacttcaactacttcagcattctttcctcggtcatggtcggctgcattgttgccaaccctgtgacccgcagcaatttttccctcgccttcgacaggaaaccctaaatccacttcgaaaccaaccggactcccgtcgtcttccaccgagacacgcgtcttccgccacatcagcccctcaggaggtggaggcaacggcttgagcatttcctcaaagtcttgatactttgtaccatcgtgacgctgacggcgccagggcaaaagaccgccttccgccataactcactgcgcaccaagattcggagtctaattgcatgagacacacagtggttagtgaccgtgattcgatcaaaattgaatgcggtacgtgctatgtaagtgacgcacgtagtaatcgccttccgcaagaggagacgagtatctctccctccctctccgcccttgcatcaaatatggcatgcgtacgcccatggagtgacaaactggtgtggacgtcgtttctcgaaggacaaccaatcatcagctttgcaagtgctgaaatggggccgtctgactttccctcctacccgttcctcccggcccccacgaccctctccctgacctcccctctcatgcacgcagactacatagtatcactgcgcctacctcactacagcttcgtcattacgacgacatg

SEQ ID NO: 1076 - DNA, 703 bp, Nannochloropsis_gaditana
tagagggggagcctcagcagagcatggaaatgtctcctactcggccccaaccgatctgacgacttctcaatcatctgttggagtgaaagatatctatgcagcttccacgatgaaagctagcgctcctccagccattggggatatgattgcgacgaatgaaaaatactgtcacatactcttcgacttactggaatgctgttcttcacactctccgtccgtgtccgcctgctcgtcgttggacgcgttaggcgatggaaagagcgtcggtgacaaaagcaatgcggcactcatgaaaaatatttgggagcttttgctagttcttcccacccaaaagcatgcgttgcaaatggtcagacaggccgctatgcagcctgccccttcttctgtcgccgtctgttcgaaaccttgtatctcggcagaggcatcaagttctccttcgtggtcctctctaatttccacaaaagcttggcatcgctctgtatacaacatgcaagtgatcgatgcgtttctgcaaccgtctgaagatgccctccatgaagatgactcagtgccccccgaagactttcacgctgcattcttgaaaactggtggatttactcacgtgttggatgtactcatgcgtacaagcgtcggtggaaatacattttcagactgcgaaggagacaatgggagccatgtcgtgtcaaagcgtgacgaggctccg

SEQ ID NO: 1077 - DNA, 703 bp, Nannochloropsis_gaditana
cgcgctggcttaattccggccccagcaaccctgctgcctcgtcaggggtgaggaggcgagttgatgcatatgcacccatgacctcaagtgtgtcctgttgcggacgcgataccccggttcctgctttgataaaaatgaagggtttattcgtgtaatgccctgacaattcactaacgctggctgcttcgtacagaggggaccagaatttagtgctgccctctcccctctcatacgatggagagctgcgccggcagcacccgccacaaacaatacggacgacctgtaaaacatgcatgtgatgatatgtcagtgttgcccaatatagcacgccccaacatgtgtgtaccattcttccgcagaagaacttcttttgttttgtgaacagggcggaggaaagtaacgcgcagcatcgaggagagggagcgaagagagagcgaagaggccgcaggggaaagcccgggcttgcagcataagcccccgaatataattaaacttgaccacgtcaagccctcacatgggcagggcaggatgtggtgggtgcaaggaaatcgcggcttgcgtatggaggatgttaattcttgacgggatggtcatggcactgtccatgtctcctcttggcttgtatcccgtcgcggcgtgcgtttctacttctcaatgcttttcatttacacggcacatcaaaacccctcacagagacggtatg

SEQ ID NO: 1078 - DNA, 703 bp, Nannochloropsis_gaditana
acagtacatccattcgaaaatgaaacctaggggaacgtgtcaggcatgcgagaaagaagttttaacatttataaacggcagtgacgtatacgtggcacgtcctgcacaaaaggcgaattccatggcaaacttacttgataattgagcagaggcttggtctcccggggccacagctcctccaataagttgccctcctcttcactttcattctcatccccctctgaagtcaccaagtttgtcgcagagggggtagtgggaatagagctcatagctgagcttgatgggtaaaccgctgcgtttttagaaagaatcgttgaatcatgaagggtttcttattgccaccgagattttactttgacaaatgtatttgtaaagggcatcgtttcggggcaacgggacagtaatgtgcgtctggcgatttgatggtggaactcgctggagcgtcgctcctccgagtcgccaagcggaagcaatcgaatacacattgtccctgtcgaatcgcatgctagtcgaagtacatacgagcgtttttttaatcttctggtatgaaaatcaggttaactaagcgacgtggtattactataagtgtctatgactcgcactacacggtaattcttagtcaccataatagccttcttcccctactttacatgatcaaagcaagaacatcacaacaatcagccatcaggaacaagaagcaatg

SEQ ID NO: 1079 - DNA, 703 bp, Nannochloropsis_gaditana
gaatctttcctaatacacgccaaacgtgacattttgccgctttacagtccagtttaccaaagccctggcgacgccatgatcgtcaccatcacaaccttgccatccatgctattccagatctatgccgtcgcatcgtagcaagccttgaggtctagcaccggcaagataataacacttgttgacctcctaggttcagaggaggtggttgaagtctcacatgcatcctctccccgcgagcctagaaatgaatggatttcaaccacctctgactcactttcacacgcaaattgacatcggacatcaaattagttgtaattgagcccattgactcgataggcagacttctttccaactatcggctcttttttccattgtgccttcctccagtccctgatgctttgcggatgacgtgccttgaaaaccggcatagcccaaaggaaaaaaagagctacttagcactggcacgcgaccataagggtgaatgaatgacacgtgtagaagatttctctcatctgtatatgttttccaatcccaaacttttatggccctagaaggatggaagtttttcatcatttctccggccgtgacagtcatcgccgagaaagaggcatccgttgtacactccacgtgctaattctagaaaaccatccacaaattccaggtctataactcaaagaagcatcagtgggccctttgaagcatg

SEQ ID NO: 1080 - DNA, 703 bp, Nannochloropsis_gaditana
caactatttcgcactttttggtcgcttaataaaacgcgtcaacccatagtcgaacgcaattaaaagagttcaacgatctgcaaaagagaggttctcacatcacccacgcgaggttggataacatgcactggaggtgattgtgatgagttcgtgagcggaaaagggagaagtgtgatgctgagacatattggtggactgtacgtattgcctacttttttggtaaataagtcttttcaaggcttgcaaatgccatggtccggaattttcccctccctttcactgggtcatatttccatggacgcttcatatgacgcggtcactgctccagatatatcggaatgtacggcatacgagtcgaacaactgctctagagacaacattggttgccaatggtgggcattatatgtgtcttatctctcgctgcttatccaccccccatgtcttgcatcccatgacagctcgctgataaatattctccgcagcggtaaaagcgcgggatttgcaaggctgtcctagcatagctgtagcgtgtgtctagacagacgcggcggacaggagggggaaaggagagcggagagtgcgtcgggaagggactgttccggtggaagctgctttcattcctccttggagaatttgaacaaaaagtcagaaatttgttggcgcgtgacaaagtgggagtaaaaaggacacgctcctagtcatg

SEQ ID NO: 1081 - DNA, 703 bp, Nannochloropsis_gaditana
ttcatcttcttcgcccgcctccctcgtcggacctcccaaagaaaggagttttggattagctactgctgtatccatccctcttttcgcgaaatgcaacctgacgtgcttcgtagtgcaaagtcagcctttggaaattttgaagacagtggagatcgatcaaataaagtatcttgcacccttaccagccaccctcaaacttgcgcgcggacttttcaaagacgtatatcaaggtcagctctttaccacgacagcatcatgtgctacaggcatccgggtggttctctctccaggaatcgatatggatgaggctaaagtcatcgatttcgtggcttctgcgcgggaggacttacgttccggtgcataccgcgacaaacttgtaagcacgttccctttcgcgaattataccttggtccgcgaggctaatgagatcagccgtcaaaccgccatgctccgtgcagcggaggctcaaaactcaaagtctataatgtctttcgaaagaaagtcgaacacaaggcttcgacacggcgggggaagagatgcaccagcgtcccgcccttcaacaaatacatatgcagcgcgagcgctgcgctggtggtcaaaaatcaaacccgtcgtgaacggttctctagcctgcgactggagcagcttggatatatctgtagaactcccttatcttagcgtgcatggctactgttcagtcctg

SEQ ID NO: 1082 - DNA, 703 bp, Nannochloropsis_gaditana
accttcgcttactatatctctgcttggagagctacatttctagggtgtggtggtcatcggggcgattgtggcaacgttagctgagttggagggacatagacatagcgatgggatatgcgtatgaatggcaccacttataaattttccagtattatcctgtgcgagacctgcctgtcgttcagtcttgaagggcaaagaaagaagcagactttgaactcccatcggggtggtcttctcgcccggacagcggctaatcactttgactcgtgctcacgactagcaatttttgacatgaacagaatatatatgctcgctattatgcctcaaaggtcgttaaatgaaaaaatatccttaaccaaatgccccgggaggttgaaccgtttgtcgccggccgttgagatccgttgagaggcgatgatctttctgtttcgtcttgaaatccgcctctgaattactgaccatgacgccgtcgctggccatcatcaaggatgaaatggagggaaacattttgataataagatttacacaccagctcagggattgtgtttgttttcatctgtcaattttttccttgccaggtacctcgcggattgcctcgaggacttacgaacaaacagccctcttcaagcaagcaagtcaaagttttccgcacggactctttcgacgcaaaaactgaaaggttttcatctcaagtggtgacatg

SEQ ID NO: 1083 - DNA, 703 bp, Nannochloropsis_gaditana
tttaactccaactcaaggtccatctgaggctccctctcacgtatcttcagcgagtccagcatttccaacagacccttcaggaactccctgtccgcctgtcgcacattcttcaacaccttgcacttcagaagggcaaaattcagcggtgaatcaatgggacgtgacagattcaaacggtgagacgtcaagtgggacgcggcgacagaggtctgcaaacattgatatcacctggggaacgctatgcatcattgtaagctgccttttcctcgtcttgtaatgaagacatacaaaagtccagaatagattataggatacagtgtctttaatcaattaagaagtcatttttaaaaaaggacagtttattaaaagaaataaccaatgtactgcgaaaggatgacctttcgacaggatcggttggcccatgtcacttcaaacagcgaatcgtgcaacccgactcttcctttttccgcctttccacctaccgaccatcgtatttgttttaaaattttgttttttcgggtgtacgtcttggtatgtcataaatacagtatatagagactgatacatgttccagctctcgacacagccaatcgggcaggactttcggagacctgcaagggagaagtcatagtatcctcctcatcctcttgtctcgcttttctaggggcccttcacaccgagtcacagcttcttgcgctctatg

SEQ ID NO: 1084 - DNA, 703 bp, Nannochloropsis_gaditana
  misc_feature (615)..(624): n is a, c, g, or t
atgcacctccccaccgcatgcccgcggacacaggttcccgtaaaattcctcatctcgtccgacaacatagcgccgtcgcagatcacgcatctctcctcctcctcctcctcccccccctcgttccctccctcgggctgtccactaagtgcctccacctgaccggccagagactcccatgtctctccccccgagccctggggtcgatccaactcctgcagaaacacaagattcgctcgcacccaccgcgtcatggcccttgcgatctgtcgctccgcccgggagaaaattcgcctcctccctccctcctctgccagcagtttctcgaagctccggtccacgtatgcggccgtcagatgaatccgagccattaagagcaggcgtgcatactcctccaggtaccctactgcctcgccaaagaacttccgagacatgtgggtacacatggcatgcaaggcatgccagacgctgggcggcctgtccattccgccctccctccctcctttcttccttccttccctccctccctcgtcttttccctcatccaagagtcgcaacagacgctggaaggccgagtgggctaagacgtcgagactgttctccggcaagttcgacgtnnnnnnnnnnccaccccatatctattttctctctcatgccgcagcatctcctttacacggggcatgcccctccttcctaccagcacatg

SEQ ID NO: 1085 - DNA, 703 bp, Nannochloropsis_gaditana
gtgtggcatctcttgcacgtccgaaggagcggtgaaggtggcagagccttctcaaactccttgcggaggccgtccatatgcccgcctttcctgtggaagaaagcaaggggaaagaacaacacgccatcagtctacgtacgggaaacttttcggtgcgaaagactgtcataaaaagggcatgcaagggccaaacgaaatatataacggggttcagggaagcacatgcagtaggaggttacagtcttagggtggggaggaaacaaacatggcaacagaaaatgactcccgggcagccgagatgccttccatgtcactcgctctaagtgctctcgaaacctttgcgccgcattggtcctttaccttcttgatccccccaaaaactcgcccaagctatttctcgtgcctgaccagcgcggaagcagcgagcgagttgaggcgcccaagccgacgcccgtctgagaaagattccccccgtcctaacttcatgcttggcacgttggtgcggtccgcaccgtctctgggaggctgggatcctatgcatgacaagtccgggtggccttttgtttcgacgcgtggtctcgtccaccggattccttggctgcgcatgagagggcctctcttcttaaccccgcccgacaactcacatgccttcatacacacctctgcgtggacatcaggcaattataaggaaagcagcacgatg

SEQ ID NO: 1086 - DNA, 703 bp, Nannochloropsis_gaditana
catgccgtctgccttcatgacacccacatccacgggcactcgatcgccttgttgcctgccccccggcagaatgatccgataccggaaataaggctccacctcttctccaacgtattgacatatctccacctgatttgcgagcaagacagccaggcgcccgtccgccgcccatcgtatggcatcaggatgctgtagcgtatcgtacaaaacgagcttttgctccagacacgagcacggggcacgggctgctggcggaagggacggttggtccatgcggtaccttgatgaggacaaaccagcccccccgatggggaagacaggctacgaaacggtatcacggtaggccagctaatgtctgtgtagattgagcgggcatgaaaggatcatgagctcacaaagcagaccaaatgacggcacaatctaccaagctcagcgacctcccctcctgggtacctcctctcctccttttaccatggctaaatcatcaccaacgactcacacatgaccggaagcacaaaatggggatcttcacacgttttcctaaggatatggccacattctgggccctttgacgtttgattctgacttggtcgggtaacgtgtctcacgcgattcgtcttctcccccaccctcatactcataggggtatacgcctgcattcttaccccgcattttctaacatcgtttcccgtttttcgaaatg

SEQ ID NO: 1087 - DNA, 703 bp, Nannochloropsis_gaditana
aaatgaagaccgtgaggttgaacacgcgcgaaagtggagggtctcgagggttaggggtcgggcgggggctggggcagggatagtagggctcctcggggtttgacgaaaaatgccgggaggttcccttttgggaaacggacaccctcggtcgcagaggtgccaggaaatgaggggacgagatacgaatggaagcgggccttccggtatgcggtgattaagcagcgcattgtaaggactctgaagattgataatttcacgtccccttgatttttgatgggctgaaatagaagcttcgcggcatccgcatcttgcaggtgactacaggcttttccccgcgctctctccaaagattctggacgagggaagcaggtagcgagaaagttgtgcgactatgcaatttaattagaggctctgggattctgtctcctcgaggcatttaactcagcccaccagataaccgtgaactactggtgcgcacgccaagattctttaaggtgtcggttgtggctaccattggtctcgctatacccttggattcattcttgagaatacagctgttgcgagagtgctgtatcgaggaccatgaatgacttactgtgtacaatgcccgcaagtatggattctcctgtcttggacgctcacagctctcctctcacctcactttcaggactttccagtaaggcgtctagaacttgccaccatg

SEQ ID NO: 1088 - DNA, 703 bp, Nannochloropsis_gaditana
ccaccgccacaccgagcttggccattgtcgatgcaacttgacgatgaaaaactcaacccctccaacaaatgtatgccttgcctgttcccagacgaaatgcaagggcactatgaggaaaaatgggcacggatcggtgtgcacggggatgaaggcacgggtttgcgacttccaacacgcacgcacaagcctccccgccagctcgctctccccctcccatgccatgacagcattaattcgacaacagtccatgcaccgtgcttgcccgccttctctaccatgcatttcatccatgtgtcatgcttgtgtccggaggcttccacgtcggctcgacctctttggtcgctgtgtattgcagagtagcgcagtctgctcgagccagctcgctttcccttcaatttggtggggctattcgcctcctccccccccactggcactgccggcagcctgcccggcaaatcctcaaaagaacccaacctttgataccggtccggcctcgatgttattttccatgccgttcgcctctttgatgccatttgcgatcttcttaagcacaggtcgattcgcaagtgttgttggaatcgttgcctcctgcataccgcaggacgtgctggcggcagcggcgttgatcctgtaggtggctactttctgcctcgcctttggtcgatatcctccaccgtgattgaagaaggggcgaaggaggatg

SEQ ID NO: 1089 - DNA, 703 bp, Nannochloropsis_gaditana
ttgaatggaggaactggacctctgtgccagcttctggcggaacatgatgcgactgaacacgttgaaatatacttatggggaaaattcaacgactgaatatcactaagaatcgtcttttcctgaatcttacctactttttgtgtcgttcacctgggtgtgcaacgtgagtcggcacagattcgggtctgggcacgctgtgctcgggcttagaatcaaaatatcaaacggctcaagttgaagattctcccgctccgttccgtggagcccctaggacaacattcgatttgaccagaaaggagcaccgtgggcggggggggggggaatagaacatctcagtaggtaaatgatgagttgaaatggcaggagcgctgccggaagagtctaaatttattacatgacagggcctgaattgcaaggatcacatggatggacgaagcatcgactggaagtgaatctggtgacgaccaattcccatcgggagacgctatgtctacgttctttacttcagataatgaaatggtcgctcttatgtgtccgatgttcacccggtcttagacccccttccttttaaagcttattaaaaattgttttcgatccatcccatcattttctcgttcatgtgaaccgactttgtggccaagcgcacagcagccttttaatcatgtcgacaaacgagccttcacctgctgtggcagtggaaatg

SEQ ID NO: 1090 - DNA, 703 bp, Nannochloropsis_gaditana
cagacccgccaactccatcagttggtccaccgagaaacccggcgtacccatgagctcttcgtcgatagcctgtgcttctttttgtgtcaagagtgtgatgcgctgtcgccacgaggagacagcggcatcggagcccttgcaggggtcccccatgttgttgctcttgctgtcgctgtggagcggaacgcctgaaaaagaacgacaggtgccgccctttcccccttcgttgagtgccgccggaagatcacccacagaagacgcagagactagtgtgatagaggaagaaatcgcccgaatggaaccccaagccaatgaatgtgtaacgaaggctagggcctgatgaggacgggggtgcgcgtgcgacgtaggtcccgcagcgaacgacgaggacgaagagacagaggccaccaagaactgcaacaagggcgtccgacttctcatccacctgttgcaataatatcagtcacgtggtagatcgctcttgttgttgtctcggtttttattcagtgactttacttgtcatgtggaagaacctcctgcctccgccttcccacgttgcactttttatcgctttggcttgaggacacgggacaccccgtgaaagctcatcacgcatcatgtggcggtggtaatctcccacaataatcatccacgactcattcgtttcatcttgttaaagcagtcattctttgtacgagccatg

SEQ ID NO: 1091 - DNA, 703 bp, Nannochloropsis_gaditana
gaaaggctgatcattgttcagtagactggcccgcgcttgctccatagcagtcgaccaggactagtgtttcgcactgtgctcactcaccgaagatggagagtcccaaaagccgtccagcaaggtcgaaccccccccaccagatgcgaccctattaaaattaatgtgataccgtgggactttggttgcgtgccggtcctccagcggcgcttcgcaaatttcttcccgtgctggccccccgcaagcagctgagggacagaaggccgccgccaagcctggtgtataaaacagagtgcatgatgacggtcagcacgaacgaggcaaatgtcccacattcaaccgcgaaaaaggaacataccgcgcctggaggcgctccaagaagtaccatcctgcctctctgtccggatggaaaagcaacaaccagggcaggaaagagggtcgctgaagaagcttcgactggctccctcgctcccccgatttacctcctggctcccaaatttctcacgcccgtgaccatggccacgtatctttttcaactcgtcgtgaagcatttaaaagggtaaatgtacgctaaactgggcctgcttttacatttgtccaggatggcagccgtagatgccgccctggagaaggcgagatggcgcttatgacgctccttggagggagggtctgcgcacacaaccctatcatctgttggtgaatcatg

SEQ ID NO: 1092 - DNA, 703 bp, Nannochloropsis_gaditana
aatgagtaaaatgggaataagacgcttggctatgaattttatcaagttcttttctttcacgtccaacgccatggctgctgcaggttttcacctagacgtggcgatgcgaggagttgatgtatagacgtctgtcccgacctctaacgcaatggatgaagggaaagaggaaaacaagaggcgtcctgtgagacggcagcgaagaataaggggggaatggggaggtgaggagacgcaggcctggcaaaatgtgacagcattgggaccgtggccacagttatgcattcaagagcacacatttcacaatgttgtatataattgtttgtcatgagcacgcaaggagatggcctttggaggaaaaacttgcgtgagaaacggctagacgaccaggggtaagcaaggatcatgacagactctaggagagtgaacaaaaggagcgagtcacatgcctcctcgtgataggagacagtaggctgcgtcctgatgctcttcgttgctcacatcagaatgctttaccaccaacacagatcacggccactttgtagaggcaccgtcatttttacacgttgtcgtcttgtccatcagtcatcgaccggcaacatcccctccctctgaacacttggatttcgcatttgcaccaataacgaaggctgatccattacgtctaaagctagaaaaagccataaaaggcgggtaaaagatcatg

SEQ ID NO: 1093 - DNA, 703 bp, Nannochloropsis_gaditana
ttgacaagtagaaggaggagcaaaccaaaggaggtgagcatggcccacaggagggagggaggaggtcggaatggtcctgaatgttgctcgcggaggaatcgacggaatacgacgccagtcttcattctaaataaatcaaaacatccataaaggggatgtgagtcagtaaatatgtgtatttgtaaccccccgctcacgttttttgtcgctcggcacggacgttgggactcgagaaagcagctttcttgcttcacccctgcaagcaacgggctggtaacagacgggacaccgtcttgccgtccccgcatctccacttatgatattaaacatcgacaggtataaagagagagacctcgtggttagaaagcgtagcctcgccgccttgaatcagccgagtgaacttgcggagatgtcagcttcaggcatgctttggcgcatgtggcacaatcctcgccttcatgtcaaaaagttctatgatgtgccgggatctaacactttcttctcaccactcgacgcatgcaggaacaaaaggcgattcaaaagacgtcgatttctacttcatcacgctggcaccattgtcaagcgtctatctgcgagtggtttatccttcctcaagaaacctcctgacacgtcgaagcaacttgctggttgaaggccggtggcggggcgggggggtgaaatagaaagacatttaggccaaatg

SEQ ID NO: 1094 - DNA, 703 bp, Nannochloropsis_gaditana
tggcgcgtgcattactgcccttagacgctgtacgtggtcacttttttcaagtttgaagcggcaaaacccacaggataggcatcgttacaccacgtcacaatgttgacaaacctcccaattggacacgaggctgcgatggcgtacaggggaagcggcctggcccatgccagtcaactcgacagactgaggcctttttcatcatactcccccaacctcccaagctctccaagcacgtgtgaggtccttttcatcataccccctcgacctcccaagctcccgaagccgtccacagcgccctcgccatccaatcgcctcccccccgagggccttcttcacccacagcccccacgttcattttctacagccgctgcgatgcgtgtttgtgtttgaacgtgctactgcgatgctatccggattatttatggtagcccttgtggaaattgcttgcaggacagccggggaggcatgattaaggaaataaggcttgaggaagctgcttccaaactatttcctgtcactcactcctgatgggacccttcaaacgatgtatctagtcttctcatgaagcaattgtgtaaaactctatcaacaaggaactgcggaaataccgcgtttggttctttgaagtcctgatcatcttttctgccaggatgttgttcattttctcacttccccctccaactttccacgacagcccatcatg

SEQ ID NO: 1095 - DNA, 703 bp, Nannochloropsis_gaditana
atgaccaatgtccgcctctcaaccaaggccccgttgcttgattgacaatagggtattgtcttcataaaatcatgtggttctggctttttttcaaccttttggagggtttgtgccgtggatttggcagggttgcggcccgcgaattacatcggtagggcttgggggaaaatccggagtcacgcctccgcaccatgtggtcgcgaatccttgtgaaaatcccagctatcgtgcggatgtgtggcccgcgcacaacatttcaggatcggagatattattctgtaagagggcgtggtatgcgagacccgtgtcgctgccacgtgtctggcatccactagacgtgcgtgtcgtctcgtcaagcgctcggcgataccgtatggaccacacatgtttacaccgaatgaggaaaaaatagctaacgaaggcatcaaatgcagccttactcacgcagataatttccataacgtatgtccagatgacacgagcggttatattgataccgtcggcccttgcgtgtcgacagcactcaccgtaccgacgagcgatagaagcggccttgatagcacagttcaagtcgagtagtggcgccaacacgcttacatggcagtggcgagaaccagtttatcaaacaacttgtgtatctgcttatgacgatcgaccaggctgcaatggtggtccgggaggctttgccaatggtatgaagatg

SEQ ID NO: 1096 - DNA, 703 bp, Nannochloropsis_gaditana
ggcgtcgtcgtagcggacagttggacggtacgagagcgcttgtgcggtggagaggaaccggaagaggagaaagaaaaaattcctttacaagagggataaaacgacgatgaggacatacttggcggaaggataggccgaaagcctgccccaatgtgcagaaatccgagctgtgggtggcttgaaaaaggaagtgtcgacaggcgatcgttaatgataaaaatacggttgcacctcgacatattatagcagtgctttcgggagcatgcgtacatcttaagaaaacgagcaaaaaaatatacagcataaaacatacgtcagattgtctctcgctatcgtacctgtgttgctgccctttaaagagatgtcgacctcctctcctgatgcttcgtgtggcagtcaatgcgacaagtcggctactgctaagaagctgctgcgaaaacaatagcatgaaaagccttgacataagacgcatcgtctgccacgtctgtcgtatacaattgtgacatttaaaatggtgaattttcgaaaatggcaccccaaatcctccaacaagctggcgcccagtacataacctcctccctaactccctttccccccccgcctagagccacatagaaccaggcgtaaatttttcaatctcatttcacccaaagctctccttactgtcccacgcgcatgcactcttgattctaggttgattatg

SEQ ID NO: 1097 - DNA, 703 bp, Nannochloropsis_gaditana
tgccggaatggaagttgaatcactttgctctgtatgccattctggtggtttgccttggtatggaggctcgatctggaaggatgcgaaaaaaacatcgtgagtcgaaatcgttgcagtgaaatgaagtcaaggcgcgttttgaaaggaacaaaagggtgtttcgcattaagaatatacacccatcaatgttatgaattcggtaggaaaaattggatggaatacagccggcacctcgattctcaagtttccccagaatgcttgctgctgatgcatctctttctgatgttttgagggatctccagccattttgtctggtatagtccgctgaatggagaaggaatgggttctaaccggattatggatgcgtgttgcatctctggagcgggcaaaagagggtgaaggaggcggtggaggcagaatttggggccctggggatgatgatgccgctgatgatgacaggggagcgcgaggtgcaggtggttgctcgtcgaccatgaccttccagccacgcaaaagcgtttactgcatggtagatatcctgtgcgttgtaaatagcaaagaagtatggctttattcctgtcgtgccatccatctcgtgcgccgtgtcgaggcctcatcgggatgcaaccacctgctacgtgacaacggatagcagcgaggtctatggcccattccacctcaacacagcgaccgctgacaaatg

SEQ ID NO: 1098 - DNA, 703 bp, Nannochloropsis_gaditana
actgtctccttcattattaacgcatacgttacgggttgacgctctgagcaagatgaccattgtacactttaacacgcatcgtcaagcagcgaggacgacaatacctttggactagatgtgagcctttttgaatccgatgagataggaaaatttgatgattcacctaatatgcataatttatcgtcgaaaaatgtatttttacgcattagacaagaaaagctaaaacaatgaaaaatggaaacatgccctagataagttcgtatatatttctttgagtttttgttaacttaactcgcctaagtgatgcgtccaatattgctcttttacagcatggccaaacagcagagcaagctagtctttttgaaagcgtgggagcggatcgaataattggaacggcctgatcaattgtcgccgcttttggcgccaaattgtggcttccagcacccccccgtccccactcgatttcccgcccctatctccagtagactgagactcgtcaaaatgaacccaagtttgagctttggatatcaatggtgtcgcatggggaaaaaattgtttgcggtggtatctttgaccgatagactggaaacctgcatttgaaaatgagaatgcattctgtctcaccactatcctcttatcaccccaccaattccactcattttatctccccctccattttcatttctggacacaagtgccaatg

SEQ ID NO: 1099 - DNA, 703 bp, Nannochloropsis_gaditana
tgcatccgcgcaaggccccttagtccgtacctcagacatggactcgacggcgtagctaaggggggatggccacacaaagcacaaaccctccacacttccactcatgaccccgacaacattctcgagccactcatccgatcaaacacgccagacacgctctgtgacacgacccgcttgggacctggcccctgttgcccccttgttgatcgggtcattttacacttaagcctcgccttttcctaacgtttgacgggcacgtcatctgcttcccccctagcgagaagttctgtgggcgtcggaatgcagcacgtgggccgccgcccgcacggcagatgtttggaggacggatttgggcgtgacgcgaagtgtataagtggtgccgcgtaaaagaagggctggcaggtgtgggtagtggtgcttttacgcgcttgcaaaactgcccttgcaaggtcgaagaggaaattgaactttacgacttgcactcccacacgatttttgtccgtccggtgagaggaaacgaatgtgccactggtttctaaaacactgaaaggggagcacagataagcgttgcacttctttcaatttgtgttgtggaggacagcagaaaacagcggggagcttgcatggaatgcgtcgtacaccaagaacgcacccacccaacaccctagtggaactttcttccttttcctttaattttcatacc

SEQ ID NO: 1100 - DNA, 703 bp, Nannochloropsis_gaditana
actccaattctagcaatttgttccgagatttcatcctcgctgctgccggcagctcgtagggtcggaaaaatggacggttaggatactggataacatgaagctcctgagccagctggtctgacagatagacaggcacctcacgcacaactggatcatctccgttatcttcgtccaacccgccatcgcctccacctaagtttttatcatcgaagtcctccctcacgtgatgatcaccactggcgctcttccccccaagtgggccctttcccccccctaatagcgcctcggcagccattgcgtggagcacgttaaactcctgcttcagggagaaaagaaaacggatttaaaatgtgtctgagctttggaatgtgagtcaatgaaacccgtttatgggggtacgcctgctcaagggaggaggtttttggccttcgcttcttgttcgccgtgttgctggtgggagagagccgtaagctcaatcagtacatttgaaaagagaggaacaagcaaccgcgcttagctatttgaatcctaggtcttcttcttatttttcatttctcagcccatggtgcgcgtatttctccattttaccgtcaagaaggagtcacaggcttcaagtcggctcaatcgcaacctcctccctgccactgcttggctgcctgcttccataacaggactcttttctcgacgtacggactgaaccatg

SEQ ID NO: 1101 - DNA, 703 bp, Nannochloropsis_gaditana
gcagagaaaaggaggggaggtgaggttggaggagacaaggaggcgcatgcaagaattcaaattcctcaacggctgaggtcgagttacttgtgagagccctccacatgtttgcgcatacataggccatttactctacatgtcataccattatcatgtaaatcttaccctaatatatgcgtccggggcgctgggatacatcttcgaccgtcgtgtaaataaaaacttccaatgactgccacggcgtaagctgcctcagacgccgttacgactcgatcttcccaaaccccactcattggttactcttgctgggaaggggacatttaatgctgtactgtgatctggctcatgatatggaaatcttcgtcatgcgacggacacctttttgagagattcattcttactttccggatgatcaaagggttgggccattagatatcaagtcctacacgttgacatattcgtggcgatgcacgcgacgcaggaatgaaatggagaaacaacacacaaaaaaccaaaaaaatcttcccatttcataaaattaataacaggctttttaatagagacaattgagtgtttattttggaaaacatccgctcaaaaggacgccaaggcaagcagagcctgaatataagcgttggaatcgccccaagaagaaatctactaggtggtctggacctcatacatcataaatattgtatttatg

SEQ ID NO: 1102 - DNA, 703 bp, Nannochloropsis_gaditana
gtaagggctcgaccaaatcatctcgttcagacctatccttgacggctcaacggtatagttcagaatcatcagcaccacaccaatgcgtcacccgtaccagagctgggatatcccggtaattccagggacgtaagtatatgggcaagggaatggaggaggctggagacactcgccttgttcttgcttcgcgggagagaggatgtcactttcttaggaacgatacaaaagccaatttcggttggtaatggattgccctcgcggagaggttgttatacaccaacgcggttgttatgtggtgggtgcgcgctacagctttaagtatgcgtctacttcggcagggatatctcgagcatcccgggcccgacgagtcgtcccgcatccaagcactttctgtgacgatgatgatcgggcggagcaagcaccatgcttttctctctcatcttcacgtgttgtcatgaatatcatccttatgccagaacagggcttacaggtccatgcgcgtgttgcgtggcggtgcactctcggaaaagccacattgggggtaagggatgaggtctccaccctgccacctgctgaccgtctacgtctattgggagactttgacggtatcacgatgccatcttacaatccttgacctgattggtatcttttcaattattaacagacataatttgacgatcaggattgctggcagcgaaacatg

SEQ ID NO: 1103 - DNA, 703 bp, Nannochloropsis_gaditana
ggtcgatagataaggaaatcaacctgttaggattagggcttatcacagggtacgtacgactaatcaacatgaagacatgagaaaaggcactgcgtgattataacatcacagcatccgtgtggttcgcggacgaaacaaacgggtccaatgacaaaggctgaccgaggagggcaagaggactggcacaggcataaacaagaagtaccatacgaacgaccagtcgtgccttcaagcatttgaatcaagatgtgtatccatatacattctccctgtcatgactgtttcttccaaatcagaataccatttccaataaaggtcaagctgcagaaagaagcaagcagggcggcatcaagaagatggaggttacatctagagatcgacttcgagcgtacccacaaaagtgcccaccaagggaacctacatctccagtcatcctcccgtcattcaccatcactattgccccccaaacccgtggcatgaccgcctcagagtcccccgaaagcccgggaagagggaggcgtcgcccgccttcccgccctcgccaagactagagagagagtcccctgtccaaacccgccgcccggcctaggcctgtcacccaccgtcctgaacgacctataccaacaccccgggacgaggttccttgcatatgactaccgtacatggctcttcttacaggtttatttggtttggactggagatg

SEQ ID NO: 1104 - DNA, 703 bp, Nannochloropsis_gaditana
tcgctgaggggttcttgagagagcgagctgagggtaaactgtagctcgtcggatctacctttaaaaggtatgaactcgccgagttgtgcgtgccgtagtttaagaaaaatacaacaacatgttcgtagttggttgaacaaggtcggaaattgcctgcacaaaccttgtgtcttgaatgcaaacaggaaaaacctatggcatatgtgttacgagacagaaaaggatgtacgcattcatccgtactttgaccagcaacccccttacatttttactttcaatttgggctattgcgcttttacgttttaagtacttgcgttgtacgctccgggcgtttccttttttcctctggaacagggcaagctacccggattttctccgagcccgcgggcgtgggtcgcatcagggggaagatttggacccgccgcactcagaagacaatgacgctgtacgcgcagagggaaagggtcgggttgaaagcacccttcaatgttttcatattgtgggctctggggttcatttttgttcgaaatacctgtcgcacgcaaactttccactttcttcgggctgacgagcaccacccccctcccctgggttgctatctcaccttttcaaaattccttcgtacaaatacacttcagcgcccgctgccggcggtaagcagcaccacgccctgtacggcaatagcgcggcaacatcgatcatg

SEQ ID NO: 1105 - DNA, 703 bp, Nannochloropsis_gaditana
atgcccactgcgcatggcgtcgtgtctcctgaaacatacaaataccttgtactgaatgtcatcagtacaaacgtcgcggggtgactattctgtctaccgctgagcccggatgacacagaccctcaatcctatcttatcgcctcaccctttcctctccctaccactcacgtaattagggcgtccatacccttgaaggtccccctctccttccctgccgtgtaaaccagggggaaaattaggagagtagccacgggtgtggcgagcgaggggcatatcaaggctaagtgacgtgcaatcccgggcatgagatcgctaatgagacgcggtcaaggcagaaggccaagagcaactttttgggtgtggaaatatttccaagcagtgatatttttgttgctgggacagttttcaatctcatcgtcagtgttaggtgcgtagtgcggggctgaaaaggaagtgtacgcgggaaggatgggggctgcttccggttgccctttcgatcattttatcgtgtttcacaatccagaagacactttcatttgagttccgtgtgcattcaactctggcaacaccggaagaatgtggagtttccacccttccggacctagcttctcgttagttaatcgtgcagggtgggcacttcagctacctttaatgcaacatgccacccctctccactcacccgcatgtacacgcacgcacaatg

SEQ ID NO: 1106 - DNA, 703 bp, Nannochloropsis_gaditana
ctcagggggggcccgagcaggggaggcctgaaagcccgcgtcgcgccaggcatgaaggccacgccaagaacacttatgtaggatattatcataataattctctcttgtcttcttctctgcatagttatcggcgtatttgtctgttgggtggtttgatttggaagatggtaaagttgagcttgaggaggtcgtacttcggcaaaagcgcttgctgatgaaaacgcagccaagcaagaccgccaatacagctgtaagcaaacaaagagactgtccggcggtgtggacaaaggcttaaccgcgtgatctcacgttggattttcgtgtagatagggaaagtgtaggtcagttgtgtcacagtgcctgtcactgcaggggactgcagtcactcttgtcaactcccggaggcaacggccatgagacagatgccctgtcggggctgccgaggcagcaagctaaaaaaccatgcgaccatgcatgtgcacgtagaaaatcaataccgcacagcgagggtgctgcttacataggcctgccttgctcacgcgttttgttgttttgccagacctgcagtcatcgctaagacggaaatgaggccttcgcggctcaggaaagcgaagatgagcatcgagccttatgacaattgacaccttttcctcggcaccaggtgcgacggagacgtttgggcgggcatcaagaccgaaagatg

SEQ ID NO: 1107 - DNA, 703 bp, Nannochloropsis_gaditana
acagctattcttgacatatcaaaggcgccgaaagaagagagcaagtgtgcagcatctgcatgcacgcccattccatgctttcgttagagaagaacgagcatctccaagcaagttacatttcaaagcattggaatttttgtctgttagcatttttcatctttcagatttgtatgactattttgtttcgaagatcaacaaagtcgttcctggtagtccctcattccctcaggtgacagcttttctatgtattgatatgtccttcttctcaactgacaatgttcttgcaaatgcagctagctattgtgatctgccgcaaaaacgtttttgattttacatgctttcttttccgcggcgtttccggttgccgcgacacggggagttggctcgagccagctgacggcccaagttgcagccaacggcttggcagtagcgcgggtgagtggcataaggacgcccattaattccttgggcaagtggcacgactgcccttctgtgtatcgtcgatgcatcggtgtgttattgacaccgaggacgtgaggcattgctcgcgagactttgaaagtacgctacgacatgtgtcgtagctatcaagcgatgttactggctggctcagaaagccggagtcggaaattgcccttacatacgccctattacaggacacgaacaagaaacgttccccggcttttcaacagcttctcttatg

SEQ ID NO: 1108 - DNA, 703 bp, Nannochloropsis_gaditana
gcgaaagctctaagcaaacctgcggatgccacaaaacctgctccgaccatatccacgcccgttgagcaatccgggttttccttgttcggcaagcctacgtctcccgcccctcccgctctcaaaaacacagtggtggccaagcctgcagtcgcgaaggccaccacttctcccgcacctgccgcgaccaagggcacagtagctgctaagccagccaaaaccgctgctgtcaaagtgacgaaagatatggccaaagttttgacccctgctgctgtcaccacaaaagtcaaatctggtaagtacattccgtctcctctgaggatggcgttaattcaaacaaagcgtcttagcttgacagtggttgttgaggtgtcccctttgatgaattgcgaaaacctagcgcaggggattcgatggagggccttcgttcactttgcaggcttcgtgttatactctcgggcttgccgtcgcccctttcaccttttcggaggaagggaggaagcggattcgcgtgcccgagcgtgagacttgggaccggcaaaaaggaggaaggccttcatgaaactatcattaagcatgctatttattctgtctgatggggactgactttcacccgtggcaccgcatcgtgcccaacgcgtgtctgagctaccctttcccagatccgtttcgtgaagacgcctcatcttaccctccaaacatcatg

SEQ ID NO: 1109 - DNA, 703 bp, Nannochloropsis_gaditana
ggcatcgtcactttaggatggcagcgggtataatgcacggatccttaccattctgatcccgaaaagcttccttgacttcaactcgggcagtcaatgaacgtgaccagctccctctggctttcaccatagagatgaggccctatcggttttgtaaagtgaaagatatgagcgcatatatgcaagcgtccaaatgtgcgcggttttactcaccatatgaaggagaaggacgatgacggagagagtgggaggaggtcgccgtaaggctggggtcattggccgggacggctgtacgttcctatagcgccccacacgctctttgggtctttactgctcgcccctcggagcctgatttgttttttggaaaggtttcgctttggaatgcgtgattcgtgggagggaatccagaaaatattcaggtgctgtgatataagaggagcggcggcccgcgggaatgctaccatcgccaaggccaggcttggaagggtgaccgctttgttcacttaatacaagcctgattctgatcatgtccttgcccttatcatcaagtaaaggttctgaagcaaccacgcacaggtaaaattttgtgggtgcgacgggtttcaagatgggaggaaagctgaatttgtggggccattgtaaacgagtggactttggtgatcccaattaagctccttcgtctacttattagctccgacgggccatg

SEQ ID NO: 1110 - DNA, 703 bp, Nannochloropsis_gaditana
gggaaagcgggtggcggagacgatgatgtacgcgtacaggtcacagggcggggagggggactcgagcatggaggtgcgggtcgccaggattttcaacacgtttggaccgcggatgcatcccaacgacggacgggtggtcaggtacggagggagaccgggacgaagatgggagggaaggaggtggagagggccatcaggggagggagggcgccagaccgtttcgtcaattcttctcgagatggagtggtcgtgtctcacgtcttgtcggtcgtgcccatgattgttttccacccctttcctctggctcggacgcgatgcctctgcagcaattttattatccaggcgcttcaagggaagaacatcaccatctacggcaaaggaaggcagacacggtctttccagtatgtggacgacctggtctcgggcctcatgaagctcatgaacaggtaaggacgtagacagaggaggggagcggagaagggggcatggaggagaggacaagggcggtcccacaggcggcaaggagagagagagtgcgccgtcggattacgacgctgtcaaccccactggtattgacctccacctctttgcctatctcccgtgtttctcgtacgtcgtatttctccctggcagcgactacgaactgcccgtcaacctcgggaaccccgacgaatactccgtcaaggacttcgccttgcttgtg

SEQ ID NO: 1111 - DNA, 703 bp, Nannochloropsis_gaditana
atacggagattcatgcgcgcggtatttcaaattatagggtttcaccctgtccgtgtgcgcgctcatccaagccctgatttataatccaacaagccagagaggacttcttttactgcgaaacagcacacgcgcgaggtcgcaacacaaagaatgctaggtgttacatgctacgtacgcccactacccaaaactgtggaagcggcccatgcagcgattcctctgatcacttttatcacggcgtttcctttgtcgcaaaagaaaatcaagtcgaaaacctcccgatctacggacaacgccgacccgagtgtcttcgcgattttcgctccactattagaaaattgacgctgtcgatcgaacaccactattcgtagcagaacattcatacaccatccaatcatggcacttatttggtcccggactaggaaaagacgcgttgtgtgccagcgaggtacggcgagcctaagccggtgtcttgtcgacacccgctactgcctccttgccagataaaaagtgtatgtttggacgttctttcgtttatcttcaccctgcaccgcaatggctgtagagattctagattttggatatgagctcgtgacctcttttatctcgcctccccttttcatgcgtaaaactcaaccaaaacgtgacaggccacgggcagcgtcatcctatcgcccgatactacgacgtacacataagtatg

SEQ ID NO: 1112 - DNA, 703 bp, Nannochloropsis_gaditana
tggtcatcaacgcggtgaaggtggtcgatttgacaaaattgcgtgaaatttagtgatcacccctccgtttccttcatgcccttccttaccacaggacaaattttcaacgcccaataatttcactttccatgagcatcgaggatcatccccgccagcagcataacaaccaacaacacccgcagcgtcaggatcaattgcacgatgcacaatcgcgtccgcaggggcaccgtagggaccagcaggcgcacgcaaagaaggttagtggtgttcctggcgggcatgcgaccttgccgatgaagaagaaaaaaggaccttctagagtccacaatcaaagagcgccggtcattcaagcggaagagcattctcttggtgctgatgtatctgaaaccgcagtcccaaccccctcggtggcggccgcactgaagccgaagcaaaaacgtcagcctccgcaatcgcagcaacactccacgcagcaatcagaacctcaacagcaagaaggggaaaagaagaaagcgcatgcaacggacagtgcctctgggccactcgtttcgggggctcgggtggtcgaaaaggaggaaagcccattcgtactggtattgaccaaaagacgcgggccttgaagaagaagttggacaggattaaggcactcgaggaggcgcgggacgaccagaaaaaagctgcgatcctgaatgaagagcaaatg

SEQ ID NO: 1113 - DNA, 703 bp, Nannochloropsis_gaditana
acctgtgtccgaagcgtgtctattcattaagtgtaaggtttttggatttcaggtcacgttggttggcgagagggccgctgctcgttcgctcgcttggcgaacgacggctcataaggcgaaaagaaaggacgaatagtataacctgaccaatgaaaagctcgcctgcctggttcttatatacaggcatacccgtcatcattgacataagaactgacagaacgcctacaacggtcgaagccacgttcgctcctgcgcactctcttttaagagcgccgactcactttatcaacatgacccgtaatgttccgcccctcttcaatttcgacttcccgtcctgcgagtatatcacgcaacatccgcgcactcacgagctgctaggctttgtactggtaagaaaatttgctcttctgagccatctttttaaaaatggcatcccttagcagtccttatcctcaaacacgccttatgtttgaaataggctggcgtggccatcggcctcatcattataacagtcctaaccgtgtatccgggagagcctttcgactcttctgtactgggacctatacactgcaagccattgcagtcagaaagcgatcgaaaaagatttcaaagacttggggacaagccggaggagatggatgtaaatgtagattgtaggcgtaccagcacttgttcgggggcgcatgcaattacgtcaaagatg

SEQ ID NO: 1114 - DNA, 703 bp, Nannochloropsis_gaditana
gatttttttcaatttctcatcattcctgtatgggcgaaatgtaaagctttcgcatagtttgaatctccgttacttgatataacggctaattgaccggtaagaactcgggagattcgggggtctctgcttttctattgggggagcttccgcaaatttcgctggtcacttgtgacgggtgagacataatgaaaccgaaagcatgtcgaggtgcaattaccctcttggtttattcatagtttgtgcgcaagatcgcagagctcctaagtgattgtcgtgggaaggtgctccgcttgagaaggagagcgacaacgccgtttcgatttgaacgcggttgggtttctgtttctccggcacttgcgatacgaccatctttcccgttttaccttgcttcctcgccatgcgttttcgttcgcacatgcaactgtcgatctggtgtgcagcgcaatgaaactctgtgtgtgcgttcaattaagacgtggccccggtcactgttctgtcgccatcgacgtattgaaggtgtttgtggtcgatctataattatagctttcgcttctcatttaaaggaagccttacatccaattgcccttctcggttccggtaaaagattctgtcgaagtgattaagtcgataacacacaccgcttacaactcacaaacagccaaagaacacttctactcttaccaccacacctaaattgaacatg

SEQ ID NO: 1115 - DNA, 703 bp, Nannochloropsis_gaditana
agccttattatgtcggagttttggaaaaagccaggtcgaacattgttctggacagtagctcaggcactatgtgagacatgcagaaacaagtatctgtctgggctattatgcaacctctcccttctccctcacaaatgtcaagctcctaagattgttaaaaatgataagtggtggatcatacaaagtcatcaaatgtttctttatagccgtctgtctattttaacagctttcctagtcttcgtcccggtgtccttcataaagatcattaaagacgttgaggccaagaaaggaagtgtgagatgatgaaaaagaggagggtttgagacggaaaaagaacagtggcggtgtacgaacagtgtcggtgtacgcgacgacgggttatcagggatggggcagggagaagacttagagccaggcaaccatattcggatgctgtcctcctatcgcctgctggacaaccccgccctcctttcgcgatgtacacgtctggtggtatacactgggcacccaaaagttcacagaatgacaaactttctaaatacgttacagggatttggcagggacataacgtgcaagcgggtggagagacgaacagaaaggagcttaaagtttggtgtatccttctattgctccccattcgcctcctctgtcttggatggccactctcgacgagctattgtttcaccaaccacagccgcgtatg

SEQ ID NO: 1116 - DNA, 703 bp, Nannochloropsis_gaditana
attttgttgtgatggattttttgtgtctggtgttttgagtggctgattcagcgtggtcggacgtcgttcaagcctgtgacgcgggttgtaaggcgaacacagcccccctattttcttaagaccaaccatcctccattaccattcaacacatcattagggagggaagctatggtagaatctaggcggcggcggagaccaggctcttctgtcttggtgaccacgaccacggcggtactcctccttcacacctcttggacctcagcagcaccatcgtcatcgtctgcgccctccccgaacacttgtcttcccccacggcctttggtgagtcatgtcgtttgtattcgattgttactgcaatgatattgatgaacgggattccactagccttgccatgcctgctttgaacggcgcacttatcgatgctcacaatgcacatgaacagcaccaaggagctttcctctctccacgcactcccttccgatgggggtccaaaagcagaagcaacagtgatagtacacaaaccaagctttcagaagacgccttctgtagtacctgtaattttatggcagcctcggtttccttttctcccaccctcgtcttgccggcttcaaggacggatgatgtgaccagtcctcacgcggcgcccgccgacccccctgcggacttcgcccctcctatctcgcccccaggtaccaacttgatg

SEQ ID NO: 1117 - DNA, 703 bp, Nannochloropsis_gaditana
caacagcccggtgacggcacgcgggagcatactggcgcgttatctgagagaaatcgatgagattccaggaagtcttaaaaccaatgggaatgaattacgatgactgtcataccatcctgtatgatttaaggatgaaaagtcttatcgatgagaacggcattcgcaccagcttgattctcgtcatgaaaattgatagggctgtcatttggggggttagagctgtgttccctaaatgctaccaccacgattcgcatcatgacgacaatgacaaaatacccaggagcacttttagacacttcgtttggaatctctacgcgtgacaagtcctgaatttcattttgaaatctgcgatcgcctgtctgcagcaagttatcagactcaaggcgccgggtactccctcctcgctgccgtcgccgccaattttgtcaccaattaatgaatgatgtgtccacacccagctccgacctcttaagtcaggttgtcggatagcgatagggattgcccatgcatatggggatggggaaatgtatcccctgagctattgtggcgtggtatctttcccatccttccttgactttcagtctcataaataccctctcccgccatacggcggcctcgcttcagctctgcgaagtatcttcagcatccacttgcattttaaagccatgttccatcctctcatccaccacagttgaccgccatg

SEQ ID NO: 1118 - DNA, 703 bp, Nannochloropsis_gaditana
ctacatatgtctcttgacttcctaaattctttagttgtcgtaagccgtgataagatcacattgtcgtgctcccaagtttacaaaggcaagcacattgattccaatcataatatgttgaaacattaatattcacctggtgaatgattgtacttacttgcgcattcctcgagctccttgcccgaaacatgctctgacgaaattcaaatctaaaactcaaaaaaccgtttaaattcagccctcaacggctttatgcatgcgactgagttgctgagcatggcgtcgactactacagctccctcgtccctctctctcctttctatataccttattgtatgaattttctcattttcttcgtggaaggggtctttggtatttcatttaaaaaagaccagctttgtctcgtgggccacaaactttgtatcgatcctttctttctattgctccacacgatctttctggtgctcgcccagtgtgcatacgttggaagcaaacttctgatctcatgtgcatatgcaaattttccaggataatgcttgttccgcaccttttattgcaccacacctgaaacgcaactacactcaagtactattacagcacagttatatgttaaatacttaccctgccttgccttcctcaactacccgcacacagacaaagagaacctcatcgttcccccgtcaacttttcaaacaaataaaccatg

SEQ ID NO: 1119 - DNA, 703 bp, Nannochloropsis_gaditana
agaataaacgggctttgcccgctcgaaggaccacatgaggataatctcgctggatacgtgcggcaggctcgacctctgtctcacgtgctcgcggacgcgttgacgtgcgatgctcctgaccttctctgacgctatactgtccccctttccggctgctcttgtgggctctagcagtggcactctgatctcgaactggaataacggaggtccaaccccgtgaagagtggaagaaaggtattgcaggcagggcaaaagccgcagcccggcgcgttgccaagagcaatgataacgacgtagtcaaaccaagtgcagagacgaagaggcttcgtctcatctctgtaagaacaatggatacggaattagttggaatacggccgggtggaccatgcgaacgtcaagcagcaccgcacaggagcgatccgatccattgaatttaaatttgtcaagcgaagcataaccccttgttctgcgcattcgctccaagaatatgtccatttggacatatgtaaacttgataaccctccatttttttgaagtggggtcgtgcaagcatatgtgggaaatgtgagtgcattgacttggggcgatggtcgacttgtttggtgttatgcgtccgggaagtactcgctccaacacatgtctccctcttgtcacatagcatatcacctccacaatacatctctttttacagcaaacggcaatg

SEQ ID NO: 1120 - DNA, 703 bp, Nannochloropsis_gaditana
ggctgcacgtgggaaaagaaaagatgaacatgtcctgatccgcaagaagaacattacctcagcgataaaatcctctgaattatacaatgagaatgtactcattacaattaattatgccataggaaatattgaaacgtcatttctgtattaagctcgcacttacgatttgcgaggctctctaacaggatcgcaagcctggtctgtgtctgagtaacaaagtactcacgtatgtgcaagttcttcacaacatttacttttgaaatatacatctaaaaatttcaaacgagcgtaaaatcacacatggaacttgacaaaaaatgaagaggtgatggcgtgagattgtttttaaaaaatcggttggaagaaacggctgctttgagaatttgaataatgcccgggcccgtccacccccagcacggcgagggatcctggaagaggcgaagaggttttggggatgggtgtccgcgtaaatgtgacaaactatttttaccagcttaacataccattatgtgccacctaggcgtctaaattggtagtaaatatcaaatgaaggcccgccggcatctcacttgcttcgcggccctattgggtaagtctcccataacctcatgcatgcgcattccccgtatcttccccccttcacccctcacttcctgaggcatgttcctcacgattcgaattttaatatgttcgtaaagccatg

SEQ ID NO: 1121 - DNA, 703 bp, Nannochloropsis_gaditana
taccacaaaggaaggggaggaagtcacgcatgttacaagttgtgaccgcacagtgcgcgccgagatcttgaaactccatggtaattctattctttgatgagccagttctacctgtcttaaatcggcaaagagagaggcgcagtgaagaacgcgagagggagggagggagggagggagggagggagggaggaagggaggccgaggagaggctcgaattgatggctcggtgatatgcttctcgtcgtcgtttgaattctgcgcccataaatattgtcgcctcgtgcattctaagcttgcatgtgcacgtacgactctctccgaacacatttcgcacatgttgtgggcacgcactgtgtctacggccaggtattccgaacaactcagtcgctaataacaaagcagcgacgcgttcgaggcacttcccatggcccatcatgatgatggtttcctacaacaaagaaaacaatcaagcgggcagaattgttcgcgcgtcgggcgtccgggttctgtttctttgtgttaggccgtcattcggtggtgacaaacgcttctatgtaatgagaagtcaatgtcgcaatgcgtaaattttcgtgcgacctgtggttaagtgtaggaacacctttttaagggacagccggtatccgcccagattcaaatctaacatcactgcaacctcatagcgacacacagaaatcaaattatg

SEQ ID NO: 1122 - DNA, 703 bp, Nannochloropsis_gaditana
aaagagaagttccaaccccccctcctccctggacaaggcggctatgcgaaattctttctatcgcacgggtgtttattccgcgattagttatctcaattttagtttatacaatatttttaggaggctttctgaatctcaacgcttaaaaagccaaagatacgcatttatcaaaggaccctcttagtcctgcacactgtgacgtcgcgagaaaatagctttaatagcatggctctgtgactcgtattgtccctcaagttcacatcaccatctaatatcgtgcaaaaaatgctgcttattaggtccaggaaaaaatcgcatgacatctcaagggcccccttccccttcagggaagtcggaggtagtcccacccgctctgaccgtctcaccatccaagattagcacaccagccagtgtgggaggtggtaccgtctttagccgctttatcggtaaaatggaactcaagagtccggcatttgaatttgcgcgtgttggtcctaagcagcattcaggggggcggaggaacattgtcagcatggcaggtcagcatcttatcgaggtagagggtacggctgcctcgccgcctcttcttaaggcatggggcatccatcaatctggatccattatcagaaacaaaaatagagggaagaagggacatgaaaagcttcttggcatgacagagtcaggggagagggtatatgagatg

SEQ ID NO: 1123 - DNA, 703 bp, Nannochloropsis_gaditana
ccagtcccttgatcaatgtggatttgaccatcagccaatctctgggaggcaaggaaaaagaggctcaagtaccatctacggcaccacaggcttcaggaatgacttgtccgaatggtgtaccgactcacgaaagcgatgcccctttgcccttcccttctcacgtgaccacgtcggaggattcttccatttcgtcctccgaacagagtaccaccctctcctcccttgaccctgtacaaaatagcgacccagaaaattctcgaagaggatcgcaggcagaccctcccagagccaggcggggcacgtttgtcgcctaccgcatcgagcgtggggacgaagcacaggagcaagtcaaagccatggcagacagcatcttttcgagcccacgacacgatgaggacggtgtagagccgatagatgggcgggagggtgatcgggacgacgatgtctctgatgtatctgctcatgtggtcgtacctaaggggcccgtgaaggagcaggcggaaggcgaagttgcgcgagaggccttttgtcgcccggatgccccagaaaagtcatccccgtcttcccaatcgatttcgcacttgccagcgccagagtgcatgggccatagattgctgtctatggatgtacacataccagaggaacggaccgcagaagcacaatcactgtgggggccgggagaggggtccagttcagaacccga

SEQ ID NO: 1124 - DNA, 703 bp, Nannochloropsis_gaditana
ggcaggttgaatggttggtggacgacgccgatggaagagaaagggcccccgggtgtgaaatgcgacatcggacgaggctcgagacttcgttttcctcggccaccgggatggcaccaaagcactacggtcataaaaagcgcgcctctgtccgcttaatcgctcccgggtcgccaattcctgtcccacgaccttgggaaaagccatgaaagatggggcccatgggacacggtcgtaaaacgcgtggggttgtaccgtgttatttgtattaataggcttaatcctcgtaaattcgttgaggggaggagagagggtccccctgctccaaaaaactcgtttgctctgcttcaaatacgccaaggcaggatggcttgcctgcccaccctaccctcctgaacacgctactttctgccatgtttctggcactggattgacacacgtacattgatgtatcactggcactgaccaattttttccacagctcgcgtgcggcgccctaaccgatcgacatatgggcttctcgagtcacgccgtcgtgcagcaagtgctggcaaccacattgctgcttttcatcacacttgcgtccacgaaagacattgaaattgacaatgcgggcggagggtctaccgctcgcaaggcaggcggcgctaagaagactggtttgcttcagaggatctcccgggcattggacacagggtccgccatg

SEQ ID NO: 1125 - DNA, 703 bp, Nannochloropsis_gaditana
ggggagggggaggacgcgggggaagtggggctgggagaatcctgtgcgtcagatctgcagcaggaccccctctaccttcaagaagtggaaaatcagctcgagtccttctgggtggaacacatggcagcgcagcaagcggcagcatccgggaatgcgggcggggaggacggaggcgggcggggacaggcagagggcagtgatctaatctacccgcaaagcagcgatcctgcagactaccccagcccgtactcggtccagggagggagcagacatgacgtttccgcgcccactttgtcgtcacagccgtcgtcttacccggaatcgcagcattacggacgctaccctccctccgaatatgccttggtgccaggggatcgatcccaccagtctctctctagcccgctccctcccccttctccctccaatccccctcctacgtcggcgcccaccggctcagtcaatgtctatgggcccgtgaacgtctttatgggcggcgcagggcatggggggtcggcgggcgccaagcgagagcgagacccaccaagaccaccgtcatccttccagcagcaacgacaacaccagcaccagcctccaccacccccgtcgccaccacccgcacccccagacggaaacggtcgtacatactgactgtcgatcatgagacactgagtgtcgatcatggcatgggtagatggggaagcga

SEQ ID NO: 1126 - DNA, 703 bp, Nannochloropsis_gaditana
tcctatcaccaaaatttcaaccaaggaaagccttctctgtccggagtagaggaggtcgaggatattggcacaaaatagtgaggagaggataaaagggtgttgggtgatggtggctacaggacatcataagtttaatctaaagcggactcatcaagattggttgaaattgtgatcgaaaagtgattcagaggtgaagcatgttggggttgtggataaaaggcataaaatctcaattctctgacgcaattgcttccactttgggattgcaactcttgtctttatcagtgtcctgtccgttttaagggccaaaaattcattgtgtttattatgttgagaggaaaacccagtgctttgtgggcaacatctataatttttttccgacctgaatcatgcatgaccgtagcgtctccaaccgtcgctcagccgtttctcttacgaaacgtttcttccacgacatgtcctgatggttgtgcggtcctttatgtacgcttatcaatcatcccacaggctgatataaatatttaaagttgatccgcaggtagttatttcgatccacagttgtccgtgcttcggattcaacccccgtcaagtatggcgtgaggcgcggtattctttcccttctttctagcatgaataaatacatacaaacatattgatacccatatcgttgacatgccaaccagacagcaattttgagtgtatg

SEQ ID NO: 1127 - DNA, 703 bp, Nannochloropsis_gaditana
gcagtaccttgccctcccgccgtctcgttgcaacttccccgtcaaacgccatccccttccaaagttgcgtggccccagctgtaacaatgagcaaatgttttagaaaattttagaagaaatttagaaaattgagagtttcacagtcacggctacaaaccgcacttgcttgctagtcaacctaggcaaggaaagcatgtttacagaaaatttgcaggcatcaattcacggaaccaagcgtattttgttaaaatagccaacaaacattaggatatctcatattcactgcattttacggtttctatagcatatacagttaaacaatacatcgcatttcgcttaccaggggtacgggaccatctagaagcatgtttgagtgggatgcaaattacacatgagggatttaaaaaaagtactcgacagctgaatgcgtagagctatcgtcgtacattgacaagatgcgtcgcccagctctctccgcatcagggctggcagagcgagttgataccctcttttcttctggaaagcagagagaggggaggaggttaagccggcctcggtcggtgtttttccttcccgcccagaaacgtttacgaaagccacaacgttcgtcacccgcaggccagacccggtaagatgccaagggctaggctcttgttttgctcacgacactgctccacattctatctctagcgtagtgatcatg

SEQ ID NO: 1128 - DNA, 703 bp, Nannochloropsis_gaditana
cccaaacccaagcatttgggctgctgcaaggtccaaatgcgcacagtaccgtccattgacgcgctcaaaaagcggtcatctgtatacgacatggcgagtcccgtcacgcgcgcttcatgcccggagaaaaaccggaggtactggttgtcgtacagcgacaaatatcggatgtcatgtgccgaggaccccgtgggggccgccgcttggttagtggattgccggctgctgcatattatgccctggggatggtgtgtgaagcgggccagctccacgccgtactttttacaaaaaacttttttccgttccttaccctccagggcattgattaatcgcacactatcgtcgtccgatgttgctaccaaatactccccctctcgatggtaatctaggcagctcacaggcgctgcgcccgctacaacgcagcctcgttccagttcccgcacacgcactgcttccagtgcaccgccactccgggccccgctcatgaaagaaggcaacagcaaggatctggatgtggtgtagatgatgacattgtgtgcggtggaatcgtcaggtacacatagtttccatgatggcatgaaaatctcatggaaggaatgagtgtggcagctcctgtgccgcctgcctagtgggaggtggaaaaaagcgattggactatcgaccacgaatatttctttttacgagctttattcctgtctcgcag

SEQ ID NO: 1129 - DNA, 703 bp, Nannochloropsis_gaditana
aattgttcctccttatgcgcatctagcatagagcactgttgctctttgacctcttttggtcatttgtagcaatgcatccgaattagagctccttgacatattttccgaactagcttctcttatttcccaagtccggcacctatacgactccatccgccttgtgatctcctccaatgaaagacataggcattgtctccaacggtgcaagccctgaatgaaagaaagatcagccaaaggtgtgactttgagggtctaaacacataatttcgaggattcccaaggtcatttacctacgaaatgggccacctccgagtcctccgtcgtgcgtgcgtcccgtggcgacgctcgcttcttttcgcgccccaacctctgggaggtactagtgccccacgacacgtacttcctatcattcagaccaacaaattccaagcatgaatatcttttttgtggcaatgttccacatatgatcgcttcatcttattctccgtcgtcacgcccgtccaggttagcacccgccccacgcatcgttcgagatgacaaggatactgcttgcattctcaaactggtcgccgggctacctgctgttgcttgcatgggcgctgttggccttacatcaaaaccatgcctttgtcagcagaatcccaagggaagtgggtgacatgcggactcgttcaagtgtgtctcgcagaagaaaggaaacatg

SEQ ID NO: 1130 - DNA, 703 bp, Nannochloropsis_gaditana
tgtcagactgacccacaatatctgcattcttttttgatctatgtgacttcatgaatatcacagtctctcttaccagtggggtgctgcgtgcggtggcgttatatcgaatctgccgagggaaacttatgaatgtagatgacaaagaaggtttcttataaggtcctagcgttttgaaatgccagctttaaatttttatttatcttcatgtatgatacagccagctgtagcatcagcgtaccacaggagcgaatgaatggattgtaaaatgctaccattcgcctagtcaagcgggcgtaacggcttctaagcatgcgatcttccccgtcattcgcgcgttttcgcctggcaatcgtcctcgctaaaaagacctcaaggggaatggaagggataaagaggggaaaaggcgattatggcaaacatgccaagggcaatatatatgaaaaggcagtcccaaaaaagcttcaacggtgacccaggcaatggatgtcgtgtgtcacgtctcattcggtaaggcttgctgagtgtccgcaactcagcaagccttgttgtcattctggcggcgagagctacttcaccaaaaaaaagctgccgctcaaccaatagcccgaacaaagcttgcctaattcgtgcacacataatgtcatagattatgatgatactctggacgctccccgtttatactttggtggcagtcatagcaata

SEQ ID NO: 1131 - DNA, 703 bp, Nannochloropsis_gaditana
aaacggtggcgagctcaacgcctctcttctcttcacctaaatccattacgtctgagtcatacctgaggtgaagggcaggagcaaagctgcgacagtcgccagacgttgcaccatacctaaaaacgtctgagaaaagaaaaacatgggtggtgattcttaggttaggaaggagaaaactatgtcgaagcgcaggacggcttttccctctgtgcggggggtctgactacgatctgcgtgcctgcgacgccagtcgagccgtgaggcaccgaaagtcgcttctcgatgtaataaaccgcttcaagttgtattttgctttgtaattaatctgcctctgtgcccggcaaggcctcggcacctttgtccgtggttaaaatggacgcagcccaagcgcgtgatggagcagacggcacgcgagcctggatctatcttccaatcgccgactcccccctgcctggcatgttagatgcacacgcgtggcgtcccggggctccccaccggtgcaagacatggcatggaagacaacattttacgatgggtatgcacatgccagcacgagtgggaggttggcgggaatgtatttgtgcccttccccctgacttcaaggactcctcaactcccccggcaggaagtagcgcctatcgagttgcaacgagcgacgcgaaagccgaacaagacaaaatcaggacccggtgtgccgtgaatg

SEQ ID NO: 1132 - DNA, 703 bp, Nannochloropsis_gaditana
cgatggtgacgctacagcggtcgatgagggcgtcgttttcttttcgctcgatgatgaacttgacggtaaggtcagcgaagaatccatttgtttaaagctcattggtggagtataggtagcgaggagacgtgagagcttatcaagccgtctggcaactcgatgttgctttgcgtctctgcgcaaagccccttcatttaccagtgcttcgtacacttcaattaaaggtcgatttgcaataccagcactcgctacttcgttctgtgagtgtatcgtatgcagaaggcgtgggcgtgatgcaaagcatgaattcgtgccacaaattgaggaggcgaggccctacctgaagtcctggacgaagggagtttgcgtggcaagtagaagcaaggcctagagcccgcgtggaggctaaaaaaggacgacgttgccgtgcagccaaaagtaggacaggacggccgagcatccgtatactgtgcagtaaatacgataattcttcatagaacaagtacacgtcattgtcaagtgctgtgacctcgctctgagctgaggcagcgagggggctggcttgcacgatctcagtctttgttcacaaccagaacttctacggaaaggcgcgtcacacaaacagaccttgaaccttaatatgtgattccctgatagtactaaacagctagacatgccttctcacctagttcgtgtcgtcatg

SEQ ID NO: 1133 - DNA, 703 bp, Nannochloropsis_gaditana
cagaatcatagaaccgtaagcatcatttcctactttggtcagtatttcggtgcgaacgcccaagcgacagagtccagtaagagtatttccggcgttgcccccgccttggatcttgaaatcgctcgttcggatcttagcatccgctgctggataggtttccacataagccagcaggtcaacaccggtgatgcccatgcccaagactttaggaggctttactgacattttgatagtggatgtccgcaatggcgggtgtaggtgcttgaagatggagaattgaggcgctaaattgaagcttactgttggggagcaacacgggccgagcaatagtaagtacgacaaatatgccgggagagaccgacgcatgtgatggtggaataagcgaaggaggtagacgcaggaaatgaggccagaactgtgataattatagtaaatagtcacgttaatcatagtgtggaggtcaaaagggcgactcaggaggtcagagaggcaggacgatcggcctgtcggctctctccgtaacggttcgaatgggccgtgaaatggaaaatcatacaacaaattgtaggagtaaacaatccattcgatggagcttatggaactgacctgtgaaacaacaactaggctaatggctaacgccacttttgtggccgaactggaggatgtattacctgttcaaggtcggaagcagccgcactccatg

SEQ ID NO: 1134 - DNA, 703 bp, Nannochloropsis_gaditana
attttccgcacttatttacacctgcttgccagcatgcaaccttcaagtttagagggcagacacgcgctcgaagtttgtccggtcttgcaagtcgttaaagtggcctccgcccaggaactccggtcggccgacataggaaaagatagggcagttcccggcctaaccgacgagtcacgtcgactccagcctcaccaagggctgcgggttcctgcaggtgtcaccggatctcccgataaagactacatggaggacttagacatgtccgcgcctgcatcccaattgtttggtaaagtcgaatgtatgaaacgctacattcgaataatgcgtgtcgcgtttatagcttcgttgtggtgggccccacatgggacgctataacagcccgttgcatggtgccggaaaaccccaataagagatagcctgaataaagtcgtgtgcccgttcttgatgtggcacgcatactccgctcactttgagaaagaacatgtggtgaaaattgacaaggcctgcaaagccagactgcagtagccacgagagcatggatgcgtctgagccgaggagcgggcgataggctttgattcttctcgtgccaccgccgtgtagctggcgtcacgaacagaaacatcacacaccaaaccatgctccaaagtgtgccacatcacgcgcctaatcttttctcgtgcctctccttgcctacagtagcatg

SEQ ID NO: 1135 - DNA, 703 bp, Nannochloropsis_gaditana
ggaaagtgttcaagaacgtgacagcattattcgatcgaaagcatgacgaggacacacgatggtcacctagccggtgatcaaacgacacacgccggtcgtggaggaggcaggaggttggactacctgttgccaaccttgcgccctgctatgcgattgttgagccacgggcatgatcgatgggggtattcatgaccgcttatactttgcttgaatgcccaggcgttgaagacggaaaagatgacggacaaccaccaatgatggtgaatggcattacgatctctttgtcttatcgcccatgttgagcgctgctgatgttcaatacgttgcatatatcgtacctcaatacccaaggcgttcatatttaaaaacacagggcatgcgggatagaacaatcttctctttggtcccgtgtcttttttcatctgctaccgccgcagttgctgttatttctgctgcctccgctgtttctgcctgtggaagctccgtggcccttttccacaacaaagcgtcaccacggcagtctttcgtgtattacagtcctttgccgaccaaaagtacctttgccacgacgttgaaagcagaaagaagaatgaaagcaagctctagtgtccctcagccgactttaaagaccaagcttttgaccttgctcttcgtgaggcgggcaaacccaacaacgaatgtcaaagaagtactcctcggaatg

SEQ ID NO: 1136 - DNA, 703 bp, Nannochloropsis_gaditana
ccgcaagctcgcgggacggcagttcttgctcgcttaatccctcgtcctccgtatcaatgtttacttcctcttcttcttcaacctcgatatcgtcctccgaggacagtagccgtcgcgggggcctcaaacttcgcattgttcttcaagctgatcgctttgacaagaccccggctcggtcatcaaatgaccaatatcatagcgctaccgactagtgcctctccaaagcgcatccatcagcattcttggtgccctaacccggaactcctgtgcgggtacgtgcgtatagggcctggttgagctatttcacgggcttggcgaacacgccctccttgagcgatgacgttcatgacgccactcccctgcccaagcccgttgacatgcactggcctctttgtcagactgcgtactcattgcgtgtatccccacttttaacatacacatgcacaggagagcttgccaaaagagtaagaaagaccgttgaacggtaccgtggatcatgtattatggtggtatggccatactatttttgttccttctcccactggtttccgccttcagccctcccctcagcacggcaagacctcgaatcagcacgatcacgaaggcggtagctttacccgcttcggatcagtccactttgaacaaaagccccattgttatcttcccggcacaatttggcgtcgcaaaagattacgaggaaatg

SEQ ID NO: 1137 - DNA, 703 bp, Nannochloropsis_gaditana
tcctatctcccctgcagctgaacgaataaatgtaattgtacgtatattgcatgattactcatcggttatagccaaagcaagacctcgatgacgaccgttttcacgcatggaagcaggagaaaattcatgcttaaagaatggatgagactaatacttttaccttgcttatttattggtgtagcgttcaacacatattcacgactgcaagaggtcccaaaggcagttcatcggattaaaagtcacctatctcaacatctcgaggaaagctttaaccgccgttactcttgatagaccctgtggctcacgggcacaaggaatgggcatgtggtgggtgggggatagtcgaatatttcataaatgcggcttcgctaaatctgaatatgtctctaatacggccaggaaaagccactgaagggatccaatcagtaaaaatatctcaaagaagtgaataagaccaacaaggacccgattgctcttcgctatcctcttcgccgatgcccagcgttttctttgcttcaatctcatctgaccgttcatgccaacgatcaactcaaattcctgtcaagattcggggtggccgccgggcacatctttgactgccaattcacgtgtgggtcaaaagatcccggtatagagaccaaatagcttcctgcacgcgcatggatggtcacgcttatgtttctccttgcgtttattgttgaaa

SEQ ID NO: 1138 - DNA, 703 bp, Nannochloropsis_gaditana
gaaagaaagaaaaaaaaatgattggtaagctcctagattgtgtgtgttgcattttctttcgtatcatatttccattatttttgtgcacgagtcatgggacgcaaaaattttccgcgtacattttgactgctgtggatgacatactggaagtctgtctgtcttagtaaactcttttgaaacgacctatcataggttccccgatggacaacagacagcggatctagcctagaattgtttccttccgtttcaatccccccaggcgtccatgattgagttccagtcgtgctgtctgaaaagaccttcctgaagatattgtccattaattacgctatcatccttctaaatctctagcatttgcttatctgtgcactgtcactgtcttgcagcggtcatcccttctatatatagaatagaatcgtcttgcctgaggtaaatcatcaggtccactgttgcctgtatccatcaattcagggattcactcgccgtaagtggggtttgcgagtcgggtggccccattccgtgctctgtttccccgaaccacgaacaatcgccgaagaacggcctcgggttttcggcgtttccctccagtcgtcgtgtgccgcaactcactcacgctcctgtcgggatgtgcgctttacacccatgcacacatccagcacaggcaatgaatggctcgacgcaggatgtactgttgcttcccaaa

SEQ ID NO: 1139 - DNA, 703 bp, Nannochloropsis_gaditana
gccggaggaaggctttcgtgcgcaccaccagcaacagcaatgaaattgacgatacctgtactaatgagcgcataatcatttgcccagtcttcgtgatatgattttttcgaagtccgtgaacagaaggatgagaataaatagggctagatttgttgaagactgctatgacccacaccgggttggacacaaatttaccaaataggagagccccgacccgatttttattttcgacggggggcttgctttctttctatcgaaaaatattcgtctagtacgaatacagcttgatctcacattttctgcatgcgtcttgttatattgttgttgttgacatgtttttctttgctttaatgaactactgccatagacctggccgaaaatcgcccgtcacgcttctgatactaaaggcgacgtggcccatgtttttctttcccatttttttcttcttcatttttcttacattcaatacagcctcgaatagactatggttgtgatcgaagaactttccacgcaattgtcctctcaattcctgtccgcgtcgtctccgcagtcatcgtccaaaaagccacgtgccaaattgggacacgagtcacatagcgccagcagcaaatccggaggaacggtccaggccacaatcggtactagcttaccgatacaagagcaggatacccctgtcacaatctccgctcttctatcagttcgt

SEQ ID NO: 1140 - DNA, 703 bp, Nannochloropsis_gaditana
gccagcaagcaagacacagagaaatgaaagataacatgcagaaatagtatgcaaatatagaagccaaatttacctcaattcctcaggaaactcagcctatcgagcgggcgctatgcagcacaagtactactttgttcaagagcgggctaagggcgaaaagacgagtcttggcacttcaccgcccccttcccttcctcgtccacggtccctgtctgtgtgcgatactccgccctggaggttcatggtcatgtgagcagactgccaggcgacggtcgcgatgctcgcacacaaaagttgctacaccggacgagcggatgcccctcgcgggatctcgccccggccctcgtagccgccgaggccaggaagcttccctgcgcccgatgtaatgaccagaaatggggtccgacctcacggagacgcggcctcggacacgtcatgtgcacattcgatggcctttcatgacaccctttgggacccgcggcgagcggcagtgcctctcttggggtatattcaccgcctttgcgcaccttgaacgtgcgtgcgcgagactttccctcacactgcaaccttctccgaatgtatgtctaaaaccttgtgtcgttcgaacaaatgtcctgacccgcttccgtgccacaaaatcccgccgtcggtgcacagtgagaagacctaggctcaagaggcggggttcaagttgtcgtaaatg

SEQ ID NO: 1141 - DNA, 703 bp, Nannochloropsis_gaditana
tcgcgtttttggtctctgtcgagaaagcataacaggaagacgagcctccccttctgctagacgccttctatcccctcactgccttggccaagacagaaaatgaaacctgtcatttgcgccgcgactcataaccccctctgacaaacacagaaaggtgacataagcctacattttctactacgagtgatttgcggctgccttcgtgggcgtgattggagtttactcttacccagaatctcacgtgcccgctgctttgcccctacttcacggtcccacagcccgggctttcccacggagagaatcatctcatagtcagccaaagtgattctaaagaattgctgtgaacgaggaggctacacgccacgctgcgtgggtcgttttccggcccctgtatttccctggtcctgctgtgacaatttacaagtacgacatgatcgacgggaaaggctacatcggggtaccttctgcactgtcttttaatccctaatttacgcgtatcgcgcacatcctttcgtacctatctacaggatagatttgaagaggaacgtcaccttgcacgcggacttggtatccttgattgtgtctactaagatcccggcggccgagcccgcctaggccgccccccctcccatcgccggcatcaacattgctcctcattcgcgctaagggcttttaaatccctccccatcgccattttcacatg

SEQ ID NO: 1142 - DNA, 703 bp, Nannochloropsis_gaditana
tgatagagtccatggggatgaaatgaccaatcgagggctctatgcggtttaagtgtcatttttgggggttaggtggtgcacaggaggagcgtcaaccggtcagcgagaaatttgattgctgctgtccactcccgttaggaacccgcgaagcactttatcaacgacctcctgcctcttctttcatcttattcggatataaaacgcttacagacatgacgggagttcaaggcgtattctagaagtggggaaagcattggacatggacctcttggcgttgctgcccccttttccgaagcctgggaagcaccacgtactgcttgttgtggtttcagcagttgctgcctctgcgacgactgcagctatcttgcttgtattttcccagcgtcgatcgaaatttaaacgtaccttggggaataaatgtggcaatcgggaaagtggttatgcggcattgatcggtaacacgccgctcatcgaattgactagtctatcgcgcgcgacggaatgccgtgtcttggcaaaggtggaatatctgaatcccggtggtaccagcaaagaccgcgtggcactgcgaatgattcaggaggcagaaaaggcctgtttattacatcctggtagtacggtgatagaagggacctcaggaagtacgggtattgctttagcctccttgtgccgtgcccgagggtatcgatgcttgatagtcatg

SEQ ID NO: 1143 - DNA, 703 bp, Nannochloropsis_gaditana
aacgaaaaaaaaaaagggtgaaggactttgcctgtgtcggtgtctctgtgcacacttcgaccgcgcctcgaaatgttgacaccgccgtgcacgcacggcgtgaggtgataacgatgggggtgacatgaaggcggacggaagggacgcggagccgcaccatgtgcacgatcttggtcaggttcaacgcatacgctgggcggactgtgtggtcagggaaaagagaacaccgtctgcgccctaattggacacgcagccgggaccgtgtgctccagcactagcacgcctgcatgtgttgaccgacttccgtggtacatgcgggttgcgcacgcttcatttcgaaatccttgccacgaaaaaaagctcgtggacgcggacaaaatgaaacgacaaggagggttggggcggaagcgccggatgggcaatgatccaaacacctcctgtagtgatggcgcgtgacgcaaactgcttggaaattttaaccttttcctgctgcgaggcacttatcacagtttgtttgttcctgacagagactcacaacagccaggctgcagatacatgcttgttgcctgctaattttcagtctccggagtcaacggaagcttcgctcccttgttcttctcagcttgggccggccgtcgtgttcttcgatctgccccgtctgtgaaccatcgcaccaccagaaggtatcgtcatcgtatcaatg

SEQ ID NO: 1144 - DNA, 703 bp, Nannochloropsis_gaditana
gatggaggtgcctggtcctgtccatttatcgagtaaggccttgattttgagaacctcgtccgcgtcgtggatcaacttatcgggacatgccgagggcttccgcttcgattccgcctccaattttatctttttagaagacagagactcaacaagagaagaacccaaggccttgtctcgcgaacgccgtggcatgtagccgtcgactgcacccgtgaccttgctgtcttcctccgtctcctccttcttcacaacccctactttcttgccttcttcccctgaggcattgggcgtcgtttttccgccaacgaagtatttctctttttccacagcagtctctactttcaagtgtgtcgctgatttctcagtgtggacgcttcttgtcgaatttcccttgagtgccggctgcccttcagtcgcagcgtcagcaagaggcggcccccctctttcatttcttaagcggatgcttcgcttcgtcttccgaccaggctctagctctgtggtattcaatcctgccattttccaacgcctcgattgatgtcctgacgtgggtaaaattttatatcgatcaaaaccagtgttggcataagaaacgaggaatttgtggcggcgataaccaaactaccggaaggcgagcgagcggcagagcgcctggcgcaggatacgaacctaaaaaaatgccactcacgtattgtaacaccctaaa

SEQ ID NO: 1145 - DNA, 703 bp, Nannochloropsis_gaditana
ggaactgagacttctccaaggggaatgtcgatcgatatgttcacgatcgatgaccctgctcataaatcgtttcgacaaaagttacggacctgcatgttatcagcatagatctgcaaagcctttaacattcttcaaggtaaccatagatagtctgggtttcgtagtgtcagtcggcagtccttagactttcccacagcccgtcaagttgcatcgggcaccacggagagagaaaaagcaagaaaagatggccgggagaatcaacctaacaacgattaaaagtcctcaaatcacatctcttggctagtgtttgagcacttcgcattgagaatgtctcgtccaggatttagcacgctctcatctttagctaaagcaacttcttataacctcctgctatcgctttttgaacaaatgatgattgcatatcaggcaactgcatgcgtgcattaaagcacattcataggatagttatccttcctacctttatcttcctaattattcttaaatctttactctcgcgtccgtactctgtcttgccgctcaggtgggcatatgccaatacctgattatacccgtattagctcactttcctcgtgcctcttgcttcgggtcatgtactcgtactcctgtttctcctaccgaagtaccagatgtggttcaccgacatcacactttaaaaacttcaatttctttctccgccttgatc

SEQ ID NO: 1146 - DNA, 703 bp, Nannochloropsis_gaditana
ttcccttcagaaagaacggaatgactacaggcgatgagctcattgcttttcatgtatggggattatggccttccaatgctgcttgaggaaaaatatgtcgctctcaccaagtacctgataagtgtaatcaaagttaaatcttaaaaaagaagaaacgcgaggaatgacatttaacgacttttactacgtgaacgtgatccgtcatccaattcgtagaaccatgcccagcgtgttcatagtaaacaatggcccgcggccgggcaggaaacaggagtgtacccgaacgggagcgagggctggcgaggtcgaggccgtggccatggctttgggcatcgcagcgggccccgcactcgaccatggcggaccattttcagagtgagacgcgcgagaagtatgggagagaccgtgtggatgaggccattgagatgcacgtggcttgttggcctttagaggacggtgcatctccttgttcatgaaggaggaggtcggtactgcgcgctgcactagtctgccccgcgtgggcagacaatgccgggattgctgaagcactagagcaatttcgcatgagtggtcaataataagtacttcaagtacttgtgatatgcggtagcgcgtttcagggctttcatactgggcgaacagggtcaaacttcttgtcacgtactagccatctcatccaactttccctttatttgcacccaca

SEQ ID NO: 1147 - DNA, 703 bp, Nannochloropsis_gaditana
caaatcatttcgttctcatggctttttgtttttgtttttttcctattttaaaaaaaagtttttcggaggtaattaggaaatatcgttgatcgaaaatgtctcttctacgcctttcactctatcctccgacgttttagtaatactagatgacactaatcttacaaaagagatacggggggctttaaagcgtcataagctgcgcgatgctttctgagacactacgatgaaatggagcgcatttcctcttccagagactgactgttcttacttgatacgaaggccacctcaaaaatctatgcctggtgtcgagtcattgaaatcaaaaagacacgcaccgggtggtggaaagtcgacaatacgaccagacgagtagtaaacgtaggccagaccaagtcatttaacctccccccttccacggccgtcgaccgcacagactcggaagttgagcgctcaagtctcgacacaggacgccgaagggttcagtttcgcaacgacaggtccatttcgacaacaacaattgtttgttggattcttatcttgttaatagggtgccgtgagatacgagagcttgatggtcaggtttccattttgagggctgacttcttgctttgtggcgtcttgacttctccctcatgccttcccctctactgcatccgcctttgttataaccacgactaactcatacctatctgatcaccataat

SEQ ID NO: 1148 - DNA, 703 bp, Nannochloropsis_gaditana
agtgtctccaagctcgaccatgttgacaaaagaggagcggaaaatttagcgttggaaattgggatggccatgtatggggatgtcgatgtacaatttacaatatgcagcccttccatccctccactcgcttgatgacaagcaatcgaatcgttgtgaagtgattcggaacggaagatcagccgattaaagcaagcttacaaacccttatacccttcaccagcattgtacgcactaggcttgtaagtccaagcgtacctggcctcgtgctgacgatgagcagacatcgaatgagcacgtcgagtacgcctgacctggacttcaacgagatggttcttcgcgtatctttcctgcgtctgggcctgttccatttcgatcgatccgcccactttgggcaggtggggtctcttccgtggtctgcgggggggaacagttgcgaatgagcgatcattaccggagaaaccttataatgactacacgcatcgaccaaagttgagcatatgagtggaagtttacgccccaagaagcaccgcgctcgcccggtcgcggtagcaggccctctcagtcgtacattaggacgccctcgctgaaatttgccccttctcgcttgctccccccccggctgtgtctattatctctacctacctcgacatcgtatgtgatggatcaacagcttctggtttgatcttattcactatatatgcag

SEQ ID NO: 1149 - DNA, 703 bp, Nannochloropsis_gaditana
cgaagagtggctttgtacggaattgcatgatgtggtgggttacagcgacaaaacgctcagccaatttattctctccctggctaagcgggccccttctgcggctgctctacacgtccagctgataggcagcggaattgaggagggtccgaggacccgtcctttcgccgaggcgcttttccaacgtatgaggtctcaaggtggaaaggttggcaagggggtggctcgaaatgccgggggtgtgggaggtagagctgcggcatctgtaggagagaggcggcttaccaacgccgagctcatccgccagagccagcgatactccctggttgaaagtgacgacgaggactataagcgagcgatcagtggcactggtgatggtaatgggactaacggagggaagcgaaggaaggaggagaagaaggagaaacgggaaaagaaggagaggcaggcgcgcaagaagacagctgagatcgaggaagacgaggaggaggacatctcactggtgcgaaagcgcgtgcgcgaggtcacttctggcgcggttatggacgcaaaagaaaagggcgaagacgaaagaaaacaagaagagttggatgaagacatccgggaacgagacgcgttcgtccagcgtatgctcgagaaagaggacatgaagacgcaacagaaagcatcggggggaggcctgtcggcagagcagatcaaggaactt

SEQ ID NO: 1150 - DNA, 703 bp, Nannochloropsis_gaditana
cctcgtactcggtggtcatcatcgacgaggcccacgagcggacgctccacaccgacgtcctcctaggcctctgcaaagacattgctcgcttccgagaggacctgcgcctgatcatctcctcggccacgctcaacgcggagcgattctcgaactattttgacggggctgccatcttcacggtcccaggccgcatcttcagcgttgatgtgtactacaccaaggcgcccgaggccgactatctggatgcagctgtggtttctgtactgcacatccacatctctcagcccgtccctggggacatactggttttcctgacagggcaggaggagatcgagacggcggcagaagaactcaccaagcgcactaaaggtctgggctcgcgcatcaaggagctaataatttgtcccatctatgcgacgctgccttcagagcagcaggcaaaaattttcgagaaggcccctccgaacgcccgtaaggttgtcctggccacaaacatcgccgagacctctttgacaatcgacggaatctgtttcgtggtggacactggtttttgcaaacaaaaatcttacaacccgcggtcggggatggaatctctcatcgtcacgcccgtgtcaagagcggcagccgagcaacgcaagggcagggcgggcaggacgcagaacggcaagtgcttccggcttttcaccatgtgggccttccagaa

SEQ ID NO: 1151 - DNA, 703 bp, Nannochloropsis_gaditana
gcctgtttgcaagttgccaatttagtacatggaagttagaaggcatgatcattgtaagcgtggattcaggcatcgaaggcgtgccagcgcgaccatgcgcacccgcaggaagcacattcgtatgcacaggtgcagcagaaattggtgagggggcctaagcccaccttgaagggtgaacgaggaggcggattcctccccgcaagattactggacgagggcaggcccggcctacctcttgtcgcaaacactataaccagcatagcgagttgtcgacgcagtaagtgccggcatcggcacgcggggatacgctcgcggttctccgcatggctggcagggtggcaagaaaaggcagcatggggtgtgggcgagagcctgtctccggtgctagcaggcgacaggaacaccgtgacggtcgcagacatacgacggaaagcctacgaaaacttaccaccctgctatgtacagcaagttttacacaaatcacacgcgcatgcctgaaaatgtgtgctgggcgcctgttttgccaccgactcgggatgtgtcttgcgagctcagggcagacgttccccccctctcgttgcactcttctatgcgggatgctcgcgcctgctcacgagcactattacccattcttccagtgcactcccttactggtacgtgctggcgccgactcactcacggtaatccatgcttcattttccga

SEQ ID NO: 1152 - DNA, 703 bp, Nannochloropsis_gaditana
cagcccgtcagatatctgaatcctctcgctgcctctcgccccgtgggctgcaagcgcacgctgccggcaaggtggacgacacgcctacctgagcgagggttccaaaaaggcaagccgtcaatacatcacttgcgtgcgtctttgcgatcgtttgacactggtggttctgttcgtacatgaccatttatttgctgctgacccacgtgctgctggttggctggcgggcggtgtgcccttctccgtctggcaacgcccgccggccccccctagtcatcatgcatcttctcgacccgcgtgctttacgcctaggatggacgtcattgtcccatgtacctgccgcctctcaaaaaacagtgtctgtacttttcgatttattcgttcttgggcgtgatgtatggtcgtaagtcacggtacgaagacgacaagtgtaaggggacgcacgaggacgagcaaagctttggcttggccccctctccttgtctcttaattagttgcgtccttgcacaacaaccaacacaaactcgtgtagttgacacactattgaataagagttggaagaggatggtgcgatttcaggattttggcatctagtagacctacaagcgacatgctcttcaatgcatttgggagtggcagagtgctcaagacaagctgtcttccagaaatccataccacaccctcacttacgtgccccctacttgaa

SEQ ID NO: 1153 - DNA, 703 bp, Nannochloropsis_gaditana
ctgtacgctttaagtatatggctcgcatcgaataaacttaccagtgagtacatgtccaaattgacctggagggctggacagcagcatttgctcggctatgtgctgcctgtggtctgcgtactgagaagagggctcttcctccatggcgtcatgcctgccttctacgttcagtggaggggtcgaataggacatttctctcttcgcgtcctttgtttttcgtcttctcttatattttttctttaaaatttgcccagcgctgattcgcttgcaccaactgccggggaaaaggggggggcgctcttccgaacgtgggccaagtttaagtgggggaggcttagcttgtcgattgtggagtcaggcatggcaagcatcaatgaacgttcaaacgcgagaagtggttacaaacaaaatggaagggaacggaggtatactcaaaaacaagcgattgtcttgggtgtcgttgttcccccgtgcatgctgtcgccgacgtaacatcgctactcctgtccctcatgcgagtctgcgcttaggctgtcaggctcgttgcctacggacgtgtaacggagcgtgcattctgccatccatggcacgaagggaaggggaaacaaattgatgtcatacgaccaagctgtccagcgttgtggggggctgaaacttataccttacacaacatattacgtacgacccaacaccactcgataca

SEQ ID NO: 1154 - DNA, 703 bp, Nannochloropsis_gaditana
cctccatcgtcacggccatgcgtctatcaaaagggagagcaggcagtgattggatacgtgactgcccttgctacatttaccacctttttaccaccttacctggcgatcgctttagtgtaataagaacacttaggtgctccatgcaaagtactcgcaattctgcccatgaaaaaggcgtctgtcgcggtcagcaagaccagcaagagggataaaggtggagacgccctcatggctcctcgactgttcaaaggtacagaagggcgtgaaccaggctgagtccagacaccctaccatacgaaatcgtcgaagtcgatgacatggatggcgcaaagcagagagggtcgccccctggtggcagtagggactggaaagcttccaaagcgggatgtccgacccgggtgaccccgacgatcaggcagcgagctcaagggcaaggccacctgcaagatctagcgcgggcgtgtgctctttcccagcaggcggcgccgcgtgagcaccgaacgtagtttctcaagtactattttgactgttcctcgtgtgatggaggccatgaatgcggtgtggtccgagacgggcgttatcgtggtgtgctcaatctgccgcgcccatcttctcctcttccatgccatatgtcaagcaaagaccacgatgtaatccttagatttccggtgtatccatactcatcgacccacttcctttgcga

SEQ ID NO: 1155 - DNA, 703 bp, Nannochloropsis_gaditana
cggcaagctccagaaatttcgcttttttatccgaagagccaaggaatgtcctacgatttatgttgatgtagctaaaatgtaagagaatgcaaagtgcactgcgaataggaagcgcgaccttagagcttacccgcttcggaaatggcatgaagtattctgttacgccacccctcggggcatatgaagccacaaacgtatgatcggcaagttttcccaccgagtattgtatttctcccctaacaaaatatacatatttcaaagatgtattcaaagagtgtgataacgcccggagggccgcaagcactgcccgtcgcatggctcgccggtctcctccgctcactcgccatccgcttagccggcacgggcatgaccgagcaagatcgaggcggaaggatcgagagtgagggagtgcaaggaggatcgccataagaagggctcgccacagctgctagctaagcgcggtctggtatgtacctttccacttcaatgagcctggctgctgggagggggaggtaaccaaccccgtttttctcgaaaaatgaagcacgagttgccaatctttgtcaataccacgattcgcggttgtggcagctgctggcttgtgttttcgttcgggatgcccgcatttgtggacgcgctcagtccccaagcacccgtacctcacgatccttctcgaccacattcgcccgtgctcgttatgaca

SEQ ID NO: 1156 - DNA, 703 bp, Nannochloropsis_gaditana
ctcagacgatgccctcggtcctttagggaatattcgtctttatttgcaggctcttcttgatagtgaggtgtctgttcccgattttgtcagtgctcgaccctttgaggccttccaaggcgcccgtgccgctactcgtctcgtttctgacgccagcgccatgctagatgaaggcaatagtgtacgggaatcggaatcttgtgcaccattgaacgaggaagatgaagacggtgaagatgagatcgtgcttgcgccgggggtgagcagatagtacttgccattcttggagtcggacgtcgagtggggagcaggaggttaaaagaattgcttgatgctaaaatataactctgtacaacattgcgagctccatgaatgctacatggcagtcatacaaagaatagggtcaatcacgcgctcatgcattgcgcgaaggctttgatgcccatgtgccttaaatgaccggggaccgatgaaagcgccttcacggacatgggccgcctcctatctccttcgcttgcggcgtcttagcgagagcagtgcggcaggacacgtttatccatgcaatgccagccctgtcatggccattgagatcttcccgctttcttttatcccgttttgataatgggcttctacaattgttcacgactttgaacgtccgcagtttcttccgactcctctcactcttgaatgcatacgcttccagtgg

SEQ ID NO: 1157 - DNA, 703 bp, Nannochloropsis_gaditana
agcagcgcggaaacgtatgtggccagtttattgaagaacacttgtagcacgacacagaggatcccggacttcgcctcacggtgttcgcagggagaacatcgaatgtactgtcgacgaagtcacgtaagtcagagaaagaactagagcctcgacttcgacagcgatcggcgagacggcatgatcgaaaaagaaaagagctgccatcaggggcgtgtgtcaaggacaccaacggcagagaaaggtcacagcagggtgatattaaatttacctcgggcgaacgcagtcaagcatgaacgattcgtctgaagacagaggtcgagagcgaatatccgggagggtcctcgagccaagaggccgcctctgattggtccgttcgccccgttctctgggtggctctcctcgctcgccctcggcccatatcggcttcgtttcggcgagcacccggaaccgacgccatgaagcggggcggagtgaggctggccgagcgcttgcccgtgcacagcaggtgcgcatcaggacgcctgaacaggcgttgtcgatatgtcaacagtacccacacgaccaatgcacagtcgcttttgataggtgagacgggaatcaaatcattttgtaacctcctaccttttgctcatgatagtccacctgacgaggttctgcaggcatcaactgcaatagcatttcgaccattgcagcctttgaaacc

SEQ ID NO: 1158 - DNA, 703 bp, Nannochloropsis_gaditana
atttcgtcattgccgccgggcgacccatctcaaactttcgcttcttacggtatgagggccgctttccacccgtgtggcggcgcttgtggcgagagtcacgagaaatacccataactgtttgtcaagagggagcggagcaaatagctttggttagcagaagaattgatggttggttggatataaacaggaaggaggcatcagtcgaagcggggaggtgggaacgcgcacggtgcaacactacgctgggggaccaaaaatgagcattaacagaccgctgtggtatactacttcataacacattcatttcatagcatggttcatttgtacgcagttcgtggccatgcgaatatgacgcgtcgccttctctctccttctgcaatgctggcccgggtgtcgccgtctctcagccatccgccgccgtcacaaggcgtgccgaacatgaaggtcagcgcgacgcgcagaccaaggcccacacgccgagatgggcacgccaggcgacaacccggccgtgcgatggggtccgagaaagacaggccttgcagccgggggaaaagaggacgatcgagggccatcgaaggcgggcgaggcaagcggagggctcgacctgggcgaggatgagcggtccggcgccactcgcctctctccgacccggggaggatcgatgttatctatgccgacaattccccgctttcatgattttaca

SEQ ID NO: 1159 - DNA, 703 bp, Nannochloropsis_gaditana
cagtagtgtcgcgtgatatagtggcgacatatcgcaacttgaaggcccaggaggaaactatggcttcacgctggcaagctgccgacgcgctatcttgcggtatatgcgattcctccgtgggactgcttgtccggtgctgccaccacgaccctgactctgcggtgttcagatgctctttttccgcccatgcggcttgtgcgttcaacgcggcccaagcatcgctcctactgcacgatgtacagcggtcgccgctggtcactgtgtggtgctcagcacacagacctgaaccgtcagtggagcgaccgggcggggacgccgtggccaagtgtttgggtttcctgctgcctcccttagcctcacccctcgaccagcatgagcaggacgggcgtcagtatcagccttgccacacgccgctcctacggcaccttgttcacgagcggcgcaaggagggctacgggcgactggggggctatctagacgacaaactgagactcctggagagacgcatgtcgctggcaggggcgttacccgtcccgacccactcgacggatggccggttgatcctgtgcgcggccgggcgcgcggaggagatgtttgcctgcaggcagcggctgcccgccacacctgaggtgcgaaggtagagctgaagaagagcgtcagaggaagcctaggaaagaaaagacttgcgtttgcattcgacttc

SEQ ID NO: 1160 - DNA, 703 bp, Nannochloropsis_gaditana
cctcaaaatggaggaggacgacacatgcacactcgtacatggtcatgaatgacgttcggtcctcttttaaccatcggcaacatccgcatgtatgatatccatagaaatgaaagcgatgttcaggctgttgggtcatcgttttatgtgtctctggaaacccggtggacaactcgattgctcggactttccatgtgaggaaatccctctaccgaaattttaggagccttgagcatccgtccatacgggctggcctctttagatactttcgacgatcgtaggacaacaaatttcaatggtatatcttgatccatcttttcatccacggcaattaggcgcgaaacccggccccaggagggctttattcgcggcgaggaccctggcatgggaaggcgaaacttggaatgaggagcgtggcctgaagagagaaggcctggaaaccgtgtgatgcaacgtggtaaaacgcaccctctgtgattcctgagagtggaacgtcggtattcaccagcagtgctgagcgggaccagggtggggggtgtgggctagcgtcgagttttctcaacggagagggggcatggaagaaaatcatgaccatctactgcaggcgcccaaagctgcaattggctacgaagataacttggagggggatcgaggaggacgtgagggtcgtgttcaagcgcatgggggagggcttcggaccacgatg

SEQ ID NO: 1161 - DNA, 703 bp, Nannochloropsis_gaditana
cactcggtaggcattgctttaagcctgcgcagacgcaagaagccgcacttccgacgcagcatgaggccaaggcactggcagctgatgtacccatggagaaaacaattcccattatcccttcttttccgattgatctcctctctaagtgtgttggaagtattttatgagcttaagtgtgttggaagtattttatgagcccacgtcccggaagttcttctggcagcgattaaagggaacatcgcatgcccacaataaggctctcgctagaatttgaccccgtcacaccaaagtgaatggagtgagaaagaggtggccaagcaagcctttcgcagctgtggacacgggcacgacagggaggcggcacatcttttggaccccgaggcctgacgatgggcctcacttgcttcaagctgcgctccctcttgcccccgggcctctccctggccgtcggcttggaaacatggatgcatctgaaagtcgcaacaatgcgaaggctaggggattcaaaatacgttatcctttgctcgtcactgaaggatctcatcttggaaatgctttctacccaaaaataacaaaaccgacaaacagcaaggacgtaccatgagcctcggatcgtagcccgctgcactcagaggatgttgaaaaggagggcgatttccttgccatctacatttttgaataaaattatctcaatagatctatg

SEQ ID NO: 1162 - DNA, 703 bp, Nannochloropsis_gaditana
gcatgcagctgaaatctgtgagaactcgtgactgagagcgaaatgtaggagtcgcgacacaggatgcattgagtgacagcgtgcgtggaagaaacatcgctatagctcgccattaacaatgacgcgaatctaagatggaggtcttatgtaaggcttaaggataaattgtgatagccttcgcgcggatgtcattcaaaggaaagaagctcataaatatcgagggctagctaacgggtaaagaatttaatacacaagtaaatattcgcttcctcaaaaacttggtcccggaaagccaaaattaagttaccagctcatttaccgatcaagcaagtaaactgcgcttttatgtcgctgccagtgtagaaatggcccatacgttcctgctacagtcctggcaaaccgtgaggaagaccaccaccgcccgattactcaaatgccaccagcaaggcacatcaatgtcgaaatgtcctatgcaagcgtgcgcactatttatgagcggtagaggtgggcgatctatttcttcaaatatcacatcacttaaattgacctcagtttcccaccccaacttgttcctaagcgagccgcttgactcctcgaatgacgtcccgctattacgcgacactcgatctgtcactcccactcaaagcaccaccttcctcatacgtcacaggattggcaccacattatccgcgtctccgccatg

SEQ ID NO: 1163 - DNA, 703 bp, Nannochloropsis_gaditana
catcatagcccacggtcccccgccctccatccccctcccccctttcacgcatcgacccgcgcatgtgcacgcccacaggacatacgtcgttgttgggataacacttcagtcgaaagaggagggatcccaccccttttctggaccttctttgttgtcctacgtgcaaaaagagcgcagaggtacgtccgaccgttggctggaaggggtttcgacggaatcgctgcatgcctcccttcctcgagcttgtcctgtaatgcgcatgtgctttcagaagaccgaaagccaccgatcagcgtgtctctggtgagcgatatgactagcgcggagtgatcgcttcgcatgatagacggggttgtctcgtttcatgtctacagcgatcgctggacctgtttcagtcgtcttgaccgtctagggcaaactcaacatccattctgacacaagacacttatgccttgagctcccgcttttattttcaaaaccttgacatgggatgtttgtacttggctcaaaacttcaattcttgcacttaaccaggtttccgtcttaaaagcccggtcgacggcctctgaagtcgtcacgagcgaggaccagcgttgtttccctcgacgattcttaaaagtataaaattgaccaaaagtaatcagtactctcctgttgcagcttgaagagcttggcctagaaacagctttggcaggcatccatg

SEQ ID NO: 1164 - DNA, 703 bp, Nannochloropsis_gaditana
ggaagggtttgagcgacgtgtctgtcagaggaacagatttgtccttgataggtgcgggaaggcctgatttagtattggtttctacttcctcgttcatgatgagggtgcttgctggtaaagaccaagggttcaatcttatccgcgccgagccaagtgaaaaggcactgtggaagcgataccgaggaaatggcgatgtgaatgcgttgaccggtcggatctctagtaggataaataatggcagcaacaatcgcaaacggagcagcgtggaggcggagtatcgggacctggatttccaagtgtagttggtagctcgctttgggggagacgatgctgagaacgcagataagggaaacaatgaggaaggtgacggctgctgtgggtgtggcaaagggtctcctcctcttgacatctattgcgtgagtggtgaaagaggaaataagtgctcgcgtacgaaaaaagaggatggcgggcagtactgcagggcgccaggtgcagtatcttgagttgctctgcaggcgagaaggttgcctacgctctttccgagtacattgtccctatttgctcaccaactattaatatatcgatcaactaaataaaactcacacacagacaagtgctggagatacctctcctcataaattcccaaaattccaatcggggagagccgtccgctattgttgtttaacctccccaccctagaatg

SEQ ID NO: 1165 - DNA, 703 bp, Nannochloropsis_gaditana
acattgctacatgtttggacaacgaagcgatgctcagagaggccttggctgccgctttgcccagtgacggccagtgtgcccgtacctttcttccagtctctagtctgatgtctgaatgccaagagggctcgaaaaggcaggatagcttgttcctccgggtccaggttattgctttggatctggaaaagttgaggacagaggcctgggtgcacagtgtaccagacggaggcatgtagctgtaggagtacatacacaagtatcgatttaaagcatgaccacacgtaacataaaactgcgcagacaaatgaatcacacactgccctggtcggcaatgtagccaccgtgaccagcggaacgccaaacatcgcccggggtccgacctcccccggcccatttgccttgtgatgctttacgacccctcgattgctcccttgctctgtggcctccactctccctaccaggacctcgcgcagtctctggcttcgggacttgcagcgtcctgcgtggaaccctcaatgcctgctgatgccttggcaggttgcaatacgtgccttgtctcgctttttcctcaagctcctgcccgtctggtggtctacgaactgatgcctctcctctgtccaacctccattcactccctctcctaaacgcggccctttcttccttccagccgaagccgtacgggaaaagcacgtgaataagcatg

SEQ ID NO: 1166 - DNA, 703 bp, Nannochloropsis_gaditana
tatatctcattcccaagagagtgcattggcatggattacaaaatcttttggctcatagtttcattgtttttcagccttcaaggcaggttagactgaaaattacgtggtattctcccataaaatggctggatcagaaactaccaaattggactttcatgagtcttcttcttttgcgcctgaggcgacaacctccttaactcctatcaaaattcacgttactggggcaaatcatgacaatgagacgaaggataatgcttcttcgcagcatgcgaacacaatatcattacctacaatgcagcccaaagatgcaacaagacttcaattatttgaatggagcatagctgaatgcaaagtcaagctacgccggggcaggagtaagattatattaaaagatgttgttggatgtgcgagagccggggctttcagtgccattattggtccgagtggatgcgggaagactacgttgttggactgtctagctttgcgaaatcctgcctttcagggctctttaagcttagacgggcatgcattgtcaagcgactttttccttcaaacaggttacgtccaccaaaaagagctttttttttcgcatttgaccgcgcgggagcatctgtatttccatgctgtcacccgtctaagtggaaatctctcttccctcgaatgttcgtctcgtgtggagacagtacttcaagaagtagacatg

SEQ ID NO: 1167 - DNA, 703 bp, Nannochloropsis_gaditana
ccagttatgaccgaggaaaacctccttgacttactgtcgggtaaaacgctgccccctgccatctcgacctccatccccagaccgcaccggggtctggtcaacgccgggaacacctgcttccagaatctggtcctacaggcccttctcgccagcgaacccctccatcgcctcctcctcgtcctccgaccactcgtcctcgcgtcttcttcgccggcctccccctccctttccctcctggcccggcgctgccaagcactcgtgccgacgtggatggatatggcgaaggtcgccgtcgcccttgaggatccctctcttgtcgcggcctccactgcctctcccgcgctcgtcatgtacaaaaaaaaagacagcgccgtcgctgggaggaagtccggcaagaagcacctcgtcggcaccggctcctcctcctcctcctcatttcccccacttccttctcaccccagcggcgtggccaacgggttcaagctccgtggcccgctagaggcacggtcgccttcaccccgtgatttctacctggcacccttgcggccggacgactatttggaggaggctttccgggccttccgatcgtcagaggccggggaacaggaagatgctcaggagttcttggccttcctcttggaccggctgcacgaagaagccgtgggggcgggggcgggggggggggaagggaaaggggcgaagg

SEQ ID NO: 1168 - DNA, 703 bp, Nannochloropsis_gaditana
ggctggattgcggccgtcaattttcatcccttctccatcgagaaaggctttgatgcggaacatgagcgtacctttctcgccggtctgggacaagccgttctccttgagaaaacctttcaactctccaaccttcagcttctccagaccaccgcctttggctaagacattccagttcttgctcatgcctacaaaacacttcggctcgaattgattggcttcagtactcaatgcaaaaaagaaagcgcagcaccactacactgccacagcgggggcaggcttgctggatataaagcggtcatgaaattcgcaccaatgagtgtcccagcgacgaatctaaggggtttctagcgatgatgaattgtttatattgctggtacacagcgtagacctcagcctgcataacacccaaaagggacggaatacagcaatttcctcgcaaaccaacccggaacaagaaaggtaacgctcctccatggccagacacccctcgatatttgactgaggcctcgtgctcaagcaacatacctattcaagcgcgattttcaagctagagggcattataagggtggagaatgaactctttctggtgcttgcggtggtccggccacgcattcaatgatatgctgtcttaacccgtttagagcacctgcaaaactcgcgcatcacctcattcatccattcgacaaactaaccaggtgtcatg

SEQ ID NO: 1169 - DNA, 703 bp, Nannochloropsis_gaditana
ttctacttcttttttttcaatcgtgctctttccaaggaatacacctgcacttgaaagagcaagaaatggaaagatagggcgaaaaaggaccagtttctaccctgcaaatatataatgcatggtgattaccgtatttttaggtggaatgtcaaaaagtcatattatgacgtcacgctttattcgtttgaagatccgggtgaaggtgaagaatgttgtcatcttgctttatttgcgtttaaatccagcaaggaatacaaggaataggttatcatcttattatctattattttttcataccttagaaggagaagagatcttaggaaggttttttaagtgacagactctttgctgcggcacttgaaaagaatgttgaaagagcgaaccagatctttatcgctgactgtagcgcagccgtgtccccccattcccaaagcttattaccccaccgtcaacgcacaggcaaaccattagaagtacagccccttcgaaaatatgttgttgcggaatacatcgtttgcagtgaccctggtaccggtgataacggcatggatggcgggtctggctgagtcgttcattattccgtcgtgtgtcgtaacccgatcgtcaggtaagccagaagatgagatgacaacaagctaaagccctcctcctgacaaagtctccgcaatctaccttgcttttaaatcattaagccctaagtatg

SEQ ID NO: 1170 - DNA, 703 bp, Nannochloropsis_gaditana
atgcattgtgtacgcacaaaaagagctcacgtttcgtagtgtcataagcggtgcatagaaggataggatgtacatatgatttagcggtcaagttgaaaataagcacacggtcttctgaaagcgaggtgaaaaaagcaaaaaaagcaaaaaaagcagaaaaagcagaaaagctagaaaccgaattgaacaagtagcgaattttcctggtgaatctaggccttcatttctccttcttattactgcgtgcattttttatttgtcttttcttgtatacgagatagaagcataaaatgttcgtttaaaacattttagatggaaaaccttgaagtctcccgccagtactggcccatacaatgcatcaaaacgcatgttcacttaataattagtcgttgctcaaacaagtcttagctctccatggcatagcgtatactcatacgacctcgaaacttgttctgtttagtcacccatcatctctgtatgaacggagatgcaacatgtatatctatattttttctgagacaattccctctgcagctcttctgctctcctcttttgagggatgaccgacattcagggatgttcatgtgaaggaagtgtcgtcgcgtatgtggaagacaatcaacactgaagcactctcatccatagtaaacaattttcagcacagtatacaatatacagctcatttttcaacatcttcaccatg

SEQ ID NO: 1171 - DNA, 703 bp, Nannochloropsis_gaditana
ctaatgagtttgacgaacagctagacaggacacgaaaaccaaccctccccgacttgaaaatacaaatgatggtgaaagtattgacgcactttggaggcctcagctcttcgcgctgaacggcgcatggttatcgcgcggaacgtaagtatgcagagaggggtttcccttgaagtactgaagcagcagcgtagctaaactccttgacacaatttgatgtattcctggcaacaaggcggcagcgaccgcgtcgtctttttgttggggacgaaacctatctctgtgcgatcgtttcgtggaaaggagatgtggaaacattcaagtcgataatgcggcagagtgctatgctcgctttttgtgtggctgagtgggcggagggcgatacatgcgtcaaaaaggttgtcgtacactggcgtgggaggagagctgaatgtttacccgattgcttcatgcttggaaagcattcttctcgcgtggatgcctgacgacttttgcctcacggttggcatgcgttttgggggcttacaagcttgatcataccatacgctttactacctcccccccctcgtatctaagctctctcccatatactcgtggtattttttaacccgcaacgcaaaatacagggatacgtctccgttcctgcttttcagtttattttcgtgcgcaagtttgcagcttgctgcgttttcgcatcgatcgtatg

SEQ ID NO: 1172 - DNA, 703 bp, Nannochloropsis_gaditana
tggcaactccttcaaacaaaaggtcgtggctatatgacacgtttggtttcccagctagcagcagaagtgaaattctagcgtcatttcaatacttgatgctacagctgggacgcaaacttatacatttcaaatcaaaacgacgggggtataagaggaacgtatcatttcgtgtccgaagtcgctctggagaaggagcgagctgaaatatcttggactaccatgtcaccccgacgccaagacaaatgcatggcccggtgtcggggccttgcccatggtgttttggaagtgatagtgcctcttgtgacggggcatgcggcgcttgtgccccgtgggcttgaaaagaacataatctgcctcttaaacatagtcatgagccggcccgcgagccgcggcagatctgtcacaggacacgtctatgcaaagcccgctcactgctcacgatttgatgcctcacatgcatcggccactgctcaaacgcatcctttcaggagctttgagcgacctggagcgttattttgtgcattttctcgtctgtttgtgttacttttccccttttcactttcgttgtcctctctgtcacaggacgagggtccctattccctcaagtgcaagaagaagccttgaacgccacaagtaaccgtgacagcagtctcaccggcaactacggctctacaatatatttatctggcatacagagaggatg

SEQ ID NO: 1173 - DNA, 703 bp, Nannochloropsis_gaditana
taaataagctttgagggtgctccgaaatttgtgtgcctgggcagccaaaaatcaacgcataagtttttcattatgtgcgagattggaatcccacgtacctcaatgcatgctgccgataactcgatcaaatcaacgtcttctgccggctccaagcctgttcgccaaggtcgctctttcaaggcctccgcgatgtcttctggcggtgacggggccgtggacaatgtactagccaagatggaggaggaagcagatcctatgcctgagaggtaatacttatggaaggtccctggtaatatactcggatgcgacgttttgtgtgtgatagatcttgaaaacacagagaaatgacaagtgttccatgaagaaaggcgtgcaaaagcaatgccagaccccacgggaggaggtaaagccagcgtggccccggcagaaaggaagagccagggagggagtgaatgtaatgaaaacccccacgggcgtgcttgacgtcttggtggcattaagtatctgctgcacgaaaggttgggtctcctaggggatggaatggggtgtgaggtcgtgagcatgtgtttcgtgtgattcttgaaggaggttagcgagaaaagcgaggagtcggcgaccccctgacaggcaggcccttaaaaacactaacaccacgcctattacagagcgggaaatggaagagtaaatcggtttttgtgtcatg

SEQ ID NO: 1174 - DNA, 703 bp, Nannochloropsis_gaditana
accatgtacgggttgggcattctttgaattagaaaaatcgctagcagtggattacgcgaatcgaacaaattcgggctttttgattcgtctcccgggttgggcccatattacgtagtcagctgagttgtcgaggttaataaggataatgataaccatatttcatcccgcaacgtttatagtttcggtagactctgctgcgtcaactaagacaaataatgtgagctagtaattgattgtgacgggacattgttctgttggtttaattggggagctagtgaccatgacatgttcgacgcaccgacagccgtatcgatcggatcgccgaatgtcgaaccgcaaattcgtacctctcatacatgtatacacaggcaatatctggcaaagtacatgcactaaaattacaaattccattgtaaataaaggtattaaggcattttgctttcattggttgcccttccgaggatctgaatgctagcattgacaactctttggaatcgaagaagactgataacgacgcctccaactgaaactctgtgacattttttggggtacattatctcctgcgaaaagcttgttataagccatgaaaacttcaagcctacattcaaccaaacaattgagaaaaattccttgcacattgccggagctgtggtcaaatgatccacagttggcagatcatcaagatgtgcttgaggatgtcatg

SEQ ID NO: 1175 - DNA, 703 bp, Nannochloropsis_gaditana
ctcttcgctcctgtcgggacaagcccgctccctgttgatgtcgcagttgacagactgacaagcgatgcatcggcaggtctgtagttgcggaacttcaatggctgtttgtgtgtgtggttgataggttgtcagctccgcctgggatgagtaatcggggatgtatggcgcttactttcttcgatgttgtcgccatgatggagcagtaataagccggcgccgttcgattgaaagatgtcctgtgacctgtgctgcataaattgatatattgagggggatggtgtgctgaaaaaggacaacgaacttgcctgactagaaaaatgcgtccaggcaacacgcgtatcattttgactcttgagctatcaaagagagcacagagaccctaagttcggaaaatgtcacatctcccaccctcatttcgagcacggaccaggcgggatgggaacaaaaaaattcttttaaccccaatgcttgacttttaccgactctgagtggtcaaattgttgtcctttcggggacgctgtcacggcggggccacgcggtggcggaggagttggggagggtagcctccccgtggcatttcccagtcgagacgcgtcaagtgtcgcactcagccgtagggcgccctctctctcatctcacatcgttccctgcttctactcttggacctgtgtgcacggccatcaccggtagttatcccaagatg

SEQ ID NO: 1176 - DNA, 703 bp, Nannochloropsis_gaditana
cgcccccgtcagcctcgaggtccgcgcggccgggggctgatgagaaggagcgccctctgggggagggcattggggaaggtccagtggctgaaaggtcgacggaggaggaaggatcggaagaggcgagagactcggacgccgacagggcgggggcagaagagagtaagcctctagatccccctctggcgaagctgatcccgcacatgaagaacgctgccacgaaggtttttaatggtgacccgcaaaacaacgagtatattcgtatcacagcacaaaaccggagcgtcaatctcttgtgttcctccttcttcacaattgagacgtcttttgactgacgaaacagggggtggggaggttagaactgacattgtcggtagtgataacaaaaatatgtaatttagtcatccgtaaatttccttaaaagaagaatcgcgaaacgataagtcaatggaaatatgcagtcatttttttggcacacgcaaccaaagatgttggctacatcgcttcagacagttccatcgcatcgaaggtggaggacagctccagccgttgaagtagagtcctgacttttttcttgtatttcattcaaaccttattggcactcattaacggtttttttgtgacaatttctgatcgattagacggaggcggtactaaagcccaggtgaggctgggctgagcgtggtaggcgacgaaagggatg

SEQ ID NO: 1177 - DNA, 703 bp, Nannochloropsis_gaditana
gtcacataaagataaacagaacgcgtaaaggctgcatttactgcaaatagggcacagcagtgaagctgtgaaggcaaccctagcagtataaaatttcaaactgacggtttgagtcagccgttaagtttccagacaaggttccttgtcagccctcatacaatcgtgcacgacaaattgccagtttaaattgagatacataattacgtgatcaatgcggtgagatgacttaattggaggatctgaggtgctagcgtactgccatcttttttttaacccggtccgtgggacagcttcctccacgactaaacgcctgacctgtgtcgtttctctccaagctctctctcccgtgtgtccaccggaacgaatgtagcttcgggctccacagagtattatctgagtgtctctttcttatggtgcgctgtatactttttaaattactgtgcaatgaatcttgtgagggtcacagcaagctatggtgcgcccgataagtatattatctggagatgtgctactggtcctaccgccgatccacaagccacggactcgagtcttgaggttctcaaatggtagatgtattgtacaagcataaattatcattttaattcttccatcatcacattaaatgcaagcacaggaagaaaacgaaaatcagggagcgtatactgtctgataaagggttcactacttggaagcagaagacatg

SEQ ID NO: 1178 - DNA, 703 bp, Nannochloropsis_gaditana
cgaacgaggcgtttattgcttctttctcaagagccattcgcctcgccacggcttctgtctccatattacggaggccatgatctccgatctgtgttatgggaatatgaagcagtgcgttaaaaaaattaccggtgaactggagaccgtagaagttgacttcttcctctatagagctggatgtcccagcgaggtgcagcagcttagcttagaggagggatgggcattccatcttaccgaaaggaagttaaggcttgttgactccgtatgtcctcgggccaagaagagctcacaaatgagaaggtgaagtagtgagaaagtatcgagatattgtcgcattcccccccaatgcggctactcccgcgtgagcaatcaagggcaagcaaggcgctgaaagataaaacctgctggtaattgaaaaggtcgcgagaatgatttttttagttttatgctactaaaaaatggcctgattcctgttcatttgaaatacgcaatgatttttaaagaggtgcaacgaaatagtcgtcgctcacaggaagtttgccttcgagtggtgctaggaagcagagtacgtaggtgagattcaaaatagatgcaggtacctcttccatcacatcatccctccttcactcgtacgctctcttctcttcaccttgtgcttctacagtctcacgcctccagtgcgactatcacaggccaaagaatg

SEQ ID NO: 1179 - DNA, 703 bp, Nannochloropsis_gaditana
gggcgtttttgaccgtcagggaggagaagtgggtgtgtgcgatgtctgtcgccacctcccccccacccaggacgcaactcacggcaacgctatcctccacgctcatcgcttcgagccatgcaatgcgccgcaccatatcgtacaggtcctttcgattacaaatccctcgctgccgcaccatgagctgccacactccgtttgcggtacggctccaaagcagggcgcggtaggccgcctcctccgtacccagaaacgcacatccccgcttctggacttccacctctgcggcaccaatttgcgttgacaacaattcttgacccagtaccgtcgcaagcccgcccgaacacggggcaaagtagtgcttcagaggtgggtggcctgaaaaagcctgagcccggtcaaagagggcgagggggagcagggaggctaagagggcctttatcggcctccagggcccccgaaattgatatggcggcatacagaaattgcgcaaggcctccccacagccctcgcctcctgcacgggtaaacatgtttcatttgttaggtttgccgagcgcctggcgctgtgttgaagatggaatgggcgacatcgctctgttccacgaccccgcaacccctgtgtgccttcacacgctgacgcctgacgtgccatagtattgcacagggcgcctgtgaccttaaaagacaaggagtcacacatg

SEQ ID NO: 1180 - DNA, 703 bp, Nannochloropsis_gaditana
gacagccgtctgttgctgatgtcgactgagggcatcctctaaagtgtcagtcaattcctccatggcaacctgatttgccagaattttcgtttccaggcactgcactttctcataaagccttttcaaaaactttctatcttcagaatcgtccacgagtgccatttttcctgctattactctgctcaggtcctctcgttccgagctgtcgggcactagcttttgccgtcttggggaccacggagccattttccgccacctaatcagattccgaaagtagccagccccgaggaatctgaaggccgtaagtaatactatcgtgccagcagccgtgcatagaaggtgctgtgacgttgcggtcatctgtgaagaaacttgcgggggctggagggtccacgacttgaagtggcgtcactctcacttgtacggtcaggcgggcaggaatatgaatttcgaggggaaagcataggagtcgttagctcataaactcgggcatctttcgttctgtagtgtagcacattttgaaaaaagcgctccagtttccacatcgagcagcgggcggataatttttgagtaatagcaaactggaaaaacgcggtccttgcctcccttctcccacagagacctgcaagttgtcgctgcaatcgcccatctcttagcgccaccagctcgattgactgctgaaggcacttatataagcatgaca

SEQ ID NO: 1181 - DNA, 703 bp, Nannochloropsis_gaditana
acatgggcattgaaaggcttattacgcgaagtgttcgtcgcatttttaatatgcatgtccatcatgaaagtgggtaaacgctgcaagacacgcgcatcatatagatccgccagggcaagagcgtggtgcacgaacaataataaaggccgggtctcacgcttttacgttgaggagcgacgtcttgtatgtttacgagcaacctcccactcgaacagctcctttagtccggccttcttgatccgagccagacgctgcctgctgtctctctcttccgacaagatggtataatgtccaccaacctctctctaaattcgagagctgcggcatccttgcgagcgctttgtcgccagtccgaagataaaaggtagaaatccgagacctgagccgacgctttcgtgcgacctctgaggggagccgagagccttcgccaagtttttccttccgtcgagatggagcgctttcagggccgccatagtgacgcgaaggcaatcactttgcactcatgcgagctgcatgtccctgttgtcaatatgatcgtcttgacgtacggtttatttgtgtgtccgacgtgtctgacgcgtgcaccttttttgagaggaagccgaggaagcagtcaaaattgtcggtcttcctgtgtccttttccgtagtaccttttcctcaaacttttgtctcaatttacatggtataggtgaagcaatatg

SEQ ID NO: 1182 - DNA, 703 bp, Nannochloropsis_gaditana
gcgagcgaggaaatgccatcttgcggagggttgtcaagtagtcgctcactgcccggttccatggcgcaagatattagacggctgataagaaacgccggggatcagcgcaatagattaccggactggggcggcagagccgtccggcactccctgtgcaggaagctactagcagtagggaggggaagtagggaggccgtcggccggaatgatgtggataattatacacattaatcgaccatgtcggcagttttgttgtacaatctgacaaaggtggcatttaggcaggcaaatccgtgaccccgtgagccagagcgcctcatggctgtggcaggcctcgcctcgaccaagtcgaagggaaggagggggctctgacggctagtcatcgccagccgaaaagcctcaggagcttcgggaacgggggctttgagcacacgggtccacgctcgcaggatggtacggctgtgtttatctcccaacaattcatctagcgcattctgcaatgtggcggggtgtcaaatgtgggatggatggccgcaaggccctccctctctcgggtgggcccaggtgctaactgcgacgccatacttttcctcacaacagggcctacgccggggaatctggcagcctattagatcagccggtagaggagtgaggaggcacgctgagaattccctgtcccaggcaaggtcccggctcaaatatg

SEQ ID NO: 1183 - DNA, 703 bp, Nannochloropsis_gaditana
agtccgccagcccgaccttgggcgtccacgccctcaacgcagccagaagcagggtccggccgtcctctcccacgtatgccgccggtaaaaggtcaatcccttgtatgacattgatgatgggagggacgaagggataggccgtggcccccgagacccctgtgccctcgcctgttgccggccgggaggaggcgtccacctcgaggaggacgcctcccgtctctcccaagtccaagggctcgtcctcgtccggtccacggtcgtctgcttgctcgtcccgacgattgagcataacggtgcacttgcagaccccgttgtcattgtcgagcgtcttggacaggaccgtgacccgacatgtccgtgtgcttgttccgcgcctgagcttctcctcgagtgaggccagctctctgggcatgcgggaggaccaaatcgaggttggcgacactggcgctggatctgagctgtccgtcatggaatctctggtgtatttgcgtgtgaaaattgcgacggtaaagagtggcgtccctctaagcaggaagggaaatgtgttgcagccagcgggccgctcgcccaccctgacctcccctgcccgtcatctcagggggtggagcttgctgcccagcttccctgtctgcttggcctaagctgcacctatgtcacgcttcatgcgaaaatattcacagggaatagtcgtccaacaatcatg

SEQ ID NO: 1184 - DNA, 703 bp, Nannochloropsis_gaditana
gtttgtgtgcgtcttcactgtcagaaaatactgggtttcgcgttccatcgtagccgcctccttttcgctgctgccgccagtgctagtgaccatcatagaaaaggaatcgcgcctcctcgacagcatcgaggagtgagggtcaaaagaaagatgccgctgctgaacagcctgaatgtgggggcagacgtgccagaagaaagcatgcaggttgatgacctgaggcggcaagtgaaggatattggtgggattaggaaagaatcttgctttaaaatggagtagatcatcgtggtggcctttgacggttctacaaggaaaacggaagatgtctcattacttgacttttatgtggtttctcgaaaattttgtcatcggataaatcgagcagcgcaatggatctaacatggaacaaaagggaaagagcagagaaataggcccttgaaaaagctatgactcacctgcaagaaccccaatgtggtgagcaagcatcttgaccacggcatcactgcctgttttcgaatgtagggaatcaggaagtgggatggagggactgctgactcggtgcgtgcgatagtgctgggcgacaagcagcgaggggtctctgaggggagagtccgagcagcgagacctcttgtcctccaggccgtgcacaccacagctaacgaggccacatccgccatcacaccacgcacatcctccagggatg

SEQ ID NO: 1185 - DNA, 703 bp, Nannochloropsis_gaditana
ctttcacgcttgtcggacgctaccttcctaccctgctcttactcgtgtactaacattcctgatctactcgcagggtataaatgaccattttcactcctcattctccttggccgccagaatgggggcaggagagtcgcgtgctcggacctggatatgggccacacggagcttctgactcctctagggggacgagcagtcgcgcatgcgtacattgcttggtgaggaactgcacgtctgtatcgatcgataagaaagcacacaaaacgttttggcctacccaatgcactggacatggcggaaggggcacagcctggcatgagcaaatctattgttggagacgaagaaggctgtggtggttgaaggggccacatcaggcgctcggccctggaacaatatcccgtcgccggatggaattaaaaagccatctttcattttgtgctcctgttgagagctggcacactgaaaaagggtttctcaaatcatgtttgggtgctcagttgccggggacaaaggtcataaattaccataaggccttccccaaggacgcgaatcgttgcgcttgatgatgtcactacgatatggcctcacattttcacgcttcatgcgcgcacattccagacaaatttacgtgcgtgaaatggtcaggtcctactggctacgcggctagtactttgctcgggaaaaggaccccgcattcagcatg

SEQ ID NO: 1186 - DNA, 703 bp, Nannochloropsis_gaditana
ctacgcagagagctttggagtatggggagtgaaagagcgactcatcggattaggtggtgtgtcagagcttgcttgcggatacttcgctgttgcaggccctcaaacatgtggtttctacacgccggaagtccgaaaaatgaaagactgagcaagaatacgtcaattattgtttaccacgcacctgcatgctttgtcgaaatcctgtgttggacttaacgaggccccaacttcattacacgatcccagggaaaaagacccgtgcttgctgacgttgcaccgccgatgacacattttgaaccgtccattcaaccgttacgccgccccagcacgagaaacatcatgcgagcggctctacatagcctttgtatgtgccggcactctggaaaaatcttgtgtggactgattacactttgattcaatcatacgtgacagggtgatgtcgcttgcgccttggcccaagcggcggcctgatggatcctttgaagcctccaaactaccgatctttgaaaggagcgcgactttcagcgggaggaagcgtgcgaggtcagcaagcgagacggagcagcaacaatatgatagcagttgccctcttcaaaatgatgtgtcatcggagcatctttcggatgtagttgctgctattttgcttttaatccaacgcttctaccagggaactagcacgaacgattctcggaggctgaaaatg

SEQ ID NO: 1187 - DNA, 703 bp, Nannochloropsis_gaditana
agcgctctctcaccacctcatgtccactcctgcgtgttttacgcgcggggcgggcagccaggacggtgatggcacccagaggccggggccgttaccgttgaaattcgtatcgctcctttggcggcaaagcccgctcgagcctgtgggagaccgggggccacgggcacggaccggcatcgaggtcgggcaatcgcggtgggaaatcggcttgtatagttaaattgtaatgttgagcgtctttttttcctgcggctgtcatgacagcagctcaacattggtatgatgcggcgttctgtttctttggtagcttgtcgacctcccctccccctactgttgccctcaagactcatagcccattttctgaaatccaaatacactctaatcaggattgcacggaagatatgtcgataaataaggatggtacatctcctgccgtaccagtgtactctttttttacgaactgtctggtacgtgatagaccacttggtatttgtgagtgactcggcagtagagtttgggtgttccttcaagcttatgattgactactttttgatgattcgtgaaaacaaaatgagaaatatcttggggaaattcaagctgaaaggtcgccttggaaatgggaaaaaattttatgcacttgaagtatgtactcattactattgcttctcaggctggcggtgcagcgggaacggccgtcgacatg

SEQ ID NO: 1188 - DNA, 703 bp, Nannochloropsis_gaditana
gtaacattgaccgtcagggttggacatgctcatgcacacggcattttggctgtgcccgcgtcgcaggggcctccgagtcaccacatcgcggattgcgcgagcagcggccctgctgcctctgattctgttgccctttaatggccccaagactctactcatggaagccatatatatccctgctaggctcacaggggcgaggtgacacaggaaacacgttttgttttcacaggaaaggggtcttcggtgcatgatttcggcgcattttcatcggaaacttgcaggaagaggaagagcaggaggacggttgcgccgaaccctggggcgtacttttgcacttctggtcatgcttataggcgccttagggtcgactgtcgtgcgaccaagaacagtgactgcttgccgaagctcgtcagccttttttgcatccaccggcgttttatccattcgtcgatggcagtctgcggtgccagggcgcgcatatcctcctcttcctaaaaaagctaaggcggtagctgtacctgctgcagctgagaccgataataccgtcgtgtctcgcttgccgagcgcattgactgacatatatgcgctttcagagcaagaactatgcggatttctccagaacaccctccaccagcccaagtaccgggctaagcaggtgcatgcctggctctaccaacgcggagcggcctcctttgaggaaatg

SEQ ID NO: 1189 - DNA, 703 bp, Nannochloropsis_gaditana
gtcaagttgtagctgagccaaaaatatctgccaccgctccttgtcttcctcagctatggcttcagtataggttttgggatcgcgctggagagataataggtcctcatcttgcgcagatagggtgctatgcaggtttgtatttgacttgtcgcagctttttctcatgacgtgtgtgttgtcatgctcggacggggtttgcaggactgaggaaagagcctccttggcgtcgcccgttacaacgcttacaaattcagagatatcttgctggaaagttcgccacattgttcctgtaaattgatggtgcggctcaaaattggggtgttgataaagaattcagggaccgcgacatgggcctagacgttccgagcctctgttgggagggagaacggggaggagcacggagacgcctgtgctggcactgcaccgatacgttctgaccgcaaggccaccaccacggcgaaattcgatgcaccgctacgcgaccaaatgtatgaagtaatgagttgcacgttttgatggagctttttgacccaagccgctctccgggttcgccccttccagttcccgtctcaactccagcccccgcctccacgaccgcagactcgggcatcatcggcaagtcaacttcccccctcacacattccttccttccgcctatccctatcccacaaattcgagacagccacctcagttgataaagatg

SEQ ID NO: 1190 - DNA, 703 bp, Nannochloropsis_gaditana
tactacggcgggaacgagaacatcgacaaggttgagtccctgtgccagcagcgggccctggccgccttcaatctggacccggctcggtgggcgtgaacgtgcagaccctctccgggtcgcccgcaaacttccaggcctacacggcggtcctggcgccgcacgaccggatcatggctctggaccttccccacgggggccacctctcgcacggctaccagacggactcgaagaagatctccgcggtctccatcttcttcgagaccttcccctaccgcctcgacgagcgcacgggccggatcgactacgacaagatggaggagaacgccgcgctcttccggcccaagctgctggtggcgggggcctcggcctacgcgcggaccatcgactacgagacggatgaggaaggtggggttggtggcagggggagggcacgtgctgggagggagggaaggggggaggggaagtggcggcttcgtctgagggtgggagacggctcgtcctgttccccgtgcatgagtgctcacccctgccttccctcccgtccccgccagatcgcggacaagcacaatgcctacctcctctctgacatggcccatatctcgggtctggtggcggcgggcgccatcccctcccccttcccgcactcggacatcgtcaccaccaccacgcacaagtccctgcgggggtccgcgggggggcgatg

SEQ ID NO: 1191 - DNA, 703 bp, Nannochloropsis_gaditana
gccgcgaaacccaccagggtaatgactgcgcagacgtagctggcaatcgtgaaggtcaaattggccggagaagtgggtggcgggcctgttggtgtcagcgtgggagccatcctcttagcctgtggacgacgggtcacggtgtctagcgtgatttaattttctccaacaaccaaataacgagacacatgcgcgcgcagagacgtgtggttgttcgagctcaaaaaaattgccgggcctgctgataaatccagggtataaaccaacaggattactcaggcgggacgtacaagctcggggctaaaatgtcccgtgaggccatgaatactacagccacgtacctgggaaacgacactcggcaggcgcttgacacccggagcctccctcctcgtcccttcacgctgaatcaaatgctgccctgcgctttctgtgcatagaggacgaagtcagtggcctcctcgggggagcaaaggagagaccggggcgggaggcaagggctcttcggcgtatccggcccgcatgccctagttttaggccttaagggctcagggttgtcctcctcttgattaatagagtctttattcgcccaagcgtgcatgtaagtgttctctaccctcgtgggatgccaatgtccggacttgctgccctattcatagtccttattgacgtgcacactgcccacctccccgctttatccttcttccag

SEQ ID NO: 1192 - DNA, 703 bp, Nannochloropsis_gaditana
cgaagtcagtggcctcctcgggggagcaaaggagagaccggggcgggaggcaagggctcttcggcgtatccggcccgcatgccctagttttaggccttaagggctcagggttgtcctcctcttgattaatagagtctttattcgcccaagcgtgcatgtaagtgttctctaccctcgtgggatgccaatgtccggacttgctgccctattcatagtccttattgacgtgcacactgcccacctccccgctttatccttcttccaggcaaaggctcacccgtactcgtttccgacaagcgctgtaaagatgctggaaaaactgacagcggggtgggagacgagcacagtctcagatttgaaggacttgttggaagaagcccgtcaatcgaaattcgattttgtgaccatcccccttgtccatccacgcttcgagagggatcatttgggtgtcagcgacggtcggatgggaactctgacaagaagcgacatggaagtagacagccgcacgtggacgacctgcgtcgtgggcaaagtgtcagagtggcttgacccctccagcccagatgagactgtgcgactggcggcggaagcgggcatgaagcaggagctggcgtgggcttcacatttagccgtcccggcggtactgatgccccggcctcctcgaactgagtgtgcgaactacgcccgtttgctgaaccaagtg

SEQ ID NO: 1193 - DNA, 703 bp, Nannochloropsis_gaditana
aggagtactgctggagtggcggtgtgagaatgatgagaggctgatgaggcatggacgggaggatgtcagggaagaggaggaaggactctcgacgtacccctggatgttgcacgcggtctgagcgatgcatttcgaagcgttctggactaccctatttctaagtgatgaaatcattgtgcgactgtggtccttgcgaccgcctgtaccagaaggatgcgcgtgagttgctggtgcgtgggaacaggaaagtatcaataccattagtacgagagagtggcgagcatcagagcgacgctgagagcagggaggcaggcttgcacggaccggtcaccagttctgagacttttttttgggccatgctagatttacagagtatcagtacattcaagcgcgctgcacgtggtggtgttctcgcataaaagccgcattggtggtggatgagcctgggccgtcagcgcgtcggagcccgtagcgttgttgctgcgacgtctgctccagcttacttgttaaaagtgatgctcccatttattttattcagcacttcaaaagctttttatacgccaattgcattggctggacgacggctgggagctgttcaagaggtaatcggaagaaacgctgggccggcattcaggagacttggaggcctgcgaggtacgtgggaaatcctctatttccgctatgcctaggatgcaaagagatg

SEQ ID NO: 1194 - DNA, 703 bp, Nannochloropsis_gaditana
tggtggtaagagcagcaacaacaaattgtttacgaggtatgcggaagctattttaccaaacagatggcagaaatctaaaaataaaaagaaattttccgacccagtgcgaccgactcgttcataaggttacgatacattccgtccttttattttcgaaaaaatgtgaaatatatgctgttcagcttctggagaaagtgatgtgcttgccagcaaattactctgcgtggtaattttttcaaatgaaagagcaccgagactttcgacacagcaagaaatgcagcaccttgctacatgatggaggaggtaaagcctgccattgaagtaaatgccaggttaagattgttttagtcatttttgttcattaagtataaagagcatgacaatgttgaaagtaagacgtttctgacggtcattttgacgtttttacttgtcgcaaatgcggccatacgctcccgcacgtgggccatcgcatttttccttgtgatggaagagggaccttcattttcctcctgcttgggactagtgacccgacacacaacttgtaagttgcccacggaaaaagctaaggaagagatgtcttgcgtgcgcgcctggtaaattcctcacatattttgtcatcctttcgacggtagccgtcaggtctcattatagtaaagtggttcgagggtgggccggcgatgcactgtaatcgcaaaacttcatg

SEQ ID NO: 1195 - DNA, 703 bp, Nannochloropsis_gaditana
gtcaaaataaatgtcggcatatttcctgcatcttccaaataatgagcgttggtcattgaccacccatgagcagtatcaatgcaaaaccattctgactgaggcatattgctgctgttgtaactatagtgctaaatggctagacttacagtgtgtcgtaaagagcttagaaaagggtttatatacgttgttgattgcatgccttcaagcgcgtaccgctagacactatcactgccttcgtcctcctggtagcctgaggcatttaagtggacatcgggtcctaagtcacacagaaacaatcgatgattcaaccctttaagttcgcggacaagaacttccgacttgcgccgctctcccagggcatgggtgtgtaggcggggaggagacagaggaggtgaaagtcgacgaaatgcgacagaagccgtgtcccttcactataagaagctctgtgttttttgtcacaaacaccgccacaaacttacaaacggggcgagccatgcattgttcggctcactttctactttttgaaaacatgattgatgttgccagccccggagcgtgcttcaaatgtcaccgccccacccttccgtcccttgccgctcgcttcatgtcagcgaacaacctcctccatgcatgctcctcctcatttacgcctaacttcctccattgtatttatcaaaccacagacatctcaccaatatccatg

SEQ ID NO: 1196 - DNA, 703 bp, Nannochloropsis_gaditana
tgcatcaatcaaagcagccgcataatctttacgatcgatttgaccggcttttttcgtaaatctaccctttcggtgcattcgataccataattggtgctctctttcttaatgtggcgacttgtatccagcagtgaagcgaggttcacagatactacattttccctcatgtagccttaaatgatccttcaccttgttcaacagagtatcccgcggggcgttgaaatagatggaggagggcacggtaagaaatgtgaccgatcccttagagtccctcgaagtaccagaagggcggatgggtcatgggggagacccaagaccgggcgacaacacggtcggggggtgtcgccctttgatggcggattgtatgggagggaatttccctttgcgacgacgacgtacgcacagcaccatcataaactcacgagattccccgattctcttggatgaggaggaagacaagcgctaccgttcctgctggaacctgaaagacatctcagaggcatattttcgctcctatgcatcccagctcttcatgttctctctctccgttttcgcatgtgtcctgtacgtagtcgagacctactatgataaccccttccaaaacgtcgtgttcatctccctggaggtcttcctctccctctcctttttggtggattacgtgctgacgctcgccttcgctctggaccggtggcggtacgtggtc

SEQ ID NO: 1197 - DNA, 703 bp, Nannochloropsis_gaditana
tcacgacgctggcgctttatctgtgtcgcgtcatggacagtgtaacacagaccgcccgcatcaggaagcttattacggccacagatatggcgacgacgtgaaacgtcggtcgcgtgcgcagtccttcgtacccattcctgaacgagccagtcttcctgagcacggctctcccctttttgcggctggccgtgtctgttgtcgctctttctttgacgtgttcttcatctacatgtataaaaatccttacgctctgcggttgtggaaagaagtgattcgctctagctccgacgaccttttgggcgatgagtttcaagttgggacgtgtgcgacagcctctgagggggaaattctggacgcagaaatgttgaaagagatgttgggagacgccactaatgacacggggcagaacgacgtagacgcagaggtgccgtttggatacacgggccgcgacctctactgtgactcgacaggactcgatgatgcgccaccggaggtagagaatttacaggattctattgacttgctgcgctcatctttggatgaaatgccgctgccgcgagctttccttggggcgcgctatgctgacttggttgacgcgtttatgcacatgggcctggtgccgataggcctctaccgtccacgggggttgatggacgcgcccttgcctttctccgtcgtcaatccctctccagacacgaagatg

SEQ ID NO: 1198 - DNA, 703 bp, Nannochloropsis_gaditana
tttgttccatggcccatgagcggcgaacttccgccgcatctacgagttgtaggtgtagggagggagttgctggacatgcacgggaccaggtcttgccgaggcagctatctcgcatttaagtgaatggcaattatatcttgaattcgtgaatgtgaaagttgtggattttggtaaatacacacaagtttatgcaatttgcgcttggctgtgtcgtgtaaacgttgtcttttgtgacgtgaggagcccccgccacgacacgagggcctggcttggtcatccctccagccggcatccagtcatagtaacaaacgctagaaattgagcaaagcactacaagagccctgtctgggtagccgggtgaacacatctgtccatcattcaagtgaaagctcgtacgtgacggtagagtgttttgcaggagcccctgacggccgaagcgctctcctctcgctcccgttggccccttttcgccccctcgcctgtatctatctccgcccgaccagccactagtgttgacacggacggaggtaatgggatctgcatcaaacagatgagcctttaaacacatttttttgcaacgacgtcctctgccaagaatatatggccactgtttgtaggcttacgttcgctgactcctccctcttcccaccatacatgaagggggaggaggtaaggaagttctgttttggcctgcgttcgaatg

SEQ ID NO: 1199 - DNA, 703 bp, Nannochloropsis_gaditana
aaggatgatcgcagcgagcagatatttctgcccaaataacttccttcacagagagacggcttgtcttagagctgaggagtagcaaccctaccccaacgttgcttcgcagcttcgagaataaaaggggccacagcctgacaaagcacgtgagatgtttttcgtgagctgataagataccgtttaaaaaaaaacgtcaagcaggtcttacgggtagaggggtctcgccccaggaccagcacgggaaccacatccagcacggctcagcagtcgctcgggcgccatggccgctcacagtacgcgatcaccattcagcacgcagactaagagtctactgtgtcgccgctctacctggcgtcggaaaagaggtcactccgcgctctccggcttggcgctttgccggcacagattgcttcctactggccacctatcatggtttcgcttgtcaaacctcccgtcgacgcctcctccgagtcggaggagcgaaaggcgactgaaacagaaaatgtggggctctctgcctttacggagagttttttttgcgagtggatttacttgtacattgaagcacgacaagactacttacaacaaatggaccttgaaaaattgtcaggatcaagccgttgctctggctattcaattatgcccctctttgtcgagaaagatatctcaccttttcttactctcgcaatcctctccaggaatg

SEQ ID NO: 1200 - DNA, 703 bp, Nannochloropsis_gaditana
acgttcatgaaaggcttacagcttttgggaaccagattgggacgcaaacgaggggccttctgaaaacagagaatccagataataaaacgtgttggtgtatgtgtatgcgaatgggtttacgagcgtatgactacctgtgtcgtttgcattctattcccttaccctatcttatacgccctccctccctcacctccaacctcccgccttctcaccttgtaaaaaacttgcatcatatcccgcaaccgcctccctgcctctgtcgtcgaagcattggccatgctgtctttgctctatcgttttcacaaaaaaggcatgagacgcttttccctccagatcatcagagctgccctttcgctctgagtatcgagccgtaaggaccaccgtctcggtgatggcctcgctcgagtgagagaccactttgtgccccaactctcgccatcttttttccatcacaggccttcgctgtcaggacgggcagtgttcttgttcagcttcggtgtggaaacagtgtttccttcgagtgacacgcagatcgaagacgaagcactgccttgaacgttgcatgtcacttttgtcacatgagaagggttgaaaggaataaagttgctgggcaaaactcacatgcatttacttctgttgaaacatgctaacctgcgtgcgcgcctcacatccttgcatcatcatgggggcattggaagcaatg

SEQ ID NO: 1201 - DNA, 703 bp, Nannochloropsis_gaditana
gttagctttgaatgcatatgtaagagtggaggtcggcaattgtattgactaacgttttcagtgacagggtgtaatgtacgcagcagcgcagtcagacatccgttcgctcccagacactattcgctgagacgggaaagcgagtggagaacagacttgccgcaccctgcccaaacgacgtcccgctcttcagcaaggagtcttccggcagtcaagtgctagggagggcctgtctacgtacggcctgtcaacgtggatggtggcatggctgcgccggaggaatctggatacttttcttgcactggttgcccccgacctagtgggtcgttttgtacgcaccctcacatcccccctctcgcatgtcttgcccatacaacgccaagcaagtgctcatgggatggactttagacatcatttgtatggcttcctccccgaacctgctggatgtcttcgattccaccttcaaactggcactgatcttcgtttaatgacgttctcttggtatgctgctcacttggttacgcatctgtctttactcacattccatagattaacgcgattcgccaccgcacgcacagattaaacaatgagaacaacgaatctgtggctcccaaacacgctctccgtctgttcgcgcttcgtatcctctcttgtagtttttctcctctgcctctctgcttctccgctcaatgccgaggaggagatg

SEQ ID NO: 1202 - DNA, 703 bp, Nannochloropsis_gaditana
gcttgagtgtacgcgggagggctcatgtcgggggcgatgtctcggcccccctggcattgagaacgtggtctcagtggatgactgggagctgttgtctgcctttttactgccccgtcgaatgcgcgtcgcctgcagctaccgtgacacagccctcaacgcgtgccagactgcaactctcacccgttcgccctgattcttccccacccaggacctcgcctccgcggaggcccttgcggccgccctcggccagcacctggcggaggacgagttgtaccgtgtggaccactacatgggaaagggcgtggtgcaggctatcctccccttccgccgcgccaaccgcgggtggctggaggctttgtggaccgggcggcacgtgggcgcggtggaggtgtccatgaaggagacggaggactgccagggtcgcacctccttctacgagggctacggcgtcatccgcgacgtgctgcagaaccacctgacgcaggtactggtcttgctgaagatggacatccccccggacaaggagagcacgtcctccccctccctgggctctcaccaccaccgcactgccgttttgcgcgagctggtgctggggggcgagaccgagggcggggagtcccgagcctccatccatgtgggccagtaccaaggctacctggaccacgtcgcgtccgaccgacgttccgagccccgggtggtgagg

SEQ ID NO: 1203 - DNA, 703 bp, Nannochloropsis_gaditana
gcctcatcttgcgcccgaggtccaccagagtcacagagagagcacgcaaactgttcaggcttgtatgccgacattatagcatttatcttcatcgatcagagatcagaacgtgctcctgagaattttgagcgaaaagactgacattgatgtggtttttgtgcaaacccagccccgtaccatgcatagttctccgtcgcctcgcccgtgtaagcgtaagcgagagggagaggcagaaagtgcgctgggaaaaaggacgtgggttctaccggccctggattcgaagatgtcaatcattttaaatagttttcgcgtgcagtatgtatttgttgctttctggacgtgcgcgcaccaaaggcatgtcccccgtgaatagtccgtgcaacagcacgggctgatgacgtagcccccaagaggaagctgcgacatgaaaagtatcctggaccggttcatccgctgctttttatgataatgaccgaagatcgaggagaggatgcgcgttatgaccatacacatacttctagcttgcgcaaacctacgcatgcgtcacctgcaccggaccacaaatttacgtaggttttaaccgcgactggtagcctagtgaccttggctatttcttccttgtgcatcttaaccacagaggtggcggtgtcgttgtaatgatatcagagtggaactgacccattcctacaaacgaccagcgatg

SEQ ID NO: 1204 - DNA, 703 bp, Nannochloropsis_gaditana
gtcgaaactgtgcgagatagagggagacagagatgtacgggtttcttaggtgggaccataatgcgtgctgaaatgcggagcaggttcactccagggttgtggacggccacattgtatgacatgcagggggctgctgaaggacagacatttttcattggaaccttttgaccgcccgggttgttacctgataatgggcgtgctgctcatggccaggcgctgtctgtcatctctttccttttttattattaaatgtcacgtttccattttaacaatgtaccggacataggtattagtgtaaaaaattatgacactctgcaagccttttccttcagagtccaattagcgcctttttttgggttccagcctcccgccttcccagcctacccggaagtctcgaggaggcctggagagaaaggagaagctccgaacgccacgaatacgctttttgaatccccgcctcgcctcctctgcctcaataactcccgatttccgtctttgcaccgttttttcacaaacgttgaagaattcagattaatgcacaattgaaatggtgtcaggcatgttcgtcgcgggcccgtcttatcgcgtgcgctcgcccgaagactttagcgagttccaccttctagattccccctctcataattgctgattactgatgatgaccgatttaccagacactgtcacgatttcttacagggccatg

SEQ ID NO: 1205 - DNA, 703 bp, Nannochloropsis_gaditana
tatccagcttagtcgcttgaagggcgcgagtatattcccgggctttgtcaaaaggatgtagggcgggatccagatttcgaaaaaccttgacgacatctcctttgcactcccttgtgaaagtctcttcacatcgactgagtgtcttgatcttcattgtcttagcacatttgaaagcgagaaaatgagatgattcacagaatatctttccgcaacagacgcttcgttatctcagttataccaaaaaagtttcccgtcaagcctcgacgacattctcaaccccaagtgccttctttcccacttcttatatgctcagctaaacagtggtgtgcgggcagaggaaatcatcggaaccctttgagtaaagcgctcgtctcattggtcatcgccgtcccgcccgttgcctttaccgagccgttaagcctcgaccgtttccgccgggtttccaccttgcttaattttcaggcgcctttttctttcaaataaaatgggccggccagagcactatttttcgcacttcaaaatttcaacctaaaataacgtattgtcttaccccaattacaggagcttggtgccagacaaccatttctttttaatttcttcacgattttcgaagggccctccattcgagttaagaatacgaaaacacgtcaagaaatacatagggagaaccaaaagcaccagatgcacgtaaacgagcattatg

SEQ ID NO: 1206 - DNA, 703 bp, Nannochloropsis_gaditana
tcgagccagggacatactccttgccgaagtctcggacgaattcctcaaaggtgtatcggtggtggggttccagatccaaagagagccgggaggcaggagaggaatgccgaaggtgagctttcccttcgcggcctgacagggcgaacgcaaggtttgtcagcacgatcaccactttggctaccgcagcaatgcgaaggcctgaggcatacattttggcagagacggtcaaaataatgccactaaggctttgtcgaggtgtctgcacacgtgtggagtaagcagaaggaatagtaagcagggcatttctaggatgccgtcaattccttttcatctcgtcaaaactttgatttaccagaattttgcaccgcggcaaattattcatattagaagaatgtctcctgagggccgggtctgttgactatgctcggattgcttgtccggcccacgtgttgccgctcgaggccccggttgaagctcgagactctctcgccgacctgtcttcaagagccgccgcctcgagctccccgcatgtcatgttttttgctgctgcttgcatgccactcaagggaattgtcgtgcgtcgcgaacacgagaaataaaatgaaggactgagcaacccgctggctgcgacgtgcctgttgcacgatgacacgtatagctcaacttttgtaaccctagcaggcgctcctgctgctactgcatg

SEQ ID NO: 1207 - DNA, 703 bp, Nannochloropsis_gaditana
gtccctccttcctcgccctcgctcgatcatcctgcacgggtcctctcagcacggacgtcacgccgtgcacagcgggggagtgtatcccacctatcataagcatgtacaaatccaacacgcatgtcaccctgccgtccagcaagctctgctgcacgcccccttcgtggcaaatccctgatccgacggcttagatcaggtcagcgaggcgagggcgaggcgactcctactagtaacctttgtccctccgcgacctaggtgcactacccagagcgacaactctcactcggaagccatcaggcatttgaggcggctatggttgtcatggtcagaatccttgcacattgttagtgagaagtagaaggatcgggaaggagaccaccgcccgaggcagcaaagcttgtgcgtgatgctgtgcgcagacgcaggcccgctattgcactcaacgcgtcggtggcagagacacacacatttaaaccagtgcgcgcatgattacgcttaaagcaagagcgagcttacatcaagatagagttgagtgatgatgatttggtattcgcgaggtaaacacgatacagctcttcagcctgacatgaagcctccgacctccctcccaacacgcgaccaacacacacacacacacacttttttacctgtctacttaagctaattctactttcttcatgacatagaattaattctctacatg

SEQ ID NO: 1208 - DNA, 703 bp, Nannochloropsis_gaditana
ttcaccctccttttctatagttaggtttgacacagcttgttctcgtgtatcatattaatgcgggtctgggcattcctgatgaggtcttcacattcggcgatagcgttgtccttaccgtgctcggccaaatcgccttcatgcccactcttgttctggcagcgcggctttgcccccctggcatcgaaggcactttattcgcaacgttaatgagtgtctttaacggcgcaggagcactcgggaccgagctaggcgctctcttgacttctgcacttggcgtcaccgaacgcaatttcgaaaatttaggtttgctcatcattatctgcaacctgagcagccttttatccttgcctttcctttccttgctgggaaatgaggatgataaagttgaagtagatagtggtacatgagaaatctgcacacaatgacacacaaggcgaagtccttttaaaagagagatgagctcttgatgatagtatgtacagtatgcgaacgccaaattaatctatgctgtcacatgtgcggtagcccgcagcctatccatcgggcataccgactcaatatgcattggtccaaactagtgttgcttcacgcagatgagatggctactttagcaacggtcactccgcacttgcttactattgccctctttccaagtttgagtacctcttctaaagtcgctctcactttccgtatttccgacaaa

SEQ ID NO: 1209 - DNA, 703 bp, Nannochloropsis_gaditana
tttccaacgcggtacgtctataacttcctccgcctatccaatggatggcttcctcccttgttgcatgtttttaaccccaagcgcactgcgcttgtatgctatttcggtgcctgggttctgatttaattcatctacctgcccacttcatggatcttagtgtttgcttaatggatcatccttactaataacctcaattctccggcaggtttcagcgtcgagccgtgttgacatgtcccctttgcccgtggatggggggcacgtggtgattcgcgatcccgcttcattccttgccaagaaggcaaagattgcttccgacgggcccagtaaattacaggcacgtccaggcacttgtatcttatatgaatcagggaagacaaggttgcattcatctgtcctcaaatgcatcacctttccgatacgttggcttgacgaggaagacaatgaccacctgtcaatgaccctcactttgcttcgcgcattacgctctctgctcgatccttctcctcgctcactctcatttggtaaaaaccatgcgttcgactccctatccagctcctcttcgactgggacttcacgctcacgcacttcttcttgaacgggcgacgcgcctgcagctgccacaaagcgatcgaagactgcgacctgctctcagccgcctaccacgagtaagccgggaggggggagtgaaggcacgtgtgttatg

SEQ ID NO: 1210 - DNA, 703 bp, Nannochloropsis_gaditana
aatatctaggtgagcacgcgacaaagagcactgatgcaaagaaggaaagctcgatctcgcggtgatcccacaaagggttcgaagcagcctgccaagttaaaggaaggtgcccactcactagggcagcgtgttctccttgtcgtcgcccatcccgacgatgaaaccatgttcttctcaccaacaatttctcactaccgccgtctcggctggagcacatccttgttatgcctctcaactggtaagcctggaaggtgctaccattaaggaataagagaagggcatgaggctcctttcatttcttgcagcccaggacgacatgcatatgctcacctattgaatgtatcataggcaatttttatggtcaaggtcccgtgcgttctggagaacttcgacaggcgtgccgtctgcttggagttcctgcacgccagctgaccataattgacagagaagccatacaggcaagagtgtaatgcgatcgctctccaggatttgatcctacatcaaaattctataacaaatctccgtttatgtacaatttatctgtagtacaggatagtccgaccaatgcgtggccggaagcatctctttgccctattatcctcgacgcggtgaaacgcaatgatgtacaagaggtacatatggaacagactttgtctgtgatgacaagcacaccatgctcacatgtttctctggttgacacagg

SEQ ID NO: 1211 - DNA, 703 bp, Nannochloropsis_gaditana
atgcctatgagcaccaggcaaatttaaaacggatatttaaatcgccttcgtatcatagtgaaggcatttatcgagagttgtgcagacgaaaaggccaatttttgcaagtgaggccattaacatccttcgtgcgaggacaaatcatcttgaagttccttcatcgtcaggaaaaaaataaaacaagcgagcggataaatcggaggttgctcgtgctggaagataatcaacgtgctcggatcactgacgcgcataaaaccacttctccattgtttctgcgtatgctcttgatcgcgcttcgtacaggtgtgatgctttcaggtattaacgctttatcggtcgatgagcaacttgacatctatctcgggcatgagtcatctcctagtcgtattgtggtacacatgttagacatggtacaacgcactattgaagaatttggaattaaaggccagcatagtaagggtcttcttggtcatgttctagccgccgttcatgcaagtcgacaagggctttctaacgaggagctgtgcggaattgtggacctcgcggtgggaatacaaggtgtaccggcaccttgcatggaggccatgttttggttgcttgaagagatgaccatggttgtgaatggcttccggtaagacaacgtctagtaaggggaaataataaaaatatctttcttctcaggaaattttcatttcttaatgca

SEQ ID NO: 1212 - DNA, 703 bp, Nannochloropsis_gaditana
ccttcatcgtcaggaaaaaaataaaacaagcgagcggataaatcggaggttgctcgtgctggaagataatcaacgtgctcggatcactgacgcgcataaaaccacttctccattgtttctgcgtatgctcttgatcgcgcttcgtacaggtgtgatgctttcaggtattaacgctttatcggtcgatgagcaacttgacatctatctcgggcatgagtcatctcctagtcgtattgtggtacacatgttagacatggtacaacgcactattgaagaatttggaattaaaggccagcatagtaagggtcttcttggtcatgttctagccgccgttcatgcaagtcgacaagggctttctaacgaggagctgtgcggaattgtggacctcgcggtgggaatacaaggtgtaccggcaccttgcatggaggccatgttttggttgcttgaagagatgaccatggttgtgaatggcttccggtaagacaacgtctagtaaggggaaataataaaaatatctttcttctcaggaaattttcatttcttaatgcaacagaagcttttctcatgaggtttttcgaagggtaatttttgatgaatttctggggacaaatgaagcctatattcgccagcacgacctcatggcacggtactttcaaaaaatgcctacgtgctcacgcaattttgaatgtcttgcgtaccatct

SEQ ID NO: 1213 - DNA, 703 bp, Nannochloropsis_gaditana
atttctggggacaaatgaagcctatattcgccagcacgacctcatggcacggtactttcaaaaaatgcctacgtgctcacgcaattttgaatgtcttgcgtaccatctcaaggccgcgggattgtggacgaaattgaaagaagcccttgtggacattgaaaatttcaggatgtggtggacgccggcgcacaaaagcgagtttatttcgttgtgggcgtccctgacatgtcgtaaaacttttgcgaagtattttgcaaccgcgagaacgaagtctaccagcgatttaaatcactatcaggtatgattagaccctcctttacaatgcctgtatcataacacagtgaagagtttctttacagctgtcttgtacatatcatccattttctaaaaaaatagtgtttcgaactaaacgattgaatgtcgtgcgtgtgtatgtctttcaggatgcacgcaagccccgctggctcttcaccaattattataatatatattatgtattccacattcaatacctttccgaaaaagatctatgattttttgtgtgaagctatgcgaattagagccctttattcgccttgctgacaatcgcaacatattagggtgttcgggcgtatttcgatgtggtggatgagtatgttcgcagcttagaatactacagagagaaacagaaccccagagatgaagacttggccgacgtagtctt

SEQ ID NO: 1214 - DNA, 703 bp, Nannochloropsis_gaditana
atgatagtaataattgtagaagcacgtgtcactaaagctcttaaatcaaacagtcgaaattttgaagctggaattgctttcactacgcagtcaggcggtgcgtctgatgagacatctcctcgataggccaagacatgggccgcagtttggaagggtgatacgagcgtcattggacggcgagcgcttaagcttctgccagacaagtcttccttcgtgtgtattgtgcgaaatttctcgcgtaccactttttcactcaagtaatcatagcatgctcaattgtctgcgctgatcataaaaatccatctcttactgggactgcctatcattgtcgttctccaattgcaggttgccgcgtctgaggaggaaggccactgtaggttctcgcttaccatcagtcgagatgccagcagatagtgcctccgtatcttcagagccctcaagcttgttgtctatcgtagatcgaacggcctacgatcgtcttatcaagtcaatcgcagatgcgcttccggaatctacacggtcacagtttcgaggtaaggaagagaggagatggagcgcttcaagaaagtgatatgtatgtatatatatgagcctttctctgttcccatcgcatgatctctcagatgaagcaaaagaatgcacagactacgctagggcacgaaagttgatagagttgatactggcccaaagtgcggtgatcatg

SEQ ID NO: 1215 - DNA, 703 bp, Nannochloropsis_gaditana
cagtagaagggcgtaagcgcagcccccattgttgacatcatgaccgtccatgctggcatttctgaaggaaacaggaggaacatacagcgagacaaaacgtatagccgcgctcactgctgtcataaatgctccggccaaaagtgtaagtcgtaaaccccatcgctctttcagcatgtatcccgctatcgtgcctggaaggaacaacatttggaaagaaagtgccacaatattcaccaagcctggtgagacgccgtagactgctgccgttgctggcgtaatcgcgctaaaggccacccaaaccaccgcgttattcaaaatcaagatacagaggagaataagctgaaagtagcgcgagccgtggaccctccacggatgccgctggatgactgtctcctgacttgccacattccaatcttggctgctgccagagctctctggagccaaaaaaggagcctccatgccgctcgcaaaaccagccccgtcacactgccgtcgaacgaggttgatgagactggttgtgggaagtcaaacgcattgttcttggattatgatgagggggccatcttcaattttgtgtgtcgctctttttgagtgagcgagcacagatcctgatgccacaagcgatgacgatggtttgcccggatgttgctcacggccgcgctcgactcacaccacagcatcgcacagactcgcgagcactatg

SEQ ID NO: 1216 - DNA, 703 bp, Nannochloropsis_gaditana
gacgcctacgaggctgatcggattggtaagcacactcgagaacatggtcgtctttcatctccactagatgagaggccgcgggaggtttggaaaacgcctttcatgcctttcactatgcatcaacgaggcatcaatttcgcgcatgtcttctaagctctagtaaacatgcagtcacgtatgcgcaacaggcaatcattttcacggagttcgatttgtgcttcgcatgttgagctagttcgagctgtccatggtgtcttggcgaagaaattccatgagttcgcatgctgcggccaacagcgtggacactatgtctttttgtcgcaccgttgccgtacaatgagactgtcatgggactacgacgtcttcaatggtttcacgtgtcatcactttggcgcctgtcttctcgtttcgtcctcctaatccgaattccactgccatgccgttttcgaatcgctccgcgccgaggagatggggggtggcgctgtcgcaggacgtatataatctctcgcccctcacggaaccggctattttagctaagcatagcgttcatcattttcgtagcttacattcacttggaacccgcgtctcttcaaccaatcgcaaatcactctggacagggaggggagcagacctgaggcgagagcactcaccactacccgatcgctttgccatgaatttgacgagtccaaactaaggcttgatg

SEQ ID NO: 1217 - DNA, 703 bp, Nannochloropsis_gaditana
cttcaaccatggctgaagtagaatctatgtgtgggtaccgtgtgtaattcttgttaaaactttaaaacaaggcttgaagccgcatgatgcactggcatgaggactctgatatccatgtcaatcgcttttctaatgttcccagccacctgcaggacctacagagagcgtcgaggccatgttgaaatgcagtcccgcaccgcgttatattacactcaggatattgatcacatacaggaccagcgggtgtacttgacatgtcccccggacccaacatgatttgggccaccaaggaagtatcctgtgtcggccattgtccgagggtccgtggaccccgggcgtcatatttcctttcaggaaaatgtcccgaatttgaatttcaaattgaaatatccgaccacgtttcccgtccctacccgactgcccccgccaggcctgcaattttcttcgcaacaaacgtccttagccacgatgtgagccgtttaccactgtcaaaattatatactgcttagcttttattttgttttattatagatgaccggcatgtacaaagcaataaccatctttatggtggtttcaagtctcgttgaggcacaaaagttgagggccgtgaacggaaaggacgtggcaagtgcgacagtgtcagcgctaggcgataccacaaaaatagaattttcccaaaacaaagcagccgctgcaagagatg

SEQ ID NO: 1218 - DNA, 703 bp, Nannochloropsis_gaditana
tcaaaaagtaggatgagaaattatgcgtctgcatttgtaggtgcaattacttccaagcgtaagtgtaacttttgatatttttaacgcgtcctttgtttaggatacggccctcttgttgattggtcgatctgacatagctcggaaaggtatatccggcacttgcgcttttaaaggttagtttttactggaattttcaatttaatcaagcttgactcatatagcaagaaaatttcaatgggaacgccaattgaaggacgccctggatgcctcaaattctagcagtggcatgggccggtaaacgaaacaacggcaaccttgttgcacttgctctttctttttcgtcccaaaactttcctcctgctgtcgctgcactgtctcggctgacgggatcttgtaggacatggtacatgcaaataacttgtgcgccagcacgcctttgtgagcggcgtcaagttatccttgcgtggcttccacctccaaggccgcgagtagacgcacgcatccggcagcaaggaaggtcgcggccgagcgagcgagcggtcgggcaggcaggaagataaggcctgtacagtgaaggaggtaactcagcgtcgtcctgccctcgccctgctctcctaacacttgttctatcacaagatcctgaaagctttcaacacttgttttactgctgtattgaccccaaggactgttgaccattgtaatg

SEQ ID NO: 1219 - DNA, 703 bp, Nannochloropsis_gaditana
agcaggcatagcaccatagacggcaggcctctcatgttttttgatattacttgttgttttgtccttgcgcttcggagttaccgcgagaaaagactgcgttgcaaaaaaatacttgtgtggcaagggtgagacgtggcaacagggacgaggcgtggacgggaggcaagccaaaaaaatgctgaattatacaccacttcaacctcccaatggtttcgttgatatccctgtgaccaaatttgaaaaaaaatggcaaaggtaagtaagaagaggaacaatagcagcggatgacatgagtggggattacaagcccccgaaagttgttccagcaggcggaggcagcctccggcagggagattttgtggaccgaatcaggtcgggattttgtgaccgaatcaggttggaagaggggagctcaccggtcttttgtggaccgacaacccggcctgagcttgcgttttgtggaccgaggggccggcccaagaaaattcaagaaacgggtagatgggccttcgtgtacgggtgggaattgtgattgcacgcctagtctgcgagcaataacgtgatatgtggctgcatcacctcaataatttgattcatctctttccgtcatttttgtctgaccgaagtggtcgcacaacaagagacaggttgtgtacgagtgaccgaggaattaccattacaggttaccagtcataaccctatg

SEQ ID NO: 1220 - DNA, 703 bp, Nannochloropsis_gaditana
aaatgctttgtataaagaccaagccaagggacttaaagggatgattcccgacctgatcgtggccatatgcgcgggtgacgtcggcacagtcgacgacgcagctgaattagcggacatggggtacgatgctgtaattttggggaggggactggccacatcggctgatataacacgtttcatatcatcgattcggtcgcgggagtctatgccaagcttgctcactggtgcaggcatgatggccgaagacctgaggcgcggaaggcgggagggttgaaaaaaaaggaaaatatccatacgtgtatagcgattgagacattcgaacgcaagtgcgggtcgcatatgatcatggcccatttcatttttatcgggttgcctcacggggcctcgacggcctcggcgagcaggggcgagcaacttgaagcaagccacagagagcctcctccagtaccttgagaaagagaaaaactctcacaaaaaggtgccgggcaaaacaaacgcgccttacagttcacatacatatattacactgtgagattgtggggggaaatatatcgtgctgtatctctctctgactcttgacatgcaagtaactcatcctccatcgtggtactcactccatttcgacaccgcgatcatgaaccaatcctcccccttggggcccatcttctctgcgtttacgaaacaaatttcccaggtatcaatg

SEQ ID NO: 1221 - DNA, 703 bp, Nannochloropsis_gaditana
gctctctggagaagaaagtgcatgccgacccctcatgcgctaaaaagcagcccagtacgccagaaatgccagagatattaacgagaaggacctatacatatttcgtacaattgcggaggccatacgagacaccccctttcagtcgccagggaacagtcccatcctgcagcctcgctagtcctgctccggcagtcgcccccggcacgacaaacaccactccctcgcctccccctcgaaacgggcaagaggcggaaagtgagacagacattgacccgagtttccgcttcaaaccgtaccatactcacaggaagggcatgcgtgtctcatgaacttcaatttcattcacggattcctgccctttgtcgcgttttctaacttcaactagtcggtactggcagccccgtgtgcatcgtcaagtttaggagcgacgacagaatggacctcgcatgcttttcttcaggcgtgtcctaccgttgcatttcaatggattgaatattgaatacattatagcaaagtttgtccttcaggtcgatggcgagtgcgcgttcctaccgcttcatcgtccatcccggtcgcacttccgccgttctggccatctctttgctaggtatggccttgctaatagcgacttcgcggacgcatggtctcccagtcagcacagcgaccacactcgtgaacgccacaaagaatattagcctccatg

SEQ ID NO: 1222 - DNA, 703 bp, Nannochloropsis_gaditana
ctacatgcttcccgtcaggtccaagcacataagacatggttctccgccgcttttttgaccgagtgcgcgccgccacagccacgacagcccctgccgccaggaggacgaagagagtcgtctgccaagagcctcctcccgtcccgcgcctgccgctgccaacccccccaccggcttgcactgcagaggctgtcattgagccacctctttgagatgcggggtggttgtcaggcaaaaaacgagtagcggacgaaagggtgaccgtactcagcgagcgccggagcccgaccgaggtcggaggagactccctgtccctcacagcccccggcacacgaccattttttatgcccgtgctaaccgtattcaccctcgattaccaccacttctcttcttctctcatactaccttccggtactcgcgtcctctctgcactgccctggcagcccctggtgctctcaagtcaacgcatcaacggtgctcaacactctacaagctttagatttattcgaccaattttgagcgtcgcgcagcagcactggaagatttgcagcgcggtattacaaaagcaaaagcaaggtcacgagtttgactcccgacttgctcctctatatcattacttgacgatatcacgtcacaacagccattacgtgacgtttcagaaagtgcacaacagcttggaggcttaacgagttgacgaccaagcatg

SEQ ID NO: 1223 - DNA, 703 bp, Nannochloropsis_gaditana
ttataaagtacacctttcggaagatagatcccaagcgtgttgattccttaattctttaatttccccaaagaggtaacatttattttgttttactgggcacgttttgatctatgtaaaatcgccaaagcctgtgcgcgttgaaaatgctctcagttaccgacgagtcaagatcaaaatttgttatcgaatcatggatttctctgttcatattctacctaaatttcatagaggggaagttataaagtctgtgggagcgtagaggggaaaatgtcccgttgccttctttcatcagctaggtctgcattgcttccactgacgcgcccaaagcatgcatggctcatcattggtgtatacctcgcgatggtagcaagcatgtgggcggagaaaaggcgcagtctcgcagcctgcacggccaacatggggtacagggaccggaattgcttgtgggagtgttcgaagggcggcgtggcgcgaagatactcggcgagggagactctcccctggagagacctgtgtgctgggagtgcggaggacgtgcacctcgcggcgtcgtcagacccttttgtgttgtcatgtgcccagttgctatgtagactaccgccttttcacccccttttggcatattcctcttacttgacttcacaggtggggtcaagtaggattcataacagtagcatcctttgaaggttcttcggaaaccatg

SEQ ID NO: 1224 - DNA, 703 bp, Nannochloropsis_gaditana
tgtcatgtcgcctgaagtgggtgcatccgtttgccggttaggcgaggaggaacaagtaaggcgcaaggggccttgcttaccaagtagtaggaggtactaactactcggagtatgtaaaaaatgggttgtcagttgtaagaggtagaatgatgtttcttgatctgagggtagatcgaatcagcgataagacagtatgcgtcatcggccactgtgccatcaggggagtcaggggagaatccctagagatcatattgcaaggtgataactatatctttctcttccttgcgggtaccgtcaaaaatgataaactactatactaatactgggacggatggcaacagagggtgggacttttgccaatggcttgaacgacctgctggtctatcagccgacgactgcgcgctacctgatgaagaaacaagcacgagagagcctcttgcacagttcttgtcctttgatctctgaatttcacacaaaaatcacatgggaatgaacaacactttccggggtcatgtcccttattctctgacatcacgctgagcgttcggtaaaggagggcagacccacgttttaacaagtaggctatggcccaatcgatcgctgcctcgactcttcgatcttaaaacgcgaattttgcatacggcagaaagggacgaagacggaggacaaggaggctacgagacacatccataggaaaagtatg

SEQ ID NO: 1225 - DNA, 703 bp, Nannochloropsis_gaditana
atgcacgtgatattctgtgcaccctataggcgaatagcacatttcctttaaaacagtgtgagcgagaatactgaggtacataccatatgtacatacgagcaaaaagagaaaattcatacagcgactaatgtaggaatcccacgggacagccttgctgtggtcccttgtttgtgcatttgttggtgaaatgttgaaattattttactagaacgctgaaaaccaacaacgctggatctgtcttcatccatgtacactgggaaaatatttgcttcacaggggagaaataatcgaagactcaaaatgtacaaaataaatccctcattcgacctgggccctcgagcgaggcccaagatgcgtgcatgttgcagtaatgcacgggcttggcgtcttccgagaggctggggaggttaacgttcttcgtggcaggggcttagcgcctgaggagtgagggggtcggggcagccttgccgttttgataatgagtggccacgtaagatgcgaagggttgaaagtaggatagtcatagagctgtataaggtaatggaggtggcaatgagaagtgggtttgctcttctagctaatgctgaagccggaaaagtatctgatggccatgccgtatttactgctaccagacctttctcctgtcgcaggctgctccgacacaaaataatcaattcattgaattcaaaggcaacgcgtaatg

SEQ ID NO: 1226 - DNA, 703 bp, Nannochloropsis_gaditana
tagtatggacatctgatatgcgagcagcgaggacggacaaggaagaatgaaaaagacaatgagatccagccaaatagccccccaggcaccaaacgaatgcaaaataatattaagtcttaaaagacagaaacataactttgttcacatttcgaatcagttcgggcattatggaatatgtagtaagttttccctgagtaaccctaaaagggatacgggctttcctttgaaactgaagatgcacgaaatattccgatggaaggaagacagcagcatcaaatgggcgtagaataatttttcttgcggatttaggggtacaataggttataagaggacttaaaagtggtgtaagagcctctagttggggcggattgggagtcgacgcagccagcatcagacgcccgggattgagaaaggattatacatgcatacccaactacaatacatagggagccctagcttcttattaatatacagtacactttaatccaccgtgagagcataaatgaagtcggggcacttaatcgcacttcctagcgcggtatcgactagaaggggccgggaggttaatcttgacgctcgccactcctgctagcggcgatggcacgcttcaagtcaacgtatcgcgtcaaaagctgaaaatcagcaccatattatgctagctcaatgctcattttggtaatgtcttgacagacatcctgtgatg

SEQ ID NO: 1227 - DNA, 703 bp, Nannochloropsis_gaditana
actgatgttaagaggacgtagacctgaaataccggtacatacgtgagaacaaaaagagacttgagagatatgtagggactgtgacttctattgatcttcctccacagaggaggcgcatgagcgagcgaccagagagaggggcgatgacacgctacccacagcgaaagggggggcaggcgaggctggaaggagtgcctttgagtgaatttatcgctcgctgtgacattttgcttcgtccagtgggattgaagagggatttccaattagtggggccgattactcgatttctcttaaaccgccaaaatatcggcagagagcttggtagcgcaccctgagtgccagtgtcatcttgaagcgttgcgtccaccgtgccccaagggaattgagctcgatgaatggtatagaataatatctcacgctcatgcgcacaggtgttgtcatggtcgacacgcctacgaccactcgcacttcctccctcccgtcctcccccccttcctcctcccaacaaacctccccggcactacttcctccttctcctcccccctctgcccaccgaccagagaatacgatcgtgatacccgcagatccattacaaacacccgtagcgctatattctgagcatcatccaggggcaagtgtggagtctgcccgagggaagccaggcgggggttggggcctggacactgcaagcagcggggtcatg

SEQ ID NO: 1228 - DNA, 703 bp, Nannochloropsis_gaditana
atgaggacaatcgaccccaacatgcatagcgtatttgatccccaaaaaccggcaatgaatacgtactcagcagcacagcagaggtagagtgcttggctaggaatcttgtcggcgctcacgtggacctcctcgcgtatcgactaatatcgcgctcgcactccgggggggaaaccttatgatgttttaggcccccggatggtgggggacacgagcgcgaacagaaagaagcccggccgggtcctgcacgttgaaaccggctgcgattatcttgagatggcgcaggaccttgacagcatgcaagagagtgtgcttttccttcgcttgtatcatctactatcaggctttgtagaaggccaaacctataaagtcgtggacctgtaaaagcccttatgcgcccaagtgccacctctttagaagtcgccctgcgtgatcatggtctcgccttcacttttcgcttccttgcatggggatgctcatttgtctcccacgtcaacaaacttctccgcgcgtgacttggttccgcgtggataatacacaggcacgcacaatacgagtgcactgtagtgtcggcccaacaattgtagggaacgacaggtgtcacttcgtgtggagaaggtgagcactacgggcaacgctttgcactctgctttgcggtcagcaccacgctgacagtgtagagacggcttcaatagccgtgattatg

SEQ ID NO: 1229 - DNA, 703 bp, Nannochloropsis_gaditana
tattccggagttggtgaatcggttcagccagttaatcgctactgttagacttatcatgagtctaaatggggtgataggagcagaagaaatcgacaagaggtttggcagcgggcatcaacccaggtctccagctagagatgatcaggccgaagacagaattcagaaaagaaggcttcatgtaattgatggtgctagccacgcaattcgcaccgaaccagtgacacagaccaaaggacgattgagcttccgcgagcaagaagttgtaattccattttgccattccattagcgcagctgcgggagaaagcagttccgcagcagctgttggatggttaaatgaagcccactcacatggtatggactgcggatgcacagcggagaaagaaattacatctgatgccgaagacacaacggcaaggacgtcaaataaaaatcgtaagtctcttgtgcaaaaagctctccatagtatgataagaggtggttcatttcgtaccgactataccggtcagcgctccctgtcgaatacaataaatataagcgcacatacaaaattggatatgtctttgttccagaccaaaagaaatggatcctgggcggcccgtggtgtgacagtagctacggataacctcagctataaggtgggggggaggataaatatttatccgctaaatagcctttttggatgcttgcgcatgtcacggatg

SEQ ID NO: 1230 - DNA, 703 bp, Nannochloropsis_gaditana
agctgggggtacacatagataggctccgaatcacctccattcttgggtgtacccgttctgatgcgtgtggcaatacttgtgtctcagggaggatattcgaggcggaaagtaggctcaagaaaagagccggatgggatgcgtaagcaatcaaagaagtgggcgatgcacatagcaccgattagacgcacaaattcctcacaccaagagagaaacaaaaaagtgatcctctagcaacgaatctgttgcgaccgtagcggtgatgagctaacacgaggctttcacctctgtagccttcctcatgcgtgagggacagcacatgcagcttaggcgccgcgtagtgccccggcactttacaggtgctttactttcacatgtatccgtagaaagggccgactaaacagaagcaatgcaatccttatttcacttagctttggccatttactcgagaatctccaagttgtcaatcttccgtttctttcctttgtttcttttcccccgctgggggcgccaccttcccgtgagcatcgccagactcgcttctgctccacatcgccccatcgcaagcagaagacaccatcaaactgcgtgccgtttagaacctgcgcagagggtcacaattcacgagcaatttaacgttcatcctcttcacaaatagcacaggaacgcctgtcgtgacccgagattgttaaaacagtccagcatg

SEQ ID NO: 1231 - DNA, 703 bp, Nannochloropsis_gaditana
acagctcaaacgtctgagtattgcagtagagattatgaatatgcccagtctcatattcttggacgagcctacaagtggtctcgactcagtcatggctcacgatgtaatgacattcaccaatcgattggcagaccaaaaccgcaccatcctggccacgatccatcaaccttctagcgaaacctatgctctcgccagcaaggtgatcttggtaagtgctggaaggataatgttttgcggaccagctaatgaggcacaatcgtacttcatatcccttggtttttcggctcaaatgtttggtaatcctgctgatttcatcatcgctgttgtcagtggggcagagccgtcaagttcatcgactacgggaacaaaagataccgatgccaaaagcctgagtgacctctatgaagcatcaaagtattttcaagtacctgctactcgatcacaaatccattctggtgcgcgaaacattggttctcaaccgcacgcctttccaaccagtgttaccagtcaaacatatacacttgtaaatcgattttggatcgcgcaaagccgacagtgggagtttgttgttgcacaactggggaagaatgtggttgtggcttcaatatgcggggcaatttttttcgggcaaggccgagagaaaagcctttcaacttttagcaatgtcagttttaatgtgagctctctttggtacttcgcaatg

SEQ ID NO: 1232 - DNA, 703 bp, Nannochloropsis_gaditana
ggtgctcgcatcagagacagacatcttcaggtaattccggaggtcagggagaggtaggaggttgacatttttcctcattgattgctttgcttataacccatcagttttgatgccagctgcttccatgaagcagcactgaacgcatttatggcgcagccccgagctgtttggacgtctgcacgtgctgcaattcggcaggtgctttcaaagggagagcccctgctccaagaagacgctgctttgcgtgcgcgaactcttttgccattccacaacgtgaaaatgcatttaccagcgcgcataggagactacacggacttttactcatcgcgggagcatgctacgaacgtaggcattatgttcagaggcaaagaaaatgccctgcagcctaattggctccatctcccagtaggctaccatgggcgagcttcaagcgtcgtcatctcgggcactccagttattcgtcctcaaggacagctacaggctgattctatagatgatgtacgtgtgtaatgcatgaggtggtagggacatatgcgaggtctaaacattttggaggggtgaatgcgtcttccttccgcatcttcccgctgacggtttattcttccatgtcgttcgtcacatttccccctacaaaaataactgcccatacaaacagaaaaaaggctcaatatacggcccctcgcggctgcttgacttcgaaatg

SEQ ID NO: 1233 - DNA, 703 bp, Nannochloropsis_gaditana
tccgtatacgaggcacgaaatttgccgaactgctggtcaatcaaatgccccaagttttcaaactctgtcccggacaaaaaatcgtcaatagcataaacgtgcggattacgatgcaacaatttaagcagtcgattgtttagtcggatgtctcccgcgttccggctgaaaaaaaggcgtttgatctggaaaggcaaaatgctgtaggagcgagcagcttctgaacgacgcccacgtgttgcagccttgtgttttgagaaaaggttctcatctagtacgccattatcgtgtaaagcttcttttagtttcacttgagctgtgggcggaaatagatcttcatatttacgttgcaaggccgttgaaaaagatgcctctccggaagcagggatgggttggagatgctgaggtctcggtgaatcgatttcttggcttgagtttttcatggacactttatgtcgcaagagtgtatgcagacctttgtccttgtctatggggatgaaacgagtggcgaggatgacagtgagacggcgttcaggaggggtggacggctagtcaacctccccacgccctggtctctcctctcagccctagagccgccctctcggcgaggcaatgaactcctccagcggactcacgtgcttcatctcgacatttgcacatcagacgacacactcaaaatactgtcagtacctggagccgacatatg

SEQ ID NO: 1234 - DNA, 703 bp, Nannochloropsis_gaditana
gaaataggccggtttacaatcacgcgacgtgcttcaagtccctcgttagtgacgaggcgggcgcttgcactgctcaataaggacaaggccgtgcttgtctcccgtagattccttttattatcacgacaaacacatagaatggacacttcacagcacaggacgcctttgggcatggaggcggccgataaaaatgcaccgtcctcctaagtcgatgcgcccacccgctgcattcctcctccccgtcctcctccacgcctgtttgaacattccccatgtcactgccgatgacattatcacgatccgggttccgaccatgggtttggaaatacaagggctttcaagcaaatgcggttctgatcaattttggggcattccatacgcccaaaggcccgtcgagcgctggaagcgggggcaaccctcgtgggcggagccctccacgatgcctgaaggcttcgcacaatttgacgcaagcgggcacatgccgcaggagcgctgccctcagctatgcgatggcgttgtagtgggctcggaggactgtctcctgctgaacgtctttcggcctgcctctccggggagcccgatgcccgtgatggtctttatccacggcggctcctttactgaaggaggcatcgactcccctctcttagatggcagctccctcgcggcggaagagggcatcgtgattgtcactatcaattaccga

SEQ ID NO: 1235 - DNA, 703 bp, Nannochloropsis_gaditana
cttttgaagaatattattttgtgtgcgcgcgccacctctctctgtgtttctcaaggaggtaggcaagcatactgctgggaacttggcacgaggcatcttctctgagaggtcatttatttccggcatcaaccttcatgtctgccttgaagccgtagatgactatcccactttaatgctgctattaaaagcagtaacgctcgatactttaaggcgtcatggtgaagaggacggggagggcccgaaggcgtaatgaatagtttgcgagcgacgcaaaggagtccatgaccttgatgtgcggcgtcttagcctttcaaatcacacgacgtcttagccttgaaaaccaaacgagcagaagtgacaaacctgttcgatgtcgaataatctctatcatactcggtgcccatgtattcgcgcatggccggagggacggtcgcgttggtttacgttcctactcgagatgccgcccgcgctcgccctgctctcctgttggaccctgcgtgatggcgtccagccctgtctccacatactacactgtgccccgcccatagaaacaacatttaggccacatgggtggaccatgaccagaacaatgccctggcttgcgaagcaggtaatggtccaactataacatgccattaacgcgactctaacgcgacactgaataatacgcaataggaacccattcgccttcaagcaccccatg

SEQ ID NO: 1236 - DNA, 703 bp, Nannochloropsis_gaditana
ccacaatgtggaaatgagcaggtcccaagcgttgaaagcgcccggcgaaattattcacacgggctaatgcctacgcgcagaaaaagaagcacgagaaaaacccgctgaaaactccgtgcggcactcctccttactatctccctggcggagtcccccgccatgtccgatggcgccaagaagatgcagacaccgaatccaaatccgaggcgatgatcttggcaggatgaccatacaggcccgtagtcgcagagcttcgaacctcgtggaaaggcgactagggaacgtgacggagaggatgaccattaatgccaacgatgtcacacggcccttgtttcttcctggtcatcgtcgctactagctgggggcggaaaatggaaagcgcgcgccgggaaggaaacgtaatgattcccacgtaaacatgaaagtggcggtatttggcctgcgttattgcctttattgtgtgatggtattgtgcctgatggtcaaagaacgatggatgcaccgtggagctccggtcattcctgggaggacaacaaattgcccggtggagtccccgatatcatcacaccatgagacatgtaattctcaccgtcgcacaccctaatgcacaattataatcgtcatcctttgtcggacagactcgtgacagctttatacgtggcagtcgcgtcggttccgtctttttccggtcctctttatcatg

SEQ ID NO: 1237 - DNA, 703 bp, Nannochloropsis_gaditana
gcgcctggcgctgcttctggtcgccgacttcttcctcaccaaccagctgcggactgagctgcaggcgctctaccttcacctccttgtcgacgcccacttcaaacccgccctggcccgctccctcacacgctgctacgcgctcctcaacagcctctactcccgtggcgtgggcacgcaggacgacagtcttttctcattctccgtccagctctacaccactcccagcattgtccgctggctcgccacctccacggaggacgaggagctgctcggctcgccgggcctgatgcgcgtgctcaccgaggccctgctcgcggccttccggctggcgggctggtgcgacggacagcccctgtctcagggcttctgggagaaccccctgctacagcatcgacgctacgcgcacttattgcgagacatggactacgccctgcagacggaggggaccgcggctggcgtcctccggcaggcttacccggggcccgggccacggcctctgcgggcgtgggtggaggcgctgagcatgatgcagcacgccgaccctatggtgcggaagacgggcacacatttggaattcgagtcttcggtgtggatgcaagcctttactctgagcttccccctctactcgacgtccaccacgcttatcgcacatggactccgcgcgctccttgacgcagcgcctccctctccttcccctcccggt

SEQ ID NO: 1238 - DNA, 703 bp, Nannochloropsis_gaditana
gaagaggaatatgacagccgacgcacaacgacacatatggccatgagcatggcatcccatagtatagggcgatctgctggcgttaagatcggctctggaggcgtgtcacgctacagcaacggtagcagcggcggcagtccaggcagtccgggtctgttacaattcaagccagcccgcgagcgaccccagcaagacccacattcctccttctccttgctccccatggaaacgactcaccgtcggttgctctcctcgcccctcaaggcgaagcgaaaagtcagcaaaaccccgttcaaggtcctggatgcgccagctctccaagacgacttctacctgaacctcgtcgactggtcctccatgaatgtgctagcagtcgggctgggcacatgcgtttacctgtggagtgcctgcacgagtacggtgacgaagctttgcgacttgggaggagaagatgcggtctcctcggtcgcctgggctccgcaagggtcgcacttagctgtggggacgagcacgggagaggtccaagtctgggatgtagaccgctgccagcagcttcgcagccttggaggccactcggcgcgcgtaggaacgatgtcctggaacggacagctgctggcgacaggaagcagagaccgtctaatttgtatgcgtgacctccgagctcgagagccgcgcatcaagaagctgcatggtcatcgtcaag

SEQ ID NO: 1239 - DNA, 703 bp, Nannochloropsis_gaditana
atttggaattcgagtcttcggtgtggatgcaagcctttactctgagcttccccctctactcgacgtccaccacgcttatcgcacatggactccgcgcgctccttgacgcagcgcctccctctccttcccctcccggtcacagagtgacagtgagagagaaagaagggggcgaaactggggacgcggactggtcggaccgtcttttacgctttcggaacgtcacggaagcagcagttgagggcattcgggcctggatgaccagggccctgaaggggggcgaggacgcctacgcgatgaaggtggagggataccgcgaggctgggacgggacttattctggaaaggcctgggatcggggtccgcgtgcacgaggcttgcgtctctttccatatcccgttgcatcggttcctggcggccgctgtcttagaaggggctgcccaagggtttccttttcccactcatgtgggtgcccagcccgcattcgaagacccttcttcccccgctttaaaagacgcaccgcacctttcatcctgcttggcagattttccattgcgttgtctcgcgttgagtgcccaaatagcagcaggattgtggcgacgaaacgggctctcagtgcaggcctcctctatccattacaccacgccgcctttctgccgcgttttccgagacctggacctggctgctatccagttggcgatcttgtt

SEQ ID NO: 1240 - DNA, 703 bp, Nannochloropsis_gaditana
cctggatgcgccagctctccaagacgacttctacctgaacctcgtcgactggtcctccatgaatgtgctagcagtcgggctgggcacatgcgtttacctgtggagtgcctgcacgagtacggtgacgaagctttgcgacttgggaggagaagatgcggtctcctcggtcgcctgggctccgcaagggtcgcacttagctgtggggacgagcacgggagaggtccaagtctgggatgtagaccgctgccagcagcttcgcagccttggaggccactcggcgcgcgtaggaacgatgtcctggaacggacagctgctggcgacaggaagcagagaccgtctaatttgtatgcgtgacctccgagctcgagagccgcgcatcaagaagctgcatggtcatcgtcaagaggtgtgtggccttaggtggtcctttgacgaatgtcatctcgcgtcaggtgggaacgacaacaagctctacgtgtggaaccaacacagcagccaaccgatccagaagttcgccgcgcacaccgctgctgtcaaggcattggcttggtctccccaccaaagcggtttattggcatcaggaggaggcacggccgatcgacatattcgtttttggaacactcttacgggcaaggcaatgagcgaagtggacaccggctctcaggtctgcaacttgatgtggtctagaaatgtgaacgagatc

SEQ ID NO: 1241 - DNA, 703 bp, Nannochloropsis_gaditana
gtttacctgtggagtgcctgcacgagtacggtgacgaagctttgcgacttgggaggagaagatgcggtctcctcggtcgcctgggctccgcaagggtcgcacttagctgtggggacgagcacgggagaggtccaagtctgggatgtagaccgctgccagcagcttcgcagccttggaggccactcggcgcgcgtaggaacgatgtcctggaacggacagctgctggcgacaggaagcagagaccgtctaatttgtatgcgtgacctccgagctcgagagccgcgcatcaagaagctgcatggtcatcgtcaagaggtgtgtggccttaggtggtcctttgacgaatgtcatctcgcgtcaggtgggaacgacaacaagctctacgtgtggaaccaacacagcagccaaccgatccagaagttcgccgcgcacaccgctgctgtcaaggcattggcttggtctccccaccaaagcggtttattggcatcaggaggaggcacggccgatcgacatattcgtttttggaacactcttacgggcaaggcaatgagcgaagtggacaccggctctcaggtctgcaacttgatgtggtctagaaatgtgaacgagatcgtgagcacgcacggatactccttgaatcagatcattctgtggaaatacccgagtatggccaaggttgccactctcacggggcatacatttc

SEQ ID NO: 1242 - DNA, 703 bp, Nannochloropsis_gaditana
gaacgcctttcccggggccaagaacacgggtaactcactcggaaccagcctcttgtttcctgtaggtcatgatattcgatgatgtatttcgcaaataatgccaaactcaatttaaaaaaatgtagagaaaccttttgcctatcctacatgtacgcctgtgattgcatttgaaaaagcctagaaagcatcaaagatttccaattaatgtagaattgtacatgatttggacaataaagatgaatcacacaaagtaaaacttgatttgcgatgtcgtgatctgttttaaagatgattcctgcacacttcgtttgctgcttcacctggggcttatcaatacaatatgacgtcacgtgaaggagagcaatcttgccggtcagacacggcgttggtgcagcccgctaaggccttatgtttcgactttcggggtaggcaagagaggtcaaaaggatattacggcgcttgggattgacatgaaggcagactcctcccgacgtttttctgacttctcgcagggagcaaagttttcgcctcttctgaacgcggggagtatcttcaatcatcaccagacaatgccattactacgtctgtccggtctgtctttcttatcgattggcacaactttaatcctcaattacaaaccttactaatcattcttcatcttcataccctttttacgcacaccgaattactatgcaggaaaatg

SEQ ID NO: 1243 - DNA, 703 bp, Nannochloropsis_gaditana
ggtacatttttttccaaagtgttcgactcggcgcaattgtcagatccgtcgctggcaaactttattttgagaatccacctacactcagtcccagcatctcgcatgccatcggcccatcgcggcacgggcaggagcttgtcgtttcctcttggcgatggcctctttgccccggacgccgtggttcaatatcttcactgcactgtactacacaagttcatcgcgtgtacctcaactacactacagaattactatggagcgcgtgttgaagcagaaagtgcgcaaaatggtggagtgccgtactgacacgccggccatgcttgaggccttgcaggctatcgccgccttttatgggcagcgggaggggggaaacactgccgaggcccgcaaatccctccgtcaagacttggaaaagcaaaacatggtgttgtgtgatgatttcttgagactcttcgaagtcctcaaggaacgcttggctgctttggatgcgcacaccgccagattggaagaccactgccacggcatccatgcacgaattgagacagcggaggaaagcatgagcgccttcttagccaagacacgagtcttacaaaaacagcaagtcgagtgtgagagcaaagcagtacagcttcaggattttctggacaactttacgttgtcggacgctgaaattgcggcgttgcgatatgaagctgtagaaaaagtg

SEQ ID NO: 1244 - DNA, 703 bp, Nannochloropsis_gaditana
ctgccgaggcccgcaaatccctccgtcaagacttggaaaagcaaaacatggtgttgtgtgatgatttcttgagactcttcgaagtcctcaaggaacgcttggctgctttggatgcgcacaccgccagattggaagaccactgccacggcatccatgcacgaattgagacagcggaggaaagcatgagcgccttcttagccaagacacgagtcttacaaaaacagcaagtcgagtgtgagagcaaagcagtacagcttcaggattttctggacaactttacgttgtcggacgctgaaattgcggcgttgcgatatgaagctgtagaaaaagtgctgcctgacgggcatcgtccattttttgctgcactggcacgcgcgcaagagatccggggggaatgtggagcattggtgggttcttcacgacaaaacctgggatttgagatgctggaagaactgtctgagcatcaagaaacagcattcaggcgcttgcactcttacatcttgcagcgttgcgcgggattggagcgagatgaccctcaggaggaggtggaggaaaacgatgtggccttggggttgggactgcggacgatacgggaccggcccgcactatttgttcactgccaggagtgtgtgttgcaacgccgcaaggacgtggtgcgacgccgcttcctgcaagccctgtctggtagggatgagggggcgga

SEQ ID NO: 1245 - DNA, 703 bp, Nannochloropsis_gaditana
gagagcaaagcagtacagcttcaggattttctggacaactttacgttgtcggacgctgaaattgcggcgttgcgatatgaagctgtagaaaaagtgctgcctgacgggcatcgtccattttttgctgcactggcacgcgcgcaagagatccggggggaatgtggagcattggtgggttcttcacgacaaaacctgggatttgagatgctggaagaactgtctgagcatcaagaaacagcattcaggcgcttgcactcttacatcttgcagcgttgcgcgggattggagcgagatgaccctcaggaggaggtggaggaaaacgatgtggccttggggttgggactgcggacgatacgggaccggcccgcactatttgttcactgccaggagtgtgtgttgcaacgccgcaaggacgtggtgcgacgccgcttcctgcaagccctgtctggtagggatgagggggcggaggatggcgacgtcagggaggagaaaggcaaaaggagcatgagtggcagcgggcagcggccaatcgacatgcattcgcatgaccctgtccgctacttaagcgatatactagcctggctccatcaagcggtggcctcagagcgagagtttttgaccaatctgttcaggccggaggcgcccggggggtcgggggggcagggagagcggccgttgccgggcgagggcgtgccgactgatg

SEQ ID NO: 1246 - DNA, 703 bp, Nannochloropsis_gaditana
atggtcaggaaagtggcaccctcgaggatcacaatcaggagctgtcccaggcggcgatgctggggggaatcatggagggtgtggtcgccctgctcaaagcccgcatcctccagctcttggagcccgccgactcgtacggcgtcacaaaccgggagagcaacgccacccgttcccagattttcctcctcttccggctcctccatcttctggctttctacgacgtcacttttcagaagctcgggctgactgcagacgcctccgcgctgggcaagagcatgcgggagacccgcgtagaatgccagcgtcgattcgaggggcgcctcgaggcctggggaagccagagcttgatgtccgtgcccgcttgtccgatcgatctatctcccgcccaagtcatgggggagttggggcagtcattggcagaaatcgtcgctgtgcacgaagcttccctcgtcccgcccggggccctcgggtacgccctcgacgaggtcttgaccgcgctcatcgagcccgccttgcgcgcctgtcgctctggggcggagggcctcggcccatccgatgtggccctctacatgatcaacaacgcagcgattctctctgctagcctgaccagtggcagcgaccctccctccccagcggtcacggcgtgggtggaaaaattgcgtgaagagatggaaacctggctcggactcgtagtcaggtacga

SEQ ID NO: 1247 - DNA, 703 bp, Nannochloropsis_gaditana
attagatgtcgctaaatcggttgaaatagatagatgctggccacacagtttcaagagagacaccacagacaagtattgtttcctggagagcagctagctgctcactaggtcatgtacatacacctgggcaggaagaggtcgtaaagaataggctctcacgcatgttgatccttcataaacggatagacgattgtgtaaaagcagcagatgtggaacttacagacactaaaagttgaaaatgggcaccttttttgctatgcccttatataagccgctctgggcccatagcacaggtttagagtcctgtattttccttatttgtgagagacgagtttaggacctatggctggaccttgcaaacctcagcctgagcaattccggcacaaggaacattttcgttccttttataacatggcattggcctaccctccatataaacatgcgagttggggggaaatagcctgaaatctgcgtcaatgaaagcctcgacctggcatagatgaaagccggcaagaaacgttgggaacgtaagactcgacgtttccgccgcgggcttgacacgtcgtgtgagcgagcagagacacaatcaattatacctcttctattggctaacgattggttgacatcttccacacaacaaaggtctaccaacaaggaagtacaggattgttgaagacaaacaacgcaactcgatgggggaatg

SEQ ID NO: 1248 - DNA, 703 bp, Nannochloropsis_gaditana
ccttcgcgcgggccaccaaatcgaaggcaggtctggtcttagctctctcgtacttgacatgccgctttttgttagctgggccgccgccgtccccgtgaagcttactgtcgtttccgcccgcacgtaaacgcttttgctgcccttgttgcatcttttcatcagatttctttacatctttgctatgaacgcttttgtatttcccttttggggcacgactggtgctttttgcatgcgcagggacagtatcttgcatgcttgcgatcgaggggccaggtggatgaccctgtcaaaaactctactaattcccacctgtcagccacgtaacctgctcgtgacgaaacaataacaacgtgaatgccaccaaatcaaagctctgaattgattaatgcagaagaaagcttgacacagaaagaggcgattttggtcctgaccgctgggagccgtttcccccgacgagaagccattgccctatacccgacctccctccctttcttgttgacagagatgaaaaatccgcccagccaggccgcccaggtggcattgcgcagcgtcattgccgtcgctttcgagcgcttttctctttttgcgaggacacagacaaggtctcgtgcattcgagagacttagttgtttgtaatttgtggcagattcatgcaaagtatccccctcatattctctctcacctttcctcgtacagcttcatg

SEQ ID NO: 1249 - DNA, 703 bp, Nannochloropsis_gaditana
gcggacagtttctaaggctccactgggtatatgctgtgtttccatcatggcccggctccgccgaagtgaagcaaacaggcagaggttacgcaagggacgctgcctccgctgccaatgggtacctctttccattctttcttctgtgggattctttcgatgaatagcttccctttacagagactaaaatgggtttaaaacgtgttaattaagaaaagtcagggcgccgagaacgcattccgttccgagcctcagccagcagagggctttaattacactccgtagtttgccggtgtcccccgcaaacctgagctcagacaggagtttctgcttgcttttagtcttatcctgctagatctagtaaaattggtgttgaaaagccgcgggacagagatcctgaacccgaaaccctctcaatcatttcctgaaaagctttccgttccgacccgccgcaagccagcccccgaccatccgcccggaagaacaatatcgaaatttggcacccgttgcggcgcacactgcggcataaaaaaaaagtctcgcggggggtggttccacttcacataattgttgtcatggatattctcccaagcatgtccccgaaggatagcagcaatctctgaccggtacactgacaaattcgcctccccgtcaaattccctcctgcctccctgtcggacctacagaaaaagaggaagtcaacatg

SEQ ID NO: 1250 - DNA, 703 bp, Nannochloropsis_gaditana
gaattgttctacgtgccgtatgcgcccgtccatgaatatgctagacggttgcgtggcaagcccccaatcctcgagcacccccctcaacgctaagacctttcactgcccgccacgtgactctccatgcccgtacaaacggccctccaccctttcaaaccaacaatcttacctcggccgtgctaaaattgcccatggtgaaggaacttcccgacacgtgcacgacctgcccaaactctgcctcagcccgcactttgaggtggacgatgctgtactgcgacgacatggctgatatcgaacagcgtgtgcccaagggcagacagcacgggacactgacactcgcctgtacaaagcccagagcgcatgtgtgtacaggacgagaagtgtgagaagcgatgcgcaggaatggattcaaagtgtcctggagagggaaagcaccttcttggcggtcgactcgctagacgcgatgcaggcgtcggctcaccccgaattacaagggggggcacgcacgattgatggggacaacactcacgtataatacatacgttcataagtaggcaccccattactgtcgcaataactgcgatactggcacgaccatctccttggagccgccttgacttgtcgtcccgctcgtgtccccgtatagccgcggtgtgatcccttccctcctccctcattggcaccgcaaccagagagcgccatg

SEQ ID NO: 1251 - DNA, 703 bp, Nannochloropsis_gaditana
gctgcgggcaacagcaacaatacaggcagcagcaacattgtacagaatctcatcaataacagccgcccgtcggtacctcctcgtgacaacacacccctgcttggcattggggccacggaggcctctctgaaatcggacgggagcggaggaggacacgggagtggagagatagcccggaccaatggggtgggctggcgggtgcatttgaagggcaccgcctggctcgtaggcgtggcggtggtagtggccttgggtctttttggtgtgctggccttgcggcgatcgcgcggccacgaccctgtgccttttgcccacgtctcccatcctttgcagcctacggccctgtggggtgcggtgcgaaaaccttatccgacaggggcctggtggacgaacttggttttgaacaagggagacaacaacgtggcggtcctcccgtacgcggtcaaagccactgacacggagggccttcaggtgtcctactccgccttccggcatctgtccaccgccatggtcatcgcggatttgttcgccccggacatgtccctggccacggtcgaaaacgccacgacgcactacgtggaatcctacgaccctttgagcgtggggctggtctttcccactgtcctgcatttgcaagggaatcggccgtcgtactatcgtacccacttggtccgagggtgcccctatgtgaccgtggagtact

SEQ ID NO: 1252 - DNA, 703 bp, Nannochloropsis_gaditana
gagagtaaggccgctcagctccggcttttgcgaagttctcgtggcaactagcgtatctgtatccttgtttgacaagaagtaaaaggaaaacggcattgcgggggccgggcgggggtttagacaaatccattttcttgggagcagaagacacctctgcgcgttgcctcaaccatctcttcaagcagagcactatagcatctatcagacatgcaaacacaccgacatgcctgtaggacggggacacaccacgcagcacaagcatcctggatgttctcctttaaaagacgtccagtgaatgagcaatttccaagccatgtggtggggagttagctcttcacaggagttctgatgggatgggaatttttcgactgctgcaatggcgtggcaacccctctccttgaggtccgtcctacaagtggaacaagtcagcaaacaccgcacgatgcgccctccgtggtcatgtgcacgtttgggagcatgtccacaggcggtgtatgggttaaggcgatgggtgccacgtgctttgaggctcaggatttttctttttcaaagctttgtcctgcccgaccggcgcggaaggggaaataattgcacagtcataatgccggcgagacccaaaccgataaaacacgcggtgggaaagaaagaggacacaggcgcattacgcgatccctctcgatctttatacacattgtcccctagg

SEQ ID NO: 1253 - DNA, 703 bp, Nannochloropsis_gaditana
tttattggatgtgctttggtgcctcctcctttccctttctggaagtatcaaagccaaaagggcttccgtgatctcatcgtcgtcatcttcgtcatcacaaagtgatgagaaagaaagtgcgcgaattatggagtggatttacgaggttttcctctggtcattgccgacaagttgattattgcgcttaactttcttctcagtctccaccaatactacttgttagtcatttatcattcatttcatgccccatggatgtcgcgcaggcttccatactacgtgtttcccgtgctatttccttccatctacttttggcgcgaaagttctgtgacccatgtccaaacccgtcactgctttcccccccgtgtggaaaacctgtatgtgattattgtattcccccgcatttcgacgcatttgccggaatttgaggcctagctttcctcatttatattttagcagtcttgttcatttctactcttttcgactttgctgcttcccaggactccgactacacgcacaagctcccggctccgttatcgtcttcaacaccacgtgcatcttagctaagcaactcagcatcgtcacgatgaaacgcgactgttgcatcgtactagttctcgtatcgattctgagccttatccctgcagatgcttttctggtgcctgcgtctccgttacggacgcaagcttctagtctactgaccatg

SEQ ID NO: 1254 - DNA, 703 bp, Nannochloropsis_gaditana
aattgcttattttgcaccacatccactgaatgggtcacatctactggtacgcacgagatggcaggttgatgccaactagacctgctcttaattttgcacatcatttttcatgtcgaacgcattgcaatacgcccttaattcgaagcacaggggttgatttttacaaagggcatcctctaagataactccgaggaaaaagccgatacggcaaacaagggggggtgcgtggattgtgacgataggagcaccactttcacgtctgtacccctctcagcgatcttccggtgtatgtagcctccgatacttccacgatgcatgctcatttctttacttaggcctttgcattgagtaactgggtatacatggcaaatatggactgtgtaaggcatgtacggatactaaatcttggagcgcgtcccacgggactggtcctcgctaatccgtcaacaactgaccacaggaaccccaattaacaggtgaccgtgtctggataaaaggcgaaaggccgaccaacttcctgcacagtctcaaatttgtagtcgagcatcgactgtccccctcaaaggaagtagcggaacccagggactcaaataaaagcggaatagcagcgctcttggtggcggtagaaatagtcgagcaacgttcaaaaatatgtcagagacgtcttcctttggcatcctcatcgtaggcctagggggaaata

SEQ ID NO: 1255 - DNA, 703 bp, Nannochloropsis_gaditana
gagaggcagatttcttcttggttgaaggcgctggaagacatactcggggcagaggtcagcgactcatctaaaacaagaccatccgaacccaagcaaaggacggacaatgaagtttccaaagaagtcgtgaccgtcctaatcatgacaattatgttgtcgataccgtacgctattccattatttacgctttattattggcatgagttgcgtcgacacctgcaatatatatgacgagatatgatgaaatagggcctgagatacacaagcgtcgcacccaatgtgtcaacacttctccagagcagctgtaccaataaatggtcggctcattgggcgtatggagggtatggatggggaggtatcgtctttttctaactactagttgaaattcttggcgatgccacaacgctggatgtccgaaaaaggcagctgaagaaacgcacacatttctcactcttcggaagcgagcatgcaatgatgccctcggtctatcaatactcacttgctcaataattctgactgttttttatcaacaggccacaatgagggtcagaggcctcgagccgggtagctttttccaaggactcgtccttctcagtgccgcgagtcaggcaggcagaccttttgcccaatcgcctatctgccctctatcccgagaaaaatcacattttcctgccttttgttcaccttactcgtcgcagtcatg

SEQ ID NO: 1256 - DNA, 703 bp, Nannochloropsis_gaditana
aggaggagtcggtcgagggttgacaaggaaggggttggtcaaggacgtcgagggaggggggggcatgacagagccctgggtgggaggggtgctatgcgtgggcctgagctgcttggatttgatgctggtgggcgcgtccggagacggggagacctttggggccataaacacctttcaaacgcaggtgttttgcccgggcggcgcggcgccacaggtcctctgtggccttggcggacatgctggggatgggagggagggagggagggagggagggagagagggaatgcgcctttactacgtccatcgtccacgtcttgaccaaaatgggtcgggacgtgcacggagacgagctgctgcggcagttagaacaggcggggaccgacacatccctggtcatccgagacgctcagcattgcaccagtttggcggtgctgcccattttggcctcttcaggtgcccggggctgctttgtgaacctgcaggcgaacgattccttcaccccgggggaggccttggctgccctgagggagggagtgcgagcaggcgaggtccagggcgtggccgcgtttcactttgggtacccccacctgatgatcaatttccaaggtccagccttgcgcgattttttccaagcagcggcagaaattctagatggggccaatgggggggagaaggaggtgggaaggcgccccgcgaggagaag

SEQ ID NO: 1257 - DNA, 703 bp, Nannochloropsis_gaditana
atgataaacgagagctctttttttacatcgaaaactttatatattttccacaccaaaaaaaacatgaagcaaagctcgctattgcacgaacgttcgatttccccaaaacgcagtccatcaaatttcttgtttctttaacagtcagtgtaaagtcctgcggcatttaaatcatggtggtatatataattcttccccgcttattttattttttggatatcaaaatactaagcttgaattaaaaagagacgacgattgaagatcggctctggaaggacgttgaagacagtggcccttctcaggtgccatcaaagagagcatttccaatgccttcatcgggcaaaacatttattacacgccctccttccacggtgacactattgtcagggcactacaccttgcccaataggtactgcggggctggactgtgtgtgtatattggagtgagaccggccgcagccggaaaggaaggagggtggcggcgatccatgagctagtctttggtgtcgtgtcgcgctgattgttcttattttgggttttgcactcgtgtggggcgtggtgccaattttggggtatgatacattcattgcagcatgcttttcgtcaccgttgacgcctttcattgacccacaggtatttgtgaacacgcactgaccgctccactcgcagcttgaaaggaaaccgcgcgcttaggcttcagaggatg

SEQ ID NO: 1258 - DNA, 703 bp, Nannochloropsis_gaditana
acgcacaaatcaccacgatggggacaaaagtacatgcaaaagcggccattttatatgtcgataataccatagagcgatatcttggatctgtggtaatacgtttggggctcaacgaccaaaaaaaggggggaaaagctggcttcaagaagactgcaccgtgctgacgcgggaaaggggttttagagctttgaagtaagctttggcggccacgccacctttttccattttcgtgcgtgcgtcctcattttcccgtgcgcgtgttttttgggggggataggttatcctcgtggtaaagtctactggccatgtgttgagcatgggattgatggtgtttcccctctcgaaaacgctgacgtggccctttcccgggcttaaagcaatccatcattacgcactcggagctggaacacacgaccgacacgcactgaaagaacatcacccacgttgcttcttgatccatttgggggcctgcgtaggcacatgcaggcttatcctttcaacaagggcgcttttcacagatagtgaacctattggttcgatcaatgcgttcatcactcatgttgtgttccctcatgtcctcaggccacattttgacagcccgtgcaaattcagagtttgttcctgctcgaagatcgccgttgctccaaggccccacgtactcacgaccacactgtgaccctcggcaatctgcaaaatttgcatg

SEQ ID NO: 1259 - DNA, 703 bp, Nannochloropsis_gaditana
taaaatggccaacccctcgaacgccgacaccgcaggcattcggcttattttattagctgtgatatttgtatttctctccaggttctttctcacaagtaagtttaggcttccatggcagtgccattacccacagaaggatggagacctcccaaagcaaccgcagcggccattttatcgcgacgaggggtctctattgcccatgccccctctattttacacgtcaggaatcacggtagagacacagaaagcggcccattctactttaaaaagtgttgcggaaaattatcgggtggaattgggcattcgcatgaaagcactacacgatatggtgtacaaacacttgccggggtgggaggatgacaaccaagaggaaaaagagggtgcgcatggcacgtgcatgaacaaagatcgcccaccaaaaaggctcgcagatgtgacagaggacttgcaagcgcggatgtgggaacactttcttaaaattcctccatgttggcaagataacgaagatttactggaagatctgcttcgtcttcccactccagtatatgccttgccctcccacgagcaagtcccgcgctcgtaccgtacaccctgctcaagcattaatctcaacacatctttctcaagctctcctccgctttattctgcacgtgccaacgaaacacactcccggtccccgtccggtgcttacacggatgccatg

SEQ ID NO: 1260 - DNA, 703 bp, Nannochloropsis_gaditana
tgtactttccgcccgtcgtgcagatggccttgacgcgaggacaagcttgcaaggtgtgggttgccttcgaagcctttgtggctcggatgtagggttgttcgagacctttgcgaggcatgccttctcgttcgcatttgattaagagtgaccatgtcagtcaaaggcccactagttactcatcggcctctcctgtctcccgcccgtgggcacgtgctgcttgcgtacataaacgagaaggcgagcgtacccacgcacagggacttctctcgcgggccacgcctattgctcggtgcttacacccgtcacacatcatattttacttggttgtcaactgtgtgcatgcgcgtgcaccccctgcttctgctcttccttattgccttgggtgatataagcaggtgtgccgtctcatactcctttgtgtcgtaacagtcccctcgagcccctcatgcgtttacaccgttgggtggactgtgttgtccgtgaaccatgagattccccacaagtcttgatcacaccaaagcgccctgtgcccgtggtcctgtcaatgtgcccaacacccggcgcttgccctctcccgtctgcctatttggaaagtctccagggatgcactgacttttccctcccccgcaccctccctcacagcacgcaagcctccacgctttcttcctttacctcttccaccgtcgcgtcctcgagtagcatg

SEQ ID NO: 1261 - DNA, 703 bp, Nannochloropsis_gaditana
cccgaagcaataaacgttttttttcaaatgaaagattacactaggtccttgttctgagaacctcacctgcggccacggagcgccgaaggcacgatgacggaaaaatatattcgccagccaggaatgaaccccaaataaatttgaacttccttggaaattcttttgacttcacaaggaactttgccgacggtgctcgcgtgtgtagcgggtgtgcgctttctcgaaatgttagattgctctgcgagtggttttcacggcccacattcgtacccggatgctcggacgtcgcataagcctcaactcggaggattatgtacgtaccaccatccccacgcttttgtgtatacacgtcatggccatattgcggcaccatgtacgatggatgaattctctaaatgtcgaagacaatgtacacctttaaaggaagggcaagggcattgtccttcagcacacatgtccgtgcttgctccctctctgcttacttcccgccacccccaacatcaacacgcagaggtcacgtcaagatgacaatgacgcatccttagacgtgagcggaaattttaaggacagttgagtcgaatgagatggttttaagccagattctgacgcctttgctgacgaaggttcttggggactacctcaagcccgagtgtttccaggaggatacacttcgcgtagggctgtggcgggggcacgttgagct

SEQ ID NO: 1262 - DNA, 703 bp, Nannochloropsis_gaditana
cgatcgtccgcggaccgatccttctcccccaggaccgcggcgcgctcctccagttccagatggccagattgtaacgcggcatgctgggccttgctttcttgcaattcgttttccacctccttgaccttttgtttcagcttcttgatgtagccaagcagctgctcttttgtcaactccttggcccccccacctttggcatgggcctccctgccgctgctcccttgcccagccgcggtcgccccagggtcatccatgtcgcaccttaaagtgacaataaagtcttgtgctcgcgattttctcaaaagagatctatgcttggcccatccaaggacatttctgggtccaaaagttaggtggttgtactctgagtagtgaagtgggagagcgaggcggtgaatcgcttgtctcctcctcaacttgctaaaacatggcctgcgtgtgaccacaaaaacgacgagtatacgcgaagacaatgataaggcacagtgatatcgtgactgcgcagcaaagtccgtgccgacgcagcctaggtaagggatcagcacgcaggggctatcgctgcgaggctggcggttgaagccaacttgcgagctctgaagtatcttcccacccctcccgcgacggcacgccctttctgatcccagtctgcaatctctcgcgtcacagattcgctaagcatacattgtcgagtgctgagctgatg

SEQ ID NO: 1263 - DNA, 703 bp, Nannochloropsis_gaditana
ggtgaatcgcttgtctcctcctcaacttgctaaaacatggcctgcgtgtgaccacaaaaacgacgagtatacgcgaagacaatgataaggcacagtgatatcgtgactgcgcagcaaagtccgtgccgacgcagcctaggtaagggatcagcacgcaggggctatcgctgcgaggctggcggttgaagccaacttgcgagctctgaagtatcttcccacccctcccgcgacggcacgccctttctgatcccagtctgcaatctctcgcgtcacagattcgctaagcatacattgtcgagtgctgagctgatgggaagcgtgcagcgcttgactgccctcattttgggtccgccgggcgggggaaaaggaacaatctccaaaaaactcttgaaagacttcaatttcttgcatctgtctaccggagacgtgttgcggaggcatgtacgggatcaaacagctgttggtaaagctgcacaaacttacatgataagaggtacgtacgcaatgttgtgaaggcgagcgggcatgatcacagtcggaataagagatggaaaccggggcgggagtttctcagtttctgcatgttgtcgaaggtgtcgggggataaagatgccatgaggtgcatgtaggcaagaggagtcatggagatccatttttttcgcactgtacaactgattggactcctttgatttgacttgcaagg

SEQ ID NO: 1264 - DNA, 703 bp, Nannochloropsis_gaditana
gttccttgacctggcttcaccgcgcctgtcaggggcaaattacgcggggcatgaggtacctcttagcgtaaaaagaggcgggcatgtttgaaattgcgaaattaaggcctcctggggtagactcagtcaaagtggattctgtaccatcttctcacctaactgcttgtcgtcttccatcgttgtatctcccctacatttctactgttttttacgcttctcacaggaccaatgagtgccaaggggaccacagcatctgccttaggaccggatgcttggaaagatttgcttaactggtatgtttatgtgattggcggttcaatccagaagctaaactggccatttaggggggggcattcaagagcttaccccccattcacgggcttgtaccgtgaggcaactctttccagctgaattggcaccgatgtggtagcctttatcatgagatatattcgtctgtcttgagaatccaagctgggtggaacgcttgggtccttgtaccctgcggcgctgcatactccttgagctcaagagactagaacgttgagaagcgccagtccacgggcacgatttggcgcctttgaagcatgcaggacggccaagggccttggctggaaacaatagactgttgtactggccgtttttgatggtcatcggccagcgcctcgaggtcttctcacgtcgtgtcgcgccccccctcacagga

SEQ ID NO: 1265 - DNA, 703 bp, Nannochloropsis_gaditana
ggcgcttcaggagagcggaacgtgcttttgtggctgcgacttcccggtttcaactggagcaaagcgaaagtcataccttcctcctcagcaatgcaaaatgcgaatatgcacgtgaacgcattggaggtggaattagaggacgagcagtcttcgcaggtgttggacgtatcagtcgaagtaacgcttcatgaattgatcgcgcagcagctagttatctacgtaccttattggattgtaaatatcacggatttgcccttagaatatgcacacgatgtgtgggacttttcctctgacagagctaggctgggtatgcaagaaggactgttggccggtcagacagcgaaaaaagtggagagtggatcgagctcctggcatggcatcagagtccccaaggaaatcccaccctattccatagggcgcaagcatcatcagaagcacggaccgcacgggctgggcctacgagctttgctgcctcctccaacctcagaggcggagagattattggcgagagccaagggtcagatagtaatggcgggttatacatccaccgcttcctctccaggaatgacccgcttgagcatgcgccttcatgaagaaaagagtcgtcttcctggtgcttggagccgtgggtttgctttgccgcccgccactgaaggtttgattggtttttttgaattgaggacgcagccacgtccggcagggt

SEQ ID NO: 1266 - DNA, 703 bp, Nannochloropsis_gaditana
atcgtctctgcgtcatccgactcgtgttctcgcctcgaggcctgtggcaagatactcagcacgtcttgaaaagccttttcttgcctgtctacccacaacattgcctttcatggtcattcagccctttgtatttctctctatcgctagagcagacgaggccgaatatttaagcggacagagtcccatcgaattctgttcctcggatagggcacttcaagcgctgcgtcatttagcagccatgcctctccttcatgacagtaggacgcggccaccgatctgcttaaaatttggattgattatgtgttttactgcaattaagtggctgggttcggcttcaggcttcgtcgcccctataaatcctgattcgcatcgagctcgaacaagttggaccgctgcgacacgtttgacaccactcccatctgctgcttcttccacactaagaatatccctattaaaatgcgcatcagcgaccatcgataaagcaacagccgtatccgtggacaacgaagaatctaaagaaggcccccttgatcttttcgcttctcaatttgagcaatactataaccgggctcttcaagggaagcccgctcaactaaaaagtctgtttgctaccggagctacctggtcgggcgtgccgttatcagaaggcaatggtgatcttcaaggagtgtttgacgcgctggatcaaggacgagccttcatg

SEQ ID NO: 1267 - DNA, 703 bp, Nannochloropsis_gaditana
tgcatgatgttggttgtgagaaattgtatcttggatggggcttgcggggtcaaagagatggagtgacggctgtttatgacgcttccaggaagcggaaaaaatctgaactgtgagaaaacatttctaaaaagtcaagaagaagggcttaagatcaggttaaaagcgcaaggggcacggagatagcttggaggtgctggcaagggccccggcagtcggcgaggtgctgcgggacgcaggtcgcggaagcgaaggccatgtgtcaggattcaacggttttgatggcccgccgtccctccctttcgacaacaatcttacctctagccttgtcccaaactgagcaaggcaccagagctccgtgaaatagaaaagaggtgggattttgcaaccggggaaatcgcactcgtttgtcttccttgagggcaggtaccggcaaaagaggaaggcccattgttccaccggctgcaaccgcagtggcgtagtacgtcgtgcgagcacgaccggtagaggcgtgccacacgggcaatgcaaaagggctgagaggtaccgccccttggcatctttatgatttacagttacttaaccagctttcactcacaatcttttgtacacgcacaggctttgagtttgtgctttcggaggaaggcgggtgtcgattaaaggctctctcacccacggacaccaactctaaatttaaagtacaatg

SEQ ID NO: 1268 - DNA, 703 bp, Nannochloropsis_gaditana
taccagagcggatcgcgagccgccattgcgggcacggcggctgttatttcgttgatcttttgctgacggagcgctaatagacattgttttttgttttctaaaaagtgtttcgtgtgaagtcgtgcatgagtggacgggcagcggtaagtgatagtcgtgttgagtgatgcgcagtaacaacttgacgcagacaataaagcttgttccgcttacgggagaagtcaccaaagtaattctacccaccgttcttttccaaaacctgatatctccatttaatctgcccagcatgaaagcaaggacacgaaatataaaaatgggagacccatttaagaggggtatgtgaaacggttcaggacttcaacggtttggatttttgaattttgcaggagcccgccgacatgttctggtcgggtgccgacccttccacgtttgccttcttataatgtgtggaaaataaaaaataatactcattcgcgaccgttgtggtggtcctctgcctcccgcgcttcagtacaacaacactcaattccgtagtcttgtgcaggcggtggcggacagtgaagcagcggcaagatagccacatcaccatcgaggtggccgtcgctctcgccgagaaccccagtcaaaagcatgcagacactttccgtcccatattcttatgaagactactaccaggcaggtagttgtgtccatttcaaagatg

SEQ ID NO: 1269 - DNA, 703 bp, Nannochloropsis_gaditana
attctacccaccgttcttttccaaaacctgatatctccatttaatctgcccagcatgaaagcaaggacacgaaatataaaaatgggagacccatttaagaggggtatgtgaaacggttcaggacttcaacggtttggatttttgaattttgcaggagcccgccgacatgttctggtcgggtgccgacccttccacgtttgccttcttataatgtgtggaaaataaaaaataatactcattcgcgaccgttgtggtggtcctctgcctcccgcgcttcagtacaacaacactcaattccgtagtcttgtgcaggcggtggcggacagtgaagcagcggcaagatagccacatcaccatcgaggtggccgtcgctctcgccgagaaccccagtcaaaagcatgcagacactttccgtcccatattcttatgaagactactaccaggcaggtagttgtgtccatttcaaagatgaacttgaggaagttagtcctttatcgacgccctctatagaggtgcgtttctttgtgagagcaagaaggccataactctagtgaggaaggaggacgggaggtttgccaaatcatccgataatcactccgtatgcacatatgttcgtctactttccaagttcaccagtgttgggagaaagcgacatgccgcggtcttcttgatcggcgctttcgtcgtagcaggcatattgctt

SEQ ID NO: 1270 - DNA, 703 bp, Nannochloropsis_gaditana
accaggcaggtagttgtgtccatttcaaagatgaacttgaggaagttagtcctttatcgacgccctctatagaggtgcgtttctttgtgagagcaagaaggccataactctagtgaggaaggaggacgggaggtttgccaaatcatccgataatcactccgtatgcacatatgttcgtctactttccaagttcaccagtgttgggagaaagcgacatgccgcggtcttcttgatcggcgctttcgtcgtagcaggcatattgcttgtcgccgcgcgcaatttgaagagttcctcggcctatggcaaagcgcatcgaatgtcaggccacgatggctcgcatttttcttcttcaatgctgtcgaggacgccgtttactttattggctctcaattacaccgctgcagcgctggctgacgagatagttgccttgccgggtctcccagaaccggattcttcatttcgacagttcgcaggttatttggatatctctcccacaaagcacattttctactggtacgttgaaccaaatagaaattccagcgttctagattgggctgcggtgccgttgtcattgtggacaaacgggggtcccgggtgcagtggtctgtttggatacttcgctgagcatggcccgttccgagccacccaacacggaagcggcctggaagttaaccccttctcgtggaacacactgagccacatg

SEQ ID NO: 1271 - DNA, 703 bp, Nannochloropsis_gaditana
tgcggggaggcagggaggacaggagggcaagcctgggcatgacctgcgtgccatacctctcgggctacaaggctggaggggtttgtggttccttttgcgcggctggcaggggatgaataagagcatagtcacgttcgcatgtcgtgcacctttcgactgtggtgcaagggcaagcgtggggtggcaaagagtccaagtccttatttttgaatgaaacatgcgctagtctgctggcctatggatgtgcctgtccaccctggcgatgcttttcaggcatgcaacgctgatcatagcgttgctatcatttcgaagagttggggctagaagagtgtcttgacatgactatttgccatttgaggctcgaggctgtccatttcgcccgcgcagctggcacgtccaggctgacacgtgtctcgcctggactctgacagggccgcacatgacgctcgggtccttgtgtgtgtaatctcgatctgatttcattgtgtattgaggcttgtattgggctcggttgtcgtgcctctctttgtagccctgacttcctctcctagagcctgagagcacgccagcgccaagcgtgtagtatcaggttcaggccctgtctcatcacccgccttgtcctctatatttttctccacagctccaccgccctccccaggaccggacctccctttcccccccgcacggccggtccatcgccatg

SEQ ID NO: 1272 - DNA, 703 bp, Nannochloropsis_gaditana
aatgagggctttcttaaagacaccccacgcgtctaggtcgtcgacgtccaccgccgccgtgttggtagatgttagggcggccttctcctgcgcggtcgcggaggccttttccggaacatttcttctggacatgaagtctggaaagtgggacgtatatggtgtagactcagtcgtggattatgggatataggttttgacgccgaaagagtttgtgcgctcagatgcgatcgcccgacgaacaactttgctatggcgagttccatgaccaattactgactacggaaacttacaccttgcgcccttcgatttactgaaatgttctttccccgagagcagcacacacatgccgacgggccttgcgtcgaccacgtcctggtgccgaatcatatgctgcggtcgtctttctaatcgaagcgacttgcacgtgcgtggctcttgagctacctcctccccctcccgctcaatggctacatccccctacactgtctccggtcgccctcaaacactgccctctggtgtacatcacactcgactgaagtggttgaatggctgtgaagcacgattgtacagccacacttcctcttcgtccttttcctcgaggtcttcttcctcgtcctcccctccttttgcgcctgcctccacaaatattaccactcctgtcgcaaaagacagcagtgtatcgcggtgtgtggtctattggatg

SEQ ID NO: 1273 - DNA, 703 bp, Nannochloropsis_gaditana
cctcaacaaggtgaacagggacctgggcatggatttgcgcgtgcccctctttgaacgctggctcttctcccagcgtcccactgatggcaccggggatcctatattgccagacccgcgattaaacaacgaacatgagcgagctggccgacacttgctcatgcgagagctgatcgagggaggggctagcaacgatacggcgaagcgagtgatagagcagttgaataaaaccgcggtcaagctcttatgtcggatacaaagggcttccgcgtccctcaatcccccttccgtatctctagaggcacgatggcagtccttgtctaaaatatatgtgcatttcgacgcgggacgtgggctctactcactccgacacaagtcgaaaactgtgacagtcaaccgaaggcattacgagaagcttcgagcactccacgcccgctttgggggaatgtcaatcaataggcctgggatcgatcgctctcaaggcaaccttaagcacggaaaacgagaacgcccgggaaagagcgctgaagaagagaggttcttccatctgcgggtcttcctcctcctcttgcgctacagcagtctggcggggggcacagatcgcggagggggctttcaaggcgccattaacgaggaagccttcgacgtcctacgccgtcacctggattgtcggatggaatgcttcgcctctcccctcaactgcatg

SEQ ID NO: 1274 - DNA, 703 bp, Nannochloropsis_gaditana
tgggcacgggcgacagggaggaaggcaacaagacgagcaggctggcgccctcggaagccgagggagggatggagcgggagcatctataatccccatgcccttggcaatggctgcgacccccaacgagcatctgcgcctgagacaccaagccttcctggcggagcaagagttctaccggcagcaagagttctaccgacgggggcgaccctggaaccgtgctcccgaggtcccctcggttcccactctccctggacacatgcgagtgcagccaccgttgggcctggggtccgtgcagttgggggggtacccgctgccctactaccctgcgtacgtgcagagccgtggcatgggcgtgaccggcggggtggcaagcagtgccagcgcggacaagtacggcgtcatggggaggatcggcacgattgagaggccctcgtacgtgtccgtggcgcccagcattcattttgcagtgtcttcggggggggagttcgcggcgaggctgaccgggcccgtccccggtagcgtgctttccaccttccgcttgacccctggggcccggcacaagaagagcaaacggcgctggtacttccccttgaccgcgcacaacaacctctgcgtggctgtggaccagcttcgccgccaacattaccgggagacgggcgtcgtcctggccctctcccccatccccaacgacgtcctgcgccag

SEQ ID NO: 1275 - DNA, 703 bp, Nannochloropsis_gaditana
agtcagaaccgtgaagatcataaagccccacaatactgagaaatgcctgtgccatacactttgtcttgcgcctatcgacatttttttactcactatcactgatttggatcccagcttgtcctccccgtcctgtatcgtgcattgttgacttgagtttgataccagaaatgcttcgaaagtagtcagtcagcatccatgcgagtgttacaaaggacatgtccgtgcgccgacgcgcttccatgcaactttcactgattggggcttaaaaggagacaccccgcggtacgcgataccttgagacggacgccgggagacggtctaaagcgggttcccaggggccagcaaggggggaggtcgcttcctgcgggggcgacggaggtgagcgctctctccgtccatgtccagccccgccccgccaggcaggtgtgatgcgggcgttgcatgcgtggtcaggcagcgaagagagcctgagacacctgcgccaaccactgctgcctcacccgtgcgcggtggtggccgggcaagtgcgtgtaaggagggagccggacatggaggcgaggaggatgagagtgcacctcaaggctctcctcttctgctgtccacatcgcgcaaataaaaaccaccatcctttatatcattggagcacatatcctgttgaatcacagatcaacgttttaaagagtcgtcaatccgcgacgagatg

SEQ ID NO: 1276 - DNA, 703 bp, Nannochloropsis_gaditana
gagaggccctcgtacgtgtccgtggcgcccagcattcattttgcagtgtcttcggggggggagttcgcggcgaggctgaccgggcccgtccccggtagcgtgctttccaccttccgcttgacccctggggcccggcacaagaagagcaaacggcgctggtacttccccttgaccgcgcacaacaacctctgcgtggctgtggaccagcttcgccgccaacattaccgggagacgggcgtcgtcctggccctctcccccatccccaacgacgtcctgcgccagctgagcatccagacggacggagagcggctggccgagagcgagtcccagaaacaggcgcatgacaagctgggcaagctcctaccccggcgcttgctggaggccctggcgcccttccagagggaaggggtgtcatttgtggtggaccgcgaggggcggggcctgatcgccgacgagatgggtctgggcaagaccatccaagccattgccgtcgcctgcgtctacaaagccgagtggcccctgcttgtcatgtgcccctcctctgcccgctaccactgggaggcggagctgttaaagtggcttgaccgggacgtgttaaaaaaggaggagatccaggtggtgaaagcggggagggagcgcctgcatgagacgagcaaggtggtcatcctctcctacagcctggccctccgcctcaaggaggtgc

SEQ ID NO: 1277 - DNA, 703 bp, Nannochloropsis_gaditana
agggagccgctgacgcctcgcaagagctagcaaacgcttcgttgaagccaaagcatcttctacaccagcgtaaagtggggagtccttcttcagataagcctggacgaagtcgattatcaaaagacatggccgtgctccgggttggagggcaccgtcgaacacgcctctgatgttgtctgccaagctcccttccttgttcaagcctgaagcagcggccatagtagtcgaattaccgacaaaaaaagacgacagttctgtcggagtgggtgttttcagtgcttttattcgaaatttgcggcgcaatcctgatccgcgaaggtttattcgcggacttccgggtgtcagctgccagccctccccctgacagagggcacgtgcaggcgagagcgcggaatataaatgaagcgaacggtggccacgttgtgctcatttatctccaccagaagtgaacatatcaatcacttcaatcgcctcatgctttatgacatgccacggtcgtgcgggtggacgtgttggaagggatggtgggtcatgagtgatatcaagctcttctaggaattatggcgcgaacggtacacctacatccgagttgcgagctcctgaacttctagcgaggtgaagcagacaaatgtgtgagccagcacgtttaacacgaaaatatgtccaaccactagcacagatcatcctatcaggacgtgatatg

SEQ ID NO: 1278 - DNA, 703 bp, Nannochloropsis_gaditana
gagggatgtcgagcacgggcgaagcacgaggcgtgaagttggaacagttggtgggcagggacctgtcgtccggcgcggggcgcgggcagggcggccgttgagaaagaggagaccggacggggcctggggccagcccgtcgcgctggcaggcgcacccaaaccgaacagagcacagggaccggacggtggctctgatgccagtcatgcgcgagtacgaccatgtcaggtggcgcactagggagaaacgttctttccggcaagtgttctttccggcgcaacattttgcaacgaacatatcgccgcattcagcaccgcgggcttaacacatctattcgaattattgtgcattattagaccggacctctatcagcatgcatgcagagtggtataagataagtctagcttagtatggcaatgcgtgttatgcggtgcatagattccacaaagttgtcatgtcaagaacacctcttctcgcatcgatggtgttggataagaagcacgtaaaattcaggctgaaggcgactaacaactcagcgaactcacggtgtcgtttttttcctctgcacacacaggaggacaggaaaaaagtgtgtttggacattaggtgccggagtgtcaattttgtcgtacgattttcttgaatttgcgagcgtgctactgtcgtagctgggggttacccagtccggtggtgtggaaggagatg

SEQ ID NO: 1279 - DNA, 703 bp, Nannochloropsis_gaditana
gtttcgggagctctcataacgagcttatcagccagactggctcctccttttcgcgactgatgcccccaggcagtcacacaggcaggaggcccatcagccaacggctcgaggcagagaagcgccgtcgggcggaggaaacggctgcgagggcggaggccaagcgcatgcgggaggcgccgaccatggcccccgcggtcctgggaaccacgcgctcaggccgcaccgtccggtcagagaatgcggcgcgtgatgcgacaggatcaaagaaagcccgacccaagccggagaagaaggctcctggtcccagggaggtggcagaggaggggcaagaagagggtttcctggtggacacgggcggggcggaccagaacgactgggtgtgcggcgtctgcgaagaaatggagaggagcgaaggggaccggcttgtcttgtgcgacggtccctgcaagcggtccttccaccaggcctgtctgggcatgactgcggaggaggtccgcttctcggagacctggctttgcgaccagtgccgcgacagggagcacacttgcttcgtctgcggcgatacggggaaggacgacgggcttacggacggtgtgcataaatgccagaagccgcagtgcggaaagttttaccacgcacactgcgtgagtcagcacccgaatgtgaccatcgccaagcaccagcagggggaagacgacgccgc

SEQ ID NO: 1280 - DNA, 703 bp, Nannochloropsis_gaditana
ccaaagctctctgcggtagcactttctatttctggcgcctccttccactcggatatgtgatcgagcaaagcttggtaagttgcggtgttcccgaaggaaagtaaaatcctatccccccccatttgctttatcctcccgcccgtcttattttccgtcacggcagcaaggagcttagcctttgatttcacgtcatcttctccagttggcacaatccacggacccagataatgagccaggcggagaggaatgatgcggcctaggttcggcccggtttccagtaccacccttgtcgaagcgagactactgcggctcccaagaaggctcagatacacgagccagagccgacgcatgacttcagcgcgttgtgttcaggtagtcaacagaaagatttgagaatggatgacaaattaggatttatcaagggttctcattgaaaacgaatgtgactgaattgactgcttatttcagctggaaggctcggcgaggagcggcgatgatcccgcctgtcgggaacgaagcagcgcctatcaagatgggcgggggcccaatgattcgagcggcggaatacataacctcttcgagtttgattggcacttgtctgcctccagagtgtcaggcgtgcagaaccgcggcatggcacggtcgatatccggacaatccacctgaatccaacctccccccctcctgttaccccaggacaatg

SEQ ID NO: 1281 - DNA, 703 bp, Nannochloropsis_gaditana
caagtaccacgagtacctcctcctctgccccgagcactccgaggagatagacctcccccgcctcccaggctgggacgaggaactggaaaccaagagtgtcgtccggtgggaagttagcgcgagagagggaggggccacggggggagagggcgggggccggctatcgatcgctctggcctctttgctgccccctcgacaccttcctgcagctttccgcctcccaaccgtgcttctggacgccgtgaacagcaagccgaagccatacagccacatctcctgcctcaaataccagtgtaaagtgccggagagggagcccggcccggagtgtcagtgcgaaggccagtgcggggagggatgcctgaatcggctcttgcatatcgaatgcgtcggagggggtggagggggagggacaaaagagggcggcgaggatgagaacgggggtagtggactcaagggggacaagaaggagaaacatcacaactgcaacgtaggaccggcctgtgggaatcgtgcctttcggaacaaggagtatatcacgcaccaaatattccgggagggaggctgtgggtggggtttgcggacgttggagaatgtgcgcaagggacagttggtctttgagtacgtgggggaggttatcgacgacgacatcttagagttgcgcctccaagaacacgcgcgggagcgccccaacgaccacaacatg

SEQ ID NO: 1282 - DNA, 703 bp, Nannochloropsis_gaditana
tcctctataatcacggtcacatcgtgacgatgcgccaacccgatgcctcgtgtttatgccaggatcattcctatattgtccgtgtggatcttgtgcatccctatgagctgatctggcaggtttccaggtattaatgctttttgtcacacctctgcagcaaaaccattctgagcctttccgctctgttgggcttccttgctctgcccgcccgtctgcttccgtcccatccctgatatttcatcgagaaagctgacagaattctcctttctgacatgtcatctgacagggtcttttccccttttcacgccagctcttctacctttcctgctgattcagtattgttgtacactgtttaccagcagcgtagacgagagcgtgggtgccacggcggctggttgggtgcgtcacttcgaggaaagaagagcggcagatcctgtccgacgggaggaaggcctgttccgactcctacgccatccgtggagtactgcaatactttagactctttcaaagaagagcctctgagtctttgcgaccttttgcggcagcatcgtggatttgagcggtcttgctcgccgtggctgttctctcgttcgacagcctcgcaaggaaaacgtccgctgaaaatttcgaaattggggggtgggaattaattgcgtctacctaccaggcgtcacaacgtccagcttaacatagacacatcatg

SEQ ID NO: 1283 - DNA, 703 bp, Nannochloropsis_gaditana
tcaaagggccaagacaaggtcttcattcatggtggtcccttcaagcactgccaccgcggccgtccttgtccttgctatcgcagtagctttagtaatagagccaccggtgtttttgcggcgttggtggcttgagtggggtttgtctctggaggtttctactgagtgtcaaacgacggaacactacgctgtgggcactggcttcgacgttttctgggataaaggtgccctcagcgtcttgagctcctcactgccgcaatcctcgtcgtcggcatcaccgaacaacacattgtggcattcatatgcccgcgagaaaccttttattcttgctgcgcgggctgtgctaaagcacgatcctatccaggacggacactacttcctcaatcaaggcattcgcggacaaaccacccggcaaactgtggaatccctcctttacgagcccaacgtctcgttgaccctacttggtacgctggataggccgggggggccttcaatcccgtaccgtttcactttatcagcggacaaggcttgcactgacggcaagctgcattttgctatactcctgggagagacggatgaaagccaagacgatgatagcgacgacgaaatagtctacgcgggtaaagatgggcctattccctccaacaaagcggcctactacaaccgggtctggcttcggtacgggtctgacaaggaggaggctttc

SEQ ID NO: 1284 - DNA, 703 bp, Nannochloropsis_gaditana
cacattgtggcattcatatgcccgcgagaaaccttttattcttgctgcgcgggctgtgctaaagcacgatcctatccaggacggacactacttcctcaatcaaggcattcgcggacaaaccacccggcaaactgtggaatccctcctttacgagcccaacgtctcgttgaccctacttggtacgctggataggccgggggggccttcaatcccgtaccgtttcactttatcagcggacaaggcttgcactgacggcaagctgcattttgctatactcctgggagagacggatgaaagccaagacgatgatagcgacgacgaaatagtctacgcgggtaaagatgggcctattccctccaacaaagcggcctactacaaccgggtctggcttcggtacgggtctgacaaggaggaggctttctttggttttggacagcactactcccgatggaacttgaaggggcacctggtccccgtgatcatcagcgagcagggggttggccggggccttcagcccgcgaccttcgcgctgaatacgttcctccacggcgtaggctccgcctggcacacgacctacgtggccaagcccatgtacctgacaagccgcggacgggctctctctctggtcggtcccaaagtctccttcttcgatctgacgctgccggacattgtcacggctgaatactggtcatgcaggagcatg

SEQ ID NO: 1285 - DNA, 703 bp, Nannochloropsis_gaditana
ttggcggcgtcagcagcatttattagcaaggcggtgggtaaacgtagcttcggaagcgcttgttcagcccttttcccccgaaaatagtttatgtttcttcccaaaccgcacattctggtgctgcctgacgcctctgcgcctctcctgcaaaaatcatcgtgtcgagccatctcaccgccgctttccagcttttgaaaatgcttcagcagcaatcaaagtacaaaacgtcttgttgtctgctatttgccagtattcctcccgttaacgttgatctccgtgacgccgatggtaatgaggatgatgccgccgtggctggaaattgtcaacaactcggcagctggtccagtgaaagttcttgttcaaggtcaagaaactgctgggttatgacgaaccataaacgtcagcaactgctgcgcatctacgcggattcatgatggcgggtttgatttttttttcttggaagaaaccactagcgggttgttccagggagggtcgaggggctccgcaggaagaggaggttggatgactcctttaggtgtcacgtggagagcgcggagaaagtatgctcacgggtatgcaatagacctgcgcgtttcactgcattttcttcattgtcgaactcgctggttcactgcatcaattatcgacatcttgacaggcagtatcgcggcagtagcagctaccgccgccaccactcgaaatg

SEQ ID NO: 1286 - DNA, 703 bp, Nannochloropsis_gaditana
ctactcgcttctagccgggaatagttagcactgatcggtatgtctcaagttccagcacaccacaaggccatatccacgtgttagaacgacccttgcttgcatgccatgaattgactactctttgttttccaacgcaacatcttttgatgtcgaatggacgacgtgggacgatggaattggtgacttggtggaggaaaaggttgcttcgggaaaagatatcttccgatccgatgatgagagagacatcatgcagcacacaacattcgggcacacgcgatgttagcgcggctttcacgcgcaaagggattgcgtcaggacacgtgccatgcatactgcaaagtcaatgagcttttaagatgacgcttccaggacaaagctttttcagtgcatggtgttgtggaattttcaatgcatcaaactacaagatcaagcagaacagccctgcttcatcaagttggtcacctccctttttctaaaaaaatccctacattctcaccattcagggcacggttactacgagataggccaaccatgcatcgcaacactcatgtggttcttgggagagtgttttgtgtcgttgcattgctgacttcgtccacgggcgcgcagcctctctctggatgtgggttgggcgaaacccggctatatatccaagtgcacggcactgataaattgacagcatgcacggactatttcgacaatg

SEQ ID NO: 1287 - DNA, 703 bp, Nannochloropsis_gaditana
ggttgattaccttcaacttgctctttgacaacattttaaaagcattaaaaaaaataggaaggttatgattatcacacgttcttccttaatctacttgcaaccctgcagattcgcatataatgtatcatccaccacgaagaagcgtgtacttgtgcacaagtttcaatcggcacaatccatctcgtagtcagtaagagccttggctgttgtgacgagcgcagctaccctcgcattcaacccttcccacaaaagcagtgctaataaatgtacatggctttggaaaaataacaacgagctctttactatcacatttatggaagcaaatggcataaaatgctgacgtagtaaagataaagctcgtttccccttctcgttgcacttgactgagaggaagcaacggcttcggcgtcctccagacttgcgatgattttacccggcttacgtgtacttatttgtacttcctctcatacgtatttgtacacctacatagatcctgaagggtctgcgtggacgacttgatttcccatcggggcagttttaccacggatcacgaaggttaacctcttggtaggtggtgctataaccgtgcccagacgtacgggtttcgcactctatctatagcagcacaatatattcttcggtgtagatgctcatactgaccgttagatggaaaaaagccctgaaggccgtctatgtcatcatg

SEQ ID NO: 1288 - DNA, 703 bp, Nannochloropsis_gaditana
ccgccagcccaccccattggtccgggctatctctccactcccgtgtcctcctccgctcccgtccgatttcagagaggcctccgtggccccaatgccaagcaggggtgtgttgtcacgaggaggtaccgacgggcggctgttattgatgagattctgtacaatgttgctgctgcctgtattgttgctgttgcccgcagccctgtttcctcctttccgaatcccccccatcgccgccccccccccggaacccccgccgtccttgatgcccactcccacagaatgcccatgattggccccgttgttgctcatgagcttgaagaggtagtatgatcacgcccgcaacccggaattgtgtgtcggatttgtctcactttcctggctgcactgattccggcgttcgtcgcatatcgcgtgcaaccctctctacacgcacaggttgcaatttgttggtataaaattagttccgttggaaaggacgcacaatcgagcactgctgacatcttttatcatctacaaaggaggattcgagcagcactttcagacacattcgctgtgtagtttgcaattttcctctacagctggaacactccggattgcgatggcgatgtgcctcgccatactacgagcgctccgtcctgccacatatctctttcagtccctcccttattaaacatactcgaacgtatttacagctgactctatg

SEQ ID NO: 1289 - DNA, 703 bp, Nannochloropsis_gaditana
aacgactagtaccacatgattttctccttggttgcggggaaaggcgatcgtttccttgtgtgtggtggaaggcaatcacatgccagtccagcagaagacataaaagattagaaaaaaacctgtaagacagaccggcatggcctgacgacaaccaaatatcaaccacacattgtcggtcacgcgggtatgtgtggcaagtttgaggtcagttgcttcgctgaggcgagttgcgtctcctccgcattcagccatcaggaacccatccatgacctgcataaatttgactttcttggtcccttgttcactacgaatcactgcctccctcgggccagccaagatgctcctttgcaccattgccttggcctgaaacctggcagtgtctcctttttcgtttatttgaccaccaaaggctttgggcgtgggaaacggacttgagcgacatgggcgaggacgggacgcgtctcatcaaaccctgaaatatatagggcaagtcccgatagctcgaaggagtgcgattcattcgtcactatctccacaccaccacacataggagagactaaaccatgactgcaccgtgagaactggcacacctttcgagggactcctattgaagaggcaggaacgtgcgttttgcaacagacagggtggaggggtctcagctgccgtagcttcagacaaggcagctgggggccagagaagcatg

SEQ ID NO: 1290 - DNA, 703 bp, Nannochloropsis_gaditana
acatgtggcgtgcgtgcatgatcacaccccaagttatcatactccgtcactgacacgccatcctgggcaatcctgtcaccggggcacgaccacacacgcccgtatcagccctaggccctcaggcacacgccataagtaaggatgaaggagggcaatcaatcgtgctttatgctgtggggcttcagcaggcgagaaacgtctgggacgtgagagaagctctcccttcctcacccgccataaatcgtgtggactgtcacaccagtgaccacattccccgaaagcgacgtccgtctcatgcgtctgctttggtgaggtgggaagaaatatgtgctacgtgctgggggagagagctttaacttagaaatgtcacgggattggttgtaaacgacttgttcgacatcaggagctgcgtcaagtcatctgactaatggaaagactcgcctctttgtcagacgccataaagggttcggatgcatttgcaaccaggagagaagatgtatgaaatcgtgcatttttggagtacgccatactgacgaccctgcacttctttttccccacgtccgtcgcaccgtatcacaatctcaggggataaaggaggccttcttgcactctttcgaagtgaccgcgacggcgactctttgcaggaataagagttcaacaacacaactacatacttgtacaaggtctctggcgcaggaatatg

SEQ ID NO: 1291 - DNA, 703 bp, Nannochloropsis_gaditana
ggtgctgacgtacttaggcattctggagttaaacggtcgcggtttaaacggccgcaaaggctaggccggcctcttagaagtggccaagtctcccggcacctcacccgaggcggtgcgcacgtggtcaaatgtgtccacggtcatgtgcaccaaaaagtgccgggtcgtgtgcgtggtcgtgggcttggtcggaaggtctccttgggggagatacggttgattctttgcggtcagggtccgaaggagagagagggcgataggaaggggaacgccacgtcctcccccctcagcctcctcgacacctgctcttttccgggacattgcttgccctttttcccggcatccgccgggaaacgaccctgattcttgggcatgaacatgtgtgtcgtcgaatttgatgggggacggggtggtatggcgcgggttttgcggctgtttttgggaattgttgctgcagtgttgatgttgatgcctgcagcattgcgggggtgatggagacgtgtccgcgtgcgacgctctctccttttgccagtatttctcccgtcaccaatgccaggacatgaaagaaagccacatgttgtgcatgtgaaagatacatgtaaaaggcgtattgatcgataattcgtacttggatgtgcccgctgcgtgatatatgcgacccttgaacggtatgatcgactctccttccctctcactttgcaac

SEQ ID NO: 1292 - DNA, 703 bp, Nannochloropsis_gaditana
ctgggcgatgttttctctgagtgtgttcagataggacttggtgctttccacggcaagcacgaaggttgcgatcaaccccagcatgcccacgtctgcaccagagaaccggcgtacaccttgataggacctgaccgccaccaccgccacggctcccaacaagacgcctgcgatcgtctgttttttttgtttcaagacggagatgatgtacaggacaaagcctctcacgcccgtcatgtgcgccaaagggggatggccgtcggggtgctggtgaggaggctcgtggccatggctgtgaggcccgatgtgcatcttgagggcgcaagaccgtgaatattgcttcctcatcggcaagatggctgtacttgccgatggaaaggcgctttggtgtcgtacgcctgcaaattgaggttgccatccggataacggggtgccaaaacaaaaaaaaagctttattcagcgaaaaaaatgcttgaatttccacccgcaaacgtacactttctgtattatctagcagcgcaatgtgtcaaggacaagataaaacgatacagtgttcgcagtggcaaaacgcacctgtgaaggatgaagcggacaggggcccgcatggcatggcgtgcaggccttgtgatttcgtcatggataaaggttgccatgccgtggccactgaagctgtcattcctagcacaaatacaaaaccaccccaatg

SEQ ID NO: 1293 - DNA, 703 bp, Nannochloropsis_gaditana
tgactttacgagactcgaaagtcagcatgttttagccatctttgacaatcgtagctttacattcgggatcaatcatcccgatcgagatttaacaacacaagtctgcgcgcctccgaaaaagaaatctctacagaatgtacgactatgcattcatacaacgcacacagtggtatgtcaccaataattcatttgaaaattgatgcgacggctcgttccctgaatgaacgatcatgtggatttttttggtttggttgtgcgtcaaatttctgcacttgaagctcctggcagcaactaagctccccggaagtacacgctcccacggggcatcagcttctcgtgtcttgctggcgcgaccaagacagcctggccagcgttctttggacacatgaatggctaatagtatattcaccacgtcctgtaagagcaactattgggtttaaatgtgccagcctcgcatgccatggcggcgtccgggcctgccgcctctctccgcaaccaccactaattcgagttagcgatgcaaccagtgcttccttgtggatgtgccgctacctcgtctgggaaaaatgcactctctatatcccaccgcggacaatcttccacgaagagaagtgattttctgtggcgttttcttatgtgtcactttctttttccgaacgggtgcaatgtgacaggacctcacttcgactgattgcagaagatg

SEQ ID NO: 1294 - DNA, 703 bp, Nannochloropsis_gaditana
gtatacgtaaagtcaaagagcgggaaagcgttcataaagcatgacgattgatagaataaacctgtcattcggttaccatttaacgccaacaaacagctttttgcttggatgttacagctgactgaggaaataaagatgaatttttacttccatgtcatttatatcttccaatatttgttccggaaatgacagctaatgactttttaatcgacctatttcaagagtctatctggacctgaaacggcgaacatttgaaatttcaaaaaatctgtcgccctacctacttttacttttcaggaactagaacagccttccttctcgtacccgtctcagaaggtcgctcttggcgacagggtgtgactaaaacagcttttcccagatccttgttggttacatgctgtgtgctcgccttggcgtgctaatatttttttgtgccttgaagacaaccaatccctgaaggaacaaaggagactttgctcgggatcagtacaattttcgtgtaggtatccgcagaaatgaaacgatcggcatcattcatagagttggagttgtagacataacatctgacgcagacagatgagagggatccttttttgtccatgggctgtactcacgtcttatggagcattatcctcctcacattgctacttcctatatcacacccatccacgcatatccagcgaggtctacttcctcagtaatg

SEQ ID NO: 1295 - DNA, 703 bp, Nannochloropsis_gaditana
gctttatgttcataatcatgggtggtgcccaaaagagaggaggaaaaactgaagagcggtgcacacaattgggatgctgtcacgggaactaagatcagatagagaaagtgtaagatgtcaggaatcttattctgaccaggagagggcgtgcaaatacatgaaaggggtgttcacggggatcaggaaggcaaagagtgaggagcagacgctgtgaaaccgagctctaaaagcaatgtcgctttccttccttctacccccacttcattctccacgggtcaaagtgtgtaaggcaaaagattaaagaccgctatgaaaatgaattggtggtcagagaggagcatcagcatgtgtagaaatccatgtgaaaagacaaggcagatggcgagtgagaggggtctcactcgtacgcatgcatatgaccggcatcaactcgattgtagaaatgcgtgccactaattttgtttccaatctgaaattgggatcgcccggatccagaagtggagaaggaatgaaatcgagactttaaacaatcgactgagaatcgtcgctttgcatcgtcaaacctccgataggtcttccattcgatcttatcattttcgaagggcttgcttgtacatatgttgcattcgcctcttaatattgttgcccctcctcggcttttctgctagccttgcatcatgcctcgcactcacgcatcgtcttt

SEQ ID NO: 1296 - DNA, 703 bp, Nannochloropsis_gaditana
tgccagggtaaactcgcttaaaaagcagcgagctgaggttcactccggctgtacaaatactgttcaatcacactcttccactgttgctgacttcgactcttactcccgtttataatcgtctgtcagggataacattatgcccagtgttacacttcaagccgatgcgagcccggtcgacaatccttcttcccaagagccttctcttgaagaccggcgtgtccggcaagacgtaccacctcccccgcccctctacccagcgccacgactcgaagcccctgtcgtggtagtgcgtcttccaggaaaacggcctcaagccaggcgctggaaatgcgtcgaacaggatcggctcgtacgtgtgtgtcaaccttgttggccgcacgtggattgtaagtagcttccacccggcatgccatctcaggggtgtcacctcactacgtccacgccccctccctgacaccaatatcttcagggcaagcgatcgctcgtgagctggaccgcgaggttcaagactgtatttcccaaagcacgctgctccatctacaagatctcgcctgtgaggtgacgcctccatccttggccagcctcagacccgagccctccacggggatccgggagcccgaggccatcccaagcagaccgccaagaagcgacagggcgctgtccccaggggggcgacggggggatccgcacctagacggggatg

SEQ ID NO: 1297 - DNA, 703 bp, Nannochloropsis_gaditana
acctgactgtgtccaacattttctttcaatatcgcacgggcttcggcgttgctcagcattgcagatggcaaacgagatccacacgtaaggtgtgcctgattttgtttgttgtttgtactggctgcggcaaaacgagaagggaagtcaagtggaggagttttggaataattttgtgttgatgttgaggctaggaaataggaggtcgtggcaaccacaaaaacgcttctttttgtccgtcgcagaggctgtcgaggaagcaagcgcatgaattgaaatacctccacaagcctgccgtaccccaaaaggcattcgtgaagtgagtgttctgttgcacggtaagttcctgagcatatattttaccatccgtcttggcgatcctgcttgctttgccggctccccgctgttcattaaacacccatccataaatgacgaggggaatcgtgcagccccggtggttgggctgagtgccttttttcatcgtaatgatgtgtttgtgtatggtggacgaaaggcacgccacgaccggggaaggtcgtggggacagggcgctgcaaccacagaggccccctcctcttcaagctcaactcccacccctgtccatggtagattgcttgtcaaaaccacaccgctattccccacgtcatgttgccgttcccttccacgctcactcacaatattcccttgcacgacagaggtggtcatg

SEQ ID NO: 1298 - DNA, 703 bp, Nannochloropsis_gaditana
tgcctcggattctggtgggaagaaacgcctgttggaacggctggaaaatgctcggcagacattgcgggaagtcaagctgacggatgacgaaggattcgacgtccatctccaacatcatcacacggtaggcagcgtgatcagggcatatgggagcggatgagtcgattttctcgggagatagcaggcgcggcgtgtcgcacttatgtcacgatcgcgtagtgtcgagcaatgcctcggtcacgatgacaagtgttaacagcttcgatacctaatcacgcattgaacacagttcatattgggggatctgaatttccgaatgcggttacgggcacgtgaagtcgtggagcacgtcgctcgaactgttcgccagatgggagcttccgtgtggcaggaaggcgagagtgagaggagtgaggcggttgatacatccattacacaggcgaatgaagcgggagaaattggtgacgaagatagcttatgggtgagtacacgcccctggggccaagcagagaatgacaggcggcacgaagacaacaaccatgtctatgacaaagagggaggcctcgaccaaagagctgatgcagtggatcagggaatgaactgggtgagcaaagactacatgcaactcttctctcacgcggaggaggagcgagctgttgtttcttatttgtcaaacgcatcttcctacatcgggagcgatatg

SEQ ID NO: 1299 - DNA, 703 bp, Nannochloropsis_gaditana
acttttgtcaaagagggcagaggcgccgcgttcctcctggcaccgtgctgcaagttggaaagccagttgacaaggtcctccgcacccacacggcaccattgtccacggcatcgttgacatcagcagcccatgcctgtgtccactgtacagctgggatgaaggaggcaaccaacatatcacagatatgtggcttgcccgcacatgcgtccttccctctcctcagcgacgttcgtagcccgttatgtcttaggttactccgttgttaatgcgacgctcggtcgggcaggacaaagtcacaatattcactcgcagaggggccaagatacgagcgtgtcgctggctatggccactcgtcagcagcgttttgtaatgatgggcaacccaaatgcccaagaaggaatatattactactggcgttatttgaactgggtgtatgatactccatcgccctaccacctgagctaattttatgccgtatatcacctctctacatggcgggacatacgtgcccggctcgagattcttacaagtattcctatatatgaggttgttgcgtgcagattactacatctcaagtgctatattggctttatttttccttcttctcttgtgtcacaggacctggaaagccacctaggaggtctaaatagcttcaacttcttttaatttttccgaattctgttcgaccgctttcactagcatg

SEQ ID NO: 1300 - DNA, 703 bp, Nannochloropsis_gaditana
atctccatgggatcatgctcgacccatcctggttgcgggtagatctgcgcatgctcaagctgatgcaagccaacctgctgtccgctatggttgtagatgatgaacttggtgctcgaagtgccctggtcaatggcacccacgtagctattaatgtacgagcttgtcatggtctatatccacaaggcgtgacgaggagcccgcgcggataaattttcgagcggtggaatattaaaacggatttcccagcgcttacagctgacaaacaatgcaacaatggggcttgccgttgcggagagtgaccttgaaagaggatgagatcgccggcgccaaagctgttcaaggatacgtgcaaatgtacgaatggtaaattcgaaatgagataaaggcagcgcatgatgcgtggtagctcaagtgtgcgcctgtgcctcaacacgacgagtgttgaagggtattcccccggaatcgactagtgtggcgagtgagcgagcccgagggaccaaggtacaacagaactccccacctcctaacttgcaacacgcatgcgataattactttgataacactgacaatgatttgttcggcacggccacgaatccctgcgctaggatgcttggcactatacatggcgagtcgaggcaccccattccgacttgaggtagataattgctcttgtgtcgccttttcccatagagcctcaagaaaa

SEQ ID NO: 1301 - DNA, 703 bp, Nannochloropsis_gaditana
tcgggtcaaaagtcatgaaataccttccgcctttgtgtaagtatttctctcaggagcgtgaacagggtgcaggaactctttgcttcttgttttaatgcgactttaaaaagcgactctccccaggcactgttaaggaggacagcatcctactcacttcatccactgcagacttgacatgacatataatacgcaccgggacagaagctccaattgattcaaatttaatcacctgattactgaaatgttgataatctctactcgaaaactgaaccattcgattgtcgtgatgaggattcttcccaggaagttcacatgttcccgggcctcatcgtggcctggttgcctggtcctcgcatgccataatgtctagagaattaggtttaatcagaaatgagcaccatcagcgtgcatagataatagtgtttaggtcttttagtctcgctgtccccaaggtgtgtgatccaagcaaaagcgtgaccgtcgccgcgctgcctggtcgttcctagagagtattaggacggtagatcaaggaatctcgttccgagcattacttgatcttccaatcacacaaggcaccaccttaaaggaaaccatatatttaacacaagaatgctcttacacgactttcactcactcctgtaagggtaacacgcaggtccaggtatctcacgcataaccctaacactaggcggatcgaaccatg

SEQ ID NO: 1302 - DNA, 703 bp, Nannochloropsis_gaditana
cacttcacaataagcaggcctgacaccatgtcttccctgatggccacagttcgagactggcaagatcgccaccgacgctttgtaaagagggtgcacgcctttcgcatccccctgtcccctcctgccaaggccgtcgcccaggtcgtatatttttccatccctctcgtggcggggtacttcataatgggatgggccactgaccgtgccaaggctgagattcaatacagcgacagcaacgaggctgaagagacaaggatacgcagggatgccagtcaaggagaagaagccactcgggtgtttaaagcgatgcgcgtggagtcgagggggaggcgcgatagacgagcagattgcccgtcaaaatctggggctgcagagttaccttgactctattcgagagtcggggaaaaagtgatgttcatacatgtttgtgaaagaagagaaaacatagctcgtcaactttgaaggccgcgtgcctaaaagctggcatgtatgtttcttgcacatgtccatgagacattgtaaaataccatcctggatccgcaagacttgcagtttatccgatgtcgtttctcgagaagcaatgtgcagtaaaagtccaccggctaggacctatgttcgtgcgctctcatctccttctcagattctttgcttcatcatcccccactgaacacagggtgagcatgcaattttccatcacacaatg

SEQ ID NO: 1303 - DNA, 703 bp, Nannochloropsis_gaditana
gtcatcaacgacgagggtgagtccgctgctcttacggggctgttgcatcgcctggtgaggcctgaagtgcagacagtcagaggcattgtgctgatacgacgagaaagaagacgaggcggggacggtggtggcgcaggaagcgtgatgccactgcccctgcggcggctgcaggcgcctgcgcaaacagcgtggtgcgtgagtagtcttcgggagctagctgccgcaacgcgttctattgctgccctcaccctcatgctcgagcccaccccagcattggagtagggctgcctgtcccgctggcccctctgtctccggtgaaaggggggaaatgttacactgtgagtgcgattagcacgtcagtatatattttatggggatttcttgcggtgccgcaggatgggagggacgggcattgcgaaaggatgacgaccaattcgtgtgatatcaatgcagcagcccacctgggctcaagcaggatcgtcaccaaaccgcaacgatcgctgtcttgcttttgccctctttcgtcactacttcttgccagactcataatccttacgtctttccaatgtatttgattgaaataccatcaacttctgatggttgcggtatctatggtctatatgagaggggagtcgtcttaaatgctctctctattcatacccgtcccgatgattgaagacatcagaacagtcgaaacagcatg

SEQ ID NO: 1304 - DNA, 703 bp, Nannochloropsis_gaditana
tctccgcctcatccatgagcaggcgatagaagcgctgcggtcggagaacaaggtgctggaggaggggaaaatgcatgcggttgccgagatggagaaggtgttggcagcaaaaagggtagcggaggcacaagttgaggagcttcgggaggaattgtctggcatggaagcacaaagggaagaactccagaggcgcgtggaagtggctgatgccgagcacgcggctttggaggatgagaaggctcgtcatgaatcgagcttgtgtgcgctcaggtcggagatcgaggcactaagagaagagggaaggcagcatatgaccgcacttcaagagatggttgcagtgttgaaggcgcagggcacggaggggagtgccccatcctgtgataagaatttaaccgatcagagtagtgaaggtgaggggcccgagcaaggagcagcgacggtgacagcatcactacaagagctggtccagcgtctaacggccgcaaatgtgcagctccaggcgcgcgccacaacggcggaaatagaggctcgcgggcacgcagaagagaacgcgcacttgaagggaaggctgggcaaggtcctgcgtcgacgcgtctcctcccttcctccgctcgagggggcggaggatgggcacgttcaggtaatgcgcgccgtgcgtcgccgccaagggggcgggacgggagcgagtaacgtcgagtccatg

SEQ ID NO: 1305 - DNA, 703 bp, Nannochloropsis_gaditana
gtcttcccacccttgggatggagggggggggtggaagctgtagacacggcatcgaaatacagcatcagggcggccgtcaaaataataggtagcaccaacacaaaacaaagaatcatttcctaacactccgtgtgctagttcgagaggctccaatacacagtgtatttgttcatggcctcccccaagcccggcttcaatgccttgtgcccgctcacttgcgacctgaacagcgttgtcgaattctccttgaaaaaaagaacggaagtgcgacagcagtccatccccatcttcagtagttgttgctccgccctggattctccactgcttcgcttgtcttaaatgtagtacgaaagcttctgtcgtggcatctggtcgtgacagcaaaagaaggagacagaggactgcagccaaaggggggaggaggttgtggcgtggaaggaccggtttatagaagggctgcatttccatcggacgggccatcgtagctctcacatcttcttctttttgatgctcccgcacgcccactttcattcctgttcttgctgacgagagcaacatatagaattagggtgatactcagggaaagcccggatacgaagctactcccgggacatcccctcctcgatcataatttacctttatcatccacacctcatagttcgtctgtccatatttttacacagacgtaccgaggcatcatatg

SEQ ID NO: 1306 - DNA, 703 bp, Nannochloropsis_gaditana
actcagtcctgtggctgatgaaaaatacatcagctctccttcgcaaccaagcatgccattaccctttcccaatgaatatcgaccccgatacttccctccttggcgtcgtcctccgaacccaacgctacgagcgtggaaattttataatatttgttctgaatcagggggccgcatggcttcatccgtgcgcatagaaaacgcgctctcgactgcctctgtagttgctacacaggactgctgctcaagaaaaaggtctagtgaattttctaaagacaatgcccctggaaaaagatagaatttacatgcataacatttaaatcattgagtcattagcatcaaggcaagattcctttgggaggggcatggcatggattattttgtggcagtcgcggtaggagtgtattccactgtcggtgatgggaaccatgtcaagaaaaggcatcgcagccagccagcccactagcctgttgcagttgccgcagcaactgccatataaagctgaaatcgttgtttcccgctatcttcctcgtgaaacttgcattttgtttgtataataaaataaaagaggagcgattcttttcggctgagtgcattatctccaccatgcatgtctacgcatgatcatccatctcacccaccgagtcgactatctaattgccccccccccttctcagctacagccttgtttttttccttcaagatg

SEQ ID NO: 1307 - DNA, 703 bp, Nannochloropsis_gaditana
tgccgcgtatgcgttctcatatgcagccacgtcgtcctcatctcgcctccgagtgagaggaacacgtattgaggtcggactctgtcttacctccgcgcctttcttcttcgggaagtccatgccttctcctttccgaaaggggttatacctgtccggcacaatcggttgtgctttatcaacaaaccacgtacatcaaacactgcatttttttctttttcctctttacctgtccagaaggatccagatctagatcgccacctcagatcgaaagacacgttcgaagaggaacatcgacatcacgcctcagtgtgtctcaatgccaatgggtcgcatacaacgcaagacagtcacgcaccatcatcttctagccgcgattctggccatcgcttctgtgggcatgacgcaaactagagcattcctcatgccccctcctggtgttgcggtcagaaaagccggaacacgcacgtctccaaacacgtacgccgcagttatggatgcacctgtctcaatcggtgcattggtaggcactcaaagcccccgaataagtacacagaagagcacaggacggcgtggacgaagaaggccaaccagtgcaccaccctcctcgtcagcctcccaccccaccaacgaccatccccgccaaaacgaagtcatccatgcacccgattcccacgcatcccccaccgaacatgacatcttaatg

SEQ ID NO: 1308 - DNA, 703 bp, Nannochloropsis_gaditana
agccccatggctattgtcatgcctcccgaaacgaggagagagagaagcgtccatttccgggtgacggcctgcgtctttttatactcctgcaattccccgtaccctagcattgccaatccgcttcccaagccaaggcccgcaagaagggacggtaacgagcccgctttcacgtagccaataataccgcccaaggcgacgatgcccgagtaagggatggtgatacagaaagagtacatggaagggaacttcgacgcttttctttaagagcaaaagtataggagggaaagatggcaaagagaatatgagcgtgagccctctcagtatgtaaaccatgtttaaggacgagtaaaagcacagatgcgatgataccgcggagaaaaatggatggggaaacggggtgccgattgtcttttgcaggcatcttggcgcctctcttgaaaccagcgctacttctcaggctcagacaagttacggaggcacgaaaatgtcccctggtctttcgcaaggagctctaagtcgcgcggtcatcgactgggatgggccatggccctatgtccccgtgaccatcgtcttgttgtgataatcgcccaaatggaagcaatcggggaaaggagggaagaacccgagacttgagtacagacgagccaaggcacccacgaatacaatttaccacccaatcacaggattgtatttgtgcgcgatg

SEQ ID NO: 1309 - DNA, 703 bp, Nannochloropsis_gaditana
  misc_feature (1)..(417): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgggcgagggagaacacaaaatgggaaagacgcccgccggaggccaggagcacagcatgaccggcctggccctcggtctgcgtgggatgagggatttacgatgtttcgcatggttcatgagtgctatcgtgtacccatcacgcacgctcttgctgctttcattttttcagcaagcatttatttcccctggcaggttagacactcccagcacacgtcacctccgcgcgtcgatcctcccatcccgcgccctgtacccgctatggaagggcaacaccatagaaaaatg

SEQ ID NO: 1310 - DNA, 703 bp, Nannochloropsis_gaditana
acatgtggcgttgctgagatgtaatggcccgccaaggggaagaccgcgacatggctggactggagcaagctgccatatgcctgtccgcatctcctctagctactcccttacctacttattgttcatggcttcaagcgcaagcacataacatattcacgctctcaatgtacaggcaaaagaagttagtgaattgccgaaggagccaacggaaaaaatggtgagtcttacgcgttcaaggggtttccctttccgtcagagcaggtctctttgtcgtatactttctcctatctcaaatatcatggcacgcatttttttggcgaaagatgcactagtaacgaatttctcaccatatgacagtccacagtcctgacccgagcccttcgccgcgtggccaccgtgcccaggaacatgcgtcgcttcgcatcccaaggaggcgaccacggcggtaagtgatagcagaagtagactgggtttcacctgacgacgtcaagcgtgatactcgtatgacataaatgattgagtacaattcattttgaatatggtagcgtagcatggatgtactcaacgacgggctctcaatcggtgaattggaaaccgacatgggagagctgtcctcatttccagagggtccttctctgaggctgctatcacgtatttacaactgtttacacttatgtttttttgctgctcctttcagctgatg

SEQ ID NO: 1311 - DNA, 703 bp, Nannochloropsis_gaditana
cctatgcgggcctggctaaaaacaaggacaggaagaagaagtggaccaaggccgacgaacgaaacctgaaattgcttggacaggaagttagacacgcctcaactccagcagccatcaccttgaatgccatgcggacctcttttaatacaattgacgtacgcggcctgcgcctccgagatgcggaggccaaggtggacaacttcatcaaggtcggcattccacagaagcggaaagtcgtgtatatattgcacggccacggtacgggtcaactaaaagaagggttgcgagagtttatgaaacgccatccttacgtaagtcgccaccgtgccgctgacgattctgatggaggggacgctttcacgcaagtgttcttgaagtagggcccaagaggcgcaaaatgtaaaataaagtcagatacctcgaagaaatgtgcattaaaaaaattaaataccgatgtttggcttgctgtcgtttatttccgacgctttggaaggcaggcggcggagcgtacgcggggggtatgggccatcccacgtttgaattccaaggttggtgtgtaactagctcgtccatggctgcgccaacctactccctcccgtaggcgccttgctcttcgcgagcatcctacgacaggaaatcttacgagcctgttcatgtcaagcttagtcctgcatgcttatctcttttcttggtcgccgctagc

SEQ ID NO: 1312 - DNA, 703 bp, Nannochloropsis_gaditana
attaatacatccaacgggggccgttttttgtcctctctctggaatgatgtttttgatgttctcctgcaaacaagacaatttcggaactgttgcgcttcttccattttacacgatctaaccggtgaatcgatgaattcgtcacattgatcgtacatgctcaataatacaaacatgtccgctcatgcgtcgccggctttcgacggcacttttcgagttcttttagtgaaattttaaaccttctcgacacagaagcacttccactcgctcgacattcttcagcgagcgactgtagatgggtcagtctcacccctattcctttcaatttgaaaaaagaaacgagcaggcaggggcctctctaaaactttcgaacaatgcaactttgacctctcgtaatcgcgcacgatatacaaaacagatgcttggtagtcggcagtcgccctattcctccatggggcagtacggcccccgacggaactattctacctacggtcggccatcagccaggctgccacatctacgcttggataccatgctagtattgctcgttgtatgcttcttcatgggaatgtatttgccgggttggatgggaatggcgcccactgagtcgcttggacggggcaacgacggttctatgagccgcgaaaacttcgctgtaagtacccctgacttgctggagagagttcaaattttgaaggctcgcatg

SEQ ID NO: 1313 - DNA, 703 bp, Nannochloropsis_gaditana
cgatgagaaaatgccaaaatggcaaatattgcggcgtatgaacgagcagaacctcttccaccttcggaaagcttcttgatcaccactccatccccttgtttcagtccgggaagttgttgacatgactctccattttttctctcccctggatagtaaattgaatttgcctttgtgcgtcgacggacctcaaaagtggggggctcagatatgtcgttgtcgctgagtgtcgctatccaggcgcaaatgaactcctcgattcggccaatcacttcttctcttgcaatgtcatgggtgacaccgcttgcatcatgagaagattgatcaattctagcaggaaagggagtggtattgggaaatgaagaagtcgacgaagataaatcgtcgttgtgcttgccgtttgctgaggtgaggaggctggaaggttgagcaacaggagaagtaggaggaaaaggaggatggtttgaagaatagaaggcagctgcatatgaagggagctccagaaattcacgagcttgcatcttgtctgcgggagtcgcgaaggcctctgcatcatgagtgaacgtaaactccatgaaaaattaacctcctacccccccgaagccagcttgcttcaggtagagcgcgatgcagcgatctgctccccgcctacaccaccaactcactctaaccgcttcgaacttattatgatcgaatcacagatatg

SEQ ID NO: 1314 - DNA, 703 bp, Nannochloropsis_gaditana
catatgctgatggtcgtgtcagccgaggctgcggccagaagctctccggagcctgagaacttgagggacgaaacagctctacgttgcttgccgaggctacctgcagcctgataaggtcccgcttccggagcgcactgtggctgccccccgtcctcttcctcctcagcctgtacgttttcgggattcatggatacctccgacaaatcttgcaatcttgctgaatgattcgatgtctttcgtgcgcattcctctgcggcagcacttgaaacaagtagagcaggtggagagaggggaggtgacggagggctcggacagctggaccccgagaacgtttccgacgagtgatgctgacgttcatcttgcagcactagcatgctatgcttttaagtgatcctgtgtgtgtgtatccgcggtatggcattcctgagggaaggatggctttggtacgattgagttgagctaaggccgcgaggggtcaagttgaggaaactccgtcgccgaagcgactactgcgacacatgcaaccttcttggaggcgcttcgaccgagcctgcatgccgtggaaggcgcagtcccgcggcaagaggcagtcaggttatgcgtatctaatgactgccttgacgtatggtcgggctgattgcatcctccttcttcaattttcgtcccttcctgcagacccacctttttcctcgttagcatcatg

SEQ ID NO: 1315 - DNA, 703 bp, Nannochloropsis_gaditana
atggcgccattaggtcctaattcatactgcttcatgacttctttgtagttcacagtgtcgcggatgtcgatgtttgcggcgaatggcacagactttacggccgggtcaaggttcacgtaatagcttttcgtaccctgactgttaagctctagattgagacgctgcacaagcgtagttttgccgcttcctgccatacccatgaataagagaacgataggcttctttcggaaggggggtggggaggttggtggttcgtccgtacatgatggtggagactcattaggtctgacaccgctgcttccgctctgcatacctgtcgtgtcttttgaagggataattggagctgcgagtgaggaagtgaagtgctgtgagataaaagaggaaatgcagttgccgcctctcatacggagagctctagcgagtatcctagagagcgtaggctgaccgataaaataatgtttatgaaggatcaagcggaaaaggcggaccgaaagtcgggaattctacaaattgatataaaaaggcttaaccttgatggccttctattctatctgagcgggctagtagtctacggactaggcgcaaagactttcctcatgaaccgtttccttctccgtcacacttactccaggtgtccacgtagcccatgtcgcgacgcattggacagccagtaaaccaagtgcggttgacaaatgtagctatg

SEQ ID NO: 1316 - DNA, 703 bp, Nannochloropsis_gaditana
gaaggaattaaagagctactacatggacagagtctgaaaggacataaacatcaatgcgatgcccgaccttcgtcagtctctgcggtaaggcctttcctcgagcgacttaacggcaaagatgatcggccgccttttctaattacacacgctcgacctcagcccttttcttaaacattctattggctatgtcgtaatgatcacgctagtaccaagcatactttgtgccagatttgtgattcgctgccaactttcttgtaagcgaaaacagcgagggctcattttggcaagtaccgagtacaaccctgaaccgcacactagcagcatcgtccatgagctaataaacatttttgtgtggcgccaaaagcaggaaaaatcaaggctgcgggagtaaaacagctgatagttacgacatcggaagtattttggccttcagtcctcgtctttttggctttctttcaccggtcagtctgctaccaccacaagacgcatacgttgccctgtccaaccccgtggtccccacaacatggtgtatctcgtacttcgtgtgccttgtgtggcaagacggtaccctttacgcgtccatcgtcgcacggtatatgctttgaaacgctgctgcactacaaacaccccgacggcgtttgagcaaaccccactggtcctccctaaaaaggtcaagaagcggaaagtcaaagttgacccgatg

SEQ ID NO: 1317 - DNA, 703 bp, Nannochloropsis_gaditana
ctgcccttaagggagacaaaatcgtggtacgtgcttgctcgataaagcccagattcgtcctacgcatttatacaaaaatgccaccgctgttgtgcaacgcaactacgagtaaaatccactatcgtgcgctggcggaacaacgagcacggccgcaacaacatcgtgtgcagggccctgctacctggttttgttttgttttctgtagggaagacgtcgcttctttccgtgttgctgactcggcgacgagcatcaggaaagcccaagagacccaacccttcttcgtgcaggggaatgtcgtctgtagtatttcgttattttcgtgaaaacgatatttgtgcggggggtcgagctggtgggttgaggactacgtgcttggcaccggaggctggttttctttcttcccccttatgaattcgcctcgcgaaccagaagcggcgaattgctcatcgcggagaacatgacatttaaatcagaatgtgccttgcatccttcaccacgtatcgctatatcttgcatctgaagtgcttctacgcagcggtcatgatgaaattcttgagacattttggtgtgttttgagtcctgtcttgaagcccgcacggagtggctcataaggcgaggaacaaatgtgatgccactcccacctcgaaccattttttcctatgtccaccctacgcagccacacatttgaacagaagcaataatg

SEQ ID NO: 1318 - DNA, 703 bp, Nannochloropsis_gaditana
gacagagcgcgtcatacccaatgaattccgtcaatgtaggcgacatcagtcgttgacaggtaggtgagcgatggacattttcgctcatactgacgaacgcctggacagatgtaataccggattcattctcgtcagaacgtctctgcctatgcccgcgcccataaattttcccaagtctccgggagacccccgggcttcattgagtctggtcttcataccgatttgactccgtacttgcgtttaattgtctaacttttttatctctgacgagcatgcccttcgtgtcatgcttccgtggtgtcttcctggtgcaatttctcggcagagggcagatttggtgtccgcccacacaatgcgagatcggggttttaaacatacttaaagtcggcgaatgtgctcagatcaagtataccactaccaagcatccagtcacaactttggaatctgccccttgaccgaacctagaccccagcgcaagttgtcggtgcatgttgcattacatgggtgtgtatgcctgatgaagtgccagcgtactacagacatgggacatagtcgttggcgtcgcttagactggttccgggcgttgggtggccggaccgcgggcaaggacgagtcagcgtcaaagctagatgtgagcgttacttttctttctgatatatccaccacgtttactccttcgactctacaggcgagttcattgatg

SEQ ID NO: 1319 - DNA, 703 bp, Nannochloropsis_gaditana
tcgcatccgttgcggtagtgccgctgctgaacgccgttgggatgtcatcgttagaaaatgccactgcacatgttgcgtggaggggaagatagcgaatcatagaacaatggcaatattcgccaacatcatgtgcaaacataattcttaaacgcacacagccgtcgcctcgaagtctttaagtcatctgatggcgtgcacgggctcggctttgtgccttcatgccccttcaagatacggggacaatacgaaagggagaaatgaatgtcagcatcgaggcgcaatacaatttacaaacacccacgaagatgacatcttcggcttttcaaacgttaagacggaatatgtcagcacttgccagcctggctgtagggcgtctgtaaggcgaccctccaatttggcgaagccacgctgacgatcaaagctggactcaactcgccccttggttgacaaaaacacttcgattttgaccttttcgagctcaaaagtaccttatttactcggaggtctaacgtctgatacacttttcacagtgaatgggggcatctggtcgttttgaatgagttgcaagcctgcatctcttcgaaaaggaactaagttggctcgcaacgaactgatttgctgtgaggagatcccagaggacaggctaatataagcaaacaagcccaaacacacgcatccaagggcctcacatttctctgccatg

SEQ ID NO: 1320 - DNA, 703 bp, Nannochloropsis_gaditana
attgagggtgctttgatgttgctttatcttgtgggcagagtatggcaggcataatccgacgataagcaggctttaatgaacgaaatatgatccaataacttatgtttgacgatttgcgagtaaacgaaacgttcttgatgcatgaaatgtttggaaatcaggcgctggaggggcaaggatgactgttcttcattggtttcgagcatattaactccatatttatttctcctttattttacctccaaattccagtttctcaattggaaatttggccgatctttggaggaggaagatttgaaattaggcttctgcatgcattttatgcaggatccggacattacaaatctagaatggcggttcgaaggtatgaggattcgaggcggcgggaacgggaaacgtctgttctggataaattggtctcactacgagctgctaaaaaaataaaacgcaaatcaaaagtacttatttttgttttgacattttcaattacaaccaatagagcacaaatgccatggctggtttttgccaagtatctccgtggcaactctcaatttccggtcttatgatcgctcgactaccgtcacatatcgagtcgtcgacgaggacacgatggcagtctctattgtagaagtggaaagccagcgttcatccgtgcaatacggtcacatgctccgcctaccggttgtggacactagcaaaaatg

SEQ ID NO: 1321 - DNA, 703 bp, Nannochloropsis_gaditana
gaacaccctgctctacgaagggatatgcgtgcgcagaaggtgaaatgtcgggacacaattcgcggcgaaaaacatgtctgaggcgacgccaaaaattttcttcaaaaattcttagtttctcggagaaggtatcacttctcgcggaaccttcaaataataaaaaatcgagctcgaggaaaagaagttagctctggaattgaaattcgtcacaactactacgagtagtatgactaagaaatatcgttacctgcgtgaagatcgacgagcccctattttgctacaagccacaccttctcagatgatagtaccgtcgatgaaatgcgtgtgatcgcgaacaaacgttgattgctgaccagatattgtgccatttttctcaaactttacgagccaacctccccccctatccctccgcgccgacatcgccgtctcgtggctgttcctgccggaggggaaaatagatggcctctttgcaccaaacacgtcataacacagcacgtgcacactcatactcaccattgttttttttgggtgtacgcacggccccacagcacggttgcacgtgtcagcaaggtcgcgggtcgaggatactacatctcagcgcttggctttcggatgatgcagcgcaagagagtgtgatacctcatctcttgaaacgccattttcatcaaatcaagacgtagtattcgtgaaatatccacacatg

SEQ ID NO: 1322 - DNA, 703 bp, Nannochloropsis_gaditana
atttaccatttccattcctttgcgtttctttgtcatggcgctacctcggccaatagtagaaaaaatagtgagataactcaacaacgaaaaacactgtaatcaaatgacgaaacgaagcaataaacggtcgacgaattgcttcgatcgtcacatgcggacatgcacggagttaaattggatccgatgtacggcaatatgtcctccccaggaaaaaacttcagcgagacgagcgagttgttaaaaaagcgacccccggactataacacaaaattagggcgtaccacgccaacgcttatgccgcctgcgttaccccataccaggacacgttacgggaaccgctcctgcgtgggacgcactgtgacgcatgtcgccgtgcagttgtaatgtcaggcacggtgcgggcgtgtctggtatttttgtgtggtaactacaggccaggcgtccctcggggcaggaaacgtctttggcacgacacggacacgacgggaggatgggaaatatcgtgcgaatcttgcctcattcacaggccctccccgctctgcccgcgtcgagggagcgcacgacgagatccttcccttgtcatgactgatatatggactctatcggttgcattcgacgcatttccatgtattttgtgtgaattggtggctgtgacaatggcattttcctcttttcctcccacttcaacaagagttgacgcctc

SEQ ID NO: 1323 - DNA, 703 bp, Nannochloropsis_gaditana
tgatggcaagggggggtataaattcgtgttgagtgcgtcacagggcgtccaggagacgaggcgtaaagcgaatcatcgccagggaagggatcgagaacttccctgccttgttggtttcaccgcccgtcactggcgtgccttggcttttaaagggctttcctacatatttttgcacgttcttcttgtttgccagttgcctcccaaaatttcacttatcatttcgaccgtcctgtcttgtggaggaattaatccggctctctcttcatctttttacatcgcagagagcggaggtcattctgcacaggtaatggccgcatgccgcataccaacgagggggaggtgtcacatttcttggacaggtaccgcactttcatcagcgtgtactggcaacaagagattcgcgacgagccagacggatgcagccaaatggcgtcagatctacggccaaaaacctcccccccatgccggaaaaaaagccttgcctccccaagaactcgcccggctggacgctagaaacggcatcctcgttgcccaggaatcagacgaaggcattaaaactttcagagcttttgctggagggaaggaagattacgtgttgcgcttcggtgaccatgtgtgcgtgataggcaagaacggggcgggaaagtccttgttttgtcaggcgctcggcgggcatagagaggtcctgcctcacgggatgatg

SEQ ID NO: 1324 - DNA, 703 bp, Nannochloropsis_gaditana
cgtcgtggttgacgttgctgtacatcagtcaccatgaggacgaggcattgcccgaagtgacctcgcacgttctagagctcgagcgcggtcgggtgtcgtttgccggaaagtctgagcagtggaatgaactggcgttgaaaaggcggaaggagcacgaggcggggggaggaagaaggggggaatcggactcagtctagcttgagcctcagagtgagtgagtgagcgcgcgtaatccttacccgaggcgcggcccacacccggcgcacgcactcagcatgcgtaaatgggaaaatggctagcacaaatatttctgccttgttgataattttgtgtacgaatgaaaattgcggccgtgtgtacagtacgttccagctgttgttaccgctttccaaactacaccgatgggagcgtggacattgtttttcccccgatagtttctttcgcattcacaatatctgggcccaatagtgcttcactttccaacccatcgcgccgaaaagagcgtccaaacttttctttgtagcagtgccatcatgagggctttatgtcttatgcgtaccccccgacccttttcgcggaatttttcccgagacccgcccggccttgccgccactcatccccagatacgatacttagggtctcgcggccctggcacgcttactcacgcatgttccgaccacattgatgcgcaggcgaaatcatg

SEQ ID NO: 1325 - DNA, 703 bp, Nannochloropsis_gaditana
agaggcggaagaggaaaggagaggcttgggagcctgctttattgcacaaagcacaggactgtacccgctactgcgagcaacgcagggctctgcgaggctagaagctactccgaattctgcgtgggggtggaaagcatggcgtacgtgataaaaacagaggaccattccgcccccggctttcggtgggtgtccttgaaacggcttcagtattgcgacgccagaggccgcaagcggacgtgggaaatggcggagcggatccaacgccgcactgcctcagagggccccccacctgcgaacggggttggtatcgtcgcgatcatctcaacctcatttgcgaaggataacgatcacattgttttaggtatgagtagatagccgagtgtctcttggcagcaagctggatttaatctgtggctgcgggatcaaaggacgattaagaaaggcttctctcatatatttgcaccatttccttgcctccgaactcatccctctcccaaccccccccaagtctcacagtttcgaccccctgtgggaaaggaggtgctggagctgccagcggggcttgtggacgacggggaggtagggattttggaggataacgatagcctcatgggatttgaatagcaacacgcggatctatatagcggcaatgcccgaaagagagatctaagagaccgtctttgcatgctcgctcaccgcaatg

SEQ ID NO: 1326 - DNA, 703 bp, Nannochloropsis_gaditana
agggaaggcagacgaggcagcgagggaagaggctctgtcttccacctctaacagcgagagcgccctggatctgacggctgatatcaaggagatcctgatagccggggctagaacgagtcaagccacgaagaacagcccacgcaacggacttgacggacaaaataataacatcagcagtagcccccgcaagatccctgcggcatttaccagccttgcccctcccctttctccagaatctccccgagagaagcggggcctactcgacttctccgcgctcagctctctgtcccccggccgcaagaaagtcgctggtcttggatgtatccgcaacacaacaagtcctttgcgcgcgggaagtgcgcctgctggagctggttttgtatcccagcccacttcccctatctcctcctctccaagctctccctcctacaaattccctctcagctcccggagccctgcccgcggcagcagaggcagtcctaggctccacagtttgcggaacctgacaggcacgccccccaatactgcgcgctcgccaaaacccgccgatggactttggggcctcttgggctacacgtcaccctcggacagcgccgtgcacgaagccgcccggcagggagacctgccccttctccaaacgcttctcacccagaaccctaccttggtttccacgcccggcaatgataacgcgacgccgttgatg

SEQ ID NO: 1327 - DNA, 703 bp, Nannochloropsis_gaditana
cggaacctgggggctacctgctacctgaacgtgctgctgcaagccctcttcttcaaccggcgcttccgccaggccgtgtatgaattccgacccccctcaggcccccgccccggggaggatgggggaaggaaggaacggatggtcctgatcctccaagagctgcagcgcctcttcgcccacatgcagctggggatggcccgggagggagaccctcgcgagttcgtccggctcctccgcctagaccggggccagcagcaagacccccaggagttccgccgtctcttcctgggcaagatcgaggagtgcttcggcgccctctcctcctcctcccctccctcgtccccctccccggacctggcctccatggtgcggagcctacaccggggtcgcctcctgtacctgaccacctgtctgagctgcgggaccgcctcccgccgggagggccccttcgacgagctcgaactctccctcctcccttctccgtccttccccgccaccgtagccgccggcgtcgcccggtacctggccccggagcgcctggagggggagaaccgctacctctgcggccgatgcggagagaagcgggaggccgagcgccgggtgatactgacggccctgccccccctgctcaccgtgcagctcctccgctacgtgtacgtgggcggggagaagcggaaggtgaagcagattgtggccctcgatg

SEQ ID NO: 1328 - DNA, 703 bp, Nannochloropsis_gaditana
tcctcctggctatcggctccatggcagagacaggacgcgtgaccccaaatgcgggcatggaagtttccccgtcgcggtccgggaatgctactgactcaggtgaggaaacagaaaactggtcccatgctctcttcgatcttgtattcgtcgtggcattgatgatcatcgagcctgctgcaaacaatggctgcttgtgtgagggagattcaagtgtattgttcgatcgatgagagggtgcgctaggggtgtacttgtaggaggtggtaggaacaaagttcttccgagctgaagcgcgtccactacctcaataagatctaacgcggcacgcgtgtcgagtgtcattggtctgccactgcacgtgcggacgctttcaggatatcacgtcgtcacacattcatgattctgtcatccgatctctggcgccggttgcctcaagtagaagcggcaacttgcaaccgcgaggctggcctctgggagtggaggagagggggccataggagtgccccatttttttcaattattgccacgcgctcgacacgcttacatgttcgagacaacagaaacatagtgttgtgcatgacgcgtggcatgacgtgggttgaggcatgtttttacgccttttttgcagcgtcaaccggcgccatgatacattgtggtgaccctccactcacctcattttggacccgctcctgcacattatgta

SEQ ID NO: 1329 - DNA, 703 bp, Nannochloropsis_gaditana
caacgagggcctcatgtcgaagcgcttggaagcagaacgccgctgggtgatgacaggaacgccccatcggcacgatgccgcggatctggcctccctgcaagccctcctctctttcctgcgccaagcaccgtacggctcctcgcacaacgagtactggtacaagctcataagtggacgaggggcaggcgcagcgacttccgaattgcgtcggaaccgcttggtcgaactcttgcgacgaattatggtgcggcatacaaaagaaagcatccctgagatcccggctccacactggggagtgacacgcttgcgcatgtcgcgtttggaagccaccacctacaacactctggtgtcgttggtccacgcaaacctggtcacgactgacatggtagggggcacccacgcaccaggggcgctccatccggacagcatgttgaacccgatcaatcgggtgtcggcgaacaccctgctcggtaacttgcgcctggcttgttgtggaggtggtgctcaggtcgtgtctatcgagcagcaatccatcgtcatgacccttcagttggcgcggcggttgttcttagagtttcaggaggctcgccgccgaggaagggagcggacggccgtggaggaagaggaggatgaggaggcagtctcggtcggtgtggcgcgggtggccgcttttttgaaccgcctcagggcgtacgtgaacact

SEQ ID NO: 1330 - DNA, 703 bp, Nannochloropsis_gaditana
attgctgcagccaggcctgtcagtgcactggcacgaggaagatttagtggtgctgccggaccgggtggataaacctctggacgaggacgttgcaaatcacaagggttctggtaatattgtcaatgttgacacgacttcctctactgtgtctgtgcagtcgccatcatctgtgccttatcacttcgatccaggaccttcgcaaataaattaccacgtgacgtccaggttccttgacactggcaagaaagcagatgaacgaggcgaaaatcaggtcggaggaaaggagagtcggggactaattggacatggtacattgggtgctggtcgcgggcctctgacttcagagaagatggagccccctcctaacagtacggttggccgggtgagccaccacactgatgtcaatgaggaacacttctctgaaaagatggacggcaatgctgacgacggctcatggcaagtagttagcaaagcttggcatatgataactcatttgcgcgcctatctcgagaaccagtcaagcaatccttcgtcgcctgaccacagtctccccttgaaggctgtcgtcttcagccaatttcgagtgtatctaaatggactgaaagtggcgctggagaaccacggtttccgcgtggggaaattctacgataaaacgaggcttgctgatctctcgagattcaaggccacttttgcgagtcatggc

SEQ ID NO: 1331 - DNA, 703 bp, Nannochloropsis_gaditana
atagtgaaactgtccatgatgcacgcggtgtcttaagtcttgccgattttaattttgcacacggggcagacaaaattcgcgaaataaattcgggtgatacatgtgccaaagagcctgttcgacgcgtgcgcttcgaatagacttgtgaaaaaataaccatgcgatactgttttgaagcaaaagtttttacaaagataaaatatgtaaaaagcatatagatattgaaatggcaatctaacattttgcttgcagtcgcatgcaacgtttccaaaatatatccgtcaatcaaatcttaattgtaacatatctacccctcctgcttttatgcacgggtgagtattgttaaagcccgccattaaccgctacaaacaatgagtctgatttggtccacagtctttgcgggtcttgttttgccacattcgagattgtattagatgctacgcgacgggccacgatatccaccgagcaagagaagttaacggaaattcaaactggcacaagagggacgtcagaaatatgagtctctaaaatcaacgtccctgtccactacgtgaaacactttcatcgcacgctttttgatgtgcataaaatgttaattttctgccgaagcgatctcgcggcggcgactttatcacctcgcataatatttattcgcattcttcttacaatgccaaatcaggaagtgataccacacctcaacatg

SEQ ID NO: 1332 - DNA, 703 bp, Nannochloropsis_gaditana
tgaaaaggagagacgtacgatgtactgaccaatcgacaagggtaattttatgtcgatggcgactatttgcggagaggtagaatatatttccgttgcggtaaatgtaccatctggaaaccctacgcttgctgagtttatattcaatccgactgaatgcagccggacgactgccgtgggccgctttaccacgatagtgacatcgaccattccctttgtggccaaatcgggaggtcccgcgagcgccaggtgcacatcgtaggcaagtggtgcgacaacgtcacttggcaagaggccttgctcgtcccactcgtggtgcatggaagctcgtctctgaagctggagcaggaacaaaaaaagcacgagggggcaggaggttttgctcaatatcctcaaggcacatcgaaaaccataacacacccgcggcggcagcgtatggccctgatgaagggacaggacacgagtttcgtggatgagggcgaagtgtgagcgcgataactcccatgccatgctgcttagtggcccgcaacctcagacctttgggttgaccgggcgtccctgtgtgccccctcactgttcagcgacaagagcgaggcgcgttcgaaaaatgcattgcagtccaaaccctaccccttaaccacctgttctcattaccacagacatgcttttgcgatgcgccagatggggcagtgcagagctagcggcg

SEQ ID NO: 1333 - DNA, 703 bp, Nannochloropsis_gaditana
cgcggctgtgggatgtacggaatgagatgtgagtacataaaagcacttctcagtgcggcggagaagggatgacctcctccttctgcgccccaaccatccatgatctctggagtctcaggtattcgctaccgcggataaacacacagccccgttttcaccgcatgccatgcatcatcaagatcaaacgtttgaaagacctagtaacccatcgtccggagaaaaggcgtgacttagctgccaccagaccggctacctgacctctccagaaaagagcttctagcgccttctaattcgagctgctcactctccttgatgggaccattaaaaagtaccgtggaagcccaaaaagcgtgcatgactggccggagggactactgtagcagttttgctatcttggcggacatataccactttttaatatcattttgcacggaattagttttgctttcatcctcctcctactaggagtccatgctttcttccctcatcacgatgtctaatataaaacaatgtatgtatattattattcccccggctgtgcatccccgccttggacatgcatcgagctgtacatgctgcaacaaaagaagatagtcctccatgtagaggactccgcaagtcgtatccttcgtgtcacaaactcatacggtcagaatttcaacgtcttcacaggtacaaggttgcccttgccgactgcgcgatg

SEQ ID NO: 1334 - DNA, 703 bp, Nannochloropsis_gaditana
catcatctccagccttcactccgtcacctgccgcgtcgaccagtgctacattacgaagcagtggagtccgcagcgatgcaagtagcggtcgagaatcacgctttcgagattagtttggagtgaccagttcttgatgcgaatgaattcgaagtgttctatgatatgttcttaaatgttgtggtatttgaaagaattacatttatgccacagttgtgcatttcgcttcgataaacattcataccaatcgcatggtacgcgtacaaattctcccccttgagcattagggccgttccttacatgctcttgacgacgagaaagggtttctttaaccctgtgcccccagtcaccctgatcagactcgacctgcatgggccgtattccacggtaccagcgcacagagccatcaatataccttcgtacacaagaccttttgaagagaaaaagggctagttctagcagcagcatacgcctcagtgaaaaaatgtatgaagtcattcgacaggatataatttatgaagggtcgttgccgtaggtcgaggatgactgtaacctcccggcttcactcgtttgggtcctggtctgcgaaggcgctgggcttgccaactcggtggattagtgtagccgtcacaaaaacagaaatcacgctaataatctacaggacatacaaatacagctccagaaaagaagcattcccagtagcatg

SEQ ID NO: 1335 - DNA, 703 bp, Nannochloropsis_gaditana
tgagatgggcgggagggaaagagaaggaaaagcagactctgagagaggacagggggataaaaaggcgacacattaaaacgaagggacgtcctttcctccaagaacgttgatgcgtgccctccatgccacttccagcccactttccagcaaaagacgccttggtcccggggcaatccccttgcaagcgccggaacgtcacgggcttggcgaggccagcggcttcaagaatgtattaaaaagaaattacgtgggcggtgagggagtgactcacgcatgaacacgtaccgccaagacccagccaccaggggtctgccctcaccggccagcgcgcgtcgtgcccgcgtgtgcattgttgaaaccagcttgtgtgccggcagtgcatggtggcacgtcgggggaaggtttgggacacgatgcacgggcagtgacgggcacgggcgtggtgctggcagcggtatccgcccagagcccgggaggagtcgctcccgtgaaagtgctggcattgtcgacaagcccactgctccccctgcgcagttcaacacgcatcactcgttgttgtcacattttatgtgctcatggtttcccaccatcttgcattttattgtcctttgcccatgtaggatttgggttgagagggcctaggtcataccagcactccaagatcgaagggcgaagcatcgagtcagcaacatcatccccgatg

SEQ ID NO: 1336 - DNA, 703 bp, Nannochloropsis_gaditana
tttcgtttccctctgttttggtttcaggttattgggaaagtggcacggggggtgcttgtcgcggtgggcgataacttcaagccttcaaattgcacccgttcaaaagcgttccgagacctaattgcctcgctccatcttcatctcaaacagtgcgagcatgccaatgcctgagcattggccaccaacgtcggacgaacattttccactgtgcctagattaacaagccggcatggaagcagtcctaaacggaatcgacacctgccccttcggggccctcggactcctcggctctcttactcttacaggatttgcgcttcaacgggctgtggatggtccttcaaatgcgccagtaggacagtatcacgctcaatcctggaggcgctgcgttcaaatcgaaagcccgctggcatttgtgaacgtcgttgttattgtggcagaagcagttatctatcgccgacgctttgggtggtgcgaatggatgcacataggtggggtcgtgagccctacgctattgatgtgcattttgtgggactatttcgacaaaaattgttctaacagtgccaaattgctgccgggcatgtgtcttgtggtcctggctcaagtaggccgtctcgtagcggttgtggtctcctcagcaacaccgactgtccttgatctgacagcaagtattctgcttcttttactatttttttggaaagtcatg

SEQ ID NO: 1337 - DNA, 703 bp, Nannochloropsis_gaditana
cagtggcggtctgggcagtgggatcatgtgtgatcgatcacccagtatcagcgggactgattggattgtcgctaagttacacatggccgcttgtgggtaatttgagtggtcttctgaatgcgtatacagagacagaaaaagaaatggtagcagtggaacgggtgcatgagtatacgaccgagccccctgagcccgacgtcgttttcagtacaatgatcggcaaggggtgcgaagagaatgctggagtcgcagtggaggtacccccctcatggcctcaaaacggcagacttgctgtccacgacctcacgcttcgctaccacccgacgtggccaccagctttggaccggcttaattttacaatcgaaccgggcgagaaggtcggattgtgtggtcgaactggaagtggaaagactactctattgtcttcaatatttcgactcgttccctgggaatgtggcacaattataatcgatggattgtccgttcaaagtgttcctctaaagcgccttcgttcctctatggccattattccgcaatcgcctgctctttttactggtaccgtccgcagtaatttggatccgaaggaagagtattctgacgccgagctttgcgcggctatgcaggcttgtcatcttgaagacttccttttggacacgataactgatgtcgatactcccaatcatcagaaggaagcgaaatctct

SEQ ID NO: 1338 - DNA, 703 bp, Nannochloropsis_gaditana
ctcagggcagtggctgttgtcgctcatatggtcgtcaaggcaagagcgacaaaaggtgtggctgcagggtacagcgactggatccttgaggaaatgtttactgtgtagtgaatatggaatagaatcaagatgcggaaacatctgagaacgcctacggcggcattcaggtaacaggcgggtgtatagcaatggaataagaagaaagtccggaaaaacacgtcaatcggaaagcctgaattaccacatggaacagctgacaagttcctcaatcttgttaatgaagtcttgctgccctttcgggtcgagtaggcgggcgagggtgtcgagggagcaaggaagaggaggggatgccccggcacccttctctgctccttcaccacctcctctgcgggaagccttcctcattgttgcggctgctccccagtcccgatgtacaagcgccgtctccgcctcgtcataggcctcactaacactctgagatggagcggattgcgtaagttcatgagagagagatgtcgatgcaggactgcacggcctcgcgtgaaagccgcggcattacgcgagttcagcgactgccgtcatcggcagcacgcaagggttagggttcgaagcattgcgctggaaagggatggggaggcggacagaccggaatgttaatgaccgtgcgcccaacctatcctgctaggtgcccttggcagcgatg

SEQ ID NO: 1339 - DNA, 703 bp, Nannochloropsis_gaditana
tttagacctttcaaaggcctcggccattgcccaatgggtaagtatcgtcgacgcttactctccatgtgtatctatgcagtacaatcgagtgctccttcctgtattctatcggtggtcgtattattcgatatctgatgcgcttttctgcttagctcttcctggacctcccgtactcttgcccttacccgttcacattttcctttgatcctacagatgaagatccggctgtggttgacccttttattcgtgagatggttgatacgatagagggggagaggaagggcggggctgctttacccgcgtaatggtgcattcaaatctaaagggaaaaacgtttgcaaatttgaatttttgaaaaaagtcggagccggattgatctgtgctaccgtctggcgtccggatagggtcggtggtgggacacgccttgctattacgacatactcctgtgtatcctctaatcgcatgcccctcttgcgcaattattactttccaattggcgaaagcgtttaaactcttttggttgtcacatcttgcgaatttttttcttatttttctgttggaactattctcttgtcacatggggttccctcccttccctgccgtccccttttccttcgtgcttattatgtgtccaagggatgaatttagtatgctcacgtaaaaaaaatcttaattcccttatttatttgtatgtacctacctc

SEQ ID NO: 1340 - DNA, 703 bp, Nannochloropsis_gaditana
ctaatcgtataaaacctaaattatacattacctttcgatagagcgtttttaaagatgaggaacccatttcgtaatgcgtttctggagccatagctcagcgaatttcggtcctctcccaggccccgcccgcgcggggatgacggagagcgttagagagtggtagattccagttcaggttcgagtccccacggggaccaggaccccgaagggacatcctattggtcaagggttcacaggagcagtgtgtcgcacataatggtgcgggatgggttcctggcctagaaacccctttggcttcagtttcatttttatacttttgcattccatgtgatcacaggcctccactgtctcgtgtcgcgcgcatcactgcacaacttggtttcacggagggggtaacatgggtcatgtagtccatgcttgtgaacgctcctacaatattacactaattgcctgcggtactacgccgacaaaatcgaaatccaacagatgtgaggagagatttttcaccctgcccgctaatttctctccacacgaacccaacctgaaaacaggccaatgcgtttctcgggaactgtcttggatatgtcaaacatgatgataggacagacagtcagccgcgtaaaagcccttcagaggagtatagcaaattcatcttcatttattttacggctgtaaagacttttgaaacacatccgccgacatg

SEQ ID NO: 1341 - DNA, 703 bp, Nannochloropsis_gaditana
ccattttcgtccttgaaagctagattacgggccgtgctgaccaagtatgaaatgtctcttggccaaagataggcacaaagttcataaagaacagcagcgggcagatttggcaatgtcgttgcagttatttgcccactctctcggccaatgtcacgttctttcattggcggaaaatgaaaagttaattttcataaagtaccctgcagaatcgcgcagattagtgcgcggaatgtgggaacaggaagaaacagcaagtggattaattatattcctatggcaattcattgcacgtcaaaacccgccacgtaccatgctttcgccgtcgtcgttcttgctcgccgattcacgtcggaacgctaataaccgcacgaatgttcaataaccacttgacaccgttcgaaattcgtgaacttaaaagtataaatacatcataaatcgtagatgcttcttgcttccgtccgccgcgccacctcaaagcatgtacgttcccctcataagatgctgagcatcctaccgtgacgcctaatttgccaacatgaaaaactcttttcaccccacattcaaagaccaaagaataagtagatacatttaaaatacttttttcctatgatctatatgtacatttttatttgaacacttacccaacactttcctttgttatttatctgcacgactctcctctcgttattttgttttttgtcag

SEQ ID NO: 1342 - DNA, 703 bp, Nannochloropsis_gaditana
ctcattcgtgtttttttttctctcttcgtccgcatctctcgtttgctgcccgggacaagtggacttaccgccttgaacgtcctcgggcctcaccgcaccatcttccttcttcacttttttcatgccccactagaaaaagggagaggggggaatgtagctgaagatgcttcaaaggaatatatcgcggtacaaagcaaaggacgatggaccccgcctcctacatacctgagcctgaactatgagcagcagacatgaaagcaacagcagaagaagacgacccgaatatgataggcgcgtacacatgacgaaattctctcctacaacctgtgtctggcatgaacgggaagaaacatgaagaggaacaagggcaaagagataaggtttccctgcccctcccttcgctaggctgcatttgggcgaaagggatatggagatggcatacaaaaatcattaacgtccgtagtaggtgacaaagagcactacatcaaactctatgcgtaatgcacttaacagacacgggaggaatagtacgcaaaacacttttttcctccttgcagctcatacccagcctcctccaccacttttatcgcccctctttcgacgctcgcctcctcgctcgatccagctcaactcaaccatagcttgcgcaacatacacaccacacctcccgctacagatcctttgggtccaggtcacgctcatg

SEQ ID NO: 1343 - DNA, 703 bp, Nannochloropsis_gaditana
tgcagaaggaattaataaagtgtgggtgtgctgtatctatggagactagaaaattgagttttaatccgggcggcccaagtgtctgcagaaacgaccgcggggatttgcatcatccaccttggcacttatactgaaccattatttgatttttttcaatacacagtaatagagacaagaaactatgtaaatttaatgtctggccaagtaatatacgtgcagaatgagctgtagcaggaaaaatgtcgattgcgtcaggagcctatattatatggaccaaattccgcaagcttggatgaatttacgttctatcccttccggctgatttgcacagcgtccacaccacattattacagctttctgtatcttctaccgggccatcgacgaaatgaacatctcccaagaggggactttaaacgaccgaaggccaagtaattggggtagccccgacgtcgattcctgactatgagggtgtcagaaagcgcaagaatatcgagacctccaggacagccgaggatcggtgcgtctcctcatatggaccagattgatggagatcaacgagccgtagaaagccggtgatagtatctcaagtcaataaatggatgagccgtagaagcgagaagaggaacggaaaacggcgtcaacaacgaccttaactttcccccttgacagtgtaaacaggcaattaatactggctggggtcatg

SEQ ID NO: 1344 - DNA, 703 bp, Nannochloropsis_gaditana
gaaatcgcctgtttgacactcactacaaggaaactgcagcaccaggctccgagagagacaaaattggtacaatgtaccgataaaatagcctttttggtgcacagtgcacgagagacgcagtactgggctccggtctttatactaacctaccaagtcgggagaaagtcgaagggatgggccgaaaaagagcaacagcctccggcacatccctccagccctctgtcgggcatttcagactttcagctccgtacattcccacaatttcctggaaaaagtggagatcataaaatgtgccacggttgtcgtggtaagctcacgggtcgggggaaagtcacagagatgggccgcctggggaggagatcctcaatgatagcgttccctttgtcggcagtttccgacttcttccccggagattcctagaaaatatcctgaacagggtgaaggtcgtaaattttaggggcgacgtagagcatgcttccgcggccgggacatttattgagcacgatggattggctttcaacacgattttacgggtgatctgagtcatcatcttgtaaagggtccgctttcgtgccaagttggtcgtacatcaacttgacatggtacacacgaacggaacatctcttaccttgttgcctcactcctcttctttgacgctcttctcgtttttacgttgtacagacactttcacaccataatcatg

SEQ ID NO: 1345 - DNA, 703 bp, Nannochloropsis_gaditana
cttaaaagactctcctttcagtattttatcctggaccggtcgggtggcgtgggagatccggaaagagaatgagcgagccccggggcccataaggcatttcacccacctacaccaaaactttttgcataaaaaccgtgcgctcaatcatgttttgctccccgaaggtgtaaacgctatcggagtacacaattgtatgcctaagcacgctggcaatgtgccggagagggtttcatataaatgagcgcctaccatttgacgcggagtatacgcagcaattcttcagaatcatcatatcaaccgccttgtttcaaaattacataaaacagaacagcgacgactttcctatcaaagtaaacattactgtcggtggaaaggcacaccttttgaacatgtcatagcgaagcagtcgaagccagttttacgtccgtctcgagatcgatcatgcgtccacactctacccatcagtatgccacccggagtgccttgagcacagggaatggtagatttaccctcattttgcggtccattgtttcctttttttcctatctgcatatctattgggaaatttgtggatgacattacccatggtccctcgagaaatgggaagagaaacaagtgctgacgcgagacctcgatacagcgtgctacgacacggcaatcacggttctgctgcttggtcgctaagaaatcgtaacatggagga

SEQ ID NO: 1346 - DNA, 703 bp, Nannochloropsis_gaditana
gaggagcctttcctcctcctcttcttcctccacctccgcccctacctcaacctcgccttcctccatctggccccctccatcatgggcgtggcccctcgaccccgaccatgaagcctatgggagagacatgttcaagattcgctttcccccttccgccgccgcctccaatgcaacttgcacgggcgctggcagcctcgatgaggacttggacttcacccttgtctcccaaagctcgcctgacagaatctggatgctccctcatatctgtgagcggtgggaagggcccataatcgtcgccatcttcatgcacggcttcaccgccgagcacgacgccttcatggcaaacctgaagtgcccccagctgcaatgtctcccagtgcacccctctgtccctgcctccagctccattcccgcctcagtatgggccgcaccaaacctatatcctgtcaatgccttgcgaaatctcgcgatctcggaagtgagaacgacgcacttccttctcacggacatggacctgtggccttcccgccgtctctaccctctcctgaagcacctgtcgtcgaagagggagatagacagtaagggcacgcgcgagacgtttctggacccgcttcaggcgctagtggtgcctgcttttagttatcttggacaagtaactggaggcgagaagcaggaggccagggaggacaaggtgggagggatg

SEQ ID NO: 1347 - DNA, 703 bp, Nannochloropsis_gaditana
agaagccggagcgcaaacgaagccagtcccagcgatgtgaagggcagggtggctcaaacagctgcaggtgacggccctgagggtttctataatctgtcgaggcgatgtctccgagtaaagcgtggagtttatgtggactccaagctctcgcatctcctcccgaccgtccgcagcgtgcaagccatgcccctccggcttggggcggtcgcgagggagggtgaagacgccaacaggtcgaaatcgacgcttgcacgaacaggtggaaggatttacataaattgataagcgcagaatcggtgataaagacatagacaggaactcagggttctgagtgcgctgtttttttgtgtcgtacacgcgtgtcttggctcctccggcaccgccagatgggggcttccaagctaccactgtgctctgtgctctcctttttcgtaaacccacctccaacctactgagcttctgcttgtacaccatttgcgctagattgtggctttcctttatggaggcgggcacctgaaggcccccatggtctacctcccgacagtgttctttgtagctgtggaattcattgtcaggacatctttctcctgtcaacttattctttcatgaacaattcgcttttcaaacacgcgattacgaagcacagacagaggcctctcttgggcgccgcgcgtgatcaacgcctggagattgagacgtgatg

SEQ ID NO: 1348 - DNA, 703 bp, Nannochloropsis_gaditana
tggttgtttgccgtctgtctacccagcgcgcggtaggcgcggccgaaatccactggtatttagggaatggggggggttgatgtttagtaggtggccacgaagaagctccgagacagcggcttagacagcaaccccttcccgtacaaacacttcggtacaacaaatgaagaatcccatgaacatcaattacatgcacagctagtgtctagagaccgcattcggtgaacacaagagacgttgaccgtcgactagacacgctggcgtccgcatgagaggctctcctgtgggcgctccttgagggctccctcctcgcggtcgtgtggctggctaagcacagtattgcctgtcagacaaaactacatcggccggtcgcgccacaaatcggtccctcgtcctgcacataacagcaagagtacgttcacgacaagcaagtacgtgggggacagctccaggacgcccccaggcaggccgtctggttgagcgagacacgtgcgtgagtggcggggagcctcaggggagagcagcgagtatcttttcgcctgtccggccgctcccgggggctgaagacgccctaggtgagggcttggtggctggattcgggatgtttttgcgcccacatttaatgaatgcactcgaattgatgcaggagtggtgacagggccttggccacgtgtctcgggctcacggtgggagcataactatg

SEQ ID NO: 1349 - DNA, 703 bp, Nannochloropsis_gaditana
aaaatccacacgtgttctattttgttacaacgtttatcgcaggctctaagcgggatatatcttgacttttgtggcctgtgatggagcccgcgcgatgtgtgcgtggtactgcctcacgtcgctgtcgggtcgctaaatcaagagggggcaggactcgagctgtgtgcttagccgcactaggacttctgggagccatggtgccatcaaaggctcagcaacgcagtatgaatagtcctaccaaatctgactacaggcatggtatgggcgggatgggtaatggggagtatggtcgtggcgagcagcaacagtctcaggcctccagaccaagctccctcagccacttttatgacattgccaaagcgcagtctaaattcctcgatccggccgctgagcgtccccccctgcctgctgattctatttatgtggttcagcttgaaaaggggaaggaattgaggtacggaaggccgggaagcggggtgcgggacgacgcagaggccttggagattttcgaggatgtcgcctacgcgccaaaggcagggcccgagaaagcggtcgcactttatgaatctgcattggtctatgccacaggtgggaatggggtggaacgggacctggccaaggctgtgcaacggctgggcgagtctgtacaattggggttcagcgaggccaagcataccctggcatttttcttgagcacgggctt

SEQ ID NO: 1350 - DNA, 703 bp, Nannochloropsis_gaditana
attgcccagggaggcagagggcaacgctttctcgcttcgaggacgtaacatttttttaagaaatcatgaagcagatcttgaaggccgtccaaggaaaaagtacgttctggggatacacccgggataatgaagttatcctacaacagccgaaaagtgcgttatgccgcggatcgtgtgacgattcgtgtcctggtccctcgccctccgtcttaaaagtttatgagtcggccccctcataaagaaagccaacctcgctgtgttattacccccatgctgaaaaattgtcccgtcaggcatccttactcgtgcgcgcacgcatgcttcgccgcggtagcattataactagcataagtctggagctgcttacgtacctgcaattctagcgacgggaatcgtgtgcaaaggagtgtgcgtgttactgctgaaggactccgctacactcatcacggcagtgaacccaagtcgtgtgagcgacattttcccccacgaaaattcgagatttctgcggacctgcattaaatctgcaagcacgttatattctcttcgcgaaagctttgtgctataggtggatgcctcttacatatgccgccttcttgttaaatgaggacttccgatcgagaagcctttcgactagatgaaaacttatggcccgtctgcctcaatcagctaacacattcttctttggcactcaggcttagccatg

SEQ ID NO: 1351 - DNA, 703 bp, Nannochloropsis_gaditana
caaaggatcaccgaagacctcaagactttgggtgcgagcagcacgacaggaagagatggcgtccgtcagcggtggctgcactatctttaggtaagtcatagcgcagatctatcctatcctaacgcaggatttatcttccgcagaggcatgaaaaacattgagatacgttgagtcatttttcggaacattgtgtaatcgagggaattggtcggggcgttaaggcacgtccgtgtccgcagactatcgtatgcttccagtccccatgcgcgatcacggtcacccagttgcgcacgcagggaattttgacagattgattgcatgttgtaggacacatatgagtacgtttatgtcccaaaacattatcttgaacaactcggaaaccacaggagctctgttcctgtttcttaattcagcgcccacgtccgcatttgtaataaaatgtaggccaagaagaagcattcttcagaaggaaaacgctttacttttgtgtggtttcactctcgagagcatcagcagtagtagatgtttaggtgttagggggggacggaggaaggcgcaaggcgttttaccggcaatttctcaaggggaagatggcgcggagaaaagcagagagggaaaaaaagcggcatctggaggaaagaaagcttcggggcccaagagtaagcgaggagcaagcagcagcaagtccagtcctcctcccatg

SEQ ID NO: 1352 - DNA, 703 bp, Nannochloropsis_gaditana
cgaatcgcagccaggcctcgagaatagctgatcccccccatcccctccccgatgccgccattaaggttgagcagatggaggtgcgcgttgcggaatgccaacaattgttgaaggtgccttcctttgaaagagctttcatcggaaaggaagccatgagcatacgcatacacgcgtttgacgatgggctctccccctgactgtgaagaagctgatttccctgaggtgggggacgcgggcgacggagcaagggaggggaaagatgcagaggcgaggggagatgtcggtccgacggtggcggtgaccatgcgtggggatttacgaccgtgtaatgtcgctacggtttccaaaaaaagccttcgattgcccgtgtactgcacgcaaaaggaaaattttggttgccacgcggaggccagcagggcgagaggaggtatgagaaagcacggagcgacgacaaagaaatttagtacggaagacttgtatgaaaatccgcgtcgacggtgccaaagcatctttccaccagaaaatagcgttcctgagcgaactatgaaagtgaacgtgttttatcatgagtgcaagttgcgatgaatatttctcattcacaccagaccaagcaatatcggtcgtcgtttggtaaagtgcactttcgccccactttcctgacagcaacatcctttgcatcgaaaatctttgctctgtcttcatg

SEQ ID NO: 1353 - DNA, 703 bp, Nannochloropsis_gaditana
accatccgtctatgcgatcaaaaaatgtggatgtggcctcaatttccacgctcatgacccagatttttctggttttcaatgaaatgcgccttgtgacagctgcgagaggatagccaggtggttggggatgcccgcccggctaggaagcggcgcgcacggtgcagaggaacaacgcacactcaaagtatgccactgcaaagtgtaaactacggtcgaccgccactccctaagtgtgacgacggatcagggtgagcaatgcaaaaagagcttggagaggatggtgagggagagcgacgggagcgagggagctaggcgaggagcgaagcaagcgatcaagcgttgcatcacttccttttccaacggagaacaaaagccatcaagacatggaagacggtcatccatcgaagaaaggcctgcacgcgattatttcaacctgcgatatgtttgagatgtaccctgtgcgcgacggtcgaatggtgggcgccaggacgcgaaatagacattttttaaccttttggatcacgatcgctttttgatctgttttgtttgagcaggcagcctcatactgcaaggtttcacatggacgatccaccaacaatttttgtgtgttcatctgaacagagagtctcctttcgcacgctttggccttacacaacgaagccttcgtcttcgggccttcttgtgtggccatttccttaccatg

SEQ ID NO: 1354 - DNA, 703 bp, Nannochloropsis_gaditana
caaatgtgtcagtgttgagttgcgcgacctttgcgcgcccgctaactggtattttttttaagatcacaacgtcttgtttcctgtctcagcctctgttgtcgtgccaaagaaaaaaaccgtaccagctgccttctatatcttctagccatgctcgaaatctccatcacccttttctcatttcttctttttaattgtccctcacggacacgttgcgagccatcaaaaatcttgcgacacgtcagaggcgacctctcatcctcactattgacctgtgtagcccctcgcggtgcccctccactgcctcagtgaccgaccacgttcattccctttcgccgcctcgccagactcagagctgcttgactcgccccgccccggacgttgccgcctgtgccaggactcttccagatttgcggtgcgccgtccgacaaaggtgacaccatgctatttgggtattttttgaatgctcttcatgcttgttgtctgtcacggctgaccagtagcgcctttacgggcactgtgaatacgtccctatcgatcttgccccgcctgtgacgtaccaacttcctcacggctgccccgagcctcgagacgcggaggccgctgccaggcgattacatgacgcccgtccctcccaacccatgtcatgatagcatgcagccatccgctttttctatgaatgatttcctcatcccctcgttgcaca

SEQ ID NO: 1355 - DNA, 703 bp, Nannochloropsis_gaditana
tcaggtcctgaccggcccagtatcttgcctgactcatcccaagcagcagaagaggaggcttcagccgcaaatgacgaagcctcaaaaagcgtcacatgtccacaatagcataatgtgcttcttatcgcatgcgcttggagcacagggaacaaaaaagaccacagtcacgcccgcaaagctgcactcccactcacacggccccgcccagtcagcccctgcccttgcgccgccggcgtccttcaaccgtcgatttaaataagtggcgtcatcggcccatgcggtatcatccccgccggtcctctgcctgtccctccggtctttccgataagggcgacaaaagtttacaaaaacaaaatgctttgcgctccatgaaaaagaaggaatgaatttcattattcccacttttattctgcaaactccgtgtgtgtgtgtcggtcgacgacgcatttctcttcgtagggattccctctctgatcaagttttcttagctaccagatggacactggcaggcatagacgcaccgatatgtagtcgaaatacacgagctatagaaatagtagcttattattaggacataaaaccctttctagtcggcaaacagtccttttcacataatattttctacctccgtgaaggactcctgatagtgaatgtgagagcattcttggtcatcttatagctttatctcacactcggaatgcag

SEQ ID NO: 1356 - DNA, 703 bp, Nannochloropsis_gaditana
actttatgacacacatttctgagagtacgaagggagggcatcctcgccatgcctgacgagtcccgtaatacagagcaagcatcctagtccctcccctcaaaaggtcgacaactaaatgtctgtcaccacatgcatagaactcaccggtttcgtcaggttggaggcggcaaagctcgccgcggctttgacagactccatggtgtcctatgggggaatgcggcatgggagggggggcgtgaggcgcggagtccgtagggcatgacggagatgctttgggtgcgagaggactgagggctcggcgtaagagctgctggtttccaaccatagtcttgtttacgatggcatctgccccgaccatcccgtcgtcctcgtcctcccacgatcagtgcatgcctcggttcgcggaggaaacaggaagcggggcgggcaagttctcgagtgctcgcggcgtcggcgtttggctctcttgaaatgcagcaaagatgtttctcccccggcactcgctgccttcctccccacgcctcgcgagccggaacacttcttcgcggggctcacgtgcgttttttccttgccaacacggttgaaacagaggactgcaactggattgcaacacggaggtactatcggggcgggggggaaattgcgaaactggaagtaaaaggtagtctttgcagacagcatcaggcctcggtacctctccatg

SEQ ID NO: 1357 - DNA, 703 bp, Nannochloropsis_gaditana
ggatcgcggcgggaatctccgccttactatcatgcctttgccgctcctcctgtcgctgcagttcacgcctgtaactctgatcttgctgctctaattttacctccaaagatgccaattggttgcaaagggcatcttgacggctgctgtaacgctcctcaaattcgcgatccaaggccgtgacgcggtccgacattttctcaacgaggtcgttcagagcttgtgtgctctcacgaaagttctctgcctgctcactggcggctgtcactcgcttcaactgagtctccaggtactgaatgtaggccgcattgtcatacaggcaacgatccagccccccctcactgctgctgtcgcggaggtgagatgaaggaagcttggccaggcggtgcttggccaggtaggtcgcctgccctccgctttcacgggtaatatgtgcccgtatcatcgctacctgcgtggctgtgtgactacgtcgttagatatttggaaaaactgctgctggaagcaggtatggacgtattttctggggcagagtccgggtttcggacgtgtcgtgtacggaagctcgtcgctctgggcgatgctagcaggttgccggcgaacttcaaggctttgggtcctgccgccctcgacgacgaggtttaccaccgatcgacattttcccacgatagattacggtagctgcaagggccttgcggaaaacatg

SEQ ID NO: 1358 - DNA, 703 bp, Nannochloropsis_gaditana
ccgacgtgaccggttgctactcctactggtccatgcgcgcagggaaccggccctacaaccgaggcatgcgccttgattactttctggcgagtaaaaacatgctgcggggaggggatgagggtggaggggtgccgcggctgctcgattcttttatattggatcaggaccctgccgtgtccaagttgagtgaccatgcccctgtgggcgtgctgctggaagtgtgaagcgcgcacgtcggggtcctgacactctcagaatgcaaaatgcaaagcataaccaaacaaattgtacaatcatacgcgacgtaagccccatgctgtacgcgacaacgaattttttaaaaaatgaccttctcgtgttaaactctgtaaagtatcaaattttctttttcaattgtatagtatcgatcttttttccggacggggaggttgaagaggattcatccgtttctcttggcttctcatgcaattggcttacttccacgatctgaagggccacgaaacatgaacgaccaaattgcctgaaaaatgtggtagtttttgggtttatttatgatctaagcgcgttgcaggcgtttcctcacgagtcagaggagcaccccttcagcattcgaggaccagacatcctctactcactcttaccacggccatcgccgacacacaacacatttccattgtcatgctgctttctaggcatcaaaatg

SEQ ID NO: 1359 - DNA, 703 bp, Nannochloropsis_gaditana
cggtttgcgaaggttgcaagatatgggagtgagctacggcggtagacttatcctcttcgcactccttgcgggagtcactcttccaacagctacctgctcagcttgcgatcgtactaggtgagcttgctatgagaggaaataatggaatgtaaacgtcattgataatggtttcctccgtcaataatcttatcaggccatcaacctcggatgtaaacccagctgccacaattgaaaggaggcttcaagcgctggagcaatggcgcattgaggtaaagctcactaaaccatgaaggccagcctcatacctctcgaaatctccaggaggttgttactcagcggtttccgcctcacgatgctatatatccacacatacgtttttaagatcgagaagccgagacggttccgcaccttgtggcgtgtctgactttgcatatgtccattttccgtctccatcacttgcacgagcacacagttggcggagcgcgaggctctagtgcaagcgcgggaagaaaatctcggtatgaaaaatttaggcggcgtggatgaaagtggaggaggtcgaggaggtgaaggctcgttggctccgctttcaaaaaagagcgtgggggatagggcggtggaaggggctgaagcggaagtgttggtgttcgaggacacattcgaggagctggatatggagatatgggcacatgacatcaccatg

SEQ ID NO: 1360 - DNA, 703 bp, Nannochloropsis_gaditana
gagtcaaactacttacaggagacacacgctacacaggtgaaagaaggatgatccgtttgtgaataattttaacttaaaagcggaagttaacatgcaacgaaccaatgcttttcgattaaaacgtgttgctgctcagattatttatttgaatcaaatttagattcaagctcgatacatatgcatgtagcatacgcaaggaagggacgtatcttcattgctactctcgaaagtatgaattttaggttctgaatagagagtagtttctgcgataaataagcagactgaacatttttacttatgtattcatagtataggcaaacgattcattcaaccgcatccagtcgcccatacaccgcgttgttctgttcggagaaactcaggaaatgtccggtccccggagacatgcgagtcccgccttgtgcaataaccgaaaacgtatcaataatcgataccgacgacgccgggagtcgatttgtacttttctaatgctgtgaccggagtgctgaagaaaggcaatcgtctcaaccacaatattgttttttctctggcaggcagtgtgtgatcgaatcatccctaagataattctctccccttccctatttccggcagggcccagattccattcgtagggccgcttgtacaccacgcctttcgttttaacttatcaagatatggtatagccattttaaattgaaataccatg

SEQ ID NO: 1361 - DNA, 703 bp, Nannochloropsis_gaditana
ccttccctccactcgaccacacgtacctgagttcgtaaaaccttgcatgacggtcgtggaagcaagaaagcagagcataaggtagtgttggtcataacaattatgggcactagccacatgcaatcatttctcctcatttttctcagtttccagtgtccttgactcgcagcttcaggatgttgcctttgcacgcagacgaagaaagcgagcaagttagaatgccgacctagagagaaacaagtagagccaacagaaggtcaaaattgcacacctgtcaaagtcaaaaagtgtgacagcagacgaaggatcgatgaggaaagcatgtacgcaacgcggcggtggatgcggataggacagaagtacccggggtagggatattgtgatgcctgatagcggcgtgcggggagggcgatcaggatgcattgctttctctctccaactgcaccaccccggtttacggagtcattcgcatttctcacgtcgacaaatcgtgtttcaaagtcacgtaagtgacatcatgtcgtcatcacgccaattgttatggctcacaagggaaatagtatggtgcaggggaaagtatcttactcttacatcaactaagctatcaccttgccagtggtgctacactttcctgtgtcacatgtctcttttctctataccgccaggatcccctaagttgacagacacttttcgtccagctatg

SEQ ID NO: 1362 - DNA, 703 bp, Nannochloropsis_gaditana
tagctaacggtttttgtgccgttcacctggaacacgttgccagccaccacctgttttaaacccacttcaacgcctacctccatttgcgctcaagaaaacaatggtcctaattcgactacaaaattctagtcttaatctatacgcgtgatgcattgtgggtggcgctggccgctcacagctcccccctccctcctgccggcgcaagctccctgtccgttcaaactgaaatcaaattccttaccccgtccctgccttgcctcgcgcctcatgtccggcactccatttcctcgcgggggcaaccttgctttgccctttacataagatatgtgtatttattacaacggcgcccgtgcgccctaaatgagtccttggctcatccacacttcttgtggtgactttcgccagtggaccatcgccacactgcaaatccccgtctgacgggcctggaccccatggggtatcatgcgcgcactgaatgcatcaaaattgggcaaacttcgcagatatttttttcttttgaacctttgacatacctgtcgaagagtagtccacttcgtgggcacctcacatctcgccaagtcaaatagacccttgcctcgcactcaccagcctccgtccgcatgcatatgacaggtaggcaggcgtctctggagggggaaggggagttcaagttatcccagctggctgggttgccagacccatg

SEQ ID NO: 1363 - DNA, 703 bp, Nannochloropsis_gaditana
gctattcgcattctgtactataagaatgtcaactgaaaaaagagattacaaaaataatgatttgaaagagccaagtcacacgaaattaatgccgtgtcgctgccatgactcgtgatccacggtttaaagcatgcctcccgaggcagcaactcgtgcatgcctccctcgggcgagagtcggcccttcaacctaccaggcaccgattacgtctgtccactgcttacgtccatttccttgatcggacgtaatcgttccctaaatatgagggtatcgctccgtatcaggagatatttacggaatttttcctcagtcgtctgtcctcaccgctttttttcaaagagatatggactacgaatggaatcccttttgattgcgtactgcattaacttccaccatcaaataagtgtttaattccataggaagcattttatttattaccatgactttgacatgccagtctctctttccaaaaaggcctcgaagcttttttcgcgttcttagcttggcggctttcgcccttcctagctctcgctcgttctcccctccgagtccttgaagatgtatgaccggatggcaaaggccgtgagaacagtaccatcaatggagtttgaaaagccgtcaatgtctacagaaaagcggcgcgtcgtacgtcttgatttaggcggtgaatagagttgtgtggttacactggactggaactttg

SEQ ID NO: 1364 - DNA, 703 bp, Nannochloropsis_gaditana
cgtagcatcgtagatgtttatactgtctacacatcgagaaacatcaatcccccacttattgcccaacacgacatttttaacacacacccgaagtgcgctatccgacatctactgacgaagattactcactctcttcgcacttcacacaaataccttaccagggacttcagcgctccagagacactttcccttcgtaactgaaacaagtcgtgacaaggcagaacacggcggtgggcagcgtagcgacgtcttgttgtgacaagaaaacaagtagtatacaggtcgctgggggggggccgggggggggggccgggacaacgtcatgtcgtgttcttcgttgttatgtcgtttttcagttgtctcgtcgtttctcgtcgtcgttgtgataaggaaacaagtagtatacaggtcgctggggggggtggggcgggggcgaacaacgtcatgtcgtgttcttcgttgttctgtcgtccttcagtcgtctcgtgttcggtttgctgctcggggcgcacacttctcttccgcgctgcacacacagacatcaggctacattcgtattgaatctaaggaacggatgcacgtctcatgttttcgactccccctccttgcaggcacgcggcggcgtgacagaggcctcgactcgaccgtagaccaaaaacgctcgtcatcgagccccctgcacgtgcacgcgcgcacgacgatg

SEQ ID NO: 1365 - DNA, 703 bp, Nannochloropsis_gaditana
ctccttgcaggcacgcggcggcgtgacagaggcctcgactcgaccgtagaccaaaaacgctcgtcatcgagccccctgcacgtgcacgcgcgcacgacgatgcggacgacgagggcggtcgcaggctgtggtacgggtcgcacgggcgtattgctcttgctcgtttgcctctgggtggggtggcttccctactgtcttgtccgtggcttcgccttgcctcagggccctggacgactgagtcgctgcagccgctggccactgcggccgctgccgctgccaagtcgcccctaccagcccctttcgttcgtaggcgccagcctcgtggcgggctcggacaaggttgagggaacgagcggggaggatggccgggcggtcgggggagacacggtgagggtgcgtgtttgaagatagatgcgttcgcttttcctcctcccgtgttccttcccgcctgccttctcgctcaccaccgtagacacgccaatacacgcagcagggggcggcgggggggcagaggcaggggctaggaaagggcatccgcagcctggagctgatgctcctcctggaccggatcgacataaagctcgaaaagaccaacgacttggtcaaggcagaggtgggtgccgctgaggcgaggatggggacgagagtcgatgatgcggtgaggtctctcagggcagaggtgggtgccgctgaggcgaggatg

SEQ ID NO: 1366 - DNA, 703 bp, Nannochloropsis_gaditana
cgcctaaaattgacagcaaacacttggaggaagtatttgatcatgttaaagattgcacataataatcctaacttattatgttccatcagtgtccacccgcgcttgagacgtaatctgtaaacagaattattacgagcttcggagccaaaaactgattcgtaaagcgctttgtgtcaataagaaaataatttatgcatagagccagaaccctaaatcatcgtagattagaacgaaatatgagaagtaaggtatttttacgtcattccaggaggtcttctcaccgaaatgaatccgtctataaacgaatgatcgcataattgatgctcatctaccaaagccattcatgccaagtccctgtatgatgctttctatgaattcaagcctaattcatttcaatatatggcggagatctatcgagcgcgactccatgtatgggaaagaccaagaagaaggacatgtgtgacgtactacatcatgtcgtatgcccgggtgatgatgtatatgtccctgacgtgcttcaaaaaccagccacttgacataaatatcagcacgcctgcgcgctttcaagacatgtgcaattgatacaaacctttctcaataattgattctcattgcacgcctatctaagtggacacgaatttggctgcaggtgaaacttattgtatctacaaaggaggactcgcacacctcagtttaaattatg

SEQ ID NO: 1367 - DNA, 703 bp, Nannochloropsis_gaditana
taaggaatcaaggggtgtgtggttcagtgagtctgagtgaaaaaaaatgcttctgtccattattacgtcatgaaatacacttagttttcgccccttcttgcttgttctgccttcgacttacatttcaacaaagcttattaaaaagaaaaactgcaagggaaaagatgggagcgtaccgtcgcatgcacaattcacgcaatattcggcctctctccgaacagtcccacaaagcctatatattttcggcagatacatgatttgtaattcatatgccgacttattggtacattgtaaatgttgcggcattggccattagatttgcggctcgaaaggtgtggaacgcctgggggccacgagaaggactgtatgccgccatgtttgattaaagcaatcgaggcgtgtcccatcattttcttctttacgatgcgtcgcctgctcttaccgggtgcttttctatccatgctctatcacgggcattaatcactagatgaaagacgcgatgtttcatgttctcctgcggctgagtgcgagagccgggactgggacatgattccatcccagtggacacgctttcctcatttcctcctattttttccttcatactatgtgctttactctgtaggaactcgctttgctattttggcgctccggtcctgagttcttgtcgtggagattccttctaaaagtacctccaatcatcatg

SEQ ID NO: 1368 - DNA, 703 bp, Nannochloropsis_gaditana
tatccatgtttgccgcgaataacgagatttaaagccatgcctggaatgcggacaacgcgtatgtatcgccgagacacgtaaacaacttcaacgcacaaaataacgcgttggagagacgcggtacttccttaccatcgtattcttgtcttatttgagcctattccacagtgataacagtattctttcattacacatattgaaattataaatctccggcttttatcgttgaagttttcagtagaatgatctcagaagtgacggagttttcaagagatactaccgcgatgtctgaggtacgtttcttcatgccatgttagggttaccgcattgaaacgtctgattatattcactcggagtgatgcctctttattgtgacaatttcttacctttgcatgattatgggcagtacggaagttttgcgaagaaaaccagagtcggagctgcaacgggcgggcctgtagcaaagtgtccatctatcctgtcactcgctcttctcgtggtcctcacactgggatcatgtaatgctttggtgtataaaatcatgtaccaagtctatggttctgatggcgcgttttttgtttcgacgggcgtcaacattttgtacattatctacggcgggcttttgctgtaccctcggatgcttttcactgatagcatcacgcccgctatgaaagccctgccgaagcgccgattcataataatg

SEQ ID NO: 1369 - DNA, 703 bp, Nannochloropsis_gaditana
atgggcaaaagagaagcgacatgcaatgattcataaatccttggagcgcacgtctgcagtgaagttatgagccacgcctgacttcctgtgaaaaacacgtttttgtcaactttcagacaaaggcattcatgccaaaggaaaggtaatgcgtccgtttgtctcattaaatgtgggcagaggcgtttaagcgacttcagcaacgcggacgaggtcctctcagcaggggctgcagcgatcgcgaggttggaattaccggcgcaaaaaacacacacatgcaggcgggaggactccgaccaaggaatgtgcgtgcgttttggcagggtattgccacactctgcccgctttcaggcggcgtggtggggagattccgtgcattgtgtgcttggttttagggaatgaagcctcggaactgagaatgatacgatcgcttggaacaagttttccttaccccacccctggttatgtctcagacatgtgggatgaaaaatttggtaaaggatagaatgattatctctgttatgttgtctgcacgatccgtgatgcatttttccatatttttttgtctttgatcccacatttacgtctgtctacctcccccatttcgtgctgtctctggaaagttctattcaccagtcctcattgctctttttctcctcaggtctattttctacgcacacccgcacaccgagtcaaaacttagatg

SEQ ID NO: 1370 - DNA, 703 bp, Nannochloropsis_gaditana
tctgccagtccccacggaaggcattggggaggtcgtccgcctcctcctccgggcggaggcatgggcccgtcaggcgtgtcgccgccttggactgcacgtggacggaaagggggggaaggacgtgggggaggagagggagaaaaggaagggagggaccgtgggggaggtgtctcgtttggtgaagaaactacaagccgcgtacgaagggcgggagggcttgaccgaggacgggggcgaggaagagatggagttccgatacttggacgcgctggaaggaggactcgcagacatggtggaaatgatcatgtccagggaagagagccagcagggtccacgccggggcggggagggagggaaggaagtcgggggccagggggcgcgggcacgcggggcgaacggggtgggctccgaggcccctttaggggacaagggaaaggggatggacacagagcgggaggaggtggagctggcgggcggattagaaaggatgggggagcccgagtcaacggaggccctgcctggcactggcggtgggccgaagggccgggagggtcgccgaggaaaagggacgcgttatgccctgctggtcagcagtacgcagcgtgcagcccgatcgacccagaaaacgaaagatgggctgcaggagaagcatggcgtgttggccgaagcccgagcacgggctgttgcggcgtctggctccacc

SEQ ID NO: 1371 - DNA, 703 bp, Nannochloropsis_gaditana
cccccttctcctgctccgtgctgtgacttccagtcccggcatgctgccagtataggagggcaaacccacgccgttcgagacacccagggggaaatttggcagcctgggaaagcacgtgagaaatttcgtcgcagcattcttcatctcctcccatctctatttgggtagatgaggaatagcgtgtaaacagcccgccgcaaaaagcagcaaaggggggggggaggtcgtatagtgcgtcgtcctaagggcaggcatgactcccttttccctcaagacatcaaaacaccctcttccttcccggtcgcaggaaacatttctcccaatatggttataaaattataatatgtacactgtacacgtgttcgtgtgagccaagaccttacatgggttgtttccgagcctgaatcgcaacaagtagaagagagttgggcctcctggcgggagccacaagcatttgggcaacgtatgtatatgtttgtactacgtgaacagtagtgcgtaatgacccaagtataccctggctgacatatctacagactgccaactacgtgtgtgaccgttgctcctctgtatttttagtctgacggtccattggctccaacgagcaagtcgaggcacacccttcttcctcgcttcttcagcgcacttgctgagacgacttctactgaccgttctacgtttgatttttttaacgacttctcag

SEQ ID NO: 1372 - DNA, 703 bp, Nannochloropsis_gaditana
agtgcacaaatacgataatgttgccatccgagtgaggtatgacacgtgtaagtgtgagattttcagctacgaacatgtacctgcgaagaagtagtcaacttcgtggtctttttcaggcgtggcttcttcccccgtcgattgagcagccgtccggtgagaccgcggacatacccgcggggacatgtaaccattgacacgtaagaatgaacggtaaagtgacgctgacagcagcggtcgtggtccgtgaaatgcaggcgctgtgttcgcagaaatgaaccagacggcgaggaagccgagaaggcgtgtaggcggcatattttcaaaacaatggcgcgcgtccactcgttttacaaaaatccacgatgatgcacctaatggccactgtctgtgtgtgggctatgcatgaattcgggcgcggacttcgtcaaaattttacgccgcagtcgagcgagagagacggcgaggaacggtgccggttgtgctggagactgcaagaagcgcgtcctacaggctgaagtcgtgtccaacgccttcgtcgcaacagtcattcgcgtcgacccgagctagactcacgtcttcgtactcaattcacgctcatgattcctgaccaggtggcacgcggttgtcggcagctttacttccaagcttgtgctagccccggccgagtcaacctcccgtcctcgctcctatccattcaaccatg

SEQ ID NO: 1373 - DNA, 703 bp, Nannochloropsis_gaditana
ctccctaagtatgcctacagtgtggaggcctcgatggcgccggcatcagattggaggtactacgtcgggaaccgccacagctgcgggcagcacaattgaagactcacagaacagggaaaacaatgaaagtagtagtaggaacaaacttgattcgattcatgactccagtgtccctgagaacctagcggcttctgaacctcctccttcgaatcccgttactgtcacgctggcagatgtgtgccctaacactcgcctaacgctgccttggtgggaggaggccctccttttcccgtgcttcattgtgttgtgcgcgcctatcttctcttttatcatgctgggcgtggcgctggtgcccatttttggttgggctggtgccgtcgtacggtaccttcccctcctttgcacgtattggacgctactttattttgatctcgttccccgccggcgacgtcttagtcatccggcactttcatgctggctgttgcgggcggtcgtccggtacttcaactaccatgtgattgtggaagacccctcgtccctccaacctgctacgccgtacattggtgctcagagccctcacggcatttaccctattgccacaatatgtggcgctcctttcaattccgcggttttccccggtcaagacgcctattgccttgccgcctcagccttgcaattacaaccttttctctggcagtggatg

SEQ ID NO: 1374 - DNA, 703 bp, Nannochloropsis_gaditana
ctagcgcgctgcccaaggcacatatgccctccctcgtgcccacaaaggatggcggtcttcttctgcaatcttccagccttttcctccctccgactatccgtcgatccacaccaggtggagccagcacgaaggcttgggtgcaacgcgcaaacaatagcagaaggaaaaggacggagatcaagagaggaagggtccgacaacatccaggccgaaagggcgcatggacacagactcttctcctccgccgtttttgccaccgtaccctcacgagtggcgtgtactgaaatgcatgtgacgggaacgcgagttgtattggcggccctgtcgccatcacggtgttgaagccttctgagctgcgttcccctgcctgtgtgtagaggaggtcgtcgatccctccttacccacccattcgcacgcagccgcgtaccaaccagctgccgtcaccgactgtggtaagaaaaaataacaacaatcagacacgcaatccgactatcacctttaacaagccatgttcttgcgatggcactgcgcgcaaaagctctttttgtggtatccggcgacgccatttcgcaactctcgcgcgccccctcgccctgagtcccctgcaaagacaaagtgtacccctcgctttcctcttgctcataaattaccatttattcgtccaacggacttcgttcacagcctcaacatttcctcgaccatg

SEQ ID NO: 1375 - DNA, 703 bp, Nannochloropsis_gaditana
tcacatgaaaaaaacttactgggtgaccgctgcaatgcacgctgggaggcaggtcgctcgcctcttggcatgactttgcgggaaatggagatgtcgggcgcttggttgcggaagatggcatggcttggcgcgcactgctgcttgcgaaaagctcagtggccccttacctcctgatttgtgttcgtggtttgttgacaaggttacattggccaggccccacaccgttgccgatgacctctcttgtcacagagcacattttggcgaggactgagagcgcgcgagtaaggccgcgaggctacgcggtccaagacggtgcaccgaaattaaaggcaaccagtcaaagttgcttatgcatccatgaccgacataatcataacgattttacaaagatgtaaactcaccgttggcattttaagttactttcaacagggggtgtcaatgcctgccagtttgctggaaagcaagaagggttaggatcatactgtcccaaatgtaccccatgtggacacatgcttttccctctattcatgctgcccaaataaattcagcgttgggaaagagcgagtatacttgacagccttagacttcatttctatcatgtatcctattagaaagtaagccgttctcaaagcgatgaatatgacagaagcaaagcgacgagaaacaattcggggaaggtacactacattaaaacataaacatg

SEQ ID NO: 1376 - DNA, 703 bp, Nannochloropsis_gaditana
ccaataatcctgatgtcctggcctgaggcgtttttgagcgccgaggccagttcctctgcctcggcgagctgctcgtagcctacctccactcggtccttgcgacgatctgtccgggccatgactattacgtgtaccacttctgcctctacgtgctcgcccgtggccggatcggccatccaggtgcccaagaggactgacataacttcctgtcgctcagtagaaagagcttgtgcgatgcagcagttgagagcctcatgcgtgatgcgaacgcgctcaagagacatgcgcacgggctttgtgatgatgaaaaagagggcgggaggttagtgcatgcagtgtgtccagcaagagcacagaaatgccaaaagtcgagtgcggacgctctacagcactaagccacgaatcaagcataatcattttctcatgcctgtattatattccccaataccatctctcccacgtaggtcgctgaattcgcgctctcgcttgagcgacgcggaaggggttactaactagtaggagaggtgcccgaatcggtgtaagtcactttctcgccggcggggttcgcccctggacttgacaacttctgagctgtacgtcagaagggtgcggtgctttgttttgttcacgaagtgctctttcatttgataagcgcacgtgtctgccctgacaggatccactcgagcatcacgggctcatcatg

SEQ ID NO: 1377 - DNA, 703 bp, Nannochloropsis_gaditana
acacggtgatttgcgacggtgctcttcctattgcttttcgccatgcgttcatgtgtaaaaggatcatgatagagggtacgaaaagtagtcaaaattgtggattttgaaaagaaaatttggtatcatgactcgtccgcttgagcctgtataggtatatcacggagcctaaatttcaagagtcctctcacacattctgaatttatgtttttaaatatccgtggacagaaatatttcgacgttagaggtacttttggcatgcgcggtagcaagaagtgaaacttttaatgaaaattctacctgcgtcaatccgtcacagttcgcaatcacacaagcggccaatatgaactttttctattttttttttttcggcagggcctactttcccatggctacggacgcaggaagagtaagaccaacatctgcatcgtcttctgtcacaaacttgagtgattcgcatgcgccaataaccgaggagatggatggtacattccttcctgcgacagaagtcgtggaggcggaggagcaggatgttgttggcgcttggggtcgccctatatctcgttttggttttcatcgggtaagccgtgtgatatgcgtggctgcatttttcaaaatttgcgtatcataaatacttttccatacgcatccaaatacgtagcacggggtctatcgacgcaagccacgcctgttcccaagtagcatg

SEQ ID NO: 1378 - DNA, 703 bp, Nannochloropsis_gaditana
ttgcgtatcataaatacttttccatacgcatccaaatacgtagcacggggtctatcgacgcaagccacgcctgttcccaagtagcatggtagcaaacgcccaacgggtcgaatcaatattcctaagacactatcgggagaacatcttggacaaaattcagggtgaaaaggtagaaccgatgaagcccaagcgccccgtccgacggacagccgccgcggaggcgggggaccccgcacattgcttcaatggcgaccggaatggcacgtccccgcctccgcaagcaggacatgtccttggcaggagagggccggcgctgagtgatgtcgaacaggcgcatcttccagaaggccagacggacgagagcgagcacacgcaacagaaagcatcggcggatctgaaggaattgcggagagcgacgcgctcgactggaagggggatcgaggactggatcaaaattcctgtcgcggctacagtgcgcgtcccatcaggggatttagagaagctggatgggatggtctacgtcagcaccgacacggggggtgagtactcggagtgacctctgaaatccaccgggtccccgcgggccacatgctctccctttatcattgcctttgcgagcaatcgatgatcacttgatgcactgtcatgtcgcgcacaaacagcttttttcaggcagcaagggggagtatatttcgagaccatg

SEQ ID NO: 1379 - DNA, 703 bp, Nannochloropsis_gaditana
tctgtcccacgccatccctctcctaggtccgtcctctcagaggctacgagccaaagatattgagcccatgacgcccttcttgccactcggacactgcgattcagaacaggacgctgccgatgcactgtcagctagtgccagaacccgtgcttgtccatgcaagagcggacatgcgcagttcgctagttgcacccgggcggcgacttggcttttccatcccaggcgcccgggggcgatgggagacctgcgtggacaagagtgcgccccgcacgcccgtctttggactgcgcgggtgtctttcatgcgtccggggctcctggctctcatgctcgatccatccgtgcgtgccttctgcggtgatcgcacactgggggtgcgatcaggcgaagggggataccttattgggttcgaaagcaaagtgccctgcttcgtgtggctcggttggctaggggagggcgacatcttaccccattgctgctgccactgccaaataagattgtatggggttacaacgattctttggcaagctgtgaataggtgctcacttcttcttttttcctcttttggttttgccaagaaaaatatatggatgtaaagtgtgtttacattgcgcggtcaattatgtccgcaggacgcacgagtatcttgctatttctcacgctccaggctactcgttgacagccctcacaggatccaaatcatg

SEQ ID NO: 1380 - DNA, 703 bp, Nannochloropsis_gaditana
gggaccttgggggtcgtggccttggcaggcgtggagtgcgacgaagccggtgggttccgggggggttggggagggaaagagcaaggagcgatgatgccggtcatgtggtcatgggcccgacgtttctgtctgacgagagccttcgaacaccccaaatttttcgattctccgccattttcttccacatcctgcccagcgcccacagtttgcatcacatacacgctacaaaactccatcgaggaaggcgtggctaccctcaaacgggcttgcaagtacccacgacctcccccggtcccttcctccctgcctggtcccaaagaaatccccgactccgctcctcattttgtggacgctgtgctctaccgagagaggagtagggctgtgggtgatgtatcacgggcttcccaggtgcgggagggagggagggaaggaaggagggaggaagggaaagagggagaatgatgaagagattggaaaaaagctacgaggaagagacgggcaggggggtattttacacacgaagcagagatgtcattcatgttcttaccagccctgatgcatcctattttcctttcgattccttcctcgatgcttcctgctacttccaccgaagctgacagccgaggcgtccttcgacatggtagggagggatgcggcacccccgcacgtccccacggcagcaccaggagacgttggggacatg

SEQ ID NO: 1381 - DNA, 703 bp, Nannochloropsis_gaditana
accctgtattagcctttccgtgcgtgtgcatctacacgtacaaaaataatcgaatcttcgatagaaatgctagtcgaagatcctcccctcgtaagcctttgtacattatatgtgggtataatacgttgcatgtgccgttagcaattgtcgacaccagattgcggtgttgagtggaagtattcccgctacgtagggtacgaagcaaataaaggacacaccacgtttatcaataagccaactcataataagcagcatagcgaccaagaaaaaagaagccagggaaggcttgcacggcaagggcaggtccggggcaggaggtcaaaaaggtagtttacgtgtatgtgtccgaaaaatgcgaatatatactttgtgtggaaaaccgctcctggccacccactcgcccgtgtccttccccttgccctggcaacaccaccttaaaggatggatacccaagtacgaaggtgttgtggtatgatacacgtatgtctctttgcccaattcgttacagagagaggcagggcgtccccgcggctgtgttttttttttcctcagacattctgcttgtagctcgctgtcgcccggccctactggaatggacacgcaagtgtatctaccctggcactttaccctcctagttgcccttgttacggcgtccttctaaccgaccatcaaccattttgataacccacacaagttcaggatg

SEQ ID NO: 1382 - DNA, 703 bp, Nannochloropsis_gaditana
tcccttttaagctccttattccgcttgctgctgcgacaaggatcctcccctcccgtcttgcactcctcttgacacgccgtcttcacctctgctggtctcagtcatcactctgcatcaacaaggctgtccctgttagaacccatttcgatacgggttccacggttttaagcgtagccaagaagatgtaggtgggcccgcgggcggatgtgagataaacggggcattcgtatacgtctggttgatttcttaagtaccccacggatgacggctcccacgtcggctgaacagggactgcccggatgtacagcactggcaagggggaaaggagttcttttagcttgctgtctgtcaagtttcctcctactaatgtgtttcctacgacagagaccgtttctgcagcctcctcggggggggtccatctcgccccttcgatgtaaagtccatgaacataagccccctcgtggggaggagggatatcattgccaagctgctcaggagaggcaaacgtagtgacatgcgtctcaatcgtcatattatccaatggatgtcctgtctgacgggctgtcacctgcataattgctgtcaaatacgctgtggggttgaaaagccccggaagccatagacaagcaggaagattgcccaaatcctccacccacgcctgtaactgtcgaacgcgtcgaagcatatccctgtactgcgattc

SEQ ID NO: 1383 - DNA, 703 bp, Nannochloropsis_gaditana
agcaaaaatatgcaaagcttcctaaatggttccatgcgccaggggttcaaccgggacaagtacaaagaacgggattgaccatgctttccaaagcacgaaccgcctttttgaagaaaaaacgttcccacctccctcatttatccgtccataaccacaatacaatccaatgcactgaatacgcggtgacgggcaggtttttcgtgcccgctctgatttttttggggggggagaccacggtttttcgcggccgtggcgtcgccgtcgcagtcggactcctgcctccttcccggtatgcgtccttcgcattgaacgtggcttagctcggaaacttaggacagtttgattggttgcaagacacttgaatcttcttatatgtgccttcttcatgtcgacagcataaggggcatggaacccgatatttactcgtgtcgcatggcatagataggtgtcgaaccgctctcctctagcttgggggtgggagacggcaccacgtaccctttccgcttgttgcagtcgttataaacctctcatatactccgtgtatttgtcttcttgcaaaagaaacagatcagaggggcaaagtgaaagtgacaaggacctacgtgtggccaaacggacctcttctgccatctttgacgggcacgggtagcccgcttcgggatccacgacgcaaggctaaagtgaatatctcgaggaaaatatg

SEQ ID NO: 1384 - DNA, 703 bp, Nannochloropsis_gaditana
tgctcaatcgtcactgttcaaaagtcgtattatgaccaaaggaatctgcgcttgcggaatacacgtaagcaggtctttcctttcacattttcttggaaaagaattgaaagagcctcgttgtccctgagaattgcgtgacatcggaatttatgcttttatgtatcatttgaacatcaataaacacaagaacatcatattaaaggtcttttcattgatgacccttattccgccatggctgtctctccacgttcagggctccagcgccgtacttgtaaacttctccgcaattcgaactgtgcaatttcaaacccgttaagtcattagtaaatagaagcattagtaatgtggagatgtgcccccaaaacaacaaatgccacataaaacgagcccttataatttgtccgggaacgtgcgatatcccccatctgctgaccaacaagcagtttgcagcgagttgaagtttccgctaggctattccgtagctcccacaacaatgcaaaccacctcaaccccaatccgaccaccaataggaatattttggcgttgtcagaagatttcgatggggaaccacgaccatgcttccttcgaaagcccttccacgccggccgcagcttccttcccatatgccccctggcgccggtccttgcgacactccaagcgccctcgagaaagagataagaaagaggatgtaaataaaaatatg

SEQ ID NO: 1385 - DNA, 703 bp, Nannochloropsis_gaditana
attcctcgcattcccaaacaaatgcgatctacgcgctgatagctatgctaaatgctccgacagtgtccatgttgctgacctattcaccctttgcaagcacatcgtaggccggacgccgttatcgtcctccttgtcagcgtctcacgccccccatcacgaaccctccttcgcgacgatagggctttccatcttcatgccgcgcgttctccttgcctttctggcacttttaggctcgtccacgtcctatgccttcgccccccccccccatcctcgatctttaaagggtcatctcagacactcctcccgtcaaaacctcgtggcgaggcacctcctacaagaccccgtcacgaccgccgctgacttcctacaaaacgaagccggaattcctcctccctcagatctatcagctctcattcagttgctcctttaccgtggagaggagtccgttttcccgtcagagaacaccgaactgcaccctttagtgattccactgactaagtcaggggatgaatacacatgcctcctccgatggccgactccacaggagggcgcgcccgtgcctgtggtgaaagcacgcccgggattaagcggcctgaaactggtggcgctgagcacgcttgacctcgctcaccggctagccgcggaggaagaccacggccaagggcgggaggcggagtgggccgccagcctggtgaatgcctac

SEQ ID NO: 1386 - DNA, 703 bp, Nannochloropsis_gaditana
tttgaagcccgtcgaccgtgttcgcttgcaacagcatgtccaaagttgaatatcatcgatttaatacacgataggattaccgatagaagtttttttaaaaaaaatggagacacttgtttctccgagatcaagatacgtttgccccatccggcgttgcggcgatacccggatataaaaaatgacgtcaaaaattctaaacggttaattaagccaatcagaagccttccttctcctgccgaccgggcctccggcttaacggtgcgcttcatcatttccaatttcgtgtttgctctttgctttcctgcctgtcatctaagaatacatgatgcctatgtggtctcagtgcacttttgacatttactgcctggctttgaagactcctctgtcgcacctgtcacctttttcttatacgtagggcgaacttttgtttctgcctgtcaagtcaaatgtgattcagttaatgcaggtctcaggccgcttacccttccatggtgtaactaaccctgaagtaaccttcgaacggaatacggaagctgtgcaaagcccaatgtttttaaaaaccgcatacatttaacgattgtgccctccgatgtccccttcagctctctagctatgagggggtacatggtcctcatgtgttcgaaatctgaccttgtctactcttcacacacagaaaacctcttaactactctcatcaacaatg

SEQ ID NO: 1387 - DNA, 703 bp, Nannochloropsis_gaditana
taaaaagacaaccatcagaggccttttcaggcctcactatgttaaacataccgatcacctgctttgtttcgttacttttcgtgtgaagcttgttacctgtacttgttcgatccataggtgagcgacacggtgtgtcatttcgtgccttttaaacctttttcttcctcgattagacccggcctacacgagaaagtacttggtttgcacgggttgtctttcaaaatggatctgctctaatcgttgtcgggacaccatgggtcaacctccccacccctacatctcagtgcaatggaaggcgactgtcggcccatcgcgacaaacggcatgtttaggtttttaatctacatgtgtatagtaaagatgtagcacactttgatggtaccctgcttgaggcaaaataccccccacgctgtatcttttaccctcttactaagctagcgtcatcacagctgttccgtctcggatgatgcacggacacctacaaccgcatgagcatacagaaacatacccacataagcgcaatcagacacatattaacttcttctccattttgtcgcgacagtaatccagatgctgccgcgcgtcgtctctaatgccttcggacgggctggtcccaaattgagccggcacctcacttcatcgtctcatgcactctccgcgagtcgtaactccaatgccgcgctatttatggccgcgactacct

SEQ ID NO: 1388 - DNA, 703 bp, Nannochloropsis_gaditana
taatcgttgtcgggacaccatgggtcaacctccccacccctacatctcagtgcaatggaaggcgactgtcggcccatcgcgacaaacggcatgtttaggtttttaatctacatgtgtatagtaaagatgtagcacactttgatggtaccctgcttgaggcaaaataccccccacgctgtatcttttaccctcttactaagctagcgtcatcacagctgttccgtctcggatgatgcacggacacctacaaccgcatgagcatacagaaacatacccacataagcgcaatcagacacatattaacttcttctccattttgtcgcgacagtaatccagatgctgccgcgcgtcgtctctaatgccttcggacgggctggtcccaaattgagccggcacctcacttcatcgtctcatgcactctccgcgagtcgtaactccaatgccgcgctatttatggccgcgactaccttcacattatgccaaccaatagcaatagctcacatgatgagcacttgcgcatccaggccgcccgcaacggctgacttgtgtgacgaccacgagcaccgcctgcaggttgccgacggcaatgcttttcactcttttggacagcattcttcgttttgtggcgagatagtcaccatcaaatgctttgagaacaatccattggtgcgagccaccctgagtgagcccggagagggacggg

SEQ ID NO: 1389 - DNA, 703 bp, Nannochloropsis_gaditana
ccgtaggtttccggatgttggtgcccacgttgttgacgagaacgtccaacctccccacaaacgatccggctacttgctccatcatagcacggcgggcgtcgctgtcactaacatccaccgcaattccttccacttcgtaccccttagctgtccattccttcaaacaagcagctaaatccgaagcagagcgtgcacaggtgaagacgcgtgctcccaacgaagcaaactcttccactatagcttttccgatgcccttggtgccacccgtgcacaaaactgtctgaccatcaagccgccaccgggcaggagacccgatgggaggggtagcggtggccattttaagtgctcctatgtgcccaaagaaagccgtaataattctttttagggtagatcacttccttcactttgctcgatccggtgcctcgccaaaagccctgggaaaggacggaggcggaggggcaccggcgtgagaaactaggagcaatcgagcacatatcacgtgattgtggtgacaaggggccaagcggtgtcattggtaccggagcatgtatacctgaagcagctactactgagcacggatacctagcatggagggttcttatagagaaggctgaaggactccacaatcgacaaaaagtcaggaaaactccccttctcacttttcatgcaggttataatcttggttagttccctataaaaaatg

SEQ ID NO: 1390 - DNA, 703 bp, Nannochloropsis_gaditana
ctgcatgtccacacatccatcatcaacgctgcctacgcacgtccaggggcatggtggaggaggttatgagtgcttgtggcccaaaggcttcaaatcaaaaaaataattcaggctctttgagttcgcgagaagtttttttttttctatttgatgccattcttaaagtttgtagatgattctttgaaaaaaaaagcttgcagggcggcaagtaccaatgcttcctcccggcagacgcggccatcgcggacagccctccgccccagcgagtgttctccttgctcacaacgccacgagcaaagaagatcagccaaagtggatcaaacttcggttatttccccgcttcctctacatttgtaagcttgtcattttcactgtccttatacacgtgactgtacaggtgctgctgaaaagactgggcaaaagtagacactccgccagctcttctcagtctcgaacgtccctgacgatgtcgatacgggtcgcaccaaaagtgttcttcctcgcctgctgctgcctactacccttcctcacgtgcttgcatgcctttcttgtagccccctcgtcctcttcagcacttgccttgcttaagcggtctgcggtacctccaccgcagcagacggaggaagcagtgcgctcgaagttacgtgagaaaaacacagggccgcaatctgaaccccccagtccctctacaggcaatagcatg

SEQ ID NO: 1391 - DNA, 703 bp, Nannochloropsis_gaditana
agggcgtcccttcgactccggggtgcactggctgacgggggaatgcggcagcgaccttgcgagtcagacatgccggccttcattgtccaagcattcgtcacgaagggaaacacagccagtgcaaatgacgcaaacgtgaccactcgcatgtttgataaggtgcctgcaacaactgtagataaagagacgacattatgcgattgcatgtgcgctacgactgggggaggtcagaaaaatatcctaggcgcaggcgaccagtcgctccaaccaaaaaactgtctgtcacaagaatctagtgtaaaaggaagtgtgaaggccacttgtgtgcttgcaggtaggccttgaacctcgaattgcgcaggaagtcagtgaaaggggcgagtagtgaagcacagcgatgctgatctcgagccccccggcgtcccctcggcgtgccagaggatatagaccaacaagtgccaaatgcctgacggcgttgcacatgctcggcttaaaggcagcagcatcgtctcctctttatcaaatacatgttgtgatcaacggctctttacacgcatgctttgtgtacatggatgaagtcgcctcttcctgcaaaaaagcttttctgaccgagcccgtcaaggccgattaccactaagtgagcgtgggtgtctaggagttctcacagtcccttcttcttcataatttgccttaacttcttaaa

SEQ ID NO: 1392 - DNA, 703 bp, Nannochloropsis_gaditana
tgaaacacctccagcgcttcgcgttgcttccaaacagtacttgtcttcagattgcaagcagtaaatctaacgataggaaagatcaaagaagctggctaagtacattgtaattcacgcagcaagaagctttcaattcgagaaaaaatatgatttgacaaccaactcgaatgatattttgtttaagcagggcacaaaataccaacatatgcttttaaaatcccttcgtgtccatgatcgagacggggaacaacctcccgtcattcgcgccataatttccgaaaggcgtctcccaggcacccccttcctcttctccacgcaacctgtctcaaccctaccctgcgctcgaccaccacacaccaagcattcctctcgcccctcccctctccttgtggcaacatgactacgccctcttctatgcttccttgtccgtaacgagggtcgagcactctttgcgtgcgctcatcgccccttcagctcgtcgttgattcaatgtggtgatagcttcatggccgcgacgcttccacccactcacataaacgctgccttttctttgcttcggtttccactatgtgcctcacaacgcatcaatctggggcctcctgtcgtccacgaacactcatgcacatttgaattgtactgatattattctgtgacagatacttttcagcaccagtcgaggagcctcagttgttacacgaagatg

SEQ ID NO: 1393 - DNA, 703 bp, Nannochloropsis_gaditana
ctccggcttggtgatggccaacactgctcccaccaacctctcatgatcgtcctggaggcgacctgtcgcctcctcctctacaaggaaaggaacgtctaaaggttcagtgggagcgtgatgggtcaaacagcggctcgctcccagaggaatgaatgccttggtatttctcacgtccacccacagctccaaagatgtcatctgaacctggttgcgcgggcgcgagccacggccgcaactgtgcaccggtggcgggtgcgtgacctttgaggaggtagagtgactccacgagaaagcagagtactgcaacagctgaaagacgagaaggagcctccagcagaaaaggggcatatcgcagcaacctcccccccgctagcgcaatttgtcacgtccggtgcctttgcacgaagagttcctccgagccattcaagaggggcggcatgcggtcagtctcctcagcatgaagcgtgctgcagtgttgataaatgaaacatggtcagaaatgtgccctggcaattcggccttccaaaaagaggcggcaccgccgtctctctcaagaaagggaaacacgatgccagcgatttgcccgcctcgagacaggaccttcgcttctgttgctacgcgccgcgacgtgtcgccccactcatcgcatcccacacacgttcaggtactctctgtagtcaggtggctgcagagacgcatcatg

SEQ ID NO: 1394 - DNA, 703 bp, Nannochloropsis_gaditana
tcgatagaaaatagtcgtgcagctgtgtcaaagcatggaacggggcaaggaacgaatgagggtgggtggaaagggctcggttgcattccgttgggctagcgaggtcccgggggacgagggggcggggggcggaaaaagaagcccccctggcggcctttccacgtgcctgacaacgtccatgccatttccttgccctctgggacacgtcagtgcgcaggcccattcaaacactcggtgcatagcgtttaggtggtcgtaagcggcgagaagcgcgtagtgtcaggcatgcacagggtttacacggggaggacgcagggtgatggggagggagggttaggacagccccggcacatacgtctcgtgacctggtttttcgccggcaaagaccgcccctcaccccatgtctcactcctacacaccgccacaggagcatggcaacggtcaaaaccgatgcatgcatcattttacttgcttttctttgtccctacgtcgtccgatcgtttcctgggtcgcagccacagccgccgcgctccacaacctccatcccgacctcccctttcgctcccaccaaaccaagctgcgcacctcttcctcctcacgaaagcatttttaatagcgacctgtcgccgacttcaaagctgccaggcaactttgatttggacacgtgggcatcgctttttgcatctttggacgaggatgaggc

SEQ ID NO: 1395 - DNA, 703 bp, Nannochloropsis_gaditana
ccatcccgacctcccctttcgctcccaccaaaccaagctgcgcacctcttcctcctcacgaaagcatttttaatagcgacctgtcgccgacttcaaagctgccaggcaactttgatttggacacgtgggcatcgctttttgcatctttggacgaggatgaggccgtggactattggatagaagactgggagggggttattcccgaagatctacatggaactttcttgactgtcgggcccagcaaatatgagcgtggcggtgtcccaataaaatgctggttggagggtgacggagccatgacggctatctccttcaacaaggggaaggtgcatgtgaaggcacggttcattgagacgaaagcctacttggaagaaaaagttgaagaccgtttcctttatcgaggacaattcgggacaatgaagacaggtcgacatggctggagcgcattcaaagacagttttttaaaaattcgacttcccccgataaatgcattcgacatgaagttcaagaatccgagtaacaccaagcctctctactggggtggtaggctcttgtccactttcgagactgccctgcctcacgaattggacacccagacattggagacaaagggtgaatttgactttggtggactaatgaggccaggagaggccatcacatccgcagatcccgtgctggacgccatactgcagaagaaaagtgg

SEQ ID NO: 1396 - DNA, 703 bp, Nannochloropsis_gaditana
ccgtccttctcaggagagtgcctcccgtcacgcagacagtaatggcttgtcacttcgcaaaacgttaggactcgtgcaacgggctcgggctggaatatcttcccattctacacccagcggtggagctgcttcaggtcttgaagtcagtcaaaacaaaaatagcaaagagagcaaagctgaaggggggaaaagtcgcttgcccgcatctgaccggaaggaccctttcatcctggcggaggaggaggagatacgctacctggagcgaaagctgggtctttcaggaaaagacagagggaagaaggagcagaagctagtgaaggacctgatgaagtacgagggcttcgacgagagtattggggacctcctggaggcaacggatcggatctcctccttggtgggtcgagcgacgggctcctcggactcgggggagggggggaggagggcggagtcagcgggaagaggcaggggcggaagtgggctggagagactgctcttggcacagcaagggaaagaaaggggcgctgaaggaggtagggggggcgagaaagagaaagagggggaagggggctgggattacgaagtggatttgggtgatgccgaggaggacattgagggagagggtggtctgtcgtgggaaggaaaagggggggaaggggaggaggagagagggcaagcgaaacttgcggaaaaggatggcgggatg

SEQ ID NO: 1397 - DNA, 703 bp, Nannochloropsis_gaditana
gcggatctgttgcttgcgttcatatgcagccttttccttgccctccaaagatttccggtaaagatattccttccgtaagcgtgtctggcgtcggatggtgctcattaaaacttgcaggaaaaactcgcagaggggcggggaaagctgttttgctccgctgtgcgagcgtgtacggtggagggtaagatagatctgcttagtagctgttctccgcagccatggacaatgcatgcagccaggacacgaagaaagtgtaccgaaggcgtcatgcatgcttttttcttcaaaaaagcgcagaatgacggtgatgcgcgggggggccctctcaaaatgatctcgcggtaggccgtgcacagacttgccagtatcgccgcgagagttcccctctcgcaaggcgtgcggggagaacctcaaatgacaaggtgattcttgaggccacctctgcttgagtgcttccatcgcatgaacctaattgggcattcatcggactgattcccactgtggtctccgtttccatttcacagtagcatttcccagatcccttcctcctgcgcaacgcgaatccgccttccttcagcttcctacaagcgctgcactttccgcaacaatgcatttatcaaaagtgcccttaaagcaactagcatggctagtgattgtctttaacgcgtgtgtgcaagctttccgtcccaagcctatcgtaatg

SEQ ID NO: 1398 - DNA, 703 bp, Nannochloropsis_gaditana
tcatgtcgatgattttaggtttgccatcggaagtgacctgaagccccgcaccacccgggtccacgcctgtgtctaatattgccaccaccacacccctcccatcaaagtgcgggtactggctcaagaaagcagcggcaccagtctcctctttgggcaagagccccgcgtctgggaaagtgaggtcgttgtttgtgctggtactcgatgccatgacttccttcggccgtcgtaggtgcgactcagcccgtcgccgaaggcttcaaattggcctggtgcctgtaacgacgaagaaaaaagaccagcttgtgccctgtccccaggtaaataaacgtcgaagaatgaaacgtgcgtttgagtgaatccggacgtcaagttttcgcgggccgcgcggcggaggccgctcgttcgaggccaaaacctccctgggggcaaggggaaggtactcgcggaaacgaagtcggcgcccttcttcttcccaggggcgtacagaggaacacggttattgcggtcgcgtgcacgcgtgcacgtttttcatcgactgagtttgtaaattggctatgcatagttttcttgacataatttttgtttcgtatcagatatcagaaaccactgacagacagctcgattagctgccgttgctgcaccgcccgacggcccgcacccaccaaagaaaggcgtataacacagtggacatcttgaaatg

SEQ ID NO: 1399 - DNA, 703 bp, Nannochloropsis_gaditana
gcgctgtgaaggcccatgactgctcatcccttcttcaagcacttttttgtcttgcgaaccgaatttctgtacacttgacaccctgatttcctttttcccaaaatcagatcacgcagttagcctcaagttgggaccagcatgccactattgcttttctggttctgacacgtgaccattttatgaggaggctttgagccccggcagcaatatttgatcgttgttccgcggcttatccctttcgcaggaaaagccacaattctcaacgatggatgttcaagacaatttccgcccagtacgtgagaaaatttatcgtttggaggatgctcgaaaagttgccgacttcttaaggtcgcgtagcagccatccggcaccggaaatcgctattgtacttgggagtaggctgcacgcctttgaacaagtcatcgaggcccccgaaaagatctactaccatgacatacaggcagtcctgccttcgtttccgacatgttctactgcaattggcaaggaaggggcctttatctttgggtcggtagatggaattagtgtcctggttatgcaaggtcgatttcacatgtacgaagggcattcaagtcaggcaacggcctttcctgttcgtgtaattaaagagcttggggtgcaaactttaatattgactaatgccgcacgcggtctcagtcccaccttggaaattggagacgtgatg

SEQ ID NO: 1400 - DNA, 703 bp, Nannochloropsis_gaditana
gacatgcgccgtagcctctcctcctctgaactacctccactgtcctcgtcgccttctgcacgctgtgcatgctttccatgggctgtcagcttgttttccccatgtaccacgcttccatttctctgtccgctgcctccctctgccacagactcctcctcatcctcgtcctcatcgtgcccacgacaacatatgccgttgtgtcggtaatgctcctgttgttgccctcgcgccgtctctccggagctcttgtttaaaagcaagctatcactgcctgcttctgataacggtagacgtgcgactgcggcggcggcggcggcggcggctgcagcagcggctgtctgaaaagggaagcggccattcccgcaggtggcgggcgtggcatggcacggcacattttcgtctttgcgagaggtggaattattggaagtctttttcaagatcccatttccgtgagagactgtgcatctctgatggaaggccatgtccgtcgcttcctcatccaaggagcctacagattcagagcctgtctcggaggaggaggaggactcctgccattccggtgttgcagggcaaggggacaaaagagacagaataagtaagaatacttctcaatgctgctgcgtcttggcactgaacatattgctcatcaagttgtttttgatggtgccaatatgacaggtacgggattttgtcgggtcagatg

SEQ ID NO: 1401 - DNA, 703 bp, Nannochloropsis_gaditana
gtatgcaaagtggtcaatagcaagtgcagtctatctccatgcaacaaaactgaggtacagtcgttttaggtggcacgataaaatgaagaacgtctggatgaaaagcgacgggagagaacaaaatgcctgatgaggagaagacaccaccgagtcaccgtaaatatccagcccggccgacaaccattgaatgaggcaaagtgtcgctattatatcagtcacatggctttccaaacaagtttgtaaagctatgactggttggacggtatacttgtgtgtcagacctaactcttctgatgatgtatcccttcgatttgacactttcagcctcgacataccatgcattacatttgagaggtcttgtctgctgcctgacggccggaaatcatccgacgccagtctggaagcgaacagtctagcacaacagtgtgcgcttgtcctcacgtttcccccgttgatatcacctctgtcctgtacacattttcttccatacaggtacctccgtagaaggttatatcttttctgtgtgggatctgaattgctcctgcattcacgcgcctttttcttgctttccattccattgggttgtgttgcccggctcaagaagttctgcaactccagccgtaacttcttacctcgctgtcagaccgcctcccttgtttctgcttttagtccctcctaaggcctaggccccccgcgcacgatg

SEQ ID NO: 1402 - DNA, 703 bp, Nannochloropsis_gaditana
cgaaggaatgaacgaaaatatgttatatattcaaaggccttcgaaacgtgcatcgctgtgttacatgatccattttcctcatacctctgtaaatctataggtgtgctgcaccgtgtgaagtttgtttggtgagctctgcacaatttttgtagttatatggcagacatttggagctgccaacctgagcgcgttgcttatcgctcgcgcatgggcggaacgaaatctgtggcatgtgtttaaggggagaacgacatggtcagaaaggattatatacactgtctactatttgcactactgtgggaaatggtttttgttggggctcgcggcaaattggaaaagcaagcacaggactcggcagcgcgagcactcgttcaagtttctcagcgactcggcggggcatgcgagcacccgggttcatttcaggccctggtaataggaaaaaattacagtctcaggtctcaacagacgcgttgccccagtgatcaggcaggtatgaaatcgctgtgcgatcgtggacgctcacatattttcttcctttcaaagatacattagcacggggatggtatccagggtaggaagcaatggcatggtctattgtgtgctgctcctgttgctcttgttccctcgcacgacgcaaggatttggggcgtcgcccaggaaacaaaaggaagttaacttaggtagatgcgcaaagctctcaatg

SEQ ID NO: 1403 - DNA, 703 bp, Nannochloropsis_gaditana
tgtcccgttgacaattaggaagcgcggggtatagaggaaatctatctgagctcgttttttccgaggtcgtggaagtcgcgtagtcgtagagttgaagggattgaaaaacagtcgacatttcccaccggcgtaatggacaaccggcatttaagaatactttgaggaagcgtggacgatggatgaaggggtttaggtatctcatgaagaagaaaagcaaactacaacacattgtcactctaaagctactttcgatcggtggtttctcggcccatccaactggtaggctctcttgaaagggctcttggctcttatcgacgagaaaatgagcttttggttgatcaaagtaaactaaatgtctactcaaaggagtccatatggttattacgagcgtaaatgtggcaacgcaaaatttgtttctagtttacaagggccagcaccctccttcgccgccggcgtcatcaggctcgcccacggaggaggagaccgccgagggctgacacatatttccggaggagcgatggggagaaattgcattctctttctcgaaagatgacattgcgtcgactaaccgaggaataatactcttgcaccaccagctgaagggttgttcaggtcttacggccccacgatttccccgtcttcccgccggccggagaaggagcgggccaaataattgaggaaagaagtgactcgaaaatatatg

SEQ ID NO: 1404 - DNA, 703 bp, Nannochloropsis_gaditana
ttatgtggacatacaaatctgtaaatacttgtacgttgaatttttatgactgcgtaaggaatcatgatttccttgcttttatgataaaaaaactcgctctctcagctacagcaattgatctattaaatggtacttctgtttaggtaggactaggtgtttgatatgtgttaaatgtgaatatatctctgcgtttactatgtttactattctgtgcagcattttcctctgcgccggctaggaagggctaccccatttgggcactatgcatatccacagtgtagccactgcgtctcacctgagtatcctgatcgcgttctgattcatctaatgcaagacattaccagtgcaaaagacgagtgtacaattattttattttagcgtgccttacatactctcattttaaatgatagaggcgtaccagggcgcattcatggaagaggacggaacgacagaagactccacagcgggcttgcggagcaatgcagcgggtccaacattcggcaacagccgcagcaacagcacgactaaacatggtctcacatgtaatattatatgcgagaatgaagaggaagaggaaggcgatgaacagctgccaccacgccgcactgatcttcctttccattcctcccatgatgaatacgtcgtcaaatgctctcgacggcttctttacgtgttttatggatgcggaaccatctttgccgcc

SEQ ID NO: 1405 - DNA, 703 bp, Nannochloropsis_gaditana
cggggaatctggccgctgcgttgtcccgccttaaaagatgactgttgatcaaatgtttaacatagtaccgccaatgtacacgtagtgtacctcactctcaaaccttttttccatctttctcaatgaatgatctcgtataaacaaacagagggtcgagtaaaagcttgttgcgggtctcgtctgcgacaaaaagctcctgatggtcaagtcactggaagttaacggccacctaaccaatggagtcgtgacgatcataccaatgagaaacataaatttccgtcagccccttgtcgcaaacttgctgatcccaaaaaaaggtcaacgggagttatcttgacctttttgctttcgcgtgtctgaatccggccccgaccgttgcgtcggccgtctcggagacgcggtctggaaagcccggaaatactaaatctaggcacgcacgacccaccacattcagaacaggtcatcttttcattgtagtctgcatgttgtgggatgtggtctgaatccatatgttggatgggtggtttgaactgttcaccagatgaccgagcagtttcgctttcagtcgcgcttgcatagcaaaccgtaggcttattctcataccattgcccgcaaaagaacagcagtggcggcaccaggctctatccatagagcaagcaagctttccaccttcacacactgtcgaccgtccctgcgcgcgatg

SEQ ID NO: 1406 - DNA, 703 bp, Nannochloropsis_gaditana
gctatttttattcaggattaccttgttaaatgcaggaacgcgcagaatagagcggctcaggcgacctgcaaccgctggaagcataattgtgtcgctcaactacacaaatttgaatcccctgccactcttgctctcctgcaatattcatgtgaaggtatatgaaaagtgagtgtgcctgaagtccctcagaagtcttgcattagttgcccttctcccacttagtacggcgcatctggtctggccctgtcctaggatgcctatgccgcagtgtaggagcgacccgtgcacgcttcaatcatgctgggcaaatagataaaataagagctttcttccagtaatatgcaagcacacgtcttgcgtggcgcaagatgactgaccgggctgcgagagcctggcctatccgtgctagtagcagcttcgaaggcggacacaaactgtgccgcaccagacaggcagtggaagcgaatggaagcaagtatgcaggggagtgtgccaaatcgtcacaaaacatactgcctggtgcgattcttatagccgtgcacatgcttcattgaatgcatgttggcaggacctttcaacatatttttttcctcgcaccattctttgctctttggccctgactgacccggccttccttctcgctttctccttgcagtttctatttccacaaccaaaaagtatacagaatagaaattaaaagatg

SEQ ID NO: 1407 - DNA, 703 bp, Nannochloropsis_gaditana
ctttcacccccaaaggaagcgcaacaatgctggcaaggcacactcctcccaacgtcagtaaggcgggatataagagtgagcgcctgtggaagaataatgaggcatgatgatccgcagtctgcattggtcagagccttatctgcatcacgctgggcgctcaggttgaaccactcggcggccggcacgatgcgccgagggttccggggtgtgaagacaatgtcggaagctacttacccgttcctctgcattgccaatgtcgtgatgccctctttcacagtaagactttcccgccaccagcagtaagtaagtgatgaggagttggaggctctgtaacacgtggatgccgacggatgagaagctggtatgtccccactgaaaggccgctacccctaggaggcttggaaatatggaaagacaacacccatagcgcgcggcatttcagattgatcgacggaggacgagccggtcgccgtcagatttttttgtctggtaaccacgattctttgctgggcatgtgccaagctaaatgagagtgaggggtactcatcgcgataccattccagccgcagcgtgtcccctaccaaggtatcataccctgctgccgcctgcgacgccttcaagaacaaaaaactgacgcaagcatacacacagggggaaaagccgcgccagaatgcctcccccagtatcagccagtgtgctcaaa

SEQ ID NO: 1408 - DNA, 703 bp, Nannochloropsis_gaditana
cacccatagcgcgcggcatttcagattgatcgacggaggacgagccggtcgccgtcagatttttttgtctggtaaccacgattctttgctgggcatgtgccaagctaaatgagagtgaggggtactcatcgcgataccattccagccgcagcgtgtcccctaccaaggtatcataccctgctgccgcctgcgacgccttcaagaacaaaaaactgacgcaagcatacacacagggggaaaagccgcgccagaatgcctcccccagtatcagccagtgtgctcaaaagccttaaaaaggccagcatcgaggctcttaagtctccgagtgccccgtcgaagcctcaggactctccccgggatgacctcgacttgctcccccaacattttcagcagttccaggaccgggcgtattgggacgctttcttccgggaacgcaaacagcgggctttcgaatggtatggaacttataatgatttgcgtccctttgttgcgaaaacggtagagggttggcgtgcagggaggaaacgcgagcgcgcgctagtgatcggctgcggtaactcggacttctcggccgatttgtaccaggaaggaggctttcaacggatagtcaacgtcgatttcagtgcgtcggttatcgaggagatgcgatgcaagacgcgagagtcgtgccctgagatggagtgggaagtcatggacgtgacgg

SEQ ID NO: 1409 - DNA, 703 bp, Nannochloropsis_gaditana
actcgtgacacgtgaagatggcgtttccgtgcggtgcctccacgagtcctgcgcatttagcatgcaacgccttggggcagtagtcgcacaagatgagctctccaatgtcgtgacatatttcacactcctcgttatcgtcgtcctcctcctctccctcctcgccctgcggttccgccgcggtttcttcctcctcctcctcttcatacatccagtcgtcctcctcatcactggagacggaccgaggcattactggcgacttgcgctcacaactgtggaaaaaaggatgcagtgcagatgattgagtctaattgcactacaatgtacaaattcatgctcttgaattgccccttgtccacttttcgcacgtgtctgtggcaagcaaggcaggtgaagcggggcttgcagagaaggggagaagccagcgacgactctccatctccgtttcctccccgccaggccctatttactttgtatgagactctctctgacttcgcagccaagagccttatatccatccttatctcgtatatgtacacaacccacaggtgttctgatgccaagagtgaaaagcgagggaagggtggcagcaggagggaggaaggggaggtaaagaggagcggcaagctcagccaaaaattggcagcattgcggccatttcagcacagtgttcgtccaacgggaaatctcttcaagggttgaaatg

SEQ ID NO: 1410 - DNA, 703 bp, Nannochloropsis_gaditana
agttcttgatgtggtgaccgatatcctccatcattttcccttacgggttttctctctttttacatttcgtaaatgagagcgagacatttgaatatagagccattacgcatcataaagaatttacatttcaacccgagcgctgtgactggcctcactactaaaccatcgcgacatcatttttcttgacccacaacttgttgaatgacctccccataagcaaccttactgcctctttgtgtttgactctgcggaaatgccgggctttccgcgttgctgcggggcacatgcatgtcgcgcggttttcataggtttcatgccgcttccgcatgactttgtctggaagaggattgggtgtatatgtccagacatgtgtctaggtttgcgtactttataggttattcgccctgcgcgcgtaacggtcgtcgacgacgttcgcggacaaaagtgaggcaaacctgagccggacccgtctcgtgttcaaaatggtaccacagtttctctcaggtgcgaccggtcaagcagtggtacagggagagcttttgacttgctacgtccagcctatgttgtgagagcttcgtgttgaattcaacaggcccttctggcttgtcgtttgtcccctgtgcatgggcccggggtctggtgccaacaatcactctccaggcgattaaatgtctggaaatgcgcacaaaaacagagaatcatg

SEQ ID NO: 1411 - DNA, 703 bp, Nannochloropsis_gaditana
agtgctctggccgccatttcaagctctcccgccggctgaatcagatctttcaagccgcgtccaccctcatcgtgctgtacaatagcctccagtcgataaataattcgagaggccgatgaaaccatggttttgtggattgtacactgcgaatgatacgagatacgatggaggggaggtaatacatcttcgaaatggtctgcgacctaccaactatcaagatacgaacacgcttgaaaaatgcaagcacatccagctgtgcgctccgaagcgatacaggggcagagttcatatgctacatcaaatgcaccgaaactagtccagaggtctgcgccgtggatattgtcggaaacctggtaatttgagccgtgacgttgcgggcatgggccgtgacaggcaggggcagatctccttaagtcctgaaggaccccggacacgacgtcttattaccattatatggccagtgtcttggcccaaaagcagccatgacgtatcatacacttgaaacatgtcatatcattacacttttatgccgtcaaactggagtggctcaatgaattgggtgtagtaccctgtacggaccaacaagaaacggaattggttgcttcagcattttcgcatttaaagattcattttccatctgcacgacagatcactcgcagaaacattaaaaagggtattgttttcattatcttaccattaaatg

SEQ ID NO: 1412 - DNA, 703 bp, Nannochloropsis_gaditana
tgacaaaaacgcgttcaagcacagaaatctgcggccactgcgccgagctcagtagctcagccctctcctcgctcgtctcggaaggcagaagggaagtcacacgaccaacgcagccgcactgccgttaccgtgacccaagcatcgatgctagaaagtcttcgcacgtattggatgtgcttcgcgtggatggacagcggaggcacagggcccaatgcggcggtggtttcgacgggcggggtccggcgcccgcatccgctcctctttgtgctgggggatggcgcactgttcgcttttttctaggacttgaagccgtccgaggctgtacaccaacatgcacggaagtggagtggaccacgccgcgagacgtgcgcggcagtggcagtatggcccaggtctatggacttcccgcatcttcaggattggcctgctctggttacggtatttgtgcatattaccccaggtcgctcttgaatcaggaatgagaacaacagtccttctgccttactgatttccccgcgtcgcagcttaagcaagcgcgcaagccggagtgggactgcagtgcccttctgatatgttacatgcaatgacaacgatttgccgctcgtgtcgacctttgttctcagctttgttttttctttgttactgcagcacaccgcatcggtatctacggtttcgagaggcacgagggaaagtatcaaagatg

SEQ ID NO: 1413 - DNA, 703 bp, Nannochloropsis_gaditana
tcgggcagggcccgctcctctggcgtttgccgctgggagagggacgctttcaagtccgcccaacttggtgcagggtctttgaaatcgttcatgcctgcgggaggaggggctgaacctttgaccataccactcagcatctgtgtgaacatgccacccagcgacgagtaacgtgtcaaagagggcttcaaagggttcctccacgccttcgacgtggtcctgcctggagataccaaagtgggggacggagacagaaagaagccgacaacggtggtgctgatggaggcaagaatgaacgtcgtaggcaaaagggtggcttgcatccgcatttgcatagccaagcctacataagagtgtttaatggaaaggtgagacgcttttgttatgctgcgcagtgacggggcggcatgccaaaggggatgggggagatcctgagcgagcgccgggggcggcagcgagcattttttttctcgtaccgtgctcaggaggataatttcctatccaaggaaggacgggttgcgcttcatagacacgctgagcggatgcagtgcgttctttgaagcgctctgcctgatacacatggcttgaagcatcatttcctgcttcgtggacagtcttcaaactttgtcgtctacttcatttttctcattgagctgccatgtccttgccgattaaggcacaaaatacatgttatgaaataggcatg

SEQ ID NO: 1414 - DNA, 703 bp, Nannochloropsis_gaditana
gtggggctgtgccgcaaaggagagcgtgggagtggacgggtctcaaagaaggcgtggtctgtccaagcccccgctggggacgtaaacgggctagtcaagttttcgcctcgctccagttcttccagagattgctgctgaaacgtcaatggtgtgtttcccgatccagacgccacgctggaaaatgaggagggtttgggccgctgcggcttgtgggaaacgagtttgtcgggggcggaggaaagactcgccgagtcaattgttccctccctctgtgtgtccgagaccgcaaggccatcgcagccgacctcagcagtactaccagaagtcatttctcgacgattgttgtccggcctggcagcttattgacgcctgccagaccgagtgacgctaaagcggacaagtatcctagtctgtcgatgcccgtcccgtgcgtccctggcaatgcacaacattctacgacgcgtacatcggtgggcccctagaaaaaagacagagacccgatgttaaatgcgcctgtgattcgatatatgcttgcttccaaagccggggggacaaaatcgtgcaacttgcgcccctccgggaaaggcagcaggacggggctttgcggccccgcgtccccccctacaactaaatcgctaaattgagcggtcgaacaaggtgaccaaacactgatccccccttccctttccgcacacaccttcag

SEQ ID NO: 1415 - DNA, 703 bp, Nannochloropsis_gaditana
caaaacacgggcttagcggctgacggagggaaacggtggcccgattttgtagaattcgaactaatttgaataaataggccacagaagtaagacaagcgcgcaagtactatacttctgcaggcctttcgctcctgagaggagggcgaggatcatcaaggcttgcttgttaagcgatacatttcaagttctcttccgtgagaaaagtcaaaataaccgttttcgaaaaaaaatttggatgtaagagctaaaggccgtaagagcgtgccaataaggatatccattcctgtgaagacaagacgcagagggtaggagctattgcctcaggccgccccggcagcagccccatgagccacaagtagacccgttagagttgaagccgttaaggcagttcaagacgttgagcgacgacaggaaacggccgcctcccctcgcttccgtcttacattcgtactgcaggctaattgactccatgaaacaggtacgatgttgcgctccttagctggtaaagctgtgtgcggccccatccgctatcaactatctgcggccttcgccacgcaggccgcccctcctttccactaccaagagctcttcgacctctccccagacacagccacatcataccggaagcttactagcgattttgtatccacgtttcatgtaaatggacaattttttttgaaagtcgagcctgaagggttgcgtt

SEQ ID NO: 1416 - DNA, 703 bp, Nannochloropsis_gaditana
taccccatcaagacgagactagctttgacgggaacactggtcgtggcgcgagatatcgcacacgccaaattgctggagagggtggagagcggacagggcctgcccgaatacgtcaaggaccacatcatttactacgccgggccagccaagacgccggagggctacgcgtcgggatcttttggaccgaccacggcggggaggatggactcgtatgtggacacattcatggcgaacgggggctccttcatcaccctggcgaaagggaatcgaagcaagacagtgaccaaggcgtgtaagactcacggaggattctacttaggatccatcggcggccccgcggccattctggcgcagaacaacatcaaaaaagtggaagtgctggaataccctgagctgggcatggaagcgatctggaagatccaggtggtggactttccggcttttgtggtgtgcgacgacaaggggaacgacttcttcgccaagtggcaagtgtgagaagaggaggcgcaggcgaggaaaatttgacgtgtgcacttgattgcatgaggctgctacagcttagtatgccatgcctcgggatatttgaagaaaccagaatccgagccaagtgatgaccgcggtatttaggtttctctggctgttttttctttcaacttatttttgttctgaaacggctcgacaacattcttttcctgcgggtccg

SEQ ID NO: 1417 - DNA, 703 bp, Nannochloropsis_gaditana
aatttgacgtgtgcacttgattgcatgaggctgctacagcttagtatgccatgcctcgggatatttgaagaaaccagaatccgagccaagtgatgaccgcggtatttaggtttctctggctgttttttctttcaacttatttttgttctgaaacggctcgacaacattcttttcctgcgggtccgaccttagtcgctcccgctcagcctcccgcccctggcccccaatcgatccccctctacaccctacgccacattcgcgctcgttccccctcctcatcatctaggcatacatggccaaactccccttcttcttggcctgcaccacgctgatggcctccatgaagtcctcgtgcttgatctccaccgcctctcgccgcagggccagcatgcccgcctccacacacaccgccttcaactgcgccccgttgaaatcgtcgcagcaccgtgccaactcatcgaagttcacatcctccttgtcaacattcattttccgggagtggatctccatgattcgggctcgcgcctcttctgtggggtgcgggagctcgatctttcgatccaagcgccccgaacgcagcaaggcggggtccaacacatccggtctgttcgtggccgcgatgactttgatgttctcgtttaccgtgaagccatccaactggttgaggagttccagcatggtgcgctgcacctctctgtcccct

SEQ ID NO: 1418 - DNA, 703 bp, Nannochloropsis_gaditana
ttcgaccggctgcgacggcccgaatgcacaccttttcaagcaagtcggagtccgggcaggcggcgagggttgagttgatggcgcgttcgacctcgagttgcaccgttctactcttcacttggaattgccaaccattgaagtgcgtcccatcgtaagcaagtcgggctacaaagcgcgtcataggaacagtaggatttttccaccaggctctgggtgtataatctcctgataaagacatcctgcaggggctatgccacaccatcgccccccgacaagccgcgattaccaaaaggcaacaaagcgccaaaagatgcagccgcttcaaacggcactccgtttcatgcgcgtttagccccataagcagtttttaaagtgtcgactatcggcgcccgtgcttgggaggcgtctgggagctcctccaccatgtccagccaggaggttaaacgtcagtccaaagcctgtctcgaaaaccacacattgcgttagcaaggactgcgctaaaacgtattctgtattatcctgtactcacaccacagtaaaaacgatgaaacccaccagtttgctcgtcccgagctcgctcctgcttttgagcagcagtctcttcgtgtcctctttcgtcattcaatcgcacacttcatcgataataggtttaagcgctaagtcctcttcccccggtagtagcagcaggagcagtacaaggatg

SEQ ID NO: 1419 - DNA, 703 bp, Nannochloropsis_gaditana
aaggtctccgggataaattagccccacaatgcttccaagacttccgacaggcttatacgtgccagcatcccatgctcggacgctcacctgcattatctcggcatcaagcgcttcttccgctgccgtcgctgcagcatctgctgctgctattgcctcattcgaggttacatccatggctatccgtaatgatgctgctggatgctctgttcatcacgtgtgatgggataagcacatcagtggggtgataggatgatgacgggtgcgtgctcagatggcttggtccgcgagttgagtgacctgatagcccgccacgcgacaaaagtgtctgtcgaaaatgtttgctctcaggcggcttgaacacaggcccaggacgaagcaaaggcatgctgtggtggtacttgccgttcctcgacttcttttcgtttcctcaggagcgactcgccagcacctcgccaacttccccggcaggagagattgctccttcttgacctcacgagactcaccagatagttcaagagccccccaggggaggagtgggtgcatgagcttcattgaagtgtccatggtagctgaggcgattctacatgcattgtgaaacctctcaccaccaccccgtgacaaaacacagcggcgtccactctcgcccctcgtagtccgcatcgaagtgccctctgtcaaggtcagcaatcccaccaccacgatg

SEQ ID NO: 1420 - DNA, 703 bp, Nannochloropsis_gaditana
tatttattttcatcaataaataacgaagataattacaaaaacatagtatggaatttaaaaaaaatgttttcaattgggtcgtccacctccccgccgtgcgagacccgggtcgttacatgggccctcgggcgatgaccgaggccctcctgcacacaggcgttttgatgacggttgtagaatacctggacacactacttaagatattttggagatgtttgtatttatgagttcgttgtatataaccaatcctttgtttttggacatgggaaatgctggtatggcgaacgaggacaccgcccccccccggcgatgcccgacgtgtgatgacctaaaaagtaaggcactaaacttttgctttgatccggaatgtctcagtaccatacatcccaccatactatactcaaatattttaggcaggcccctttcaatcgtaatttgtgtagttggagggccttaatccctctaacctcaagcatattaaactggcgtctccgggaagaataggagaagaagcggcgcagtctccgtgcaagacccaggagttacacaccggagaacaattatctgagcagcgggcagctttagcacaggattcccccatgctgcggctcgagtgtgccattcagacatatgattggggcaagccaggattagagagcgccgtggcgcagctcaagcaagaaggcgatgaccatttcgaagc

SEQ ID NO: 1421 - DNA, 703 bp, Nannochloropsis_gaditana
gcaagccaggattagagagcgccgtggcgcagctcaagcaagaaggcgatgaccatttcgaagcgcagcaagacacacgatacgccgagctttggatgggaacgcatccaagcggaccttcgacagttattgtacccgcgggtcccaagaaaatcctcttgaaagattacctggacgcccatcccgaggccacggggagcgcgtctgtggcaggtggggacctcccctttatgttcaaggtcctctctatcgcgaaagccttgtccattcaagctcaccccgacaagcgccgtgcggaagagctgcacgcgacccggccgcaagtgtacaaggacgcgaaccacaagccggagatggccatctccctgacgccctttgaggccctctgcggcttcaggcccctggccgagctcttgtcgcatttctcctccttcccggaattcaaggccttggtggactctgacttgctcaccgccctggccaaggttgcggaagggagtgggaaagaagtggaggcgaaggaggcgctgaggaaggtattctcgtcgtacatggaggccccagaggagcgggcgatggccgagctctcagccttggtggcgcgcttggagcggaagcaggagatagagagggatgcaggagaggcgcacgatccgcttgagagcctcattttgcggctgaaggcgcattacccgggggaccg

SEQ ID NO: 1422 - DNA, 703 bp, Nannochloropsis_gaditana
gagtggggcgtgggcgctggctggcgctacaggattggggaatgcagccccgcaaatcggacatagtctatctctcgtatcatatgtttgattgcagtcatcgcaacgtttcccctggattgaagacatgcctgaccgtgatcaaggaggggtctgagtctcggcggcagggaggggaggttgttgatgtatgatactcgtcgtcttcccccttttgctcgtccagcactacgtatacccattgccagacctctccaggcgagaggagtaaccacgcttgtctagtgccagagtttggctggatctaatggcgacgattgtgctttgcccctgtaagacgtctccgaactagaagaacaatcaggccgtgatcgctaggctcggtcgccgtgcactcgacagtctcggcgtcttgcccaccaacgttgtttaatgctaagccgattagttttccgggctcactcaccattattttcatcattttctgtcttcatggtgcacttatctcttgtcttggctcaaagagcgcgtttctagggaacgtgggattttcaaggatctttctcggctagtgaaacgagaaatcgttttggaaaagggcagtttcatctcttctgaactagagttagttgcagagggcgcgcaggaagtctaaaatttcgaaatccctcttgtgccgtctgtcaatcaccctacggagatg

SEQ ID NO: 1423 - DNA, 703 bp, Nannochloropsis_gaditana
ttacacgtccaagaatgaggatattcagacagctgagggggctaggacgggcaaagttcctttcctataatttgtatagtaaagtatgcaatggctgctgaccgaggcgtaatggtaaaatctaacttccgttacaaagtaggagacgtgcctcacctgtcttcaagattttaccgaacttttatctcatttacgcaactagcctctcgccctccctcctacccccccctgcgcctaaaaatgctacccggatcccaccggaccgtaacctatcgagcccctgctgtgtgttattgtaaggaagcgctgcctttcacagcgaagtcctggttatgataccaaataatggatgcatggacatattttatgaaggacctaattgtttgtatgcgagacgaggtcggggccaccgcgcgtgagctcctattgatttagttgacgttgactcgctctctccagcctcgctagaaatgaaaagcttcaagatgtgcattcgacgggattcggtgccatccgtcgcgaggggcgacgaatgcgaattgactgaaaatcctcaaattcccgacaggctttaccagaaaatctctgttcggaagtcggcttttggtgagctggtcagccgaaagacgaggagctgctaagttttcctttcaagtcctccaccccatcttgaaaaagtcgaatctcacggacatatagtatg

SEQ ID NO: 1424 - DNA, 703 bp, Nannochloropsis_gaditana
actttctgagggttttaagttccatcgaaatatagagctcagtgaaactgagggacgcggctgtaaacattgttgggccaggcaaatcacagcaacctcctccacgccacccatacccttgtcacttgcaaggccctccgagacgacgaggaagcctgtgaggctaagcttggaaacagaccagagcgcacacgtgttccagggcgcggtggcccccgtcaagggctgccggcctggtcggaaatgatggccttccagggcttccacacgaatgcgagagggggatagagcagatttagtggtgcttacgtgatggaagcatggtgatttttctgtgagcataatcgaattcacaagttgcagggagagcgaaggcccgctcgagcaactccacggaccgttttatgtgaaaatcagaacctgacgagaatccatatgcctctggaaaaaaatactcaccagcgccaacaactaaatcctctgccgggtcaaagttgtcaaggagcgcacggaaagccattggggtcaggtccatctctaaggagaggtacaggatgtatgagaagtcctcctgcatggcaaatgataaagctgcgtttaatgcaggcacaaaatgaccccacggtgtgacgggcaggacgttgatgcgacagcccttaaactctttgacgacatcttgcgcagctaccagcagtcggggatg

SEQ ID NO: 1425 - DNA, 703 bp, Nannochloropsis_gaditana
tgcttgtaaatgtctccgagcgctctatctaatagatgcaaggctgtggtgctaagatcgcaggcaaaacatatcaagtcggggtttgcctccataatggctgcaaggcttgagccgtacccacatccaatctcgagcaatcggcacttgacgaaattatttgtggctgcgtattccccagccttgtccaggagttccggaaattccaataccaagtatcgtctttttttgaaaaaagtagctttatcggagtgtcgatggaaaaaagattcccatgcttgtactggtggagactcagctcggacgatgtcttcccgaggaaggcaagagaccgtggccagggttggttcggtcgaccttcgatatgcatcgaaatcgaaatcatggtcatgatatgctcctgcgaccgcacacttatcgccagacataaaactagacagtgaaggggcattagagggacatgagactatgcattcgatgattctatgcggaagtatcaagttgagctcttgcgaagtgaaagggtagcatagtggtacatattttacaatgataccgtccaaaatagtaatctatcgcgaccaaaacacagatcctgattcgcttgctccaattctaggggaaaacgacacgactgtccgacgcaacagacactgactgactttaacttccttacttactggctttaacctcccggccgcag

SEQ ID NO: 1426 - DNA, 703 bp, Nannochloropsis_gaditana
tcggggcttggagctgaatggacgcaaaatggcatcccacgtgatctgagaccacagggccgtgggacttctagctgtgcgtctgcctcaacttgttattcactaacgaggagaggggacactccgttccggctagacaccatagcttacgttttgcattgtcgaaggtacaaatgctgtgtggatttctgtgcgctgaaaactgagccgaacggcagaaattgcaacgtgacctggaatagttcctagcccgatctcggctcgagtatctggacacaatacgacacgtggactgccaggtttgcggtggctcgtcttgactgggcggcgcgagtagattggccatgtcgtgggatagggaaagccctatggtggtaatcaaggggagacccccagtggctcaggtgttgagtgtcggcagtttgtgcgaatgtagtcttggcgggcgtcctgagtgtacattgcgtctgaatgcgcgatcaatgtgccattaacgatcaccgtgataaagccataagctgcttatatagaggcttactgctctgtagcccacgctgatatctcgagcacgccggcgtcctttaagagccatgacacacacataccactgcgcttaaatatcactaacacatcggtacaggtcaactctggaggcccttttgtactgtgccctacctcccatccttccaagccagagggaatg

SEQ ID NO: 1427 - DNA, 703 bp, Nannochloropsis_gaditana
tgcgcaactccatgatttttttctacagccacgaacagaagacgtgagtattggttaggatggagatggagtggtggcacttcatcagaaagaaagtcttcgagaggccccaggacaaaaagaacacgcgacacaatgtcgacgtcaatgaggggcgaatacattaaatttcattatgttgaacgaacaattaactaaatggcgtgctggctgataatggtacgcaaagggctaccaaaaactcgcacatcacgttggcacgtagtcgaggaaaagaaggggagactgcccccccctttcctgtggacatacctgatacgtttcgagaaattccttggttgccatagtatgtgtgcggtgctcgaacctgtgtacaaacctttgtgcgcaataagtatcgtgaaaaaaaaaaattaaaagcccgtttccccccaacgacgggcggcttcttcggcttcttcacccccgtggcacgtacacttgcggcgggaggggcggccacacaatgggcgccgccgagagacgcactcggaattcgcacacacatgaatacgcgtggactcactttttggtctctaccggcacgcattttttggcaaacgagtacagggttcaggcccccggagacgaaatcgcttcctatcctgtctgcccgtctcaacctgtggggcgacccgtcgatcttactcacctcaacactatg

SEQ ID NO: 1428 - DNA, 703 bp, Nannochloropsis_gaditana
ttttacataacaatacgtcggatgaagcacagggcattccacagcaacgttgatcgttcacacccctgagcagaacacttaccgagccagcgctgttctgtattttgcccttctttgcaatcagaaggcctaagaacagcgcggtcctcgtgaggtccctcgctgcgaatgggaatcgcaatctgctcattgagtggtgaaggggtacttctttgtcggcttacggaaagtcacgcaagacgtcaatacggataccggttctcacccgcagcgcatcttcagacgcagcatttagctccccttccaaaagattcagatgccgcagcttgaccttgagcatggtggagattgcaggtagacgctggtgcaagttgcaggacttttctgtgttttaggtatgggtgcggtgcggcaaaatgtcgagagtgttaggcggaacgacgcccgcgtcaggaccgcggtgatcgaacgtaagtcgggaccagtcagcatccacggtcactttcatcaattttgaaaacgctgcccacctgataggagcaaggtttcctcccgcccgcccccctgcccgcaggcccgccgactcgccaggcccggattcgcccccgttgttctgcctccctgccccctgcagccccctcaccgcgctccatctttcttcgttctccctcctcgtcgaaaacacacaagtattttaggcatg

SEQ ID NO: 1429 - DNA, 703 bp, Nannochloropsis_gaditana
agtgcaggtgggggatgcttgaggagcagcaatgggcttttcgccgccacaccgtggcactctttccgtgggaacttgttgatatcagcccctgaccacatacatgttctccaactcattcgttctcagttgattcatgggacttgcagcggaaaatcattctcaagcttccatcggacccagaattctgcgagcaatggttgatcccggcgcgcttttccctcattgtgtagcgggaggtgcttccacgttttgggccctttcacttccacccctgcgcactttttgtcaagatggcatttatctgaacttacaagatgaaatatgatgccagatttatggaaacggagaacctctcgtcggttgtgttgtcagtcggtcgtgttatccgccaccatggaggggttccgtacttgttgtctggcgagtagaaagtttccgctgccaagaagtgcaaattatgccacgaaagcacgatcatcggacacaacatatggcagacctagcggtctgaccgatgctcttcatctgagagggtggtattgatcacggttgcgaaataatatggaaaacttcccggtgatgggatgtcgcagtgagctgtctccgatcaccacactcacactcttatcgccctgtcttcttcacataggccgacttcgactgaacactcagcgccgggccttgtcagcaggaggccatg

SEQ ID NO: 1430 - DNA, 703 bp, Nannochloropsis_gaditana
agcttcttcgctaatttgactcgatcccatgttggggggaaatgcacacggcgttcacgacgtaggagtcacacacggcgttccgtggcgcttcagcttgtgcaatcaattgggcacggttgcctgtttgcgcttgttcctggcattttatcatctgctcaacctctcaagcattacaaacacgtgcatatacagagaggaaagcaatcgcgccagcacatgtcctgatcgacggctagaagaggccttgtggcaaggcctgtgacctagggaaaaaacgcgtgcaacagagcgggttcaggtaggagtgacctctggcatcatgccccaacggcaaacgacggtgcacctgcatgtgctacagccagctaaggcctggatgcggcggcgggtaggaataatggcgtacacggcgcttttgctcgtggctgtcgctctcattgctcgacacgacggatggtcgggcaagagaagcagtagcagaagccgagctgcttcgaaggcacgggccctagcctccccaaagaggcattatgagtcctcgcgcgagcacgcaccagccagatcaagactacgaagcgtcacacaagcatatagagtggcggcagactcctcccagctgccaccacaccgagtgttaccattgccttgcgactgtcagcactgtgaggtgcgccagtcatactccacgtccccgccaatg

SEQ ID NO: 1431 - DNA, 703 bp, Nannochloropsis_gaditana
tttctgtgctatgtggcataaaatttctttcaaaaggttaaagtagctttgagctaaatagcatagcatatcgcgatcagggtcaacgtaacacggagacgacaaagtgcgcgtgctcttttgaggatgatcttggggcaaggtatgcaaggattgaagaaatgcgcatgcgtaatttattagattttcaagtttactattatcatatgctttcgtcgtttgctttatttttgcgttttttctcatgctcgctttttgctctgaagagatccaggcacggcaagtaactgtcatgactgtaacatgacaagaaataaacgatataaactgacaagatacacttcatgattcttttcttaccataaagctgtaactttatccgcaattcccgccgtacagagaagcggcgccgatgttcctcctcccccccccggcttcggacgcgtcgcgaacttcaaggtaagccccagacgatgccatcccgacgggctgatttacccctgactgtcgcaccttaatctgtactgatgggcttcgcggggtaatgtacgcgcggttgctttccttttttccacttctactcggtactcgaagaagaataaaaattgtttattccccgtaacgctctgtgcgtcttccaacatcccgccccattcagaacaccggcaggagcaggccttgagggtgaattacaactcatatg

SEQ ID NO: 1432 - DNA, 703 bp, Nannochloropsis_gaditana
ggcgacgttttctagagggatgtggcctgcggtgaaatcaaggatagtcctggactcgaacccgcatcgaacctctgacctcacggtgaacagagctgctgctaacagccgtgtgctctacctactgagctaagaaaacgcacgcacacaagtaatgtggaacgtctcagttatcaaaatctttattgctattcgtgttcttcgttaccccttgccactagtcccttgggataggggatgctttacggggacttggataagcatgtcgttcatgtgactaatacaatcagagcataactaaaaattttactaatataccaacatgaagcagcgtaaaatgacatttgtaaaggagtgcttacgaacttatcgatagccatttttaaggcttttggcacaaagtacggccgaattatgatccacttcgctgaacaatttctttgtcttttcttgaagccttgcctccatggcggttcattaacgttgcagtcgggataccaaggtcgcgtaacaattaaccctgcttggcttgatagacgagggtacgtctcccatcacaccaatatggcgagcgaggccgtcatcatcacggcaaagccccccgcgagaggggattttcatacctgaacttcgacattttttaaaaagcgtcgtatcgatcaatatatgttctttaaaaaacacgatgcaatctaatcccaat

SEQ ID NO: 1433 - DNA, 703 bp, Nannochloropsis_gaditana
tttttttttccaaccatcagcatcatcatcaactttcttgtctggacaattaccttctttcgggccctcctcattccctaaatacgagggtttatcattgtcgcagccaggccttcctgtgcgccaggacaactcaaggattgccgcaatgctccgcggcaacagtgaggtttccggccaaaatgtcagcgatattcaaactgtatcacatggaatggaaatgaaatttgccaaatcactagacgaacctcgaactctggtaatatatgtataccacgaatcgcaagaatggtaccgggaaaatttgcggttcttcataagagtagcgatgcaagataatgacaacaactcaacagactaccttctggttgtaaatggaaatagtgatcttcctcttcgtgggttattggcctcgacattggctcaaagggagggacgcgtgtgggtgcttcaacgagcaaacacgtgctacgacggaggcaccgtgggagaggtgctccggactcacccgcacctggccgaatcatatttttactatgtgctgatgaacagctctgtccgtgggcccttcttgccgcgctatttccagaggatgaagggggaggaggggcacgctgagccgcgtcgacgttcttggacctctcctctgacaagcttgctcaatgatgaggtcaagctagctggcaccaccctgagctgcatg

SEQ ID NO: 1434 - DNA, 703 bp, Nannochloropsis_gaditana
gcgatggcacccctgtagtcccgccgcccagattttgcaaggccttcttccctcaaatgtattgctgcagcattaggggacgtcatttccgtaggtgcgtctcgcgtttattttttaacgttctgcaacaacgtcaagtcatagtggtggtggtcccaatcgccctttcctatcaaagtttatgcgagcaaacgcgatgcgatgaggcagcgtgttatatcgcttctgaatcagtacacttcataacaaatcatggtcatcgcgcttgcttggctttccccctgccggcattcctactgcctcccttctttttcagaggcagggcaagcagcgcagggggactgggcgatagcatcgccgaggccggagcttctactgccgcgcacgaccttttcgggtgacacgtggtgcgaccacgctcaagatatggggctgattcagacactctatgtcgtggcaaggccgtttacacttcggccagcttgtggcttgtggaatgaggaggtttggtttgtggcactttacttttcagttaaagatcgatcgggcctttttactatgttgcgtacgcagcatgttgattcattctgaaaatatcccacgacgacagcaactgcgcccgtgaaagccactgaactgccagacaaaggtctttacaagacgggtgtccaggcatagctaatttttcgtccttctttcgatg

SEQ ID NO: 1435 - DNA, 703 bp, Nannochloropsis_gaditana
aagttgagagagagacgggaaaggccgcactacggtcccggtcctgcactccggccccgaccctgtgtggccagggggcgcatgttcatcccccgcctcaagagaagccatcgacatatcttcgaccgcatcctccgtctctcgcaagctatagagtatgttttcgagatgtgggtcatccacgtgcgccatcgaagctggaggtgatgttgatgtctcttgttcctgtatcgcttcattctgaggacgaggcctttcttgcatggcatccgccatgcccgcggctgcgtgatcacgagaaagggcagaattattagcataccatcaccctacatgtgcacacttcgcgtaccccagccgccttgagcttgaacgcgcatcaatcttcctgtatcaggcacgccccccgccattttagcctcgaatgctttcgtctcagccgtttctcgatgttcgccaagacagcgacccggcgcgcatgtgctatgaaaaagacatgtggaggttgccctgttgttgaaaaagacatgtcgaggttgccctccttcgtaaaccttgttgtgtggtaaaatgcagtcgtccagtggcgccctgtccgcgtacaggggaagtgtgcgtgattgtccctcttctcgttttttcgtagttccccactgcttatcctctacatctgaaccccaaacccccaaaacagaggtacatg

SEQ ID NO: 1436 - DNA, 703 bp, Nannochloropsis_gaditana
ttagcccaagcggatgtcacaggaacgtttatagagtatattacattgatttttcacataggattcaccgttcgctcgaccctaatggcccatatcttctgttgacatgagatggcacctgtctccgtcgccagaaaagccttcgtcgttttgtccttgtagatcttgcctcccttcctccccgcttccctctctttccttcgtctcattgcatgactccgggcacttcccccccgggcgagccgtacgcttgtgccaggcttcgacgcacactttcctatggaaagtggctggcaagcgcgatcctcctacgtcctcggtccacacattcacacaattctgccaaaagccttgattgaactcgttttccctcccacgcgaggggcgtcgaagcgcctcgttcgttgtttgtgcggtggcaatgaggtaaatgtgataagagcaaagggaggccagggaccacgacatgacgaaggtgaagactcccaccccggcagcggcgggaaactgcccggcaaccatccagagtgcctgcactggctccggggagtgcaacaaatgacgaacgacgacagctaggcatgtggcgaagacgaagacgctgagaacggtggtggtcaggacgaagagaacgaagcttcgataatttctcttggcgacgcaggtgcccacccagatgcaatgatggtccatccgctcgacg

SEQ ID NO: 1437 - DNA, 703 bp, Nannochloropsis_gaditana
cccaaacccccaaaacagaggtacatgggtacatcgacggcacggaagcttgtgttcgtcactgtcggaaccacgcgttttgacgcgcttattgaggtaggatacgcggtcaggccttctccgcccttgacctcctccctcgtctcattatttacgaaccttgcgccctccaggcaatatcaacaccagatgccttggaatgtctggccgtgcagggttttaccgacttactgatccaaatcggggctagtcctgagccaacggtaggcacagcggcaggttcagactatgtgcgggaagtacatgacaacaaggacacagagacgaagaagggggtcctagaaagtcggttgacttctctcctgcgaagacgtgtcgcaaagaggagcacatcaggtcaaatacggggtaatgaagcggtctctgtgtcttggtaccgctacaaggacagcttgcgggcggatatggaggcggcggacttgataattagccatgccggtacgaactaaagcataggtccacgtgtgcgagcgtgtgagaacggttctcgtcaactaatacaaccgctgccgaaaaataaattggcttgaacaatgcactggttctcaccgccccggcttacacacaagcaggcgctggctccgtgatggaggggttgaacctaggaaaggctttgcttgtggtggtgaacactgctctcatg

SEQ ID NO: 1438 - DNA, 703 bp, Nannochloropsis_gaditana
ttgaaacataccttgaaccgatagacgccataggatggttcatcctgctcatgcaatactgccggtgaaaagctctcagaaattgttggtagaagatgggatgcactaccttgcgcttcgcttgcctcgaggtacacacccctcatgccaaatgtagctgatatgccttgttcgtagcttcggtttgatgtatgcactatctcgaggattttgttcgttgatcacgcaccgatccccgcgtgactgtgcacatgcaatcgtatcctgtaagaaatagtgataattaggaataggtgagcattcatggaaagcagccatgtgtagaaaggggctctcctcccacggaggtctgtcatttccacgcttcatccgtttcttaacggctggccgaacgtttcttttcttccacgggcttggacctgggagcccgtccgggcacgttcttaggctctggacaattcgcccccatgtcgtctacatatcggcgctgtttgaaaatggacaaatgtaagctctttcttttctccctggatttgtgactatttttccacgccagtaacgtaacccgcacacattccaatcgtaaacacaggaacgcacagcagctccccgagggaccccacgtcgctttccttcgattgctgtggtgcaacacagaggcattaaagtcatagcaagatcgagtgtacgccgaaataagatg

SEQ ID NO: 1439 - DNA, 703 bp, Nannochloropsis_gaditana
gtcttcgcccaggacgagacggcgattgctaagaagggaacaaccgcttacacgaataccagacatatcacctgccagttttatgaacgcgaggcgcacaccttctagatcactgactatgctaaacattccagcactgttcgccgtggtgcggcgacttgccgtcaggaattgcctattctgctttggcgggtctgggattgtataagggcattggcggcccttcgcttcctcgtcatctcctccctaaggccattacctgctttcttatgaccactatatagccttctagccgttcagacggataggaaacgattaaggaacttgcgtccttcgggacctaagctcgtgactgagtgctcgctcaaaatttgcatgtttggaggtcgaagggctgacgaagacgcctgtgttcggggggtctggaacatatggacacgctctaggcctgtgcttcccgggccacaaggaccttttcctgttgtcgtttttgtcgtgcatcagcgtgcgttggaaagttgtgcaagtaatgggttcccttgattactctctgacacagtctcacccctctgctcccctaatgccctgtttttcacaggagtcctcttgcttcctgctccgtaccgaaggcagtgtgaacgaggataaatttactagcaggagagagaaagccgttttactttggtaacggcaggcaataatg

SEQ ID NO: 1440 - DNA, 703 bp, Nannochloropsis_gaditana
aggcacgtcgccttcgctggcattggctcgcaggactcgaggtagtgtatgggggaggtctgccgcctttcttggggacactacacgataaaccctcgggactttcgaaatgggcctcgtcaacagacaacagagttggaagggcggcgcaagccgttcgcatgacacatttgtcttccttgtccggtccctcatcattccctcttgaaggagacatgagaacgggcacgatcaggtcagactgatgcgaccagttcgtgtctgtggaagggggaaaatggtggaatcgtgtcgagtgaagggagtgaggaaaagggaaagagatgaccagaaccgccgataccttcccatcaagaatcggcaacgcgtgtgggaggcacattggcaccgggtatgagacgcagtgttggctgtgtcaggtctgcgaccggcacatggaataggaatgggcccggcggggtctcgctggcgttaggcggaggcggtcacggggactcagacccctgaccatacagacccctttatacccgacccgttcagagatgcagtcccttgcctgccgtgtgcatcgatcttacaatggtcccgggggcgcagccacttttgtgggggcccgctgcgcgtttcgcttgttgactcattccttctcatcttctttcacctcaacagcaagctcccgccccgcagggttggataggccatg

SEQ ID NO: 1441 - DNA, 703 bp, Nannochloropsis_gaditana
tgggtggagggtgagcggggaatgatggtaatgtagaagggtcatcaaggaatacacttaacgagaacaaaagaaaaaaaacgaggggtgcatttactacacagggtgtacgacggtcaaaaatccaggactattcctttgacttgtaccgtgatggcgaagctacccaccgacagtgtccatggagtgaatcatgaggaaagtggaagacccagtggagatcgagcgagataggcaagcccaaatttgcacgacatgtctttttttcgtggcggtattcaaattaagcgacttgccgctcaaccgatatttgaatttttgaacctaagcagctcatatagatgagaacagaaatactcccaactacaccgattttgcttccctcttatatttctttcgttatctgttatgagttctatcactgtaaaattctagcaaatgaatgtggtgatttgtatatccctcaaacgagtaggcaccccactacggtcatggcgacgaggaccacggcacttgcgtcatgccgtggagtcggatcttttttttttcggcatccctaaacaacctgaatgagacccacagcattaaaattgcatattttctcttttgcatgcaaatccatatgtctcattgtgtccacaatcttctgcctcattgcttttcattattctgatgacgatggtaggtcgatttcgcaatcatg

SEQ ID NO: 1442 - DNA, 703 bp, Nannochloropsis_gaditana
ggccttaacaaagccacttcatccgaacttttaacaaagattcaggggtgatcattcacgctcacacgcccatacctaatatagtcctatggtcacagccttcccctgtcatgggatacaaacgacgtcgggagaaagggagtcttccatgcagtgcctcacttaatgcggcccatggacgtaaaggtgccctctggcccataccagtcgatgtatcgtcatatcagtggctacaacaatcaccgcatgggacattagtcactcacgggtgcatgacagggtcaattagactcccttcacgacgtctaatgacttatacaaccatatttgaaccattcgctcggatatacttcttccttccgtccccaagaataaggaggagggtatcaagcctcctgtcacctccaaagtcgtggtcgtcttgcctgcaaatatttctactaggaatattatatttatcaatgcctactaatgcaggaggactatacagtattgggacagattcggtgcgtaatggacccaaaagtttacaggggcaggtctccattttcctcgtgagagatgaggaggaccgctactggtctggaccgcgtcagtgaaaattccacgttcatgtgccgctgctgaccgtaatgcaatttaaagttttatgatatattccagtgtgcgcaattaactctttcccaccgattttttgcagatg

SEQ ID NO: 1443 - DNA, 703 bp, Nannochloropsis_gaditana
tatgagtcgttggtagcaagaatgataacgtggaaggaaactgcaagatgggccacggcctagtctaacgggcccgatctactgtccccttgttcttccttactcgactcttacaggacctatattcctttgctacaaatactaacaatatatccttgttcatgagtatatccactatttatttattcactacgggtaatttgtctgtgtgcaagcaaggacgtagcatgacggcttggcaaaccgtggctctgtccaagtttggttcttcgtcctgcgggattgggccatacctttccctttcgattctcaaagcgggctagcagaaaataaaaacgacaagtagactagcttattaccgtagattttttacacggctcgtgagctttttctgtctggaaatggacctctgttctgacttatcgtgttgcacgtccgtacgacatgccatctatgcacaggcccatatcaatgtcttgttgccgcgtaaaatatggcaaataagcttatttttaagctacgtggctgactctctgtcggtttcctcgaatctttccatgcgtacgttaaattcacgtcctttttatcttccgacccaaggcaacttccctcacagggagtccatattcgtctcttgacacttcgcgtcggagatcgccaccaaagaggcaccacttgacgacgagagatcagaaagacaatg

SEQ ID NO: 1444 - DNA, 703 bp, Nannochloropsis_gaditana
gagcacgaggggcaagagcttcgtttccaccacccgccaggctccgagctgcgaatagcgatcacaggagggggggaagtagggtgagcattagggcggtgggggggggggagggagccaaggggcctgcctaccttgcatgccacctcccttatggcgtcgtcgtcccggcgcagggccctttgaagatcctggagccattccagacaattttcgccgcgaataaatcgctctgcgagactgcgcacgtaaaaaattggaatttcaagagacatgagcagaagtcagatgtgttttcttcgttttctacctccactcaccagccatcttccgtagtgtagacttctgtgctgcctagggccgcgcctaccagcagcaattcgttaatcaagggctcttccatacctcacttcccgatcagagtttcccgcctcacggcaggtgaagctatgtttggcggccctagggaggggagaaagtaggtaagagaggacggcgcggacgaatgaaaaaaccgagacaagttttcaagacccagacaatggatccgcgaattgcaagccttgacatgacaattttattccccgagagacatgcacgagagggcaccgtggggggccggcaagttcgtagagggcgagatgggcgaggggcgggaagcctgggcgatcgagtcactccccgcggtgcagtgaaagccatg

SEQ ID NO: 1445 - DNA, 703 bp, Nannochloropsis_gaditana
cgcctggaccacgaggggatgaatcggcaggattgcgaccttgatcatgagctgccagtccctggcgcccaaagcgatcgtaaacgtcacgtcgctccgggtcgctcaacacctcgtaggcctctccaataagcacgaacgtctgccgcgcttcttcctcattgccacgattacgatcgggatgcatctgaagcgctaatcgccggtacgcttgtttgatgtcatcagtggagctggcgggcggtacccccagaatttcataaaaacacaattcttcccctcccgagttactttccatggcttgtattcagggcgcgaaacaacctgtttcgataaaagatcctgtccattggtatgaataacaatattgtgcacatgtgatgccgtggcccgctaaaattcttgcagctttggccatatcacgagactttccaatttcgtagccccgcgacgtggacgacaacgactcgctcgcttccgcgacaagttcaatcaacccgaccccacactgaggctgcctcctcgaatccactctggccctcccacaggcccctaggtgcactcacagacagtgtatccgtggaggactcggtttctgtccgtcgctcgcctttctataccttcagcagacgtgcacgagggggcgggcacgagctcggactgaagagccccggcaagaacaagctcagggcaccgcaccatg

SEQ ID NO: 1446 - DNA, 703 bp, Nannochloropsis_gaditana
tcttaggcgccgcatcgccttttcctgtgtagcatcctcgtactcccagggctcctggaaaacaggggggcggtcgtcttgactactagcgcaagatttctccgttggacactctgcgaggagttgatcaattacgcccaaggggagcagccgtgcctgtgttgctcgaggtgtctgtattgtcaaaattgtggtagcaaagaagttgccagcggcagaggtcaaccgcaggtactgatctcgggggatgccgtgggaatggctcctccgctcactccctcgatcactcccttcgacgtgggcacgacttaaagacttggctcttgaaaagtttgatcgatggggaagaaggaacgcatttgaggcaacgataaatagcagcaacagcgcctcaatcaacatcaaggagggcgacgaagttgagggtggcgtgaacagagacggggatgtcttgcatgtacgacaacgtcggactcgttgtctcccgctaggccatacagtagtcatgatatcccccaatcgtgcagtccctattgatgtgtgtgggcgggaaaatgcggtcaatgttcgatcctgaagcaaacgtagactgggcgacgtgggaagatcggtggccgcggcccgtgctatctcggaatcagccctttagaggacgtcgtgcccgcctgtcacccgcattttcccaccgcaataacctgccatg

SEQ ID NO: 1447 - DNA, 703 bp, Nannochloropsis_gaditana
tgcataattttccagttgagctgtgaccttgtcgcgactggacattgttagacgagtaaggtgctggaagctactgtgatgaaggatgttagaatttgaggactgaggacaggtgcgggaccgcaatatgcatgcagcacaatggacggaacaagaaatctaaacctgccctcgtctgagtcagccagcgaactaaatcttcaccatgtcaaggcgtcacaaactgacgaacaaaccccgtgatctttttgttcactccccttgccgtcatccgatgggcgacgcacagttcggcaggctggactttgcaattgtgagctgattcagagatgtggcgtgcttcaagaaggtcgcagctgccctcgtcgcgggctgaggatgacgatgacggtccgcatgtgatgttttgtgcctccgccgtctcgcccgctcccctgccctctcccgagtgtcgcccggctcccatgcgacatcaataaacagcacattttcttggcaagaaaattttcgaatcccttttccactcgagcatcagagggccatcgcacacatttggacttgctttgataaattttatctcgtcggaaaaagagtgagaagcccgatgacgacttcagcgtgttcctcaatttccttagcgatcgcccgtgcttcttatcgtcttttctaactattttatacgttcactcagtaagatatcatg

SEQ ID NO: 1448 - DNA, 703 bp, Nannochloropsis_gaditana
agatggagaccatggacgatttggtgaggcagcgaaggcaaatggagttctcatggaggttttggattgaagacgtgttcgtatgcaacctgtcaatttttttgggggggagaagttctttcagcatgggccacatgcatcaatcaggctacggactggcagctagtgcatgcgtttgtcgaaggaagatttttttgaaggtttcattgcgcagacctgtagatctcctttctttttctacaaaatgtttgaaaaggttcgtattgaaacaacatcattgcgagaagaaaaggcgcctcgaatgcttgatcttccttgagccgtgttttttcctcgtagccccttgtgatgtttctcggttggaccgcaaagccggtacgtctgacaacgacaatctttcatttctattgccaaagcgcaagcgcatttaatcactacaaggttattgaaataatcgaaaagattttccctctatcattgttgttctgggctgaaaaggctggcctcaccgaagaagagacggaagtcgcgcgccctctcgggacttgctcttcgcctctgtccccggtgggccctgcaagtccttggccaactccactcacgaaattttcttcaaaatttcacagccatgctttcgcaaactggaactggatggaagtaggacaccagagtgtgcgggcttgcagatttcggtcttaatatg

SEQ ID NO: 1449 - DNA, 703 bp, Nannochloropsis_gaditana
ccgatatctgccagcaacgactaagtcttcccgtcagatgtggggggtgctgcgttggcctttccaaatatctgccgacacggcttaaattcgagatgcaactagccaccgtttaaatgaaagattttcacatccgtcttcttgttcatgtaatactactatcgtcaacatcgccactaatcgcagccgagtgggcgctcagaaaagcgatgagtagccaagccgttgatgatgacgagtcccagggcgagcatggggcttgagatgacggagggagatgagaaaaatggcgcgaaagagatgacagatgacgggccgtcacgggcccccagggcaggcggaaaaaaaggcgcgaaagcgaacaataggccgccgaggtccggggacagggttgaggcctcttgtttgcatgtagcacagtatgcctcagcttcatagaaagttgcgatggaaggaaattttcgagtatctgaggcagacgatgaccgctacatccgcatggagcttttccattttattttgtggctccctttctttccgtctcctccatgtaccagacaaggcgcataaacgtaattattgaagaacggctggccttcttcttgtcaaaacaaggctttgtttgtcttgaagcttccaaattactggtaactgctcacttcattatttgtgctgataacaagagccgctgtcattgccgatg

SEQ ID NO: 1450 - DNA, 703 bp, Nannochloropsis_gaditana
caaagtgtcgagatgagtcgacactaggcgggtaggatgaagtaccgcatgaatagtatgtgaaaatattggtagatgagaaatgactatgatcgaaccacgctgcatgcgtttccttggccagactctgatcactgattagccctccagaaaaagcaaggattagaaacacacacacacacacacacacacaatcacatatacatacagagggcttgtgaaaacgtttccagaaccatctcgtgcgtagtacatgaatattctccccttctcacttgttacccggaaaactcgtcgacgtgttctcatgaaacggaccgatctgttttcggagtccttgagccctctcgcaggtgtgagacctgcttgtgtaattgtttcttgtttgttcacctctttctgagcaagatgctgtaccatgcttacataatatccatgattcaaatacctaatgcatttggtgcgaatgaaagttctgctttacgtgctggcttatcaaaccgagcagttcgctggaattggcccatggtccatctaccgtgatatcaaaatacgcgactcaagcgatacacggctcattaaacattctaaggaatgagcggataaaatcgagtcgcgctgatcctcacccatattcgacgcatcagccacacgcagtgcccaccagaccttcagcttttaagatctccgatctgtgaagatg

SEQ ID NO: 1451 - DNA, 703 bp, Nannochloropsis_gaditana
tcactcaattttcgccactagttatattttacctgaatggaatcgctcagctatacccttggaacggtacgtatcagactttcaagagtattgatcgaaatttactggggtgtttgaattgcttcataatttccatcaaatctctagatcacggcacctaaagacatctcggtaccctcacgacagccttcattaccgccgcgccttattttgcgcagcgtttctgtgggacgaataggcagcatgactttgaaaattgtgcgtcttagtagcatgctagttctcattacaataatgttgctttttttatttgtcccaatttgcgtaagtgctcaccatggataatggcctgtcgtgccctcgcgctcgcgctcacgtcccctcctgtctgtctatcttcttcgcgggcagtcttttctctcacgttcatggcaaccaacttgctgttccaaagcttgctcgtgcggtatgccaaaactgccggtaagtgcagcatcacctttcggatcgtcctgccgctcgctcttctactctcgatattcgctgccaccgcggtattggttctcgtcaaagatgcctcccgggacggaatgttcagcttcactgccttaagcgtggcactctgcggcttctgcacctctgtcctccaggcggcgatcttcggctatgcggcggcttccccccccgatacacgcaagccatg

SEQ ID NO: 1452 - DNA, 703 bp, Nannochloropsis_gaditana
acaggagatggaagaggtggcagccctgcgagcagtttttacctgcagaatggcgaaaagtaatcatgcgagagatctgcacgccgccagtctgcaacagctatcggggcaagaagattacgatgctatggcttgcaatattaatgccacatcctcctattctggcattcatagcagagaaaaagggcgcgcgttgatagatatttggcaggcacggtcgcacggtgcgattgaggatgacttcgagcttgccgaaccggtgctggccgtacaagaagtgctgattcgagcgctttgtccgcccttagattgtcatcaagcgcttgtgcgtcatgcgcaaggtatagccgcagctgcgcgtgcggcaggaaatttgaccatcgcggcgagtgtgatggacagagtggagagccttctacttgcccctggtgctagcccgaatggagtattgacagtggagcgctgcgtctgcaagcttgaacaagcccgtatcctctgggcaaacgggaaaggagaccttgccatccgaactgtgacagctctggctcctgccttggagactttggaccaagacgtctctaaaaaatgttcagatgaagccagggtacgcggattggagattcaggctcgacaactagcggggcggtggatggcgatagcccgatccgaaagcacgcaacgtatcatcgacggacatttacgg

SEQ ID NO: 1453 - DNA, 703 bp, Nannochloropsis_gaditana
tgtcctagcgagcgactcagaggcaaaagagcacgaagaggaagatggctcgggatgtggagatgatgatgacttgggacccatcttcaaggttgtagcgctttggttcgatccagtcaatgcaggaagccttgtcgtgaatgcagagcttgccaagctggttttagagattcccacttacaaggttgtaccattgatatatcagattttatcgcgattgggctcgggtactcgtgaattcagcagcgctgtagaattgctagttttccggacttgcaaagaacacccccaccataccctgctccagcttttcgctcttcggcacgggaagacgctcaattcggctgcagcccgagaaacctacaatcgtatggcgcacctggaagagaaggtccaagcagcgcaaggaatcttgaatcgcttgctgtctagtggttgccccgtcttggcggctctcgtcaccaacacagaaaaacttcttgacgggtacatcaaattggcttcgatcaagcgcacgcaggagatgaagcagtcccggaacctgtcttttgtgtcccttaccgccgagccggccgttgtccgtagttttccggacattctgcgacgtggcgccgaaggtcctagaagcggaacttcgagcagcggcgtcactttggcagccttacctgccgtcttgaccaaatcaccgccgttggacccgatg

SEQ ID NO: 1454 - DNA, 703 bp, Nannochloropsis_gaditana
gctgtgcccgttttcttcacttataagattttatgcgtccgtaggcaagtagcagaatacaatgctgcgccaaatctcccttaaaccgactttccaatcatataacctcctggtaacgcatcaggtgatgccatgaactttaaatgttgtggctcacaactggcctaaagcgtccttgtttttttcttggtgatgatagagcttgcatattgtgaagccgatgaatatctcgttccgaatatccacatttagcgcgaaaatacccttggttactgtctgctctgttcagcacgccattgaagggaaccaaaattttggcctgaaagaaaggaatacacatttgaccagaattgatcgatgctgtgaaaggaagaggttcctcgtacattttgcaatgtgctggcaaggcgcctcagtagtgcgtggtccatgaataagacagtgctgcatttccctgctcgccgaggtggccagacgccctctctcgttgatgttgctcaagcgagccctccaccaccgcagaagaatcctctcgtatctaaggcactagtaaacacctccacgcaccagaagttgagccatcaatgcctcacgctttccgtcttccatctgtctgacaggaatgagccgatcttcctcctcgtcttttttaaccctcgtcgcttgtctcgtgctttccagctacagcgcatctgccttcatg

SEQ ID NO: 1455 - DNA, 703 bp, Nannochloropsis_gaditana
gtgtgaccaagccggtgtctgtcgcgccatgaggcatgcaccagttgaggagccggaggtcggatagaaagggaggcaggtaaccacgtgataacggggatgcctcatgcgtgcttcggccatggatacaatgaccgtggccccgattcacgacagagacttccaccctaaactccatcccggccacagggaaggaagacgagactctgagtgctaggcataactatgtgaagaaatgtcttccctcaagtcctccgtccaagatgcgtaatatctcatttccccttcccagtcgacgacgtcgctgcttcgcgtctcctctcgccgagccgcagcatcaccagacacgtccacaaaccgcctccacggttgtccagcctgcctgcaaacacaccgcggcattgtcgaagaaagcgtccttgcgattgtcacgcgtctcatcgtcctttggacatttcgcggcaccgtgggatcggaaggctttcctggctcgcctgtccccacgcgagagtctgaagagcgagtccaagcccgacgccagcaaaatgcaagcaaaaatgcgtaccacgacctactatttcgtcgttttagttcctatctccttaatctggatagaccatccttaccttttaaattgcatttgtacccaaaattcaggcattgcactgtcaataggcataaactacgtcccagcgaagaaatg

SEQ ID NO: 1456 - DNA, 703 bp, Nannochloropsis_gaditana
gactcggaagtgaaattctcggttgaggcttatgtcatgtaaaacgcaacgaggagcgatcgaaacgtgctacaaatccgtgctttatccgaggggcggcgggcatgtttttcaaaacatccgatttgatccacccgatacatttcttccctaatggctgtactatgcgcaaccgaggaacgggcatggaatgggtataaagcggaaggaaatacaaagtcttgccggcgttcgcatggcaagcggtgtttcgccctgtactcaacttcaatcgcatctttgcgtttagcatgtgttaaaaacggttcaacattcgcccgccttgtatatttccatgaaatctaccgacattcacagcgaccatggatgtcgcagacgaaaacagacaaggagacaatacccccacaaacgcgagcagcagtcttcgaagcagccgaagtggcagtatggacggcggtagcaactcccacaatgataatagtgaagaagccatccttccactcccaccacaagctccatcgacccgtaggctggttctaaacacccgacaaaattcaattcacacgtatgaaagcgaaaggcaagcctcaagattggaagagggaggaggcgaaggaggagatggtggagagggaggggaaggaggaagcaccggcagaaaagcaactaccccgacacaaaaattggcgtcctttttcagtat

SEQ ID NO: 1457 - DNA, 703 bp, Nannochloropsis_gaditana
agagtaacttttttacgggatataattacctgtggtcttggttatgcttaaaagccgcgccaatgattataaggagtctctcgcatagtgtctctcacattcagaaacctttattttttcattgaagttcttctaaaaagtaaatgtttcacaacgtatttccatgatggaatggcgaccattttgggtgcaattcgagagcttagtagaagcgtgcagccgaggttcaaaattttaaaattcggcgagggcgttcgcagcatttggagcagctcgtccctcgccgaccctacctgtggctgtgacacttgccaggaggtccgaggattccctccatcgttgtgggcaaagcaagttttatgttcacttcatgattggacgtcctcaggtctcttcctttgggacttaattcatcttgagtgctcagagatttttttttcatacagtcgtgatttggccaaattattgatcaagaaataatttgtcgcagctttgtcacagtttttgcttcacattgcctgtcggctttctgattgacagcgcggcatagacgaacaacacaatcacggaatttggaaccactcgagtcgaaaagaggaataataaggactttctgaaggctcctatatttatttgctccatgtcgctcctcatgacctaccactctatcttaccaatcacgccacagaaggccctctccatg

SEQ ID NO: 1458 - DNA, 703 bp, Nannochloropsis_gaditana
ccacccattacactgttgcgacgcggacaacgggtttcgacacgctcttggcttttttcttgtccggacaatgaaaaagattttgaccgccaaatgaaggcacagacatcctataacaacgaggttagtgaaaatttacatgcagtagcttacactagtcagcatgggcatccaatcgatctatcccgcttttcacaggagtatgacaaataacacacaactccttacggcggtgagaaactatgagaaaacgcgcgagaaagtactacaaagccgaccgtactagtgtacttttagccccacagctctccgtgtcatgcagaactcacggaagcgttccgcgtaaccttgtgaaccatgcctcaaaccacaatacattagcttaaatgcgaaaaaggagtggggagtcgtggcacttatcgctcagatatcccctgcctcgccgagtatagaaagagatgtctaggctttgcaggtcaaccaagaaatatcccttgcgtgccaagtttcgtgccatgtgccccacgcaaaagtctcgattttaaaaaagctcttttcaattggagggacgcaggagtttgtttcctccagcatcgcggaaattactcgaaagttgctcgaagaagaattccgcctgacctctctaccctgctttgctttcacggtacttccacaaagccgaacaggaagaggataaaccatg

SEQ ID NO: 1459 - DNA, 703 bp, Nannochloropsis_gaditana
atcattcttaaatcctcctcgcttgctcccttccttctctctatttcccctccacccctgctgtgctttcttctcttagatcgggaaggtctacgccgtggcgacggaagacacggacactctcacatttgcaacgtgagtgaagctcgcgtggttttcatttccctatttcctccctttcatacttccttgccttattctctcctcgactgcgatggcgagcgctaccgtgacctgcgtgtctctcagccctcttcctccgtgccccccatcctctccctccctcccctcctccttccttgccaggccacgcctcctccggaacatgaccagcgccggcgacaaccccatcaaagaaatcgactacaagaaggttattttcccaatgtcacttgagaatatcgtgctctgtgtccttctttcctctctttctcttgctctttccttctcatatgttatcgagcgagccgtcatacattgagttgtctgtcatgaaacttggacgggacgggtaagaggtttgtgtcccgcgtcgccacgtgaagccattgaaatggcactcacaatatcgaggtctttggcttcgtccatggttttcgactccaaaatttgagcactcaaaccctccttctccctctattttcagatgttggaggggttggggctcacccatgctcaattcatcgacctctgcatcctgatg

SEQ ID NO: 1460 - DNA, 703 bp, Nannochloropsis_gaditana
cgatgagaatgcctgcaagacagcagaagtggattcgaaagcggggatggagggagagaaggaagaaggaataaaagcggcggcgattgtggcgcgagaagttgctcccgatgagcccgcgaaatccgttgagggagaagtgatggaggtaaaggaagagggagaggggaaaagagagagaaagagggaacgtccgaaatggacgacgagaaatgctagctattgttgacgttaatttgtttaccatgttcccttgtaaattatggggcaggaggaggcggagaaaggcttggttggggggcacgggcaaagggtgggtgggaagcggtagcgtaatcgatttcatttctaaaggtgccatattttcttttctatgtgttatgcaggaggatggagacgtggtggagggggcggaggaagggagccatggtgcggcggaggcagccggggagggaggggaggaggagggggagtgggagtgggtggaccaggtcagacggggagggagggcggaaaggagtgagaggggaagataaatgggaggtaatacgaatgagagggaatgagaaggaagcttcgattgagcatctttgtcagatgtcgtgtcaaggctttccctggatcgcttatcggcgcccccttgtcctcccttcttcccttcctcccttttttctcctttcccccctctttgcacacccagatg

SEQ ID NO: 1461 - DNA, 703 bp, Nannochloropsis_gaditana
ctcttcctcctcctcctcctcctcctcctcctcctcctcctcctcctcctcctcctcctcctcctcctcctcctcctcctcttgtcgttgttcttcttcttcctgttcttcttcttcatttccccattcctgcttcccttcctctttttcttcctcttcttcctcctccacttcctctatttctcttctcgcctcccaccctcatcctcctcctcctccccctccccctccggccgcacctccacccatgcttggtagtacctgacgatgttcttgtggtacatccgactgatcgtcgtcacctcccgcctcaacctcctgttcacctcccgatccatcgggtccaaaataattttcttgatcgcataaaaacgcttgtccagacggttccgcactttcaccacctggccgcttccacctcggcccagcactcctatctccttgaaatcactctcgtaccgtgatgaagacaagccgccccgcacgaaacccacccccccctccagccctccttcctcctcctcctcctcctcatcggacgtctctccacctgccgatccctcctcttcctcccctaacgccttctctccccctccccgttcccgcctcgccccttggtctcgttcttcttcccttcgctccctcctcccctttcttcttgccacctcctccgccaccacttgctcgtatcttcgccgctctt

SEQ ID NO: 1462 - DNA, 703 bp, Nannochloropsis_gaditana
ctgatttgactgctgctgaaggtcacgttattctccgcccgaccccgtggggacatgccgagagggcgaatcattccattacatcccgttctcagccattgcgttgtccattccatccccacgtccacgtcctacgcggtccaaagtgcgcgaatgttgtcaggagggggttgaaaccaatttggcgggcatcttcgctgttatttggtgacttgagcgaggcgctggccgctgcctgtcagtgtattaatcggatgggtgtctgaggtctccccggtggttttgggcgcggggggaggctatcacccggcatatcaccgcagtcttgtgcgaccccgcggtgtgaagagcatgatcgcttgtcgtgaacgacaatgtggcaggaagtacggagcatgggatccataaagcggagggccatgtgggtatgcgggtgcgggggcgtgactttgacgtgactctcgaggcagatgtaggggcagggtagagtcaggggacgcaggccggtcatgacgctcatgcaatcttaagcgttcgggcgcacactcactcagtcactttactcattaattctcaagggcagcaaccagccgcgcttaattggcgtctgaggtagggcttcggagaaattatcctgcaaacgtagtagagagcagtggggtcggcttacacccctgcgctctttgaagtacctttagccatg

SEQ ID NO: 1463 - DNA, 703 bp, Nannochloropsis_gaditana
tcgaggagcgcatgcgcaatgcaatcgccatatcaggtcgggcgcggtccaaggcacgggatcctcgaggatttacgccaatgggatagctctcatgaaggtcagtcgttaggccatctcgagcctcataaatggatacctgttaggtatttggtatggaagagtcacgaggaaacgaggacatcaggggcgctgcgtgcacaagttgcatggcgggccatattagacgcccgttcggcgaggcaacgacagcaaagcaggacaccgacagaacgctatcctcttctatgttgtaacaaacgtcatccaatgctacgtcgtctcggtttcccacgatgttacctgagctgcatgcttttcttgaacgagaagaatggctgctaacagtcccacgggaccggctccgataatgatgtagcggttgttttccacattgtgcacatcaacctgctccacagtcatgacatatatgctatgtagtatacgtgcttatgaacctggaaaccctgtgcatgtcgtgcggtgcgctgtaaggattgaaagaggcaagtgatgtggatgggcgcgagcaagcggatttgacgtcaaaaggcgcgtcaaaagctgtgtcgaagcccgaagatgctttgaaatcctgtgcaatggaagcaatgcctcacacctacgtctccatgtggacttatctcacataagacggagcatg

SEQ ID NO: 1464 - DNA, 703 bp, Nannochloropsis_gaditana
acattctccctccaatggagtggcagcgaccaagatttctctgagcggatactacctcgagcgtaatcttgttcctcagccttgatcgcccggtcgaaatctgtcggcatcttctcgctcacaattttgttcaaggttgattgcaaacacgccatttctgcccccaaaaagctcgaaatgaagctgaagatagcccctgatttgctatgggttcaaataaagcttattacaaatggatagaattgtactgcgcctcatcaaacgacggcacgaggtatgtacaggagtcttgagcggctttcgacggcaagcatgcaccggtcttgtatgttagcattcgtgcacctgctctctccattcgatccattcgcgcatcgtgtagcgcgttgcagaagactgatatggccggggaggttgacggttgatgagccgttacttgttcttcttcaacggccgggaaacgtctgagcctccgcgcccatatttcgtctcgcttcccctcttgctgcgcattgaacccctcgctggcgtcctccatggttgaaatgagtcgtttggatgacgtaaataatctttctaaacgttgttattatgtacgaaaggcgcagttgttaacggtgaggtggcttcccaattcgtcttatgattcaaagtgattgcccgtctagttcgcatcatcgctgacactggggcgctcaaaatg

SEQ ID NO: 1465 - DNA, 703 bp, Nannochloropsis_gaditana
gaagggcggcctcggcccatatactgacacgcagccccgtggctttccgctcagactctgcccaggcgcattctctaacaacaatttgccggtacaggaagccataggctgcttcgtgggattgcttggaaaggacagaggtttcgaagatacgtgagggggaggaaggaagcaagccctacctacaacgctcctgcaagcctgggctgaaagggggggggggttaaaatatgtcgactccgcctagcgagccctctttgccggatatggctgaatattcctttctttcgtgccgcgacgataatgaggaggaagaggacgaggaaatggaaaaggaaacgggaaaagaaccggctgacgggacggagggagatggccttatggaaggaagcgtactcggcgtgaacgggaacgccgctctgtgtgaaggaaaggagaaaaaaagcttggaaacgccccctttatacgcgcagcaatgccatgcggcgaatattttgcgggaggaggactccccattcttcgctaggcgagtacaagaatcggtaagacaacgcgtagatctgtcaagtgggtcacgctgaacgacacaatggctgctttccgcggctgttatagagccatgtaactttctatataccaattcactctcctgtctttccctttccggcagctcgcagatgcgaaagaatctgcctcgagcatg

SEQ ID NO: 1466 - DNA, 703 bp, Nannochloropsis_gaditana
atcccgagcgcctacaaaaccgacaaatggacatgagccgtagggcgaatttcaaacagaagtatgaagggtgtgctctgaaaaggaggtttcttttttaatccttccgccacctcgtgcgctcgtctcaatttatcaaatgccatcgcgaagggttgaaggggccaccttcgcctacgttgatctggcgacacgtctaattaaaagaacaagaagttgaggggaaagaccttgctcgcctttgatcagtgcctcaacgaacatctcctaatttgcctctgccggtttccgtatcggtagcctggtgcaatttcttcgccgtagaagttgatattgtctcttggaaggatacgtcgaattgctgcggatcccacggtatacagatccgcaagcagggggcgaatttgtgtcccaggcagtaatcccatctctccttgaggaaagaaagaagcagcttgctgtgctaagctttgatcgaaggcttaccaaagggcatctttttttttaaagggatgtttttttcttcgagaagtcttgccttcctgctctgggtgtacacgtactcacaggcatctattgctcggttcagcatgcgttcttaagaatagttcttgtaggctgcgggaaataaagccttccgtcctgtgtccctgtccttctcactgtccccttttcacttttttcagcgctttcgattaaaatg

SEQ ID NO: 1467 - DNA, 703 bp, Nannochloropsis_gaditana
agacgacgcggtagctttacctccactcccctcagcaaagaaagcagtaatgcttgtctggttgcctggagaggtagctgcaactctactcttcttccctgcagggctttcagtattgatttttccatttttagcagcatgacgtttcttcggaggcatggtaagctgtggataaaggggcatacaggaaaaaatgacataccaggggggtggggaggtccctgtttaaagcaacgtcatcgttgtggcggtggccgtctaccttgcggaaagaccctcaaatggtgcgtctacatcctttctacactccacacacattacgtcacgtttacatgcattctcctcactcatatgtcaggttggggcgttccgagttctcgtattttctgtctcatcgcttgttgcaaagaccatcgctcgctcacttctgtctccgtactcccaaacatcaataagctcttgtcttacttggaacgccattgtaatagattccatatatacagcaccccttttgcgtgcttaaaaaatggcaatgagacgcgttacagcccttgttacgggtgcagcatcaggtttggggaacgccactgctcagcgttttttacaacaggtccgaatacgttccacgtataaaaatgtttacacatacctaacgtatatatacgactagtaactctaatcgcgcttttttttatcgcagggc

SEQ ID NO: 1468 - DNA, 703 bp, Nannochloropsis_gaditana
gaaagaagcatcctcaataaaaacgttgagactccggaaaagagaagtctctctctccatagagacaagcacatagaatcgacacatgaaggcggtgagggttttgaggaagaggagtcagctcctgacgacgagcctgatgtcctggactatgaccacattaaggaagagcgtgagacaataccgccatattctcacttgcaggggccattcttaccatccagtagccctgtggatgccctaaagcgctttttggtctggaatcttgttggaaatattgtttcccaaaatttgggagaccacaatgtgatcgagatcgagttcgcggacgcgagccgtcggcccatccgctttacggaccactaccgcttcaatatgggctccatggccgaggagggggcaatttttgccagtgcaacactggatgaaattaacccggacaaaggagataagcaagtggagaacaaggatgaggagcgcagcacagttttcttccgacccttcgccaactactccgccaaaaatcaatggctctacacgctacccaagaaagaaggagcactttgcgtggctgttggtgcgcgctggacagctgtggccaccacacgacagtgggtgcggctcttcacatttagcgggctacaagagggcgtcctggccatgccgggccctgttgtcaccatggtgggacaaggggaacttc

SEQ ID NO: 1469 - DNA, 703 bp, Nannochloropsis_gaditana
tgatcgagatcgagttcgcggacgcgagccgtcggcccatccgctttacggaccactaccgcttcaatatgggctccatggccgaggagggggcaatttttgccagtgcaacactggatgaaattaacccggacaaaggagataagcaagtggagaacaaggatgaggagcgcagcacagttttcttccgacccttcgccaactactccgccaaaaatcaatggctctacacgctacccaagaaagaaggagcactttgcgtggctgttggtgcgcgctggacagctgtggccaccacacgacagtgggtgcggctcttcacatttagcgggctacaagagggcgtcctggccatgccgggccctgttgtcaccatggtgggacaaggggaacttcttgccgtgttttatcacggaggaattcctctcattaaccatagcacaggatcggcttcgcagtctcttcactatcagctcctagatatacggcgtactgttgtagtctcgcaaggccctgtctgcctctccccagactccttgttaatttgggcgggattcgacaattcggacatgcttcatataatggactccgagggtttactgtcaagcctcgtgcgcggcttttcttggcattggacgcctattctggaatcaagtcgtctgcgcaggaacaaaatggactcgttttggcccgtaggtgtctt

SEQ ID NO: 1470 - DNA, 703 bp, Nannochloropsis_gaditana
gttcagttgtatcacatgggcaaaatgatcgcttatggtggttatgtcagaatctccccctttgcacgtgaatagccccatgaggacttcgcttgtcgatatccgccgagtcaggtagtagcgagatacgagagccttctacaccgcgttgcctccccctacttaccggtcaaggcgaacataccgacgcagctgaagaatccagagaggaaagagttgaaggggaaggtacccacaagtgcacaatacagaaattggagcacgccagtcgccactatgaaggccaggaaaaggtccacaattttggtttgtgtgttggctgcctttctgtactccgcgagcagactcttgccaacgcccctgatgtccaaagctgacgcggcaggagtcatgtccagcgagactagtgagatatcaatcactggctggttctacagggagtagatgtacaaaagagaagcggaatacgatgtaaagcagagtgcacacacggctcttgaatcgccgggcatacctccgccggttcaggcgagtcttcgaagtccgagggagacccgaggaggacgcagagcgcgagggggcgaaacgaaacaaggcgatgtggtaggacacatatagagaaagtgtttcatggatgaggcggcactttcaatgcacagagccgcgtagacagcaccatatttcgttcgaaagacgctggatg

SEQ ID NO: 1471 - DNA, 703 bp, Nannochloropsis_gaditana
aatatgactctcgcaatttgtcaatcactgctatggctctttgtcttaaagtgtggtgcatgtgttgcgtgctgtcaaatgcggccatgtcatagcacgttgaagtccgtgatgccgtgcgggtgcacaaggtgtgggctgagctacagcccagtgataacatcaccgaataggaaagtgcttttatgatgtcactgggtaatgctgtctttgagtgacaggctttggaaagcaacaaaaaatccgtcctagacgccgctgcaacttgtctatcatatgtatatatattacttgttgctgggaaatgatgtttccaagcctcgaaaataaaaatgaaagcgccgtcaaagtccggcggtcgaacggcccacataaaaccaccacgcaccacaacctacaaggctcgtcctcaggcgccgccttgcggctgttcggagcatttctgctactgtccttgccctcgaccctcctcctttcgcgccatttccggccacccccagcggccgagggagcgagcgctcccgaacaggcaggggtcctcgtccttcgtgttgtgccatctacctcgcgactgactacccaccttacccttctacagggaaaggaaagctatcaaaaatctgatctacgcacacattgttagacctttcaagttgttcttcaaaaaagccgtgtttgaagtgacgttggaacatcaagaatg

SEQ ID NO: 1472 - DNA, 703 bp, Nannochloropsis_gaditana
tccgatgataccttgcaacggctcccagaggaagccgttcgcaatcaaaagcataagaaggatgatttcagcgtcagttcatctcgttaccgtgcggaaactctttctacaacgattaacttgagtgctgctgcggcgactgctttcaaaggggacttagcaagtagaccaagctccccacacagtgcctcgaaaagtaggagtacaacaaattctccaggcctgccacccccatcatcttcaagaattagccacgatctctgccgagcacgccaaatcggcccttcgaccacccaaagcacaaacgagcctaccagctttgaaaatcctgtcacgactgattcacctgatttttatgtatccagtgagagctctttttttgagggtctcatgcaggtatgaatttgtggaaacggagaataagttgagggagtagactcatgaaagcgcaaatatagcggtgttccagtcggtcccagcgtatcttctatatccattttccccccgaaatatactacggtgtgaaaatttttcggaagtatccttcccaagatttaccactcggcgaggaattcatacttagtacactttcttttcacgttgcatccaatggaaacagaccttactgcattcagaggccttcaaggagagagttatttcaaaagtgaaggaagaaatcgctattgacataaagaaaaggatg

SEQ ID NO: 1473 - DNA, 703 bp, Nannochloropsis_gaditana
gactaagaatacgccaaaagtcatttgatacctgttagcggatcaattactcacacgctggcgtcaagtattcttaccttttggttggaaaggagaatcgaaaaccctccacgcaggaaacgacaacaaggataagaacaaacaggctttgtgcggcactgccagcacactgcgtgcaaggtgaccaccttcttctgtccattgccgttcccttgctagctgtattcggtggggagtaggcgcgcgcgtgagtgttgcttttgcggcatggagaggaaccgcgcgcgtcgggccaagtagaagtgctccttgacggaaggatacgcccccccactaccccatgacggctctcgcccctccctgctcgtcctgcggacacatcgcccacagtttgaagtctgtcccgccttttggcggcgcatgtgaatgtaacagactggaggctttctcgtcatgagccgtaggacagcaacagttctaattgctaacgcgatacattgcgcgcaatttacgaggaagcccgagaagcccagagccccagcagtctgccatcttgttacgcttttttgaaatcatatcccttcacgtctacttttatttgttgaacttttttcctcttctacttggataggatggtggaactacaggtatgtgagctttgcttaacttatcttcaaaggtgcttttgccggtcagccttatg

SEQ ID NO: 1474 - DNA, 703 bp, Nannochloropsis_gaditana
accacagatggattgatgctcactgaaaaactcagcaggcgttttgctttcaacaacctcgattctgtttttccgtgccataacctcgtctacccttatgttcgggaaaggccttgaagatcgaacaccaaacgaataatagaccttgttctacctgttgacgtatgtatgggtcaagcttgttggtaatcgggaggttttttttctacgtcgctgtgtccaatgctatgcttttatgacttactttcattggatatggtgcaatcttgattgtgcatcgaaacaatcctaagacgatcactcataccaggcggattgaacaagcttgtcatttcctcttcttcatccccgcgccaaggcttgtgagcgagtaggcggcggcggcgagattgggacaatacgcgtcgtcgagattcacgccccatgttcttggcctcctcaacacttgccaggcatcattcgccggacagggcaagactacaagtagccatcaaggttgtttcttattattcttcatcttcgtttttttaaatgatgacgaagtatgctctaccatgggcgcggctctgtttccttccccccaaagaagctttttgagaccggccacgcacgctctagctaatcaaggctctaaggggaaaaagtcgcacgctttcgggaaaaactcacaattattctatccacttctcaaatttgtcgtagg

SEQ ID NO: 1475 - DNA, 703 bp, Nannochloropsis_gaditana
gtcgcagagattcaccacatgagcatgacacttactttatacgctatacgtagattatcattatgggtcgacgaaaatcctttctggagaaggctgtaggtttgttggcacaggaagccgtacaagcgacatgtacgtatcgtaggtccgaagagaatttcctaaagagtcggtggtgttttaccattcccaggttcctcaaaacaggggtacaaggtgatgtacgacaatcagaagatgcggacaaagctgtggaaaaagcagtccacgattttgggtgagtggcaaattaaaaggtcctttggatgagacttctcagaagatgcctggctgccttccccaacctcatgctcgaatgtcgctttatttattgcacagctctctgtctattctcgtgaatgcagctgccggaaattttttggtagcaggcgaagatttaagcacaaaaggatttagggtgagcggtcattttctttcctgcacatgtatatgtatatagatatataggtgtccttatcaaaccgatggcagcttcagaaattttaccgatcttggcacgcctaggatgacgtttcacttatttagaggagcgatgtagaggcttttgtgcaacagaggctgaactcaagctttctttccaccccacatggatggtttcgcgtagaccgtcatggaaatcgataccgtagggtctttcaacatg

SEQ ID NO: 1476 - DNA, 703 bp, Nannochloropsis_gaditana
acaatgatggtcacaatagtggcgcggagtagctgttcgatgcgaaaaatgcttcttcgccatgcccccgacgaatatgagtaagctgtcatacgtgatgttctcgagttctctgcagcgcctagctttgtccgcgctgtgattgttatgcattcataggtttcgcgtcaaacataaaatcgctttccgtgtcacaagccccgaaacgtccgagtcggaactcgctcattccactcgccctcgccgtctctcgccagcagactccggccatgctcgcctcctgtttttctgaacgacttgcgagatgccggccatcgtttatcctagagaagagtggctgcattcgatcgggagatcacattttttttgccgcttctcatcgccgacaagcaagagaagacggattatggctcgtatgcgagtacggtataatcgaccctgctcttcccacgttaatgagaagtgtttcatccattctctcctttatgtttacaactttttgcattttaaaatagttttgttatattagggaggccagaggcctctttttgcctcaagtctgaaggcactttttgcgggacccgcgatgttcagagagggcggttctttgaagcttcccccacgtacagctttggtttcagcaacagcgaaggctcaggtgcccagaaaacatctcgattcgaatcaggatcaaagattgatg

SEQ ID NO: 1477 - DNA, 703 bp, Nannochloropsis_gaditana
aaggccgaaatggaaaagtaatgaacagagggtcggacacgagggagcatttttcacgtatacagctctagaattctgtcatgccatgtcggtaaatgctctcaaatacatgcatctctgcctctacacctcagtattaagtttgcgcatgatatgttttcactgactggatgcaagtcaacgattggcgggcatgtcatgtcactatctgaattattacctgcccgcgcctcttggacgatctgagcagccttctgctcagcagctctcagctctgccatgccaccggacgccatagcaatagaaaaattgaattaagatctcaaaactgtttgtttgatggggcaatgcaaatatgcagtcgttattatttcttcatagaagacaaaggttatgatttatgccatcctgagagttgtgggagctctcaggcgcccaaaaaaaagtgagggatccgggaagttatccgttcaaacattttgtacaattgcactgatatggtgtatgcagcaggctggccctttctggtgtgctgaagccggggggcaggctccgaggccggaagtggaatctcaagctgggaggggaggagaggcggcgtctcgaggagggcgacgccgttccggcctcccaggagagaggatcgagactctggcctccatttcaccacattgatccacaaactcttgacattaaacagggt

SEQ ID NO: 1478 - DNA, 703 bp, Nannochloropsis_gaditana
cgacgagccgcgaacgacgtcattttgggagccattggccaaacaaaggcacgggtacaacgggtcatgaagccgtcagctgcagcggcagcgctagccccagacatgcagcatgcgagtagtattggagccatggccttcatttcccggggtctgacttcggccggattgagagacgtaagagaagaggaaaatgaatgatcaacacagcattccggcagtgcgacttacttaaagataagccactctgtgcgtcactgtactttgtatggtttatgcaggtcgtccaggcgcatcggcgccgccttccgtctagggggtacgtgtctcgcaggcaggtatcctccgaggcgggggcggtggctcacgcaggggcacgacggcgagcgcaggcgagcactcccacctaactacgcgtcgtcctaagctattcaatcgcgtgaaactcatcaagtgccctattggactacctatttgttcgtttcaacacttagaaaacactggggaaaatcagagcgaaaaaaaaggcgtggcacgggcatagagaaggcgaaatctgaagcccgagaacgagacctgaacagggacttcaagcacgcagcagcagcagacgaacagctccctgagtgtcctcctatcgtgtatgctctgtatgtccttctgagtgttccctgtgcattatattcttgtacaagccgaaatg

SEQ ID NO: 1479 - DNA, 703 bp, Nannochloropsis_gaditana
acaaaaatgttgagcttgaccaatcgagcatatcaaattcaagaaaggagagtctgttaatggagggagaaaatggacataaggctgagaagaagcccctcgttgcggtaatgcgccacggcataaaacatgctcctgaaatgggagcagtaaggacggcttagcagctgtagtaggtgccagtacctgcactgtcggcggcgacaaggcaagggcaacaggggctgaaggcttggagacgagttgaggataacaagggatgcgcggcctgcacgccgcacaaatgtccatcatcgatcttccttaacgtagtcggaatcccagactgctgtcgatatcaggcattttgttgtggtttacctagtgctcccggcatactctgtgaccccctcattttcatcgaggaccagctttcctaactttgattccttgtaacgtccaggcggctcacgtccagtgcgtaccaatcccgcgccccgtccagagtgcgaagcacaacggccgacaaaaacaaggtggcacgcaatatttggaaatgaatacagagggaaatcttggcttgcgtggggttcgtcgcccgcaaattatcggggacgcccttgatgtctttttcgtgcagctgaggaggcttcttgcctcatgttttcgcatcgttcttagatatacacgagacattgactttaaactccttgatattctcaca

SEQ ID NO: 1480 - DNA, 703 bp, Nannochloropsis_gaditana
agctgtaatagagtcaagaggagaagttgatttgcttgacggatcgagggatgaagcaaagtcggcccccccctccgcggatttgtgatgctggtttcggatacaaagctgttggggttgcgtatgcgcatgctcagtctcgttcccccctccctttcgaccttgattcttcgctggatttctgcgacaacacgccatcgtggaacacgggagctgagtaggcaatttattgtggaaaaagatcttcgcgaccagcccgtcgccttccacaagcaaaagcatgaacaaaaattccatgagtctccttgccaaaggcattattaaagtactgtgttgtcaatgatgtgggattcggggattcatgtcagcccgttctacaggcctgaagtgaactagctaaaggttagggaaggctctttttgttttgttgcttgacgtttttcctcctttacagcaattctttcacgaaatcaggatactaaataatcgatgacctatcgttttttcatcttggaaacgcactcctcatcagcttgcggccgcacatcgtccgcgcttcccttgcacttcagcgatgagagcgagcagcctctggcagcactctgtcaggggggtggttgcacgtgtcttccctgatcattcccggataactggtcaaggtcacgcatattctgtgttacgaaacctttcactgcagggcatg

SEQ ID NO: 1481 - DNA, 703 bp, Nannochloropsis_gaditana
cagtcgtaccctacagggagatggattcacaggtcctaccaagtttgcgcggaagggagtcgtaatttcttgacggttcacaatgccgtaaaaagatcgcgacctaaaattgaaggcaggcttcgaggaaacaaaggccgcaacaggatggactgccacaacagccataagtgatgtaatttggaatagggaaatttgcatccgtcgaccctgtcggtgtcatagtgttgaaggttgaatagatataaccgatatcaaattgtgcaacttcaccaaaattctaatcaaacgcggaacatcatatcagacttgcctgcatgatacttgactgcgcttgtggatgtccgtcctagtgctacccactcgtcggtactatgttttagtgagcggtattgtggcgcatatccagactagctgtggcacctgtgttgtcgcaatcagtggtgtgagctaaataacacgtctgccttccatttatcatgcagtctctggaaggtcggggacacgagctaaacaagtcttacttcaaaaaatctggtcagggcttgggtgcttatcgtcttccaatgtggggcctcgccagcgacagggttgcctcccgttcgctcaacctcgcactcgacctctgtcgacacgcactcacactacatggactcattaacgaccaaaacatctcgccaagcaacctacactaggtgaaatg

SEQ ID NO: 1482 - DNA, 703 bp, Nannochloropsis_gaditana
tcgcgggcctttaagaggagaaaagtgtgatcataccatccaattgcagttcggaaagctaggaaaatagagagcacgccgagtaagcgatgcccccccctgttccagcagccacgcaacctgtctcgtgggattgattgtcccccaccttggctgccctcctcgccgccaccgacgcgatgggggagccttcgcccctcgaagaataccacgcatgacgggcagtgtggcgcacgggaacgcgagccaccgttttttcagctaccttgactgcgatctcgcaatctcatgtctccttacatgttgcggatacgggtctgcattctatttgcagtcttgagcgcggtggtgtaagagccgactcgctccaccttttttcttagatatcaagcatggagacactacacacatgtgcaccaactcacgtgacgagcatagtatcagacatgcttgagaacgatccacatacatgcacaatgttgccgtgttgtgtgtactgcggagaagatatggaaacccaaaattagtagcagtcttatacgccggttttaaaggaggaaacgaaggggagggaaatcgatacggctgtggcacgacaagattctttttaccgagaacgtttataacttcctcacattctcctcaacttaagcaattatctattttcacagaatcatatcgacgcgcccgctcgaagtctatg

SEQ ID NO: 1483 - DNA, 703 bp, Nannochloropsis_gaditana
cctgcagaggaaaggatttcgaaattgagagacatgttccagcccttcaatcctaaatcggctgacatacctggatacactccgtcaatcttcctttttgaagataacatgctgcccgattcgcaaaaatggcgcaacgaagctcttgtattctcttttcttcttgtcgagcctcctgccagatttgtcggtgcggccatcacttgtgatcgttaacagcttgacatatcccaccacatctcacctcgtcattatggtctaattttcctggtgcaacaaaagggaaatttaatgcctcgtcataggcttgaatagcatcatcgatttttttttcttgtacaaggcatttccgcgacgcttgagctgctccatgagcagtcagaggaggctacgagaaagggagcaagcaatctgttgctattttttcaataaatatccgttttgtacgtgaaaaatacaacatcagatgaaccgtaaactcttacacctctctccattacccctcgcaggcacaaacttgcatagcaagaatgagagccgtctgggaggaagcgcggaagagcaccgtgatgccgccctaccttgccctactaagactgcccccagcccgccgccctcgctcattgtccatgtgtgacactctgcatgggatgccttgaaactgacaatgcgccgaccactccccctacactccatggctaga

SEQ ID NO: 1484 - DNA, 703 bp, Nannochloropsis_gaditana
aatgttggtgccacgcttttcccttcagcaaaccccgaataccgtcatagtaaccattaagttgccttacatccgtgtaggtgacgcggaagtctctgcggtaggttttccttctggtacgaggggtttgtcatttattttaactctcgcctacggctcccgcatcgtttgtcgcaggatggccgtgactttgtattttattgcaggccctacctcttaaagcttcagttcccacacgccctcaagaacaatgaagacgaagagagtcattgccgcgcggtctatgacgctaatttggtgagtggagcaggtctcccgtccccgtgcacaggtcgatagcccttccttgcctagcgaacacaactcacgcgtctctccaagctagcctgatcctttgctctgcatgcttgcggacttgctcacgacgcgggactcgtcctcggtttccatcccgcttcaggaccacggcaccatgacagtgcatctcaccaaggaggaaccggggcgtgtctttgaggacctggacttgaagaccacgctcctgcagcccacgcgctccttctgtgccccgtccacgcccatcagcacggtggcaaagggccgcgggagtaccaccgcgccctgccccggcccccccaccatcgaggtgctacgctcccaagacttccccaccggcagcacctcagacacggagagccccctt

SEQ ID NO: 1485 - DNA, 703 bp, Nannochloropsis_gaditana
accttcgtctctcgaatgctggcgcgctgaaatggcgtcacgtacaagtggaggcttcgccatcatcattgggctcaatcgatggcattaccatccatagagggttggcaaaatatgaggcttcaattattgatggtaaagagcacggagaagcctggtggtggcacttgattgagatgcatgtagacggcggggaaaggggagtgattgatcacttttctccgttgaagttgtggctggtaaatgaggagcaagtacgcctcctgaaaggatttttgagccgatgggccaatggtactggttaataggtaattttttaatgtacataaaatgtcaaaaagatcaaggaactactaacatagcgctctacctgctgtcgtaaaaagctttgccacgccttggtgaagatgagcaatccgcattgaggattcattaagcaacattatggccaacatggctttatatgatgttatctgctttttttaaaaaaggcacttttttgtttctgcgtgtaggcgtgcaacggtggcacgtagaacttgtcacatgtaggtcgagttgaagttttgcttgtggccgttatggctatcgcaccggtccaagcccgggcccgaagtccctacacacaaaactcgcgctcaatcaaactggttttatatctgtgcgcatgataacgcacacaggtggatatagataacgaatg

SEQ ID NO: 1486 - DNA, 703 bp, Nannochloropsis_gaditana
cggcatattgcggcagagaagacaagcacctagcttcacactcagatgcttctctgcactgcaacgatgatcaagccgtgcgggcaaggggggctttcaggtcaactacgtcgaagcagcttttaaaagcggttatgcaggcggactcgaatacgatctttcctcgtattagaagaacgtaccagttatgcccgtcacgagcgtccgtgacaagcgccagaactgatacaatgccgccaccgagcgtggtgctctgtgagtatcgaggaaagggcaggctgttagaatgaccatggaacaatccatgatcttgagtccgcctaggggcgatggccttctccctcctccaggaggtgacgctgaaaaggcaattagacgaacgcatgcactgctaaatgagcgcgtaaagacgtgcgctatggtcaagacagaatttatgcgcacaaccgtgggaaagcagggttccaatgggtcgttgggcggggaagtatacggatgggagctagcgggttgtctttctctcgcaggtagccagctctagtatcatgcacgtcgagtgccgcgagaaaagtgcggtcgagccagagcgctttatagtattactcaagcttattactcaagatggtttcacgtgcctattctttaccctagatcaagagcgtttggcatccatccacgtgctttgatcaactggccggtgatg

SEQ ID NO: 1487 - DNA, 703 bp, Nannochloropsis_gaditana
ctcgtggaagtgaaaggccctggggacagcctgagttgggctcagaagtactggatcgacaagctgctaggggtgggggttagggtggaagtggccagggtagtggagggtaatgagaggggtcttcgaccgggagcacaaagaaggaaagcgtagggggaaaggaaggcagggaatgcatgaaaagacgcgtgcactttgtacattagacggaggtatgttcggcgctacctttgtgaaaagctgtagatcgtacataaagcaaattgttatttacagtcgtctcattgcttcttctctcctttttccctgttgctcttgcttttaagtaaccaaccgcccctcgctttccctctaaaacattgacatttcctaatttcgtgggtgccatttgaatgcgaagctcaaggagcagtcgtagcgatttatgtgacaagaagcgttcaacactttcagccggaaggagaaggaggatctcgcttgcttcttcctgtgtctataacgaaactttgttagagtccgcttacgcttgttcatagcgtatggataataaacgagtgataattgaacaagcgagacgggttgcaggcgaggggagggaggaggttggagctgccaactagaatatatatcagacgttgtctcatctattgtatctcctcccacaagcatgttgtacttcagatggccgaggttgataaca

SEQ ID NO: 1488 - DNA, 703 bp, Nannochloropsis_gaditana
aatccccgtctgttgattatttcaagaacgaggatgagtcgagggcatgctggagcatgagacagaaagtggggaatcttaccactcgcgcagatccaaatgttgcggtcgagcgtggcggccaccatggctgatgatgaatgtctgtagcgtcactaatgtggaatatatgagacgagcgtaatcagagggaggggaggtcggagggtcttcagcgccctgctttgcccggaatgcatatcggcttgactgcttcctgcatccattgatcctatattgtgaccccctgtgtcatcagtggtcctccacaagaggatacatggcagggttgccacccttgcttggcaaagattcgtccctagttccccgcgtgacctcgctcgtagtatctctcggcctccctccagagtgtgctgcgtcgccgagactggccgtgactagggaggaacaactcttttctcgagatgatgtcccgtatcacgccatcattcaattacttcactcaagaaacacaaatttcccggacgactataagggaagaagtgagaaagagcacagatcaaagcgcggcgaggcatcctgagctgacataaagcatttcggggggcttgaattcacaaggcaacgcgcatagcagcaccaaaaaacgcctgttatggcagacccacagccagaccaaagcgggctggacaggtttctgatg

SEQ ID NO: 1489 - DNA, 703 bp, Nannochloropsis_gaditana
cactgcaaagagtggcaatttgcacacttgaacagtaggcgtagttgatttacatgggccgcccgttttcggttgaatttaaaatatcaagatgcttgagacattatgtacgattggacttaaaaggtagtacagcgaatgaaaagaagaatatatcgtcgcgattaatgctccgttatggatgtctgaactgctctcttccttcgcgcaattaaatcttagaaggcgcatcccatcagaaagcgagcgtcctcccagggaccgttatgtggtcactaatacggtcactaggtcccctgccctgccttcaaattcaacactccttaattcaacgcgccctccataattgtgcacggatgttctccgagttcaaaaacaggggctaacgcacagtttttgcctaggatcccaatcctccttcgtcattctcctgtcagtctcgtgctgtaacgggccttggaaaaaacgtgttggcgccaggtccatgccctcggttttcaatcgtataaggctcaaagctacttgctcacaattgacctttacccatggtagcgtaaatcgctgaccctctctcatttgctccttcacacatttgcactaatagtactgacagccgttgcggaacaggaagatcagaagcaaccttcctccgtcgaccgtttacgaataagacaagttacgagttatacgaagcacaaccatg

SEQ ID NO: 1490 - DNA, 703 bp, Nannochloropsis_gaditana
atcctttcatacgcatgcatacaccaaacacggcacaggataatttcgtacacatgtgctttcggagcaaggctgtcaaagtgcacggatggaaagttatttcgcatgccgccccgaatactgagaggtatataactttttgaagagactggatcatggttgtgggctttaccggtccttggtattccacggaggaggagctttacacgtcccgggtaatatgcgcgactggtgccattgccggcctggcaatcatcccggtagccatcacagcgcggcatcgggtcttccaaaaaagagttgacttggccaacgaaagtgtcgctcggttgttcgaaaactttctcctcttgaaagccattttagatggctgtctttgcttaatactgctggggggcctcttcgtgaggggagactcgatcggctgcagtttcttggggttctttttccagctcgaagaggtgatgacactggccctgatcatgcgcatggtgatgcatcccttccatttcatgcttaggaaaagggacatgactgatacgaaagagtacttcaatcgatccatcctggtttgcgtgctagtgtccacttttgtatgcatcccgcttgcggcctcccgtgagttcgggcggtcaggctccctgtgttggttgacgagcgtgtccacacagttctacgccttttttactttggtcttcttcac

SEQ ID NO: 1491 - DNA, 703 bp, Nannochloropsis_gaditana
tgtcgtgttaatcaacgattttgcggcagaaccatatctttcctacatggctttgttgaataccttttcccgaatgacagcttgaaactggctgctgggctgtgcagccgttggccattgctttaaattcttaagtatcgagcgcacgtcgcccagtacctgtcatggcgttcaaccgtgaccaacattattcagattgccgtataaatgtccaatttcggccaaaaaacacatttccctacccgcttgtcacgtaacgctgcggcaggggacggaggcatcagtccgagggcaacctatctcgagacacgtgtgatagatgatgaccttctgctgcctgttgcaagccaggcgtcagcggacccttgtgtattttcgcctatttacatttattggaaatcagttacttaaacattcagagactgatcactacctgtgtatgaaacaaacattagaggacatgttgggcggggggacgtgtgactatcacggtggtttgcagggacccaggccgcgtcgcatccgaccgcgacccgccgcgtttcgcgcattttttcctcatcttggccccggcccgtggccaccgcctgcttcggatgtgatgatgaccccccgtacttcatcttccatgacgctttgagccgaatccttggcactaaactcagtgtattatcacgtcccttaatcccatgatatatttagt

SEQ ID NO: 1492 - DNA, 703 bp, Nannochloropsis_gaditana
gcgtgtgggggccgctgagaccgcaaaattcgcactggactgcctggagatggccaccttgtcgcccgtcgcgatcttcgaggcctgtcttgtgcccgtgcccgaacaggagcggacagggatgcagatccttctggagaccgcgtccggccaggcccagcgggacgccgaggtcatgcgcggggccctgcgcgttctttgcaattgtctctgtcctcggcccgcgtcattacagcctccccatgcgttgtctgtggcgccagacgggctcggagaggctttccctggagaaacccaggagaggccgacaggctcggcagggaccgcgcccgcgcccgcccaggacctcgctctcgacccgaccgaggaaaagactcgctgcgcggtgcgacgggatctgcgctccaaagatgggatcaaggtcctggtctccctcctccgctaccgccgctgcatacaggcggccgacgagatccgtatgctcgccgcccgggcgctgctgggcttggcgcaggagcctgccatctcccagatcctggagaagatgcgggtgggtcttttactctcggaggtagttcgtgcgggacccgtcttggagcgggcaggcacggagcactatgcgaacttacgctcagcagccttgcagctcatcgcccgcgtcacaggccgaccggcctccgccgtctcgcactcggacgcgatg

SEQ ID NO: 1493 - DNA, 703 bp, Nannochloropsis_gaditana
aattaccaagaataggcaccacctgagaccaaaaggttgccgcccgtctgaggcgctgcaccggattaaggggtgctggaatgagagcctcggggggcagatcgggcgtggctgtggctgtggaagccacccggacggtggactcgatcgccgcaggtacgcggctcacatatgattttggatgcagtggagaataggtaaaggcagaagcacggggcatggttgcaatgacgagtaaggggaaaagcagcggggggaggaggtcggaaaggcgggcccgcggcgtaaccggtacaggcttgctttgagccatcctgaacaaaaaataacgagataagtgagtgtgggaaaacgcacgccaaaatttccttctggattcttcacgaggttggaacactgtcctactgcgcggtagtgagcaagggctaaagagatcagaagaagtggacgtgtcggttcgagacacttgttgtccttatctcccatgaacttgtcgccgctttcatttccgattacacgaggacccatattgatataaccatctcgcgccaagggcatctgactgtaaccagggcaggcggactctgtcgtaatggtgcacatcctaaacttgcctgcgatcccgaaactcgccaagggcgagtgctggttacacggtattcagtaagaatcaacacacgacaactcaacacacaggacaatg

SEQ ID NO: 1494 - DNA, 703 bp, Nannochloropsis_gaditana
tccctcacccaatgttttgtcgaaaccccgctggtgatgatcaaaacgcaaacgaaccgcgtcgtactccccgccgacatccaaaacgatcgtgcattgagcaagcttggctttatctcgcgttcgcaccacgaccgcattgtgatacgttggtagaagccgaagcatggagattgccaagacttcatcgcagtggaaggtcccatcgtgcgtgcctatgatcggacagctcacccccgtcggcacttctgagactatcacgggtgaggacgaggcgtcggaaggatgtttcagacaggcttcctggactgacaacgaataatctgtctccatctccctatgtgtggtttgatgtggaaataaaacagacctgaatggaagtagcttggccggcgagcaaaagaaagtgaccgagaccgtccactcccagcggcctgctagcttttggcgaaccatgcttctcccacgcgtcctcgcatgtcttattgcggaggtgagccaatctgcaggggcaatatttccttcacgcgagcaaacagctattatgatgttgatgagtggacaatctggattactaacacttcctttcatgtctactacgtggtacatgtaacgcccgaccaacctccccccctctcggcgtgtttacaggaccagacgcaatagatcatagagccccaccactagaattacatccaccatg

SEQ ID NO: 1495 - DNA, 703 bp, Nannochloropsis_gaditana
aatttcaaagggtgtaagcctcacattttagcaaggacgtaacccacaatgcgttgacggtgatcctcggccacgaagaggagttggggccacgataggatgtgataaaagtagtacttcatctggtaattctctggcaagcaccacaggttggtcgcctgaatttgtaataagtcctccgcacacgcttgccgaatacaaaccatgatgggcaacgttcctataactttgtgtaaacaaattggcagaggtccgtgagtcgcggtaggacaaaggtccgtctgttgacttgagcgcggcctcaaggaaggaaatgagaaagccatagagataaggcgcgagtggtgtgcggtgtgtggaggtgaccatagagtgggatggacagaggggccctgtgtcaacgtattgcttgtcgcgtggcatttctgtcagtaccaccgtatgtgaggtctcgccaggccactcagggcgctcggctgccgctaggggaggtcgatgcctcacttggctacccagaccgtaatttctcacccgagtcccaataaaatttacaaagatttattctatacccttgataacatcctaagatatcgcagacgtgattttgatatcgcgttttgagtgcgtgttgtttctaattctctcttgtaccgccctcaaccacttcagcctcctcccttacgcaatatagtcatagcctatg

SEQ ID NO: 1496 - DNA, 703 bp, Nannochloropsis_gaditana
gcattgatgcttgtcacaatttcagcgcgcgacttggcctgcaagtatttacgctccttcccgccagcacctcctgtgatgggacgaacgctgctacaatttccaatgctgcagctgtgggaactgcagctaccgccaagagcttttcctttgttagcaagccgtggtaccgaggcgcatcgttgcattccccgcggggaaccccctcgataggagtttcgactccacttgcctacagccctcaattcctctcccaggagtagtgacctaggagccgtgggaggaaaatattggcttagagacatgctttaacgggcctggcaaggaagaaacataatgaattgcgcccaaggtcaaagcacgccgcaaaggaccgttattagggagcatggctgtggcttctcacgtcccggaagcaagggtctgggtgaagctagagcgccttgaagggcggcgcgaggagcatgcgggcgcacatgcgcgttccccgacgcgcggctttacacgaggtttcggtcatcgaccctcgtagcttgagctaaacatcgttaatttatggaagaaaaccgcaagattgtggttctgagtggttttgtggccctttttccgtgcccgcgatcccatgtgacccccttgatcgactcgacagttgccgtctcgctgattttgagcactcttacttagagacacttcagtctttatg

SEQ ID NO: 1497 - DNA, 703 bp, Nannochloropsis_gaditana
cacagcatatgaaactgacaataaggctgtagctattatgtgcttttcatacttccacagcatcacatcaccgagtttaaaaaatactgtgccatgacttttgtaaagtttgagtcgacatccgttatgcataccacctttcaattttgaggatacacggtacaaatgtacacgcaatctcactttggtctgcacaacaaccatgttgccttgaagagtgactgtcgctctcccgaaaaaaaggtctggaaagagtacagacaggtgtgtcgtgcacagggggcagtctgatttattttgagtttttttccaaggaaggggtacgcggtcccttgttcgtggcttacctacaagaatacaccgtttcaagtaagctggagatgagacatgcggtaaagctatactttcacacgtccattcaaagcggtcagaggggggggctgattctggggtcatccgctttgcacgggagcaggaggatgaagggcagcaatcaggcagtcgagagacgccaccggtttacactacgagcctttaccgccgatttgatgtgatattgacgggcagcgtgagcaatactgtcatgcgtggcgtggggtttcgatttgcatcatcaacgtggtttgagggagtcccgcaaaaaataggaatgtcgccgtcggtctgttcaaaaggaagctgatctgcccatatcgcttttaaa

SEQ ID NO: 1498 - DNA, 703 bp, Nannochloropsis_gaditana
tcacacatgacactctccgtgtttcctcctttcgtacctccgcaagccaccctcctccataaggctgcctgacttgctatcgacgccaccattgccttccatttcgaatgtcccgcctacgctataaatatgcctgccttcaaatcacgacgctccactcccacactcgcggcccttgctgttgaatggattgatgccgcaccgccgccgtcattccgttgtcccctgcgtgagtgctcgccgtttgtgttctcaatgcgtccgcgtcgaagacgtccgcgcgcctggtgatgcagccgtggctgccaagatgcctagcgaacgtattcgatgcggaaagaggagcgaaagctcataagccgtgcgactgagtgcgtgtgtgtgtgtcggagtcggcaccaaggacagggaaatcgcagacataaaggctcgctaagaattcttcgtcgagacctcgcgaggcttcgcacaacctgtccagccgccctagcgccacccacaggagatttagaaataaaaagcacctctcagccttgtttccccttctttacatgcagtgcaagtcatggtcatccaaggctggagacattgggttcatcaggcgtagcccgccctccttcattgcgggcgtccatttgcttgctgccctcagcctcggcagagaagtgaacttgacgtttgcaacagctctccttgcacgatg

SEQ ID NO: 1499 - DNA, 703 bp, Nannochloropsis_gaditana
caggaagaatcaagggctgtaagatcagcggacgaaaatttagatatagatagagaacaacaagactgaagaatgcctgaagtgaaacaggaagaaggaaattaatagccaagaaagggtcctttcgtatgatttgctcttacttcaaagattaagacacacagttttcttcacgggaaatgaacagaacccgaagctgtgattgaaatagccggccggtgttggactggtgccatggaaaggaagcacgttttactgctgtagtgtcatattctaccagaggcaatggagatgcatctcattttttccacccttctctcctcgatgagtccataaagataatcttcctcgacttgatcaggcccaggtattggcagcagtcttatcgtgcgtcatgcctcagaaaaacagatgcggccccctgcttttaatgggccgtccggtccgagtgagcggtagccaaatcctcgccgtgccgtctcccagagagctagcgccaccatcgaccacaccacccgtcaagtgaaatatttgcaagcgtctgcaacgatgttatgctcggtgttagccactaattcttttctgtgcccacttttgtggatttcatcttttgagggacgatcactcgacatgtcatgtcagtacctttgtaccatcagtagttattgcactggttttccatattaggtgatattcgacaatg

SEQ ID NO: 1500 - DNA, 703 bp, Nannochloropsis_gaditana
cccgcacgggatgcgcgggacatgaaggaataagcagctcgatggaattctgaggatgaccggagcgaggttgggtttgggcgatgcctctcgcctggagctcccacggagcgtgctgatgacggtggcgatatgatggaatgcgtacccttatgatggaatgcgtaccctgatgatagaacatgccgctcccgtagtgaacccgctggccatgctccttcccacgcctcgcctccccctcgcgagacaccacaggtcacagcactctacgcctttccacattcctttctttgacgccttttcccgtcccactttccagcaaaccatggcatctggactgtcagaatataaaaagcgggaggaggaaaagaaggcgcgacaagcggggaaccttgcccctgaaatcgatgcggcgtcgggaaaaatgataaatccgcacaaccccgaatacatcacgaaacgtccttggtacttgggggagtctggaccatctttgaaccatcatgcccgacagcgggacgacagcattttaagcctacaggagacggaagagatcctggcacggcaaccgaagaaattcctgggccgggcgacggtgtttcggaaaggagcttgcgagaactgcggggccatgacacacaaaaagaaagactgcgtggaaagaccacgatccttggggaagacggccaaggtgagcggcatg

SEQ ID NO: 1501 - DNA, 703 bp, Nannochloropsis_gaditana
cgtcggtgcaaaaacgtgtggatttatttcggaaagatcgttttggcactgttctgggttgtgtaaaagccgctgacggggagatgtgttcggctaaacaaggttgtgactttttcaattcatgctgctattcttcttggtttcgactgggcgactttgccggctacccgttgacatgtcgtagtgttcgagcaatagagtatatgtgtcctgggagcatacggtttttaggaactgatgggtgcacgtagttttgtatcacaggcattatgttgacttaaattagtgcttgaggatataccactagcatcccttcgcgtaaagaccccggacgggaacctttcaatacgttttaaaactcgaaagaaaagcagagagatgcgaagaaagatacaaaatactggaaagcataacattaatttgttagagtcactacccaaccacgttcgggcacggaagaaaaatcagcgaggagagcgccggacaccagctaatagcctgtaggcaacagctcccacaaattaaaagaagtataccttcactcaaagcttatatacgtcgggagcggtgtgcgtatctacccttaaacatttttttaaagggatcagcttttgattaagggcagcgaaggttgcgctgttgcagtctctcgtctcgtcgttgagatcatgtcttttcccttacttgccgcacaagtagtatg

SEQ ID NO: 1502 - DNA, 703 bp, Nannochloropsis_gaditana
aggaaggtgagtagtgatgtttctcgtccctctcgctcaaacgatcgatccgctggcgcaatgtcacgcactccttccccgcgctgacttccttattgaatgtcccgttaattttaccagaagagactttttttttcccttgtgattttctaacagagaaagaaaaaatagactacgtataccttgtcgacattcatacatgttgcaatgagtgtgcaatgaagttcagaaaacataggcatctgtcgtgagggatcgtccctcgcggcttcctccacacgcttccattgacattgctctcacgcatggttgaggttttagaactgtacttacattatcgcgtgggaatacaattctcttatatttttaaaatttagcgcaaggtgatgttaaaagtcaacagtgtcttctttgcgtacattactccacggggtggaactcagatctccgaggtggcagcgcctcaattaccagccaaaaagcacagaatgacccctgtatgattcactccctcgtgcaagtccttgaaatgctagttatgtgcgactaatccccttaagtgtatgatttttgatatttatcctcccttttaccagttattgagaccttttaagcactgaacggtttccctcgttttcagcctgaagaccaaacgttaagttgattgaccttttttcccctgtcacagctagcgtgagctatg

SEQ ID NO: 1503 - DNA, 703 bp, Nannochloropsis_gaditana
tcgtgggggcgggcagtatcgagacggcctcccggaggctcagggtgacgggctgggagcaggtgctccacacgtagaggttgcctcaggcgcaccgctaaaggggcaatgaacccatggcttacgtttgcgacgctccacaccaagaaaatgagggacaaggccaacctttcgggtcgcatagttgtgtatgtgttatggttctacgagtggaacggaggtgaaaaggcccaataaatcatatataaaagaccttctgtgcgtacatacatagagaagaaatgaataagactataaatcattgcgtatggcttctcataggcgttcaaatatggaccgtatggcttatcttttgctcacatttggcttggttgaagacagtcgtgttgcttgaggtggtcggtggcgtgagcgactcgcgtcggaagcgccaggtcgatgagctcgagtacccgctcaaaacgtccacctcacaggcgctttgacgtaagactgtgtgtatgttaaaagatatctgtttatagtacaacgcatagatattcttaggcgtgcgacccaaatgcagtgagaacagattggggaaacgctttttgcgggttttccagaagctcggaccgaggccctccacgggagcccctgccccacgctaattgcacccacacccaggtccactccaatcacagagggctgacacagtggaatg

SEQ ID NO: 1504 - DNA, 703 bp, Nannochloropsis_gaditana
aggccaaaccgacacaagtactcggtctcgtgcccgtgcgcatgcaaagccctcccagcttttccgtgcgacacgagacgtaccccctccgagctgggatgggggaacctcctgtctagccctactgccttcttggtcttccgcaagcccgcgtgtccatcccatggccatgcctgcgcgtcctcgtgtgcacaggcacattattcttggtgccacttgcaagtcttttatgggacacgcctttcatggccacagcaagggggaatagagcgagggtaaagagaaaatgatatcagggacaggggtatgtcatcgttccccgcaaaataatagttttgatattgcatcccctttttgaatgcattggcgtcgtcaagacttcatttcaaatgttagttgtggagtgattgcctcttaaaatgagaagaggatgggtaatcttgcattctggtagatcctgttacatggccagcagacgagaaaacagtgctccccaggagtatatgctcactggtaaatttttcggtttgtttctctttcaatcgacacaatcagtgcaccttctattgatacttggcctttgtcagtcacctcctgggcctcacttcccgaaccacccgccagcattacttgtttggcggtctgaagacctttgattgactagaccctgcgctcgattggtatccctgtacaaataagtatg

SEQ ID NO: 1505 - DNA, 703 bp, Nannochloropsis_gaditana
gcagggaaggccccaagcttggtggaatagacaggaaacgtttgaaaaagggagtttcaataaacaaaaacgatgacaaagaacaggaaaacgagaaaaaagcaaagaaacgtagtcttaaagagatgaccgacgggtttattcagaagagcaaaagtaagatgggtaatgcgctttcggcaaatcagcaccagggggaatatgtcgaggaatctatgatgaagcttacctcgacagagataagcaagaaggacaagaagaagaagctaaaaaaatagaggtgtaggcaaggtggcagagggggggaggttggctgccgacgtacttggatgtagttgtggagagaggcttttgttggtccgaacaacaagaaaattaagcatttgacgagtttttctcaagatttcaaatgggaaatgtcatgtgatgcttttccgtattccttcgaagcatgcacaattgccaggcaacatgacgacaagcaccgtgggggaggtacatgacaaatcttgaacgcgtgaaaaggtccttataagctttttgatccatgacatcaatgtcattgctattaatgtacagcactaatgcaatggtgaatgagtgccctctatgccgggcgagtgccgcggacgggctatcttgctcgggatgtgtcaagaacaatctctactacaagcagcaggccattgcctacaagaaaatg

SEQ ID NO: 1506 - DNA, 703 bp, Nannochloropsis_gaditana
cagcataccagggttgccgtgcgcattactgactattttcaaggtactttgtagagcagcgccatctcataactcaccatcactttgaagcaataacatttattccctggtgcattcgagagcggcttaaagtcctaagggagaggatagaggcgctcactgaaaccaaagcagcatgtggaatggccaaatgctctaagccctcccgctttaaacccgccgatcatgctggtcaccgatattgtcaactcgtttacgagatatagacaaaacaagtcacaaatatgaacttaggtcactattttggtcatatatttggtcaataaatgagcttaggcagctaaatacagggagtcttgagaaagcctctccgcgcttatacgtacgtcccccccaccaacctccccgtactcccgcccccaaggcaacgagcgggactaaaaaccatgttgtctgttgtttgaaagcggccatgaagatactgccattgataccgtgaataaatattctttactgggcgtgtggtgtgcttatcatgatagcttgtgattgttgcttatacgcgtctgatttttaatctctgtccttcgattacgtgcgctcctcttcgtcacagcaaggtcttcgtgctctcatcttccgtgaggccgcaagcagcgtttaattcattatccactttacatatgacttccgattacacatg

SEQ ID NO: 1507 - DNA, 703 bp, Nannochloropsis_gaditana
tatagaacaaagtgatcacgacaccatctcggaaagcatcactggtggctgacgtataccttcagcctcctcgatttctatatttagccaacgtacctttcagagtttaaagcttccacatctgaggctgttgctgccgaagagctgaaggagatgtgcattattgggttggcaggtgcggtcatgcggtgtattactttctgcccatggttcggagtccgcgcggggaaaaaaaggaacccagtggagggaatagcgagcagtaccactagcaagtaggactgcaaacacagaggcatctggtgcgtgggtgtatatggcaatttttacgtgaattatatctcgacgtgtatgattataagtacagtagcggtcgctggagttgaagtggactggaatggattgaggacgtgcgagtagccaccactgcctcgctcgcgaggtgattgactgcgagggaataagtaagaccccacaacaaatgcgatgcgtacaatgcacatactgtaagggatgcatttagagtcctttgtcgcgcagtcgcagcagcaaatactgcgctggcctctgcctgagcgggctccgatctggatacacccccgggacccgacttgttctttttcacgcctggcgctactgaagctcaatacacgaccttaacatccacaagttctcccagcaatcctattctcggcggtctatg

SEQ ID NO: 1508 - DNA, 703 bp, Nannochloropsis_gaditana
tttcacaaaaatacatcaaataaacttgaaaaggcatgggcatgacactcgtcgactgcgggcggggacgtaaaggagaggccccacaagataggagctcgcggcatggaaggcggggcttgccgttattttttgaatttcgggtccacctcctctcctccggcacttttgaggccccagacctcatcattcccggcctcgcaccattctaggcgccttccgtcatcctacatgacgctggggggtagcctgagggggccttcgcgtcccttccttcccgacgctcgggatctgaacggagctgccctgcccgcttgatgtgacgtgagtgagagctgcgagcatcatgcttttctacacttgccttcttcttgaagtcagacacgatgttcgcggaacaagccctggtatctgtggcaccattaatctccatcatatctggagatcctggtgccttcatacgtcatcatacattagtaaggattgttgttgtgcgcggccccatcaaatgtgaaagtcggcgatgctcaatgcgcgaaaaagagtgcaccgggtgctcatgccagacctccctccttccactcacgcctttgccacaccattgtcatgctttgacggttcattctctctacacaacttctcgcactacgtgattgcaaggacacctgactcattttcgggttttgccccgacaagtgcgatg

SEQ ID NO: 1509 - DNA, 703 bp, Nannochloropsis_gaditana
gtccgaacatccgtcggagcggcaggaatgaagtcaaatagtatgtgctgtgaagaggcagcgacacaaatgctctgtggtctttttgggacgtcatctgacgttatcatggtactgaccactaccgcagtgtgcagcttgggggcccactttggccatcctatgagtggatatcgagctacactcacataattgatcaacggcacatcttttacttcaacatcattggatgctttgcgagttagagacgctgattgtgatgggcgcaaaaatgctgaagcacaccggccttgagtgtgttggcaggttgtgacgctgataccggtcaaggcgacgtgaacgaacagaaataccgcgcaagcaacaaatctcgtcatgatccttagtaattgtaggagaaatttgaaagatatttccattttgcattagctttcagaattaattgcggcatcatgcgcggaagctagtcatcctggaccggggggcgggaggttattgaagtgagagaggtccgagcccgagtgccgaccccgtcgtgttgacaaacattgttttaggggcctggtatccgcatcataccgataatatgacccatgcatctgctcacagggtaggtctttgagctcttttgcggtaccttgagcgccgtcgggaaaacttccattgtagcgcttcgcagctcgacgactccatcacagagatg

SEQ ID NO: 1510 - DNA, 703 bp, Nannochloropsis_gaditana
gtcttcctccgcatccagtggcccgggagaggagccgaacaaagcgacgggcctgaaggcggaggacctgaagggagtgggaggcagtgtcgggaaagttaacgcctacatcgcacagaaattgatggaatcccctatagaggaaagtccagtaaaagtggatgccctactacaggtgcgaaggaggtggccggtttgcatgcgggggcgtgcgggctgtcttggagccctttctcaagctcaccgtcctctcttgtgcccctcgtcggctcgaaaagatggaccatgcccatggttttagaatgatcagctcatcatgcagcttcccctcctgatcaacccccaggacctagaagacctagggttggccgagggggaggaggcgacctggcccgagatcactgagagcatgcagtctgtcctccgcaacgagcaggcagcagccttggagacggtcaggcggaacgtggatttaacccgagctacgacgattctgatccactctaaagacagtgggttggcgcccgtcttgcgggatgcattgaaggcgcgggggggaacatccaggagtgtgacggtgggggaggagggggggggtttggtagagcagctccagggagcggccgtccttgtcctgttgccggacggggctaaactcttgcccttcggaggcgggggggcagggggcgcggtaggagggatg

SEQ ID NO: 1511 - DNA, 703 bp, Nannochloropsis_gaditana
cgaacccaaaaccacgagcaaagctgctggtgtagttcgcacatgctgttccgtgacggagggcggtgttacgcgtgcgttggtgacgcggttggggagaacgacgtacaagcggaatgcgaggagcgcggaaacgatgcacaggacgtagatggcagcgaaaattgcgagagtacgtgcgaatgattcttgcaggtccagaatagccatcccaccttatttttcgtatgttttgatgttgtcagaggttggcatgatagatcgaccttggaggtgaacgacggatggcatgtcaatcagctgcgactcgccgtcgctcgcgtcttactcggccatcactctccaaaagttcacgctttttgacgtcaaaacgcggaaagcacatgcaattccatggcaagagctgtcaaaagacgtgccgaaagtggaccttgccctgcctttccaagggctttatggattgccaaaggaagcataaagcatgcgcaacttgagggtttcttggcgataatagaagcaaacctcacccactattatgcgcaccaacacgtgcacaggctgaggtttcaggtgctgtgaagcgtgacgaggacggcaacgctgccgccaattaattttgcctcgttggccagtccccgcggactcacgcgaccacgtcaaagccgttgtgtcaacacttgcccctgaaggtcatcatagcatg

SEQ ID NO: 1512 - DNA, 703 bp, Nannochloropsis_gaditana
accgcaaccaaaggcagtcaagggcagacaggcgcctgccaatagattgggtgtcagtctctttgagatatagcctcgtatccagggactccttgacggaagagagcgtaagaccaaaagccacataatcgtcttcaagacaatcgccatcacaggagcatcatatttcagtgggagcttcatccgagttaaagataatttcccctctctgcatagaacgtgtcaacaacggttaacatatgaatacattttgaacgcatcgcttcgaggattgattgacttttttttatttaatgtgagataagggcaaaatattgtctgttggacccgagatgggcctcggagaggatcgggacgcttggtagcgcgggggggggtgccaagaaagggcttatgtccaccgaaaataatagacacgatccccccgcagaagagaaagtgcatttccttgcttttttcccttaaatgttatgtgtgcgcttacacttaatcgtggtatcgcaatgcatgacggctcctctaagagccaatttaccacataagctagcctcctccccgccctcggatagccttcaaaattgtgaagatgccgaatctcttgtgtttgtttctcacacattatatgcgacaaactcatatttgtccctgcaaaggcaatttgtcccgacttgaaggctcacacttcttcgttcctctgcagatg

SEQ ID NO: 1513 - DNA, 703 bp, Nannochloropsis_gaditana
gtgatatcctcctacgcgactgccgctcttctatgtgaggagagacagatgttgttgtactcctgtcaaaaaaatctgaggtggatggttatccccttatccaaggccctattccaaggccactgaatcctcggaataagagtgaagtagatgctgctctcagttctaactgcccagtgccttcaatgcgaatatcaagctagatagggaatgtcctaacattttcaatatcgtagcacttccgttcccatttgttgagtgcctcgttgcacttcaagtcaattgttttcctgtgccatgttagcgcatgaatgtatgaatcaaatgggattcagatcgatgagtggttcgaaatttggggacaaagaagaacgttccaggtgcaggtatttaatgcctcatatacgcactttcaattaaagcctcctattaacgctggagcacaaaagctcttgccctgtcggccttcgcattcgacggctatgcatggtatggtcgcacacaaaagcgcaagggagggagaaaatgcgcgaatgacgatcatgcccagcctccccatcaccgcacggctttttcactcggcaccccgagcgcaagccacccagtgggccagtcttcgcacttccttgcgcaaagtgacctaacaaagcctgatatcccccgaatgcattataagctaggtttaaatcagacaagatcaatg

SEQ ID NO: 1514 - DNA, 703 bp, Nannochloropsis_gaditana
aagaacgtttttactcgcttactggcaacgcgtcgtgcaatctcttcacagaaaaaggtagagggcatggctgctcttttaaggttttgacgatagtttcataggaaacacttgtgaagcctgacggcataactctcctagacgtttccgtgccaaataatcaccacttggtgtagtgaaagtcacgggttttgaccacataacgattgaccttactatatacacagcgtatattatggctacatctccgcaatctgctgacaccaaagggatgccatcatgctcatcttcatcgcttgaagcagaattggcgcggggtctccaactgactgcagagctgacgtcgtactcgaagggcaaaaccaacagcacaagcagcagcggcggcaatgaaagcccatcttccacaaattccagtcctgttgattctagacaggccgcacttcctaataaagcaggcatttctatcctctttgatgcagatttgcagtacgccccaccatcagaaacggacgaagaggggtcaactttgcaaaaatgtcatttgccagcgtgtactcaaatcgaggatcgcgcttccattcgcctgtctttgtgcgcacaatgtaaggtagcacgctattgtggacgagcgcaccaagtattggactggaagcaagggcataaacacgaatgcgcgcaatggaagacattgatggctatg

SEQ ID NO: 1515 - DNA, 703 bp, Nannochloropsis_gaditana
agaatataacagggggaggatggaagcggagttcaacaagcagtcttgcggagggaggttggcaaagcgctagtcgcggtggtggtcggggggcaggacgcggacgtagagggagaggtggagcgtcgggaggaaagaaagccaaagtcagccatgaaatggactggtagggacatgacaatggatatgacgtgtatagcaaggggtttggcggtacgtgcgaagaaagtataggaaaaatgtcgtgtcatgaagacgcgcggcccatataagaggaggtcaacaaatgcaggacagcacaacacgaaggaccaaagtagccgttgccagtaaggaagtccgacaatgccaaagtaagatgcaataaaatgaggtgtaacaaacttgttgatgtgtgccacgtttcaatagcgtttgccatgtttttagtggaaaggattttcctgcctgatgtcccctcgacagcgatttcaaggcaaccgtgccggagagccctccggagggggcgggtcttcccgacaaaagttgaatgttggggacataatacagcgcaggcacccatgaaggatcatgcatcgcgcaaattacgcttacaccgtcatgttatctctctgcacagcctttgtggtgcctggggtaggccagaccccttgagcccggcataacttccttctgtaggagcagcaccttattcgcttcaatg

SEQ ID NO: 1516 - DNA, 703 bp, Nannochloropsis_gaditana
atcagttgcttctcacccacttttattggacgcctacgtacaaatcaccaagaaacaccatcaaggctacaaaggctggtatgctcgtgcctggtcgataatggaacgagtcgagaagcactcgctgtgccgctcctagcgatgaacgcgtgcgagcatgcatcaacttgggagcttccctggacatattttacagtctgacaaatgcctgttttgctctacacagggacgggaggacttgggatctatcatgtggcacccaggcctggcgggctgttgtattcggcagaatttcccgggagtattacgaaggtccacgagatggccccctcaaatgcatgtactcaaggcttgcctggtgacgaatgctacgaggcaacaccgaccctttcggcggcaatctttactgtttcttaatggttggcgtcaatttcgcgtcacaccggcagtcacgcgcctggatgttggcaaaccgacagagcagcgccctgtttccctcaaggagatgggccacctcctgcttcaggaaaagaagacgtttaccgtggcattggctggcattggagtcgcatctgcgtgtcaattgtgtataccttatatttttggcagtgtagtagacttgctttcagccacagttggggaaaatacggacgccctccacagcaacactgcggttttgtctggactgcaagagaacgcgatg

SEQ ID NO: 1517 - DNA, 703 bp, Nannochloropsis_gaditana
atgcagaggggggcgattatccctccggcggaagccatccggggttgtatcgagttcagggacgtgacctttgcgtacccaacgcgcccagcaagcccagtgctagagggcttcaatttgatggtaagtcgttgtcgactcttgcgatttatcagatattctgtccttgatggtgccattttgaggttccgtgcctcccggtcgatccctttccctgcactctatgaatccgtcagccgacagtctttcccccacggttttgcactctccttcgtacagcttaagcctcgagaaaatctgggcatcacaggaccgagcggatgcggaaagagctcgcttgccctccttctaacccggatgtacgctccacttcaggggcaggtcctgctcgatggatacgacgtggcgagtctcgatccggcatggttgcgaaggacggtcgtggtcatcacacaggaggtaatttctcgatgaaaggaaaatcgtaggagcacttccctatccaggctgtccaattctttgtcgtagaatataccgtgaaccggaactgggttggttcttgcgatcaaggtgttgcaactgactggaggcctcaatcctttttgtcacagcctctcttgttttctggtaccgtgagggaaaacatagctttgggaaagccctctgccagccatgctgagatcgtcgaagctgcgacgcttgc

SEQ ID NO: 1518 - DNA, 703 bp, Nannochloropsis_gaditana
catcgtggccggaagggagctttcgtactatatatcgtgtcgtcactttttctgcggcttccagtagaggataaaaaggatatgatccacgtgatgggaggccccataggcagacgaccagggtcacgcacaacaatggctgtgccgacaccgttaagcagctctcacgcacgcataaaatagcatgtccacttcattttatgtccttgaagacagtaagagtgatattgcactagaaaaaagctcgctcgagctggcgtcgctcagtcgccccccgagccactcttcgtggagctttaaattgccgtgtttagcctcgaccacggtcgcaaagcacgtccgtgggaaacacataccacgtgcacgccccccttcctataccagtgcgtcttggggaagtgggactggacgtaccaagcacgtatatccccaggttttgggaccacgtttctctcaagatcgataaaaccatgcacgtcgcccacccgcccgtgactctttatttccctcccaatgctcctttcctcccacgtcctggtctatcacacaggcaaacaggctgcagttggatcataaactccaccattcgtcccagtaatttcgcccgtgtagtggacaagcactcgttggtgtttgcgcaccctcctgccccggtatctaaggcacgcacgtcccccatccgtgatcccggccgcgtgctatg

SEQ ID NO: 1519 - DNA, 703 bp, Nannochloropsis_gaditana
aattacatcccaaccacaaaaatagtaataaaaataatgttgcgtggtagcctatgaaaaatgtaggcaggtgtctccattccctggaccggcgtggaccctgatcaaaaaggaaagaaacttcagagtggacgggcagcgcacttgcacccggcggtcaaaatgacctcagcgtagtgaccaaccccacgaatcccaagcctgtccagcactccgcgtcgtgtgtgggatggaaaccccaatcgttcagcacccggacggcggtgtgggaccatggtgatggaaagccagcccacatccaggacctgaccgtcgcatcggcttgccgtaagattcgggtcatacattgacgctacaaacaccactgggtaggcgggcacctcaactggcacatttcccccggtttttcccagcacgggactgtggagagggaagtcaccgatgcctcgctttttgttgaatgtttatgcgtgaaattgcggcagtgttgtcccagtctagggaattattgcccgccccgcccttccactcctataattcttttccagtcccccgtaaccccccaaaaatatatgtttattgtagcatatcttgcccacggcaacatactccgaaaagagtacctttcgtcctcacccatgtacatttttggaaaactcaatcttccttttttcccttcactaaaaagtcaacaggcgagatg

SEQ ID NO: 1520 - DNA, 703 bp, Nannochloropsis_gaditana
aaggggcctctaacgtccttcgcggccttcgccctccgcgatgtgagctctgaccgtttgatgtgacgaagtttgtccattacacatattacatgccctacgccgtattactttttgattttacgcatttcggtgtgagaatggccattcgtgctggaaaagtctgcaagaaataggagacagaagttaggaggggagagcgggagagaccgcgaccggtgcttgctctccctcctcgatctaccgtaacttttcttgccaaccgctttgcgaacgcaatctccaaccctctgataaatcttattatccaaccaagtgaaccatatttttaactaagtgacggttgatgatgtagtatgtgtgacccgggctagctttcctaataagtgaaagatcgtgcatatttccagcgggtgggcgaggagaaggacgacgacacgatgcaatgtcgagaattcggggcgccgcaagactgtgtggttccatacaatttgacaattttcattatttgcataatagcctatctctaatttaaatatgatgtacttgcgagttgatggacacatgcttcgggtcaactgcaggcgcctcgaggagacgcgccctctttctctctaattaaattgtatccctcaacgctaaggcagatctaacaaatactcggttttctatgtgtatgtcctgcgtggaacagggagttatg

SEQ ID NO: 1521 - DNA, 703 bp, Nannochloropsis_gaditana
ttttccacaaaattgtgaagtagggtgaagatatgagcaagtcgaccatcgatgaatcatccgaattcgaatagccatgcgcctgaaatctacaggacgacattgattttgctaggttttatttgtcaccaacacacaagccacattgggccctttagattacaacgtctgattagtttcatgcgtgcgggttatccgtggcccatatcgcttgtgcccgttacaagaagatgcagcgagtttcggttacgctcagcaagccagcagcttaggaaaggggagctacatcacgctttgtgtctttgtgcgtatcaatcctctgccagcacaagttgtttgtgtttgttcaatcggcggcagatgtgcggccgggcgcattcacttgtggtaacaataaggagaggagtgttatcgtgttctggacccccgaatgacaggggagaccttcgtttcccgttcttgcctggaaatttattggctgttcgcaggcgctggatttaagtatgggtcatgcgagagtttgaattacaatttgttgatttgcattgcgggaagacgaacagataacctgtggggatgccaagccgctgtagcaaccgcatcgcttcatgggcgcagggagacgtgtcgtgcgcgggtcgtaagctttgaatagaggagcaaatactcaccccatgcacgcaatttatttgtcacaggaatg

SEQ ID NO: 1522 - DNA, 703 bp, Nannochloropsis_gaditana
tttctttcaaaatttgaatactgcatccaaaagcataaacgaaagaatgtcacaccactactccgcgtgccttcgaacgaagtcattacgcgtaagtaatcatcgccacctggaaaataacggtggatttaaatttgtaaatttgaaatacgacaccaacggcaactctcagggatttcttcctctcctgcccagcaagtaggccgcacgacaacgtcttcccttcggccctcaataatttgaggaaagaatacaaagaccatttaaaattgattttacatgatatactccggatgaactcgcagagtcacgccctaaaaagcgcgctagcaacaatggagagaggtggagagtttttgtgaaagacgactggcctcacgctcgcctaccatccccaggccttccctccacactcaattattaatacattgttatacatgtcctatcaaatgcgacttcttgccttcgtgcgttcgcatgctgtgtcccctaaaaatgtagaaaggcatttgacccatacttgagaatgggttacgttgtctagaaagaaaaccatttggagaccattccgaacggttcctttcaatgtgtgaatcgacatccttctttgtatatatattcatgaatataaatcgtaacttgggcaccctctcaccgttcataggttgcacaaggagacgttcctagtcattttgcagccatg

SEQ ID NO: 1523 - DNA, 703 bp, Nannochloropsis_gaditana
gcacaacggctctcctaacaaagaggcgatctcgctcgatgaagatcgtatagtaaaggagggcgacgggaatgacggaggaggaggaaatccagggcgagaggggagtggagggaaagacagaaagagagggcatgatgaaagaaggcatcgtggacgagctgaggaaggcctcgtggaccggaccgaatacgtctgcccctgcggaagagatcgacgttgggaggcgtggttgcaatgcgacgcatgcaagcactgggcccacgtgcgttgcgcgggtctttcgagcagtgccgaggccgaggcccttcccgcctttgtctgcgaagtctgccacggtctcgaacgtttccaatccccgtctcccgtcccggccaccctgattgtcacccctcagcttatctgtggacagtgggaggaagaattcaagagtcggatccaggaaggcagcgcccaactgcgggtggtcacttaccgtggtgtagcggagaccagccggagctgggagtgggaagaacgtcgcttgttggaccctgatgtcctggggaatgagtacgacatcgtcttgaccaccttcgacgtgctggccaaagacctgggccacacagattcctgtttccttcccccgtcccgcggggagacggcgcggcagctgcggaaccggaagaagtaccgagtgcaaccctcgccccttgcctccatg

SEQ ID NO: 1524 - DNA, 703 bp, Nannochloropsis_gaditana
atagcatatacaaatgcttcaagtccatagaccccgccttacttgatgctaacaccgtcgtgaatcaaagcctcccgcaacgtgttcccaaaaacgtccctgcccaccatgcccaccatggacgtcggtgcaccgagacgtgcagccatgaccgcttgattgcctcctttacccccacagcatgtagcagagtgggagccttggagagtctcgcctatgcgtgggtagcacgacgtgagaacctcgacatggaagggctcccggagccggcgatgaggaggtcgcactctacctggttctgggaatttgtcgtgcaaatagcaaaacaaatccacatttaagctgcccacgcaaactatactcttctgaattttgctatccatggtaaatctggcgtgtgcctgctagagaggtttcaagtcagtgtgtgaagatgctcgctgccttgcgtcaggaggttgcactagcacttcctcgacgatatcatcccccacccctttctttttggacgtctcgaatgcagacaaagcaaatgcggctcaaaatatttaatattacaacatcactcatatccgaacgctactctttgtcccttgcagcaagcgcacacatatctgggactggggtttccttccccctggttaaatctaccatcgtatcatcgccgcctccggggaccacaaaaaggggcgggtgcacgatg

SEQ ID NO: 1525 - DNA, 703 bp, Nannochloropsis_gaditana
gtgggggggagaggtgggagggctgcaggggaggaacgtgaagggcgagagagcggcggcggatgggaaagatgaaaggaggcgtaggattcgttcgcactcgtcgagtgacgcgtcgtccccctcctctgggcgccgccggcgatcatggagtgagcgtcggagatccagcaggagcgagtccagtgatgaggaaggaagacgagggaggtggaagagggagcgatcctcctctcggtcgtcgtcacggtcgtgggaggaaggggagaggaggcccgggagagagaggggggcggggccggcggcctctgggtacaaggagaggcgagggggagggcgccgggaggggaggctcaggcgaaagagcaggagtggaagtagggagaggagaagaggtagggggcgaggaggggaagcaagcagaagtcgggagcgagggctgggtgggagacagagagggtctccggggagaagagagaggagtgagggaagcaggaggaggggtagaagcggcagtagcgagggcgagagggagccgagaacagagaggaggagtgtcagcgagggcaggatggaggggagaagggacagaagcagtagtagcgatggcaggagggaaatgagaaggggtgggagtggagatcggagagggagggagagacgaggggagggcggcagcagaggatcgcgagggcgacggtct

SEQ ID NO: 1526 - DNA, 703 bp, Nannochloropsis_gaditana
gtgatatcaatgtgacgatgatccacccaattaaaagcccgagaagagatttcacggcagtgcggtgggatgaagccgccttcatgaccgcacgacacgggcatggtagatcacacggggttcggcttcctttcgcgtgcgtagatgacctcattgactccccggatggtgcgactactctccgggtgtccgttttgtctaaattgccgggcttatccagtctcgtcggcgagattcactatcatttctccccccttctaagagcaaccacgaccacgcgcagatacgcaggtcgcgccccgcaggaccctcgccccgatccgctttgtatcacggagatattcgaagggcatgggaggcgaagccagggttgtgatgcggacgactttggcagacttaactcttcaggcttgttggcaattcccttgtgcttctttcttctttgccacccaccaactgaatcttccgcgccctcttggtgttttccctttcgctcggcggaaacaatggcgcgcaatcattgtgcagtttctcattctcatgtgtacctcactaacagcacgaaagcttcctgtacgaggaggtgcgcaggggcaaggagtaagcgccttccctttcacgttacaggatttgattgtcgctcgactaggctacattcaacgtgcgctttaccccaagcaagaagcatttcaattgagccatg

SEQ ID NO: 1527 - DNA, 703 bp, Nannochloropsis_gaditana
cgcaggcctcgtccaggaagtcctcttcttgtaaccggtcttcgagggtagagcgtggaggtgttatgtggaggactatacagttggggaccggcgcggatggcactttttgggggcggatagagtagtttctgtgaaaattgtcgcccaaaatgggctttgtggccctttgccacgaccatagttgtgcgggttctatggaggctgcggcgaacatgaaagttgaaggcagcaacgatgcgggcagcttgatcatacgacattttccacaaagagtccacattcgaaacccacgtgcgtccctgtaaaacagttcgaataacgatgtgggtacagtgatagtgtgaaacgtactcgggagaccaaaaggaagacatggtcaacgcatcttaccaagttaccaccaggggtctcccatggcggtagttcatctggctttctgttcacggccaattgtctagcactctttcccgaagtactttccacgcgtcgtgacacacctcggacctcgaaacattacttgggatcttttatgatgttttattccatgcagtcttccgcctcgcgttgtgtgctggtcattgcactggcgtcgagcagagagaccggtttggacacatgtcaagttacatgcttccgtgattctatgaccgaccgtccacacgaacacatgtacacagcgcaaccgtagcaaccacacatg

SEQ ID NO: 1528 - DNA, 703 bp, Nannochloropsis_gaditana
tcgtcgcgcattaaattcagagcgtggatcgtcgcatctgtggtacatagctcatgcatggatggccgttgcggtagtgctaactatcctccctccctgttttgtagcagtggtagaaaaacatgctgagctgtgatgagtgcggccacaagacaaggatagcattgcttgtcgcgatgaagtttatggtttagaccacaagaataagtgcacaatctgcgtagcacggatgaacgcaaagaaagagactcgtccgacctcccccccctgggccctctgggctctcagacagcctcgcacccctccattcgaatgttacacccgaaccacgtcctgggcttctccccggcgtgtttcatgaggtgcaccgtcacactcggacaaacatgcgtacgacaaggatcttaccgcatcgtgctcgcggacagtgaggcctaactcgcttctgggaggcaccttacgtatgccgccctcctcggtcggtatcacccggaggggtcaaggcaacgtcctattgccgtaccttctcgtctcacgtttgtcttcgctatccttttcacccaggaatctgacgacataaggcgtgcacgtgtgcctgctcggaagcgaaagcggctggcaggttgcataaagctttgctgcgtccgtcaaaacgacgcgctctctttctcatcacaaaccggcgcccgctacaatagagatg

SEQ ID NO: 1529 - DNA, 703 bp, Nannochloropsis_gaditana
tcagattccccaccatatctccctgccgtgcgactttgtctctaaccgtgcgtcatcctcgcgaatccgggaggcttgcgcttccatcgttgtgccatatatattatattatattaagtcacccggacataaactttgccgggtgagttgggccttcattttcgttcccgagcctctggcttggaagcgaaggcgacttttccttctgaccatgactaggatgccccccccgttcacttgctttcctgtgcatgcacttatgtacaggcgtttctgcgccattcgtacaacgcggtcatgagtcggcggacgactttatcaagtctcgaggctgagagagcacactccttctacgagttaaacgtgcctgggagcttgccgccagacttgactccccaaacggaagaagcacagagaagccaatcaaacatctcgcaggcccccgacaacaacgatggccatgagaaaaacggagatgccggggtggagaaggaggaaggagagggtgaagcagccgagcagtcccccctcgtcctcgaacctctacccatcccctcccctcctccagcctccatgcctcagatatcgagcgccgcgtttccctccgagcaccaccatcaccatgtgtcgttgcacgcaccgccgcctgtccatcccatgcaagctccgcccgcccaccatccttaccaccctcaccacctcc

SEQ ID NO: 1530 - DNA, 703 bp, Nannochloropsis_gaditana
gaacaaagcagatctgaggactcgaacaaagtcatgaagttcaaacgccagcaggccttgacacccacgccgcaatccccgttcactgacttccgccatcggggaaacgaggaggaggaggaggaggaggaggagatcgttacatttcgtattgacggacaacacgttccagcgagtaacacaacaagcacgccgggggaaaacgagctgcacaaattaaaggatgcagacgacatatcgcgcgcagagacgtaccagcgagtacctctgacatgcacacaggctccggcacagtcctcggtccctattcccaccaccgacgctgtcgcgttcgggggccatccctcttactcctgcgcgaaaaagcctcaagaaaaggccatgcacaatatggaagcggtcatggaggcaactgcagccaagagtgttggcgaaacgaatcctttgggcccagcgtctctcccctcaggtccctgcgccccctttgatggcagcgacatgaaagaccacgatggcttgagcctgcccaaggaaacggcaggcatcgacaaggacgtgaaggaggaccaggagatggacgagctgaatggtcgcttgtcggaaggactgtccctgaaatacgatttcggcggagaacattgccccaagtactctcagagagaagtggacttattggtgggcaaacgcgtggaggaagccaaga

SEQ ID NO: 1531 - DNA, 703 bp, Nannochloropsis_gaditana
gatgggctatcctgatgtataccataagtgataatacagcactttgcgttgggtttttacgaacataactgaccatcgcatgaacggtctcaccactgaaaaggtgatgacgctgaacaaattgctcggccgttctttctgttgtacaaattttcaatggagtgcgtgcagatgtatatttgccgaagcgaacatcacaagctgttttgcgactggaagagacagaggtcgtcctacagatgaagtgggtgtaaagcaatagcaggcagaagacacttaacaacggcggtcgcgccattaaatgagtacacagcgttaagcagaacctgtcagaaattgtgcagggtaaacaagttctgaaaattggagatatgactcttcacataagccgggaggtagtgcgaaatatcaataagctcaggaaattactttgcataattgacatgtaactcccacaatatccagcgaatttcgatgtctaatcatatgaaaattattttagccctgtcaagtagttgccaagcagggcacgtgcttcttggttaagaaaatgcaagtttcgaccggaagcctactgcatcgggtaacggcttctgagccgttggatccttcgtctgatcacgaccacatccaaaatggatttcttcacgagttcatagctttatcgctccatatacccttcattcgcagaaaacagcgcatg

SEQ ID NO: 1532 - DNA, 703 bp, Nannochloropsis_gaditana
agaagacgttgaaagcacatggtccaagtcttcaacatcactatctggtgctttttcctttttgccatttcaggacccgattctctctccttacactctctgtagaaaagcttgctcgtgaagtgaagcacgacatcgaattgtcagcgtactttgcgtggaaggtaaaaaacgaatattaagtctcacaaaaggccaatgtctaaattgagaagcctgctgagcgtctcagagggagatcggatacgacccaacaaaaaattgcacacccctgatacaaaaaatttcaagacggtgtgggcatcgaactaaaactaccgctcgcattccactgcatttgaacctaatctatcgtcgacgggtgataaaaaataataattcaagctgctcgctgcgtctcgccagaggcactagcgaggaggcggaataccgaaacaaccccatgacgctctctcatatcaattatgcttgaccgagttcgtgcacgggtaaccaaccattgtaggcttgaaagtctggttcctcgtcgtcgtggctggcggaggggatagattcttaacattttttagacgcagattgtcgctccctgcgccaaagccttactcgggcagcccgacgttccctcattattgctcacctccaaatccacgcccggcaattgattccaatcacaacagtggtcgaaaccttggcttaaaagatg

SEQ ID NO: 1533 - DNA, 703 bp, Nannochloropsis_gaditana
gccaaaaggatccagtgaacgagtctcagaaaataacatagtgattccggttagcttttcttcttcagaagacaagggtcgtgacccaggcctcggtagagggagcttgttttcgatcaacgacttggtgacttttttctagatgcctttcatatgctgaaggatgattttcacgccgacacgatcctgcaaagatgtcgtgaacaggaaacaagatcacatgagagtcagctcacgtagcttacccgggtagggagggcgaaagtcgttcttgcagtgtgacgagtgaagaaaagcttttctaatttgaggagaccgtcgatagaaagcaaacttcccgtgcaggaacctgtgcagcgaaataagtcgggcttaggaagcatagagcacgatactgacaattgcagcgacctacaaaggcttagtacgatgagaaggacagatgttataatgcttatatactttcaagtatcctgaagcctccctgtgcctactaggagctcaggaggagggtggagcacggcaggaataaaaacagagaaacccgacacgtatgttgccgagcaacaagatggcagtggcctgggcaatgttagcgtagtttcacaaaggacgtacaatagctttgcagttctgccatagcggcaatgatgttcaggagccacacgacttcctgcgatggcgaacagcaacgagagccatg

SEQ ID NO: 1534 - DNA, 703 bp, Nannochloropsis_gaditana
caagtagtgaagaagaaagcttcagataaatcacctgatctgaggaggttgagaaaagagtaatttttaattttttctttcttttcgagtttacggcacaaaaccagcaaaaagaacaaaagaactcggcgtctccagcggcgaaacattcccaggcatccacacgacttccttgttgtagctttttcttcctttttttgatttttactgggaagccgttacgtaaggcttgcgatcgccgaaaaaatcgggaattattggacacgagaggcaaggggtaccagggtgctacaaacatgctggaaagttggaagtgttggtgccaggcggcatttgttcggtcgatcccttcatgagcacctatgcttggctcacgaccatgggtaattggtctgcatgtagtgtttggaacgaaggtatggcctgttcaaaggtcggggataatttgcagacttacacctcgtctcgccttgtccaagcctgacctgccaccgtggttggatttactggtatcatgcgtagccgtgcacctgtggaaaataaatcggattcaagagaaacgaaggggagatattgtttagcgaaatgaaacacttttctcgaatctttgtgattttttattcattggttggaacaggatgtgtcctgatagcctccaaataaattccaacccttgtacagtcccatttttcagacgaaaatg

SEQ ID NO: 1535 - DNA, 703 bp, Nannochloropsis_gaditana
ggtcgagctgcagaatacgaaagcagcaaaagcttgcattgacatttcacactctaccagacaggaaagccatgcattgtctgagtactgtcatattctatatcgtgatttccagctaaatagttgttgtgggcaaaatagtctttccaagcaatagacacgagactgctgccttcctgattctgcctctatcagatgttgcaatgctcctgctctgacatcacgtctctagcatgcctttccaccgctctgtgaagctacctatgcagatgaaatgtatctgcgtgcaatgcttcactttgtcgtgtttgcgggcttaagcctatcgacaaatgcaacagaaaactcggggagggcagggtagctcgtcacgtttcaacaacgcacgtggtcaaaatatagctcacagccgttgtcaccgacacattccatcctcgcatatcctctcattgtaggcggttaacattttgacggagccaaggaagcctcttcttcaagccgcttcggccggcaggcacctggactgcaggcacggccccctcccatcgcctcgtgacagcgtgggtgtaggaaggaccagggaagcgtccgccgcaacgctcacacgcacacgtcgaaagaaaaagggtcccctctgagggcacgcgaagcgctcggattgttagggtctttgcagggagcttgggaggcttgtcagcgtatg

SEQ ID NO: 1536 - DNA, 703 bp, Nannochloropsis_gaditana
ccttcaacttcgagagcccagcgagggagcgatgacaaaaaagctctgcaacgcaagcggtacatccgtgcaggacattcgcaaccagtagacagagaacttgagacaaaatcatcgcatgttggggagaaagcactgtcatgctgtatatgagcgctcgagatactgcatatcgtatgttttgcgctggacaaattccgctacctgcgcttggctgtgaaggatggttacaaccgatagggatgggtgccccgcctccctcccttgagatggtggcacaccatccccctcccctctctccctttctccctccatctatccctccctcccttttctctgacatacatactttcgcggtcaaccttcaaccaaagcgtgcactacccgtatggtacaagtatggtggcatcggacacggccggagtaacggttttcgtcctttggctttctcccagcgtcttgcgaatcgaatccagcgtctgaaaacctaatctattgccctcgttccgacatgcagaagccttaccatgtgcaaattgtgtatgtgtccctattgatctcttcgctcgatcacgaacgtttgaattttgagtgcgaatgtggtagaaacggtcaggattgcggggctgtggccttcgtcttcgctctcacccaatgtccccttcatatcaatgcaagtcgtgcgacaccagccgcgctcatg

SEQ ID NO: 1537 - DNA, 703 bp, Nannochloropsis_gaditana
gatggaatccagaaaaattggtttgatacacaagtcagggcaaaaagccctcccattggctattgctccggtctgtcccgaaggcttaagctcccctaccatgcgttgccccatcccctcccctcgcgccccagaccgtaccttaagtcttgcgcggccgaggcacgatttaccacgaggttcgtctctttcgtcctgccttgtgcatcctggccggtcgtctgcgcatagaagcccgtaaaaagcccatggcccgtgccatcgccaactttggtcttggcgagtggagcatttaatttctgtcggaagcggtttgaagacgctttgccgcctttttcggcacgatggcctttccaacttctaatgcgctcttatactcacaggtttgtatacatggcatcaaaatacgtctgttgacatcctgaggcctttgttgggtcggagtaccgtctctaggtgcagtgtcaagacaagcagcaactctagcagtgacagcagctcctgaagggacgagttcggtagcacagagctattttcagtaccacagcgatggcagatttggaaggaggaattggcacagcagcggccactatacctaatccagcgggtgcatcggctgactctgcagctgcggctgatgaggtgggtgctgcgtaggcctgattaaggcgggagaaggatggggcagccatggatgtatatg

SEQ ID NO: 1538 - DNA, 703 bp, Nannochloropsis_gaditana
tatcccacatgcgttttccatccaacctgaaaccattaatgccccatgctcgtgccatatagacggagggccctacccatccatagaatgccaagcaccgggccacgacatgagcactcggaaccgcctttaaggtgagaatgtaggccgccgcgaattgtaccagcgcgagcataatccagtcaacgtgtgccattgcaatgtctcgcgaccgcaagcgcgtcgcaagggaggaactttgtccccatgcttgatgaggtagtaacattgcccagccgagaatggttgtgaaaaggatctgcaggacgccgcttcggacaaggaactcagtcggccccgcagaccccagaagcggccacaccactcccatttgtgccttcccgataaatttaaagcccctgttactaggtgtgtcatagctcgtaagcgcggggcgtacggccatggctgcaagcccctttcattaagaggggtctttgtcggcgacgccagcgactgtctgtcgtgttttcagaccaaaaaatccacctcgtagaatactcgaagacaatcatcggaattttaactcattctggaatttctttgtctgcgggcacgtcagagagcacgggataagaagaagcgggcatcccttcatcgccaccgacgtcgtcgtcagcagctgaagtagctgtggagttgaggccttcttccacctttcatg

SEQ ID NO: 1539 - DNA, 703 bp, Nannochloropsis_gaditana
gagggtgtattgcgatttgcttaaggtccattttcacgatgctttgctatttgacggggtacctcaagcactaccgtgcaaatttttgtgccttgaagtaggaaattatattgatatataccattctctgccgttgaaaggttcactggcgcgtctaatccacacacaccccgtacccgaaacggcttgtccacgcagttgtaggccgggatgccgacgagcacctgaattcaaagccccaaaaaactttcgtcttccaaaagagcatggactaaagatgatttcgtatctcattgatgcatcgacttcacttcattccacgcaaagtagtgcgccatatatggctgccgttacggcctgccagtggcgagcgctcaagactacccggcactggcaagactgcaggaaatcccgcgccattagcttgcattatgccattcatgactgtcagacaaaaatcaactatacttccgcttcctatgtcgcgttttagagacggattggctataattcaggccatttggggcttggggagtgcctaaaccgcgactctcgccttcgccagcttcaagctctctcaagcgagcagagtttaggactccgagccacgcgggagatgcccttattatacatcaattgcgattcttttcttcactttcaattcaacaactaataactcttcgttttaatccctacagtcatg

SEQ ID NO: 1540 - DNA, 703 bp, Nannochloropsis_gaditana
gccgcggaggtgattggacgccgggtagactagacgagacaagcaagggccttgaaggccactaaaatgctttctcaacattttcaacacttagccacgtcgtgcatgcttctatatactcaggccaatttttatttgggcctcttgagaccagggcctgttcgagaaggcataaaagatgaagactagttgcctatacggctgcttcaagtcccgcgaatcccgcagtccagacgttctttcacgtgactcgcctttgcaagaagaaagagatcaatcttttgaatgtcgccacttatcattgagattctcctactttgacatatcacagggcctttggaacgcgcctttgcctggtctacatcttttttgcatgcggacttccacgagaagtcgaaggttttcctcccgcctactctcgcctgcgctttttgtactgtcatccacaataatgtaccgaaggacatgcggcgcaaagtttttgtcattccggaatatggggtcttgcggtcaaattggattcctgttctctaataccaagctcttcgcctccttctcactctgtcggcccttttccagcagacggcgtccgcggccttgcacgtcagatcctcatgtagataaaagtgatagcattgaagttcatacaagtgagaacaaaatcgcgtctccctttagtagtgaataccactccccggttatg

SEQ ID NO: 1541 - DNA, 703 bp, Nannochloropsis_gaditana
atcatcctcggaaagaaatggagtcaactttctttccttcatgtgtaccaccatgtgaccatcttcttggtgtactggctaaatttgaatgccggctacgatggggacattttcctgactgtgatcttaaacggcgccattcatacggttatgtacgcctattacttcctttctatgcacacgaaagacatttggtggaagaaatatctcactctcttccagattatccaatttttgacgatgaacgcgcaagccatctatattctcggcgttggctgtaagagttttcccacccaaattactaagctgtacctgggttacattctctcgcttctcgtcctcttcctcaacttctacttcaagacttattcaagcccgaagcctaatgggaagaaacctaaaaaggcgtgattcaaaagcttgtttgtggtaaagctctatccgatagaaggacatgtgtgagagaaattacctcattgaaattgacatattgagaagtacaccggtgataacgacaattcttcagaggcatacacatgaaggggttcacataaaaaaggaagagcggttgtggtaaaaaccttgttgaaaaagtgggacctggacgccagagatacagggactgttattcttaccgatcctcgtgtatgcccacccacaaaagaaaggaaagttgtatgccaccagagcatgtggcaatatg

SEQ ID NO: 1542 - DNA, 703 bp, Nannochloropsis_gaditana
atattgtagaaaccaaaaagaagcccggccccaagcgatgatgcaaactatccattctagcggtaccagcagccgttgaatgtcaagaatttcattttggcactcattgctcgcacataggacgagtaaatcccgtaggggtgggataatgcgaagtgggaatacggacgggaggtgaccaccagaaagagcgacagcgagaacggacggtcaatgcccgaaatatgctccgatgcctcgaaagcgctgttgaccacacccggtaatggctgccatatttggcaatgaaaggacagatcaatgagcttgatatgattgaccgatgctttagaaccttgagaattgtattttccgcaccgactcggagacagatcgctcgcctcgtgcagttgccccgcccccggacaagagataaatccgactgagcgttcttttgcctgcaacagagatcataatcgatggctttctgatgcttggcatctcgacacgacacagagaaagcttaagtagttgtcagaataaaaaatgtccagtgtaggatatggccaagatcgttgccctttggtccagtcggtcacctcgccttcctgtctcacacgtactttcttgcgcattggcacaacactgcacagtacctgaaattttcctaatagagaccattaaataccgcgtcataccagggcgtggtggagtttcgacgatg

SEQ ID NO: 1543 - DNA, 703 bp, Nannochloropsis_gaditana
cttcgtaaggttatgttgtccatttttccgacggtgcttgccatggaggaaacagccgcggctcgtttctctccgcaggtcaggtgcgcgccttggactccaatgtgcgcaagacgaattgaatgcttcttgcattggaatttagggggtgtgtgactttacgaagtggctctgaagccgaaaggaagtgggtgacggtccgcggaggacaggatatcgtacgcgaaggatgtcgacaccttacagcgaggcgcatgtccttatgaccttctgctttgtgcgacgcagacattttgaacgcatgccaattgctgtaatcccttgacaagggtctttgcgtggttgaccaggcgatatgcaagcctcacagaaggcggtggagtgttacattcgaggcctgaaaaagatcatgaagctgcgaacgaattcctgagctttctctcttttccattttatccctggcacaggcaaccagtcctctttcgccactatcacgtcgtctataattgcttaagctatgtctgacaacggaaatacacaagcctgcgtcgatgacactcgcccctgcgtcaagggctgtggtttttatggctctgcccagacgggatatatgtgctcgaaatgcttcaaggacacagcaggggtcacacgtgcgtccattgaaagtgtcccagtattgagcggcaccagcagcaccgcaatg

SEQ ID NO: 1544 - DNA, 703 bp, Nannochloropsis_gaditana
tgatgctgtccaacatcagataaagattgtcttatcacaccatgatcaacaacgttttgaaacagcctgtatttccattatcgtgttattcacacagctcttaccttcatgagggcatgttctcccccctctggggccgtcccgtgctcgtcgaagagatatagattcatggctcccacagaggagcctccaatcgttgtcatcggctctggaccttgtggcttaggcgctgcacatcgtttgcatgagattggggtaaaaaactttatcgtattggaggctggctccgaaccgggtggcctgtcagtaacggcaacagacgaggagggcttcctttgggatatgggtaagtttcttctacctttacttcgttcattcaaatgtttgctttccatatcgtatcaataaagtaaatccgcatcaaagtgtcaattcgatggctttcttgatttttcaatgttaaaattcacgatcgagtcctcatccctatcacgcaacttaatgtccaggaggccatgtgatcttctctcactataattactttgacaaagtgttggaccacattgtaagagactggtgtaagcgagagcgtgtgagctatatctggcaaaaaggtcgatttattccctatccttttcagaacaatatccaccgcttgtccgcggaagactttcacgagtgcatagacggcctcgttgaaatg

SEQ ID NO: 1545 - DNA, 703 bp, Nannochloropsis_gaditana
cgatcgtcgctccttgtgcaccaggtccgcgatgtaggcaaacgtgatagtgaacgtggaagcaaagacgcctgacaagccctgagccacagcgtaaatccacatgctctgcgtcagggccaagctagaaatgggcagggttgtacctagtacagtaataaaaagcccagtccgtcgtcctacgacgtcgctgagcttcccaaacaaggggcatgccataaatgccaggatgcctttcgccgtctcaactatgcccaagacatggtacgtgtagtttccaaaagcggaattcatcaggcctggcaacaaggcacggctgagactgagcgccaagtattcaaaaaagagaaccggaagcacgtacaaatacctccgctcatctaccgtgcaaggactgcttgtagcgggggagggacgggacgtgcgagtggcagcagaggtcgcgcgcgccgcttctggtatgagtttgggtgatgacacaacggaagagaaaaatgcctccgaccgcgcacacaactgcgcgaacgtgcttgtggacatgctgtatcgagggaaactgagtaacgtgtatgaatattgtggtgagttgtcatggaacagggcaaggcgggcgatttcttggcgaacgtacagcacgaggaggggcagtgtcgatttcaggcactacccaatgcgaacaccaccctcacttcattacttgaca

SEQ ID NO: 1546 - DNA, 703 bp, Nannochloropsis_gaditana
tttttatcgtaatgaccacgtacccttactgactttaacgagaagatacgttatgcaagatgtaatggttcccaactatccatcagacattacccttgtctcttgtcccatttctttgacgtgcacttatcttaaaacttcctcttccgttcgaccgtgctagctccttcgcttcagggacgtggttaccacgacaaacatcactcacaagccacctcatatcgcggaacaaaaggaaaaagcaaccctcccgacgacccagaccgccgctggttttcgataacagaatttcatttacgaccttatcacatcacatcggtgcccacgaacactaaaattcggatttctaatgcacattcactagcttgatggtcaaattgttggaaaaggcgtattatggcggacgactcggagcaagtcgctggtaaagcccgcttttgtcgtacatgcatgatcggaagctatggcaagaacaactcagcagaattcgaacgagtccgcgaatctgttacctgcaagctctcacacatacaatgggaatgggaacacgtcttccatcagcatcacacaagccaaagcccgaggcttgagaaacaagcactttcccggccccgggacttacgatgaacacattcatgtcgacgacgtccaactctccaaagcagcgcatgctctggaaaggcaaaaccatccgcacgaaatg

SEQ ID NO: 1547 - DNA, 703 bp, Nannochloropsis_gaditana
tccacagctgacaaatatgctttttcgtggcgtgtgtcttgtgccataagggagttcaagtgcaagcatgcgcatggcctgtttcttacctcgagaccgatgtggggacgcacaactatacacgggcagcagtgacgcaagaataagcccgacacccaggaaatcaagcgctctggtggagatccgtcgtatacacgagacaccgagttgcctttcccgcaacggcaaaacgcgcatctctgcttgatcctcctcccgtggtcggagagctcaaagcgcacgtcagaccaaaagggacatgagaacgctcccgcgccggctgtcaatcgcaagacgccgagcctgtagctccgtggaccgttgagacgtgaggacttggggcttgagacaacagaattggacatgcaaccccggaaagagttgaggctggggcactgggggatgccctaccacggtgacgctcgcccccgagaagcattgccagccccacgcttggcgcccggggaaaacgagcctgtcggacggtgccggacagttcctggtcctggatgtgcaattgttgaaatttttagtccagttatgttgtgatgattggtatctcggggtcacctttcacatcttcctgtacagggcctttgctcttccatacgcgacaccatccaagactgctcctctatcaggacctgaaagcaactcaagtatg

SEQ ID NO: 1548 - DNA, 703 bp, Nannochloropsis_gaditana
ccgggaataacgtcttgtgaaactgagtgtgccaaagcctcgagtctgtcgtcgacgccagcaaggcagcaaccatctgaattttccgcgtcgtgacaactaccctgtgtctgtaccttcgaagccagccccagcttacccccagttgaggaaaacggcgaggccattatattctgacctttgttctttgtgtagcacgagatgcgaaaatgtaaacagaagtatcaacttccccttggaggcgggattcgtcccctccttttaaccgtgcaatttcctttccgtcacgtcatctcttccaggaatgtgaactttcacagcccttatgcgtcacggttattttttcaaaattttgcactagtcacgcaatgtcttccctgcttatgagatgtattctttcttccgtactcgactcctcagtcgccgactcgcctccctctcgaaagcgacgtaccacaggcagtgccacactatgaacgatccgacaagtgaagaggacacaccgataacaaaacacatttttgtatctgtaatatgaacgattcgtccacactatgatataaggaccgtgcagctgccaccggaacgcttgcacctgctttgaagttctcagctgagaaagcctctcccatcctcccgtcactttccccatcatcacatcaagcccattgctttccgaaaaattggcagtcacaagctcatg

SEQ ID NO: 1549 - DNA, 703 bp, Nannochloropsis_gaditana
aaacgctccagagcctccagcatatcgtcctcccgcgtgaactccaccagtcctcctcccttcctgtccacgtcggagtagcacacgtcgccccccgaccctcgcatgtggtccttcaggtcttgccacgacgccgacgggggcaagtccgtgacgatcagctgatattccgtgcgcttccctccccctccccctcgtcctccgcccatcccacgatcgccgtaaggccggtcccctccgtacctatcaccgtaccctccgcctctccctccatccataccctcctccctccgcccataccccccccctcccctcccctccccaacccacctcccctcccgccgtcccgccccccccgccgcgccatctccacgcggagcctgttcccttcctggagctggtagttgtctcgtgccctcacagcatcctcagcgtcacggcgatcgtcaaaagtgacaaaggcgtaggcggggggcctgcggaagaaggcagaggcgtagaggatgtggcgggctatgaggcgcgcatcgtgatatagaatttgaaggcgcaggcttccacttcatcgggcagtccacacggcatactctctcctgacgcttttcctatccatgccttccacgctgttgatcgctgacagtccccgcacaccctttcctcttcttcttctccttgccatttcttccctcctccctcctcaccg

SEQ ID NO: 1550 - DNA, 703 bp, Nannochloropsis_gaditana
taaggcaaatccaagtacttaactccacatttgttgccattaagtgtcatgcaggaagaatagggtaagggctggccgcgacagtacaggaggttttgaaaaaagtgacaacaagttcattaaacaaagtaataatggttgtagtgaaaaggagggggggggattgaatcggtatacagaagaagtcatctctcgtataattgctggctcacagcaaattttaccacataagcgtcgaacatgaaatcatgtgttattttcccatcccctcctcgagtggatcatacgtagaatacgataacaattttaaggagtcgatttaatcctccattggaactaaaagtagacccactatccacttttcaaaaattttccgacgaaagccgtcacgcaatctcaaacaaatgctgtctgtccatttttgctgcattatgttcccatcgaaaactaccacgcacttctaaggaagcagcgacgaccgagaacttcaatctcccggcctaaggtaattcgccgccgcgtctgaactcacgcccacagagacattcaataataccatgtttatccctttgtattgattcgcatagctcttgatttgaaagatgctcggtgtgaagccagagtaaagtatttctccacatacgtatcaacctcccccctttgctataaccaatatactgctccaagcattgcaccacttatg

SEQ ID NO: 1551 - DNA, 703 bp, Nannochloropsis_gaditana
ggtcgaggcggcagggctccaacatggcttgctggagggagggagggagggagggggggaggggaaatggatgagtctgggagctagggacaatgaggtcgatcgcatgatggaggcaacgttcgtgtcaggtcagaagcttgggtcgctcgtgtcagagggccatccccacctcctcgcctcccactctccataccccccgcgcccctccttcccgcccagtccgacccacctcgagcaagcgcgctatttgtagtcccctgccgcgtgggcaggacagggtggcgagcatgggcgagaggccgtcgtgggtggggatcctggggtccgcgcctgcgccgaggaggagcttaacggcccccacccgtccgtacaggcaggcctggagggcattgcattttatcaacatgattgtccatgtgcctggatatcacaccccaacattgtgctacaaggagtttgtacggattgcttcactttctttttcatatctctctctcgggcctcgtccctcccctcgccctcaccttaaacaaagccgtcgcgcctttcccatcctggcggtcaatactcacacgacttccgccactccatgttttcttcgtctcgcttttccccccacgcccttgatttgctcccctcctgcgcgtgaggagggcctgcatgcgcccctcgaagcccaaggccgccgcctccatgagcg

SEQ ID NO: 1552 - DNA, 703 bp, Nannochloropsis_gaditana
cagaatctccttacgtaacctacctatcctagattctatcaacacgtgtgctctcaacttgtattcctctcgtaccatgcgcaagctccctttcacgagcgcacacatcctacaagccgcaactcgacgtggttccgatgtcgatggaatgcgcgaaagctatgattgtttattggattgtgcgacctgatcgatcttctgtcgacagaaagctcaggaggcaacgactcccccgcgtggccgccgtgtctttggtgtgagaagtgaggccttgacgaaagaaaagacacaacgccatgcaaattttatgaggatcaatgcgtcttggcatgtgtgtgtggatttcctgtgcgtcgcaagtcttcggtagcgcagctgcgcactgtccgcagctccggcgtccgaaaagagcgcgtcgtcgccctcatgcgttcaattttgcggtttgaaatggtcactttgtgaccggcgccgctgcaatgcatgatgagtatgccaggtcatgcattgtttgtgctctgacctacacgtggtcggaacgcaggtctgacggcgcggtccgccaatggtttcttatttaaactcgctatgggctttcgcctcgacggtcagcaacccctttctgtccatgtcccaccatgcccacacacacctgcacacgcacatacagttacaccaccatccgtgcattagtttcatcatg

SEQ ID NO: 1553 - DNA, 703 bp, Nannochloropsis_gaditana
gcataaagttttcagccgaaagcaatgaaaagaggagatatgtaggaggttagtgagaaaattttattgggacggttagcgcaccgtcccatgtatgacggaagatggtatcgatattcaagtttcaaagaacaatgaaaattaggctcttcagaggaacatatgccccgatttcgggtaattcagggcgctttagcggcaaactacggtttgtcttacctagtttcgacggtagcctcgcacttgctttattaaaactgtgtcctaaatgccctgtctgtgcaggtttctgcgtggtacttcccttaccgaacgtgggggggggacgggaggttaaactcggtcttatccgttctcaggagccaaaatctcccgttcgaagtaaaaatgtggtttttgaaaaatcaagccccactttctctcaacttgtgaatctggttgattgatagatagaatcagccaactgatttgactcatgagtggatgaagaaattaccttcttattagattgccataaaaacccgatttgtctcttgttattccctttggcgttacacagaacatgctgactcctctgcactggatctggaatggacctctggccttaggatgggtcacttcatcggcaatagtatttccaattttgcggaaagtgggtcttgttccggaggcgaacaagcttgacttcatcgcaaacgacatg

SEQ ID NO: 1554 - DNA, 703 bp, Nannochloropsis_gaditana
tgtctcagaagacggaaaacttctgacgctaccgggctttcaaaaaggcacaatacctcgcaaccgggtgagaaaattcagatctaagaaatgttcttctcgtttgaggcgcacatgcgccataagttcggttttacttcatggtaagtcttgcggaaagcagcgaattggtggcagggcccctgactcgccggcttggctcgaagccgaggtagggagcccccccgtcatgcacgatataaccatcctgcccgcactccggtccttcagcaacgtcacagggacacgcattcgtcgcgattgccgcccgtttttctcacaaggtccttcgtccggaagaaggtttttattcccgtgtctttccttgacgtccccttagcgtgaccctccgtcgcgggtatcgcttgagaaaagtcggcgacgcgacatgtcccccctccttcttcacgtgctatgtccacgctgccctccatccccaaacacagggtccgagaatttgtctcctgaccgagactgacaaaaaggtgcaagcaggagtacgcttaacgaggtcacccttcgaaaagacaggatgcaggatcaattagccgcggggttgccagcgtgacagcgtatcagtgcagcacttcttcacccacatcggcgagcttctttacaaaggcaccgcgaaaaaaagcactgctgagcgcggtttgccatcatg

SEQ ID NO: 1555 - DNA, 703 bp, Nannochloropsis_gaditana
gctcagttcaaatccttaggtgtcatagaaccggtacgtttcttaaaaaaccttaggtgtcgtagaaccggggggggggggcctgtcttgggaatgtacttcttcctttcacggtcgtgtgatgctctcccttcaggaccggaagtgaggccgtgaacaagtcatggaaggaccattgctcactccttaacctgccaaccaatcgctgaaggggcaccttccgtatgcatgtgcgcagagctcaataccctccccctgcccatcacttttccattgtcgctcctcatcccctcagagcaaggatttagacctccaattgatgatcaccaactacacactcccggccctggccgctggtcttcgggacagggaagaaacgttgcagttctgcgcgcgactattggaggacggcaacctggagcaattaaagcgggtcctccacccctaccaagctgaactcatcacccgccgtcgccggaaaacccgcagcttggatttggcaggggggctgacgtcgaagcacctgaacatgttgcggaaatacttgcagcgatccccgcgccagctgacccgcgcggtctccctgcgcgcgtcggtggtgattccactctgcaatgtgaacggggtggcctccgtgctcttcgaacgccgctctcccttcgtccgctccttcaagagccaagtgtgtttcccaggggggatg

SEQ ID NO: 1556 - DNA, 703 bp, Nannochloropsis_gaditana
tattcaggggctgaaagataacaagccaatgttgccaatacacggggatgtggactactacgcttcaaaagaaaaacttggcaaaaaacacaaaaaatcgacccatagatttaacggatatggtcagtgaagctgaataggacattttgatatttttacaggaggccctgtggactttcgaaaattttcatctaactgtactacgtttttctgaaagaaagccaaacaatgagcttgaataaaaatgaactttgcgcaaagaatagccaagcgaattgcaagaataggaggatagtgatttctttacaacaaaataaaatgaagcgggcaaaatggcatcgctttccgaaacttcctttgttttgtttttttttttcccttttcgcccgccgcgagcgagctctcgcttccgttgatgcaagtctgtgtcgcttgacatgtttataaataattggtcatcttattttggaatggcttgccattactagcacaagccattgttttcggactcattatttccttcacgctgcagggaagggggtctatttcgtaccatttcgggcagtgaaggtgcgaacggtgtggatgggagcactacgtttttgatttagggcagttttagggcacgcgtggtcggcatctcacctacctcctccgtcgtggcgtacttcgtgccgcacatttgcagcgacacgcaagaatg

SEQ ID NO: 1557 - DNA, 703 bp, Nannochloropsis_gaditana
gtgtggatgggagcactacgtttttgatttagggcagttttagggcacgcgtggtcggcatctcacctacctcctccgtcgtggcgtacttcgtgccgcacatttgcagcgacacgcaagaatgggtttcgactacgctcgaagtgccatcataaagtctcaggtggtggccatagccgtggccttggtacgtacgacttggaggaagctgtcggagaggtgcaacctggccttattcgtttataagacctgctcaagcattgtgcctcgcgtatccggcatagttcatctctctcgtccctctataggttgatgccgcacaatcttcctttcgatgtctttcaaactttttctcctttttacccatcctatctgggtcgtctaggcgctggcgcttgactcccccggcctcctgctgctttatttctctcaatcggggttctccacttccaccgcctacaaaaatggagttgcagactatagtttcaaaaaaagtgtcagcgatatcttgggtttgaatttgctaaaagcttgcgtgttatgcgccttttggtcctttgcccatgggcggctcctggctctaatcctccctgtcgtagcgacaggattttgcctgattaaaatggccgtctatgatgagtggaactcgcgcaataaaactgtaccagcggtggtgatggttctatcctcgctttccgcgatg

SEQ ID NO: 1558 - DNA, 703 bp, Nannochloropsis_gaditana
cgcgctgggtaggggccatacacacggtcgaggaggaagatgagacggaggcggtcaggtcgggggggttcccgccctcgtctgcctccatcagggaggaagagcgggtgtccgggaaacttggtccttggtgcactgccggtcgggaggtgggggcatgcctcccgcccagggatgccgtcgctgtggccgccgcggtgccctctcgggtgatgactgactgccgccgcccggcttgcaaagggccccacccgttaacggtcgaggcctccggcgaggtatttggcatgccaaaagccgcagccccgtcgtgtcttcttccagagggtcccacctccgcctcccccacctcggctggctcctccaaccccaagagcttcctccgctccatccggaaagactctacctcccgctgtatcatctgcttcagctggcccttgttcagatgacccgtctcgaaatcaaagtccagcttggggggaggtcgtgctgcctggacggcgtctgcggccaattgctgctgctgcaattggaccgaatgccgcaaaggttcgaagtacttgtgacccaaggcctgatcgacggtcaaccggtgggcgggttcaaagacgagcagggagttcaaaagggagagggcctcgcgactcgcctccgggaagagggtggcaaaaggcactttcttcttggccgcgacagagtccaa

SEQ ID NO: 1559 - DNA, 703 bp, Nannochloropsis_gaditana
attggaccgaatgccgcaaaggttcgaagtacttgtgacccaaggcctgatcgacggtcaaccggtgggcgggttcaaagacgagcagggagttcaaaagggagagggcctcgcgactcgcctccgggaagagggtggcaaaaggcactttcttcttggccgcgacagagtccaagaaccgcttggcttgactgctcttcacgtgggcgacttcctgggggcggggggccccgatcacgtcgaagatcaaggtcagctgatggacgaaatttttcccagggaagagaggcttccgtcccagcaactcggcgaaaatgcagccgacagaccacatatccactgcgtagtcgtagaggccgtcggggcacagcatcagctccgggggccggtaccagcgtgtgacgacgtgctccgtcatgggctcctcaatggactcgtccgggttctgccctttcccggcggggcgggcacgggcaaggccgaaatccgtgatccgaagctcgcaggcccgggtgaccaacaggttccccggcttgaggtcccgatggatgatccggtggtcgtggagaaatttgaggcctttcaagacctggtgcatgaagaatcgaaagtgggcatccgaaagagcctgcttggattggatgatccggtgcaggtccgagtccaagagctccatgacgatgtaaagctcgtcgtccgcgtc

SEQ ID NO: 1560 - DNA, 703 bp, Nannochloropsis_gaditana
acctgaaatctcatcatttcccgtccttgacattctctctgttcttgtcccatacccgccataccagactttgacccgaaaatgataatttaccagatcatcgccctccaggtaacatccaccctcctttttcctacagtgtgcgttgacgcgtctcacggcctcgtgacttctttccttctttctttttcttcccgccagtgcctctactatctcgtcgaaggaggaatcctcatggggtttaatctggtctttggcctggatgtatcgctggcccagatctttacgccaagaggattggagatcgagtcggcggaagggctgctcaatgtcctagcgctgttattgtcgtttgtcgcagggtacggagggaggaatgagagggcggggaagaggaggctaagctctgtccttttggggtacaattctcaatctttgaagtctggcttattgtagctactaagaagtgctgtatggagatcatcaattaaatgggagagaaataaagaggtttacggaagggcacctgtgcagaaaagctccgaatagaggtctcccacatcgccatgcatgtgcgacaaattccaaaatcggttccccctttcgactctgacaggtcggttctgctttgcgtggtggtggagcgggctaagaagtgcctcgattttaccgtcaccctattttttttccatctgctggcatg

SEQ ID NO: 1561 - DNA, 703 bp, Nannochloropsis_gaditana
tcttggggcagagggaagggaaggagggcgggggggagagcgagggggagagcgaggccccgacggaggaagagtttgagggaacagaggatgcagctgcagtggcagcagtggcggggagacggcgtagcagtgcttcgaacggggacgggggcggcttcgcggacgactggggtgcagggggagccgacgagtacctggacgagggagtgggggaggagccggtggaggaaccggtagaagaagaggtggaggaagcgagggaggaaaaagcggaactggtgggcacgaaggagaagaagaagggaaaaacggtggctcgggagaagaaagcggtagagaggaagaagaagggtggaaagtcgcaggcgtcgcgacccagggcgccggagtcggagcgggacacggaggtgagctcctacgaggatgaaggagaggacaaggaagagcggcgaaagacccaggagcgctttcgacgtttgcggctgtccgagtataaccgagaaatgggcgggaaaagtttgttgcaggaaggatcgggggagggcgggggggagggcccggtgggggagcggcggtcgacgcgtcggaaggtgcagcccctgcagttttggaaaaatgagcgggtcttgtacgcggtggagagcacggagggggtggatgagagacggaggcgggaggaaggcgggaaggagggcgggag

SEQ ID NO: 1562 - DNA, 703 bp, Nannochloropsis_gaditana
gagtgagtgacagggcataaatcgcatacctcggcttctcgttgacgaagcgatcggcctttaaaagagggacgggggaaaataggcggcgaaatcaagacacgtaacatggattcagccgaagggatttaccatcacaagtcctcactaggacatttataaccaccacgatgtgcacggcgaaaataaaggtggaggtaaatttcggagatttttatgagattggggctaaggggcctgacatacagaaaaagctggcagccgttcttattgattttataattatcaagcgcctcaaaaaagtcaacagagtaaggaggaaaaagtcattgattgcgtgtttgcctcataagaggaaagctggaacagatttgcgtgtttttttttaagtttgcagacagggagcggcatagaacagtggatgggccgcttaatccgattgcaggtgtctggagttgtatttttgcaacccctgccgtgactcctcgcgctgtactgcaatgcgacgccacagtacctttccagtgtagtgcctgtcagttacatgcttggccacatttcctggcgccgtgcttgctggatgcgtgctttggacgtcgatgttcattccgcaggatgtccggatgcctgacggctttctgttgcttgcacagtgatcgtggtcgtcaagtacatagtctaaatttctttctctcaccacaaa

SEQ ID NO: 1563 - DNA, 703 bp, Nannochloropsis_gaditana
ccttggagtgatgcggggatcatgaatcaacaatgcttcgaggccgttgtccagcgtgacgaggcgataatgcttggggtccgtcacaggacgtgtcccatctagactcaaacgggacaacaccttgagaagcggcggcgcaggcgaatttacatagtcgacatccatttctgtcccttttaatggcaaacttgccgattgtgtggtgtctacttccatacggagcgcacgaagctatggaggcctgaatgcgataaggaaaggtagcaaatgaaaaattgggtctttttggaagaaaaaagagccatacagagcattccctgaacatggagacaacattcattcactttcgacggaaaaactcgtcttcagtcgtacattgaggacaattatcttatgctattatattggacccctgctagcaccgacgatgcaactcgaagcgatggcttagcgaggtgctgtttagttcgagacgcattacgcaacgattggcaaagtccaccgtcgcatgagggcgactggcaatccgcagggctgtgaaagtttgtgagatgaccgtaactggcccttgtttgacaatgatggtcttaacagtccttccctttgcgaccccccccccgtcaagatactaccagacccaggaacagagaagttgacgagcagcacaaccacccatagcgcgcggactccggtcaagatg

SEQ ID NO: 1564 - DNA, 703 bp, Nannochloropsis_gaditana
aattttgttccagaaagcaggatgacgaaattatccctttcatgcgcttttaggagttacatcaagccggaaacgtgcttcagcgccacactcaggaggtttaggtgaggcatggcagcagaatctctcttctcctccatcagtgtcaatcatgtgtcctatacagaaacatagaagacatggtcagcaaagagacccaaaccatgcattaatcaaaattgggggacaatcgggacgtatattttggtgttgaggttggaggaaacagcggctcggatcggagggactgtcgctcgctcagccactaccaccactacttccttctttttccctgtcgcgtgatggtctggagacggcttcagtgggcacggtgcaccaatctctgccatggtagcggtgcatattttcgtatgcgtggaggaattttgcccggaagattttcacaggcccgcgcagcatcccatgttgtgtggattgcccaccataatctctccttacctctgcagcagtacgtccgcagacaggcttcacatatgccgacatccctctcatggatgaaacactcgaactttgaacaatttcaagctgggtttttagctttgaacgtgcctgttctgctgctttcgtcgtgcttctttccatgctctgttaatcctgctccttcctccacatgccgcatccgcaggtttgcgttgtagccatg

SEQ ID NO: 1565 - DNA, 703 bp, Nannochloropsis_gaditana
caattcctcagaattgggatgcgttgaaagaaatgcccgttcgagtacgtagaggtcaacagctttgtcttcaggcaggggttgcaaaaaacctaggccgaaatcaatcaccacgagccgatgacttacgtcttgtgccttgctttttccgtcttcctcgcccatgaccataacatttgatgtggtcaaatccccgtgtaccatctcggcatcgtgaattcttgctaccacttttccaagctcatcggccaattcgtgtgctgcgggcgtatacgaacgcgttgcatcattaaagtggtcgcgtaaaaatgccttaaaggagcggccttctattctctccatgtaaattctggatgcttgcatgtcgaccatatagacacagggagcgtgtacccctaccttcgcgcaccgtaacatacatcgcacctctcccacagtgcgctgttttgtcagtttcgcgtccaagacaggaaggcggtaagacttggcaaatcgctctttgactatagcggggcgacctcccaaaaaagagggtaactcgaaaactcgggcctcagcaccttgagacaaaagaacaaggccgtccgtactccgtgagtctactctggcggaggatgatacggccattttctgtatttcatgcgttaagatagtcagattagtggctattctaaatcagaagctaactgaaaagacagtcgtc

SEQ ID NO: 1566 - DNA, 703 bp, Nannochloropsis_gaditana
ggacgtgatggagaggaggaggaagaagaagaggacacaggggcaaaacatcgtcaattttcggggccgcctcaaacaggaccagtaatctaagagaggaaggcaagaaagggaggtagtgcagagccggggaagggtgaggggaggagttgtagtttgcttttcttgaaagacaagacacaagaacattgaatatgatcggtatgcgaaaggaaaattgattttgcgagcctgcacttcagacgtgaaggcctgtctttcaacctcccgccgtgagaccatctgggatttctttttctccgaacaagtcactactcacagagaagaatttaaaattcatgctaataccgcaacacaatgatggtcatccagaagacatcacacatcccctggtgcacgaaaaggtccttgaaggatttttttgcgaggagagaaaatccccgctaaaccgacgggaaacttcaaatccaacttaatccccgaaagtcctaccccccggcaccgtctctttcaagcaaatgttttgcaaactcaagctcgaaggctgattaattgatgagttttggtgtgtttggtgtacatgtatacctttagaacgattgaaatctgacataacaagagcttttgcgatgggacgtgtgcaacggcaaattcttgttaccctctttttcactttcccgacattcgcacaggtagcgctatg

SEQ ID NO: 1567 - DNA, 703 bp, Nannochloropsis_gaditana
cccgtggtcaacgtaaatgtgccagtgaaagcagccgcggcaccccccagaaagcctttggtcaataggttacgacggtcaatgccagcaagaaaggtaggggaggtcgcggaggaggtggaaggggaggacgccgccggctgggacatcgactgctggggctggctttgggacatgtgcaaaggccggatgtaggcgtgcgaaaggcagggcgctcccacgaggacagtgagaagcaaggaggtagcaggcagggtgaacatgctggacagcttcatggatgtcggagccacgtagtagatctggccggagggggaacaaagagcatgagaatcaaaaagggggacggccatgtaacaaccctcctctgcacacgcacgcatgtttgttacatccgttgtagtaaaggaaaggattgtcaggttgtattggcccgccaagtcacacaaacgagtaaccctcgccctgagcaaaggccttcctgtgcaacctcttgagcgatgccactacttttactagacacaaacctcactcaggacttcgacgggtacatacatcgcgcgccttcatccctggatctaaatgggactccacaagggcctaagaccttgttttcatgtgtatgcataaattgatcacactgcttgcctaaagccatgtcatccgctccacgctctcactcccgcaagcttgtggtttcatg

SEQ ID NO: 1568 - DNA, 703 bp, Nannochloropsis_gaditana
ggtcgtctgcattgttgttcatgtccttactgcccaaaaggtggggaattcaggggcgaatcacatccgtgtgcctgcaggttcctccaccttgaattgtccttgacaccggaagatgtcaaggcacatgcccaagtaaccacgcacggaaagcgcctgacaaaccgacaacctgccgcagaatatcccccacttctccagctgtccaccgtgctcccaacacgaaaaaaatggcgtgcaaagacgcggacaattttccccagtcaagggggaaagcgacgcgagttcgccgcctccgtggggtccacgtaagctctgggagggggggccggaaaagtaccccaaagtatcgtccgcgtaaacgatgacgacgcgtgcacaccaggtaccggtggcagcatgtagacgcactgaggcaggccaggagggatgtgcatgcttcgtgcattttggggggggcaaaggaagggattatttttttgacgacggacatgttttgacaccggcatggagcgacttccggtacagtgtgagtttcgagatgagaaacacgccctcacgttccgttttttttacaattcacagagattccatacttccagacgatgcagccacagcctccatagcattacttccctactggaggacgtcgttgtgcggttcttgtcatggcctctgacttttccgccttccgggcaccccc

SEQ ID NO: 1569 - DNA, 703 bp, Nannochloropsis_gaditana
aagggtcagggggtggacggtagccgcgggggcggaataaacgacctcggaagtcgggcggagcgacaaaattcgagtgtcgggaatgattatagaaagagcagcaatggaaatgacggtagggatgggaggagcgcccatctcggccgagacaagaagtcacgaaattctgcctcgggagccctgacgaggcctgcgtccaacacgggcaatgggggccagatggaagccccagcattccaacaagcagacgacgaattgacggagacattgttcaatcaattcgacaactacgcagactaccttcctatggacgacgtggttgccatgatgtcgggatggcaagaggcagggggcgaaggaagggggggaaacgggggcgagcggtctctgagtgacgacggacagatgcacttacagaccccgctcgatgatgaggtacccttgcccgccgctgtacaaggcatgctatcgcacagtggggcctcggaagaaggagtggtgagtgcggggttgaaaagcgggggcagccaagggagcgggtttggagtctcggatgccagcagcagcttagccgacgacttcgatgacgacgatggagacggtgattcccgcttagccatctcagtgggaaaaggaagcaagcgccatgaggagagaaaaggaggaagcaagaagtcacatccgagggggggacatggtg

SEQ ID NO: 1570 - DNA, 703 bp, Nannochloropsis_gaditana
gacccacagcccatttttgacctcacgaggcattgcaggatctacgacgtacgcgatcgagtcatgctcacacgtaccctacctaacaggctctgagtgtacatactagtgcaagcgggctgtgagctcaaccgatgacttgttataagggggtgtggccctcaggtacgtcgcggcgcccagccttcccacgtgaatgagatcgtgaggtggtcgacctggataagtgggtttaacctcctcttactcgaccccaccacccttacttcgtctattttttcctttagaacgtcgatacgcggtcgtcctaatgcttgcaatcacgctgcagtcgtgccgtggctttatgagcccgctccgcggacgacatagcaaagtccttggctttgcgacaaatagcctcccgaaaaggtggggacacgtttatgcatcggtcaactcgcatgcccgctcaggatccgtgtttaacataaagggtgattgtcatgattgactgagtcttttatctccttgtgcattttcctcggataccttgaacgtgcttctcatttcaccttgccctcgcctggatggcccgtggtcccccactagatgccccaccaagtacccactgccttccctccatcgggatgggagaataccttttgcgacctcgtctagcgaccaggaatggcccgccaaccgagttcgccagacattcatg

SEQ ID NO: 1571 - DNA, 703 bp, Nannochloropsis_gaditana
acaggaagatgaatctcccgtgaatacatcggcacactttattttcaaactgcatggtccatccagcaccttcactccgttccatagtctatgtgagcagggggggaataaaggccacaggaaagcgccgcatcctcgttgcgtgatgctcgtcatgcctcgggtccagtcattcgacggtttaaacggtttttaaacggttgccccgaaactttctgaaagattcggggctcagaaccccgcggggtgcacttgagcacattgtccgtgggcttgtaggcgtgccgggggctccgcaggtccatcgcatgggttgggtcgtgtggttgattgatgcgtagagggaattgatgtagtggagggggaagagaaaggtgcctgctaggttctcgtgtgtggtcccctccatatggctgacgccgctgtcacgccgcgccgggatgagctcccccttttctctcgccattgaatcaacgtgattcattgccaagttgcacgatttgttccttcacgtgcccgcgaaacaggccatatatatctctcaatgctcaacttatgcattttcattacaaatcttacacttgcgcaggcgctggcacagttgaggaccagccacaaacagccgtaatttacgggaaagtagaaattcctaaccaccaagtctcgcaggtgcttctttgcgctccaacacaccacaactatg

SEQ ID NO: 1572 - DNA, 703 bp, Nannochloropsis_gaditana
ggaaattcatgaccccccaccgaagcgacaaagacgagcagaaatttttccttcacggagagaggggcgtggatgccgcccgcgacagggggagggagcaggagggaaaggcggcccaacggcgaggtcgaggaggagggagggagggagggagggagggagggagggagggcgagaatccagtcgtcggggcggtcgataggccgacgcagggtgggcgtaggagcgggaggaggcggaggaaagccgccggcgccacgagtggtaaaaaagcgcgggaagaatctgcgtcacccatggcacggacaaggcgctgacaaaggcgagaagggccaggaggttcccgacgaccagggcagccaggacaccgaagaggaaggagggcaggctgaggaggaggtagaggccaagcgcccggggggaccaatcttggaggttgaagcgcgggcgccagacccgttggcagtagcggacgagaggcacggagtcgagggtgtaagagaccaggttggcgaggaggacaagggcatgcatgacgcgtgaaacggaggcggcggccggccacgccgggagggcgtaggaggggtcgggaaggtcccacccccaccgatgcaccaacggaaagcccacgcccaagaagagaaggaagagaaggcccgccgccagaaaaagggcgcgagggaagtggtggggcgcgggcatg

SEQ ID NO: 1573 - DNA, 703 bp, Nannochloropsis_gaditana
gggatggtgactttaatgatctcatacaagccggagccgttcaaatttgagacaaatgcttctttggctgccttgtagtcggcaggctggatggcaggcatgctctttcttgtcttgccagccgcacctcaaagaccgcgtagtgacaaggcggtgtagcgtagaagcggctcttatttgcaaatttgctggcgcactcaagtgacactactccagttgctgcggctgaaatggcagctctttgtctcttgcagcagctgctgcgaagagggtgagatggtgatagacctgaaattcctctctcattcccctctagcgggctccagcatgctgtgcgacaatggcgcgggagaggtagcgacggggagatgatgctgtctactgactcaacttcccgagtcacctgcagggagtatcatgaccaggttgaaaggaaggttaacgcggtcgtcggtacattgtgtcttgaaccacgtccctgagcaagctgatgatggaaaacatcggacaggacaggtatcagataggaggggactcgcccgcgtgcctgcctattcgctggtttcgcctcggtatatgtcctctgcaccctaggacggcaagcgcgcgggcatgggcggctctgacactcatgccagctatgtaaatgtaccacatctcctgacagcagaaggaaattgtttagctaccccaccgatcgatg

SEQ ID NO: 1574 - DNA, 703 bp, Nannochloropsis_gaditana
tttcaactcattaggtctccagacgtacagtcgccgtgcagtgattgatgcgcatggatctacataccattctttcttgattttgagacaaaacaaatgaaagctattgtagacgacgtcggaatattgatcagtgggggggtactcattactttgtgcgcgcggttgatcgcgggtgtatgtggccgaagacgacctcacatagcccaaaatactgagcggcggcaacaaaatgaatctctaccaaccaaaacatttaagtacgatggtaagaatcggagcaaagagtgtcaaggcagcctcgaaagttcaaatgctcttcaggaacctttgctgccgaccccgttggagaaatgtggccagaagaccgatgtttacttgaagcggaataaaggcttggcttggtcccgggaggtatttggcgcggtgctgtttgtcatttattttgcgcggggatgcatgttactgcgtaagggagatgcggacacggccggtgctcgtttgatccttgtggcgggtggatggcttgtcctctcccaattggaggagatgactggattaggtagtccaccggcagcaagcatatgtcgccgcatggagaggagtagagggggcagtccgggcccgtcgaactccatccaaacacccacactgccacaaagccccgcgtggctgtctctttggcttggatactgcttttatt

SEQ ID NO: 1575 - DNA, 703 bp, Nannochloropsis_gaditana
ccttgccgcactcgcgaacgtccagcagttcaatctggtccgtcgtctcgtctttcgatgccgtgcagcattggtcggactcattctccgacaaacgcttcgggtcgatggggcggcatcgacgtattcatcgggacagatcataaatcattgcaccgttgacgcgggaaacagcgactctatccgttacctggtctttttatgggccgttcctctcgagactaccattgccatcgctctcgtattctgggttctgcgctgctggatctccggcgctgtaggagtggcgctgattgtcttctcggtgttgattaccgtcaagctttctgagcgcttgcgcaaagctcagcgggcgttaatgaagaggaaggacgtcaggatatctctgctgggagaggggctgcagggcatccgggttctgaagcttttggcctgggaacgcgacttccttaaaaagttagaagatgcccgggggcatgaattgcgggctctgcgttcttttctgctcatgcggtgcttgatttctatcctgtggagctcggcgccagtgattgttagcgccttgaccttcctgctccacaccatggtcttggatcagcccctctcagcctcgcaaggttacgcgaccttagcgctcttcggtcttttgcgcgaccccctcgctagcttgaacacgtatttgaacagctttgtgaagggtcag

SEQ ID NO: 1576 - DNA, 703 bp, Nannochloropsis_gaditana
aggcgtccgactccacgtcgcacccggggaattcgtttgtgtctatggccccaccggatgcggaaaatcctccttgctcatggccttgctgggagaactgcgcgccgtccccccggccacggccgaaaacaaaccctctctgcccgcacacctgccggccgcccagcccttgaaatcctcatgcggcggacgcgtgtcgtacgccgctcaaaaaccgtggcttctgagtgggacgatccgggacaacattctgttcgggtatccgctcgacaatgcacgctacgaggctgcgctagaagcgtgcgctttacgtgaggacctggaggctttgagcggaggggacctgacggaaattggggagaaaggggtgacgttgagtgggggtcaacagcagcgcctgagcctgtgccgcgccatctactgcccctcggacgtcgtgctcctcgacgatgtcctctcggccgtggatgcgaatgtggcccagcatctggtccggcactgtctgactggacccctgctgcagggtcgtacccgcatccttgtaacgcaccaaatcgccttgacgctacccagggcagatcaagttctagtcttggggtcagactcgcgagtgatcgctcaagggaatcccaggcagacccctgatatgctggacaagctaggaaacatcgctctggcggtggatagggatgggaagggaaaa

SEQ ID NO: 1577 - DNA, 703 bp, Nannochloropsis_gaditana
tgagcagagaaagaaacgtcagcttttggtgtgcttgcctgcttttttcttgttttttgtcccggcatcgctcacctggcgagccggcgccacaacatacgcgacaacctcccctgtccccttactttcgtgtaataatttcctgaatcgcccacctgcttgcgtacctgtacacagccaagctttctacacctccgattagatgatttccctcaattttcagttatgaggtttgcgtccttgtcgagcactcgagcggacaggaggagagacttctagtgcaggccatggaggcctcacttttggaacaagaggcaatcaaggcccaacgcgacgaggagatcgagagtatcaagctcatctacactgacgacttggtgaatgtcctaaaccaccctcaggactgcgtggtcgaggtcaagctgggcgaggcaattgacggggagacgtcgcggaccgtcacccttacggtgtacttacccgtctcctacccatctccgggagcagagatgcctttctttgaagtgcgcggcgtgaactggtcgaatcccaagcatgaccaaatccacatatatgagggcatgcaggaggttttccggcaacaggctggggaggtcgtgctcttctcctggtgcgagtggctaaaggaggagctccatttgctgcccatcacacacagcacggccgccgatgagcaggttga

SEQ ID NO: 1578 - DNA, 703 bp, Nannochloropsis_gaditana
tatacgacgcagttttgacaattttgatcaagcatggtgcatagattgcgctccatgtccttgaaaatagtgagaggtctcattttgcctactttacccttcaaagatctcgagcatgaacaaaatctactaaaaacggagctgggagattgagatagaccgtacaacaccacgttactgtgtcgctacgtaacgactttgactcaagagagtcgtcgtgcattgcggcaccatgatttgtgaagtaagcaaagaggaaacatggaagaaaactaggcgtagcaacttttctcttctctgctaggggatcgtgttttttgtttccaatggacaaaaagctcttttttggtacctcctcaacgctaccaagcgtctcgatcctctccgaggcccatctcggacccgacagacaaaaatgtgccatcgtcaaattattttgacctgtgaaacatatcaaaccctaaaatctcaaaccaatccattggatagacatttggctgtcaacccctcacccacacttgctaggcgaagggaggaatcgtcatctctggtggagaagctcgaatagaagtagtacaagacgtcattcccctgtgacatcatctcattcgacgtcattaccacacatcagacggcactaaattgacacatacgatatcattgcccgcagtccagtccaacatatactttggaggagatcatg

SEQ ID NO: 1579 - DNA, 703 bp, Nannochloropsis_gaditana
cgcgcgtcgtttcccatgccactcaacatgcggcgacctaccgtctgccggtgggtcaagccgcgggctaggttctgatacacaggctccaacggcctgtaagctttgctttctacaacatcgcggcctacgtccgaatcttgcccacctgatttttcctgctcggagtccgagggggcaggaaccggcgtccgtgtgcgagaccagagattacgtgtccagcccgtcacagaggcctcagttgcggacaaaagccgccgccagtccatggcgttgtccgtctccaatgtttatgcttacaaaataaaggggcgtaccgtgagttctcaacggaacatggcttgatgccttcaccgcggactatggcaacatatcgttatgcaggcagatcgcggccagggtgccgtcactcctgactcccaaacatgcatggctttcgtagtgctcgccatgtaagtggccaaaaaaatgtctgcctcctcatcctttcatcgcatgtcacactcaagcagccacgccctcctggtgcgtgtgcgccggggtcactgaaatgaccaggtacctgtgtgctaccctctcccaccgcgtcgctgaaagagaccagagctcgaagaattctcacgtaccgcccatttcccccactggtgctcattttttgcacgcatgacaagcacaggggtggatatcactgcgtacgaccatg

SEQ ID NO: 1580 - DNA, 703 bp, Nannochloropsis_gaditana
atgcccgtgttggcgctcgtcctcgtcccgttggtcttttggtcgtagcgcgcagcatcttgcgcgcggaaagggtcattctccgcccccgccggcacgatcgccgcaccacacattcttccacgcccccctggggaagagctcacgcaagtgatcggcctgatatttgagtacaatggggcggggagggtcgagacaaccgtactggtgttgattgttcagaaggcgtactcccggcaggagtcttgggctgcgtagatctcgtattgtgcctgcaggtgctgcaagctccccccgccgcttgctcctgccttcgaggttgcgctggccccgtgtcgatgccttttggcgttttttgctgagaaagtctgacatttggaagtgcataagttgatagcagcagcacggtaaaattcgtgctctgtacacacacggagcctgcctccaattgaagctggctggtgaaatcactcacggactcatcagttctttgggacctttggttctaacgatccctcgctgcgtcgtgacatccgatatgagctttgtttgtccagaaagccgttgtgtactttaagtcggagctggccctcctgagcatgagcttatacatgtatttgggggctttcacaggctttcacacacacctccccacccacccccgcgcccagggccctttcttcttttccctgaagcaaacatg

SEQ ID NO: 1581 - DNA, 703 bp, Nannochloropsis_gaditana
tctcaaccactatggtaaggtagattagagaaaacaacatatcttacttaagacacaacgtactgaatgcggctcagtctggtaacaaaaccgtttatgcgacacacggtccgtcgaacgtacggcgtacgtaactacgtatcacgggccttgcaaaagatcactgggaaatgaatgaatggaggctcgataatcttgttggggaaataggacatacacgtcgtgtatcgggacccagattggttgtactggtctcactatgtcgcggcacgacttcaaggttaagatccctctgtcgcaatatatcgcccactatccttgctccaacgtacctgtcgctgagttgagtgctgggcaggctggaccacggctgaaatccaactatcggacaggcgtcttggaagcaatccgctgaggagggggaggaggttggcggttgcagtgacggtgacacgaaatatccactgctctttacatgcttggcttagtgatctgccttcttaaatcaatggattttgcgctcatctgtgtgcctctttgaacattcgacaaatgggtgataggaccacgcatttggagagcggctcaccttccggctgcctgtcgctgcggacagtatcatctcttttgtattcatagctctcacaccacgacttcacgccgcccaccgcacagcctcccgcttactagttatacagctatg

SEQ ID NO: 1582 - DNA, 703 bp, Nannochloropsis_gaditana
ccctacccattcccatcagcctcttgaaaactgcacacttggcagtgaggacgggggaatggaggaggatgacctggtggtggacctttatggacgatgggaatgccaagtgtgtacattgatcaatgacgggggagatgatggcgttgcaacgtgctgccgggcctgtgaaactccgcggctccttaatgccccatggacatgccgatattgcaccctaatcaaccagtccgcgctcaaacgatgtgatgcatgcggtaaaaaaagaaaaaggagaaggctagtggaaggggaaggcgcagggcacgggcaggacaccgcgcctactggaatcaagctgcatgcccttggtcgtgagaagccaagtctccctgctacagcggccacttccacgtttcttccttcccacaccggctctacgtatgcgggctgtgcgactggtgagggagaagacgaggatgacgacgaggatttaagaacacaggaggcgtttgcacgctccctcttcgacgagttcgtgctacccatccaacggaaagccaggtctcccttaaaatgcttatgctgcggcaaaatccattctacacgacggatcatgacaatgcatttcgtgaaaatgcatttaggagtgtttaatggggcgttcgatcttgagaatgacaaggcgctccgggccctacggacacaagctgacgaagcaatg

SEQ ID NO: 1583 - DNA, 703 bp, Nannochloropsis_gaditana
tgcgcggcgtgcccggagtgcttccttctcgtgtgcacttaggacgtatgggatagcgccatggtctccatgtgtgtcaccggcagacgcagtcgtgccaccgcgtgcacaacaacaaagggctcccatcctatttgatataataggagcatgtacgaatgtgttgggtttttcttcggctagtaaacggatatcacagagaccgcgatctacaggattgcaagctgactccagtttattggtttataactttaaacgccagcacaagaaccctattccagcctaaaagtcaaataaggctcttatataagctgggggtgtacgtccaaggcctgcctggcatactttccaggtgctgggtcgtattaaattaggcatgaccgttgcaatgactgacgaacatgccaacgcctctgcttcaacctgcgaaagattcgctctctatgcagctccgtaaaccaataaggacccagcaaaagtcattgtggctctcctcaggacggtattgtctggaatgaatagctcattttcatttgagtgccagaaggctagcccatactggggatttgatggagcagtaatgcacgatacttactccattctgacctccatgcttcacttgccaggcatcgaacaggcccggagccgtagcgtaccctactttgtggccttctcgcttcccagcaacgtatggaggagcatg

SEQ ID NO: 1584 - DNA, 703 bp, Nannochloropsis_gaditana
aggacccccaagagcaaagccacgggcctcagaaaggatgctgggcgactcatgatgcgtttttatttgcctaagagggcacaaataacaaaagggcacgaataagacacttaagactttcgtacgtcaacttcttcccgcgggcgtcgtgtttcagctcataaagtggcctgacaagtgcctgcagctcgagcaacagcaccagcggcccgggttcaaggatactacgtccctgcctcttctttgaggccataaccatgaccaatactgccaaagttgccggacacgccattgatgacacgtcctaggaggttcatgctaccctgcgaccacccttccaagcctccagggcctgccgtggcatggtttgacgcctcgcagagtttcgggcactgctcccgtgtaggttgacggtgggaggcgggaaagtcgtatatcatttgcttcgccaagccttctttctaggcgataatttcacttccagcttggctcctgccttgcgtgtgcattcccccaaggtgtgcgtcctgttctaaggctcggaggaggtcttaagtgtggcgtctgataatgtggcgtagacgagtgtcaccaaaagagtaaggaaatggatggtaatctctctctccccccccctcctagggtacagaaatcggaaggacgcacaccagctttcttgcctacacctaccaccagcacgatg

SEQ ID NO: 1585 - DNA, 703 bp, Nannochloropsis_gaditana
gggtaggagtagggaaagggcgaattggatggctgacgatagccctcaactttcgaagacctggttgaaatgttaaatagttacaaaggatgtatagggaggaggtcagaaggcttgccgtgtagcgaggacatggggtttagagcgataaggaagtgaaacaaatggcacggccatcgggtatccaggccaccgtcatcccttttcctgttgacgtcctccccccctttacatccgacattgcgggtttttcgaagccaaaaatgcattcaattgtgttacaactgacgataatttggccgttttgtttgtctttgcgtcgactggagactatttcggtggttatcataatcgacgagtcgaaagggacgtcgtgagtcgaaggggtaataagaaagacacatagaaaaaaaaaggttccaattcgcaagataaatgggcaaacatgtgaatatgaaagagaaatgaaattcgtggcgacttgaatgtaaggggaattgaggattttgtagctccatgcttcttgtcacacaaggttcaacaaatctcggatcaacaagtgttaaatttaagatcgccccttacgtactttgataaagagtgatcaatgcaacacatgcacaggaaactcccctccgtatgcctactaggacctgacgacaatcacattcaccctgttggtgaagctcgattcctgccaatg

SEQ ID NO: 1586 - DNA, 703 bp, Nannochloropsis_gaditana
aagattttgttaaaatcattttgttgtggttattgtcgggaggacggacacaagtcttgatttatgtcgggccactttctggggttcttggcgagatgctttctcgtctcctcaaggagcgatccttctgccgcaccccccccgaaggaacatattcatgtgtccctgtccttctcttgtccgtgtggggtctttgtagtatctttcgatgtgccatgggcctgtgcaatatcctttgtagccttaaatcgcgactggtcgcggtttttaagcatattgtaaatgaccctgttttgtgacagcgattgctttgcgaagtggtacccgtggaagggatggataagaaagtgcccatagcgagcttctattcaagtacccctgaaaacgggatgcggcgctttatagatcaccatttgaatctgaactgccaagcatgaatagcgttaccaaatgcaactcatgacatttattcccggtgatgaccgtagcctctctaccggctaagtaatgaattgccgtgctgcccaactaaacttctttcaaaaatcgcaaaaaaaaatatcctcatatcttaaagtactgatacataatacttccatgaagataactaggtccacatgttgcacttgtggacatcattatgaagatgcttaagatggccaagaaagctcttaattgcgccgccgtaccctccccttcaaac

SEQ ID NO: 1587 - DNA, 703 bp, Nannochloropsis_gaditana
aaacctgaggcaggtcccaatgatactgggagcagaaatgctgcgacgccctttccagttgcaccgagcaagccaatgagcaagaggatgtgatatttggccatttatacccttgtgcttacgattataggcgctgatcgttttaaattgtccagaagtagaggcagtttgcagtagggcaacttcgttaggcagtggcgggaggtcgaggtctgctgactccaaggccttttctaccctctcaaaaggattctccctttatgatgagatatatgtttcacgtgcctgccaatgcaattgtcgataatatgtgtgcaggccgggagttagaggaaaaaatgtacggacaaaaggccactcgctaggatgagagcgacaccctgacggcccctgatactccctcattctgatgcctgctcatatgccctccgtcctatttgcctacagttatcactctgatgctttatcgtattccttgccatgcaccatttacttcgatacagccaacgctcctgtaatggaagcagctcttgagccttcaatacccccttcaaacttgccctcccattcctcagctccatcgtcggatgaccctcttttatccgtctttcgaagtcatttggagaaaaatgttcccgtccctatagcaggggtgcagactctcctccatgtgatgagtagcagtcgtgcggtcacaataatg

SEQ ID NO: 1588 - DNA, 703 bp, Nannochloropsis_gaditana
cgggctaaacttgacttccccatcgtaagttcggccgacagtgcgaaggattttacgcatctcttgtggccagacaggagccttcattccaacgcatcaccccagtcgtcatcatctcccactcccacatagactcaaacggctatcagttttccatctctgttattcgtcgtgtgacgtgagtcgggaagttcgcgttggttttgagtggttttgagacacccacgacagaagtatcttatcgccaatggcggggcaaggcgtgtgctacgagggaagtaggagagaagaactttctttgcactggctgtgaaacacttgtgctagatgagcttggtacgttgttttcaggctcttacgaaatcattgctcagtgctacctacttgcttgctcttctttcctgtcgggtaatatggcgcaactattttggcccatatttcatccccatccacgcaccgaatatctgcttccgactgtctcgtgtgcccacgagccacactttatctttcatttgtgcgatttgatcatcacacttcaagcttgcattgagatgaagattcaaacgcatttactcgtttgacatatatctcgtagtttctaaataatcccacatgttcccacgctacaccaaactctttcatctcatgagagtttttaagataatcataaaatttattaaatattatcttttcctcctggaaa

SEQ ID NO: 1589 - DNA, 703 bp, Nannochloropsis_gaditana
actggtgcgtatatcgatattcgtgtagcatttatctccatttatctttagtgagcaagataatgcaaaaaagagggcgaaagtgggccgcgagttgtgtgtatgtgtcatgtccgcgctctccacggacaggacctaggcaaaagtttaaatttttgaaaagggatgtcaacggaaatgttccccgacgaagggcaggcgtcgcaccgtgcttgctcaaggtgcataccacccatttggcgtgcataatggcgacaatttactctcaatgttactttctaagggctgatgaccacaacttgaaacggaggaggccgaatttcactggtcatacttctttaactcttcctttttctcaccaagagacgacatacaaggcatatgcaatttgtcctccatcttttgtctccttgacaaagaaatgaatgtactttattctagtcctatctgctgaggtgtctttgcacaacagattgaaagcacacacgcttctcgtttcactcttttacgttaaattcaagttcttccgttctatcaaacagattgccaaacgtgggggcagtggaataccaattgtaaatcacgtgaaagccggtaaggcacagcactttctccgctatttcttaaaatccagtaatgctgagacggatagctttgggtttgtcaggagttgcggtattgctatcggtgttaaattgcgatg

SEQ ID NO: 1590 - DNA, 703 bp, Nannochloropsis_gaditana
cttctcatcatgaccgactcccggcgtcaggcacgtggtttgcttttcaagactgactcgtgtggccacccatgtcaacaacgaagctaagtttgcaaacttggtgtcacgtttggcagtggtctctatcgcgcttgtcacgagctctctcactccaacatgtcgtgccatctttctcgcatctcgccctgctgcctctacttccaccaggtcatcatatcaaagcacacgccgtttaaaagatcctccttctacaccaactcatcagccttcgacccggactcctagtatggttcgcacgcgcagccgatcccctgaacaacctgtcccggccgcggtcttcccagtcgcagcggccgccacgccagcggaggacaggcaaggctacaatgcgaacaggagtgcctggaatagcagccacagcagcaatagcagctgcgattgcaatcgtagtacaaatcatagcagccatgacagcagccatgcaccaccctcacggcccttgactccaacatttttcgacgcgctagcttctccagcacgaggggagatgcttaccctgggggatttggaatgtggtgtgtgtcttggcctgctatgtgaagcggtaacaaccccttgtgggcatagtctctgtcgactttgcttggtccgggcgctgcaacgtcagacgaagtgtcctgtctgccgtgccgtttgtatg

SEQ ID NO: 1591 - DNA, 703 bp, Nannochloropsis_gaditana
ttcgttttgatattcatgctttttctttccgcactttttaacaacgttacagaaaaatgatgtcaccataaccagagaggtgatacctcgagagctcgttagcacgacattttcggcctcaacaagagagttaatgcaccgtgcaaagcagtcaaagctattttcataattttcatgaaaattttcgcatacacatcctttttaagcaaaggagttctcaaatattacgtcaagaaagtggaaaaaaacaacctcctctagctccctaagcagtttgtaagaagacggccgaccgacaactacaatagccagtaaggctgatgcaagccaagtaacatcaaaaattagtgaaattctgtcgtggacctcctcgcccttcatctttttatcgagagatcgaaaagctcagcaaagcccccctctccgggcgggttttctccttcctgcctcgcgggccgtcagagacagcgtgctacgatgacgtgtgcttgtcgccctggacaaggctttccttcacagctgccaggggcatggccccgatggtctccacgtacgatacgtcttgtgtgaatgcttagaaacatgtgtggcacgctgatgtacaacgtagcatagctggggaacttgggtcgactttttggcctaactgcgtcacgtcacagctcattttcgcacacattaccacgcacagtgccaaagaatg

SEQ ID NO: 1592 - DNA, 703 bp, Nannochloropsis_gaditana
aattcgtcgcaaggaaactactcgtaaatattgggacaaagcagcatagtaatagtaggactgctttcgctctcgatcatgatcatgtatttcatacttttatctgaaaattcaggcagattttagattaaaacacaaaatgtgccccgatgagccaccatcgtcgaaacagaaagagagtgttcctcccgtcagctcacgtttttcatcatattcttcagctggatcgacaataactatgaatccgccacggcccgcgctagccctgtgtgctgccaaaacagcgccattggaaaaagccatcgtcagcaagaaagtcacacatccactcacacgtgcttcgtgcatttctcataaaaagatttcagaatcattgcatcatccacgttctttgcttggttcttccagacgtgctgataatcgtctattgtcgacaaaaatggtcaacaaggagcgaacatcctctccgcttctgctcctggagcatcaaaaggacatcacaagtacatcgaagaatacgagcgagaatgaaacaatcaaacgacaaacacgtcgagcatcctgggcgccttctcttgtcattccctcaagctcgggttccaacagtgaaagtgcggcgagtgacccaaagtgctccgatcccggcgcctgtatttcgcaaggacattcaccggctattcattcctcatcacattctagttta

SEQ ID NO: 1593 - DNA, 703 bp, Nannochloropsis_gaditana
gaggctcgcttcgcgccattcttcgttttcattccgtcgcttgaaaattcaaaaaaccgttgttcggtgccagctggtagcccgataactcctttcaccaatccacatcccttgtcgacattctttcggattgacacaggtgagaggcccttccaagtactctctgtaacatcgtcatgactatttaacgaaacgtgaagcaggtgtggcgcatgactgatcacatttacacatctatgcgcgtgtacaatgacatccctccctcaagtcctccgccgtacggtcctctatcagaaaatctctcatctgtcttggcattttttcggaagctcataccccttacaatcagtattttaacgttactgagcaatgtgctcattcctcaacacactgcaatcacacttattggcgcgtcattatactatgaaaggggaagaaaatagggaacaaaatttcaactatagcacattcgtcgccccctcgtgttcttctggcatctacgcgaaaaaaagtactaaattcatgataacgttgtggtctccatacatcaaatagaggggacgtgtatttgcctcttcgaaaaagtcctctgcttaagcggtggctgcgtgtccgcttgtggcagcaccctgcctcaaacacttttatctcccagcttcaaaaacccggacacgagtataaagtgctttaaagcattgagatg

SEQ ID NO: 1594 - DNA, 703 bp, Nannochloropsis_gaditana
cggacctcgtcgtggtggcgtcggaggtagcttcgcatatttttattacctcatgttagggttgatagtttatgtaggtttgtggtcgttgaggaatgaaggatcattctgatttctcttatgcaagataagtaaaatttcggcattatgtggcagccttttttccgcggtgcacggattgtcttttgctacttaaaaaaaacagcacaaaatagagagcgccttagccatggctagcaatgtcaccacttgacacataaaagatgtacaaattataaagattatgaaacccgaatacctcgacctgttgttgcaacgcgatgggatgtggagcaacttgctgggctgcccgtttgaattcaaatcctcgcggggattccttcgcttgaccgttagggccgccaggtacccccgtgtcgtagtattctttcatagacctgtctgtatcacctgagaaaactggaactgcttcatatttctaaagtcgtctacatttaattaggatatacatcttctgaactctcctttcattaaaaagacataaatcgagcaattttgcaactttcttacgcgaaggacttcgatacctgatatctcatttcctacctccgtgtcgacttcttatgcacgtcgtccgattattatacattatccatcaattcatcgaaaattacgttatgattttccagggcaaggaatcatg

SEQ ID NO: 1595 - DNA, 703 bp, Nannochloropsis_gaditana
gcaggcacaacccccatctacccctatcaaccctccagatcctcctccgcctcctcctcacacgagttcgcccgctctcaatacggaagcaagtcggaaaacaaacatgaaaatcacttggcctacacagcacggcttgatcattgacgccggtagcacgggcagtcgcatgcacgtgtatcaatgggacgcgcgtcgctttgacacggtgcctccccccttcagcttccccctcaccagcaatcgatggacaaaccgtctggcgccaggcatatcggccttcgccgactgccctcaaaatgtgggcacctccttggactcgcttatttctttcgcgagagaggtactggcgggcaaagagcaccagttcaagtactttcccatctacctgaaggccaccggtgggatgcgtcagttgtcgccctccaagcgcgaagccatcatagatgaggtccgaaaatacatgatgaataagaccacttgcccgttctattttgagcacgattttgcccgcgtcgtctcaggggaagaggaaggaatctacgggtggacagccatcaatttcttgctcggaaagcttttgccggcgagcgcgggcacggggacggtggatgcgaactcctctgtgggcgcgctggacctggggggcgcatccgctcagatatctttcttcgtccctgaccaggacatccttgccaacatg

SEQ ID NO: 1596 - DNA, 703 bp, Nannochloropsis_gaditana
agaagactcgattgacacgatgtggatttttagagctgaatcaaggtgccaatgtcccgttagtatgactgccgtcgattcggacgtcgtctgggagagcagcggcaggcggcgagcgagcgagcaaaaagagcactcacaagctttatgacatcttgtgcccatttggcatggctgcatgtatgtcatgcatcttcatgacgtagctcaggccggacatggtgatgtgtcgtccgcgttgatttgcgccaagatatcttttcctccagagcactttctctgctcggaggcatgtgctgcagcccccagcattgtcctcaagctccgagggcaaaacgcctgactcggactggggaagggtaagaccgtaaggatatctttgcactggcaattggacaagaggctaggggcttgatcggtctggccttgtcagtgtctgaccagaagcgtgcctctaattgtaatatggtatagccttctcctatctaaccaacctaaaaatggtcaaatctcatattcattgcgtgtttctgtctggggcgatgtagtcctttaagcatcgttatatgagccgtatgcacttgtcggaagcagtcgggggaaaaaagttgtgcagaccgacctgtcagagccatattgcctgtatacagggaatttcatcttacccttcgtcctccccatcgtataaccttccaaagggatg

SEQ ID NO: 1597 - DNA, 703 bp, Nannochloropsis_gaditana
cacgcggccgcaaactcatccctcccacgagaaagcattgcgctctgttccccgtaccgcttgcgtggaagagtgatcacgacgacaaaaagcattctgtgcggttgagccccccccaaaagaataaaacggacgcaaacgtgtcctctatgtcaatcgctcacccctcatcgcctagcacaagaaatgcgaatgcgcgcttggccgcagcaggtacagcaagaccgaaaaaaaatcgtcctctcgcttacacgtttttcactcattcttcctcccagcgtactcccgtatttggtcttgcgattgcgatggctccagacggtgaggctttatgttgttgtgttgagttcccagacgtccgtctgacgtgatgagacgctctgatgtcagagcggtatcttgggagataagattagccggcacgcggagacggcgcggcgattaatggactctgcgggcgatgcacttgggtattcaagtggtgcattctcagtggacgtgtcagccgtttttgaagcattggactttctccaagccaacttgccatgtattgcagaggcttatcttgcaccgatgagatgctcagaccatttccaccattatggcagggtcggccggcgtgaaatgtgtcgtgatgactcatcgtatctcttttccgacaggaacaacctcagcacactcgctttcctcgtctacaaccatg

SEQ ID NO: 1598 - DNA, 703 bp, Nannochloropsis_gaditana
ctcttgtgcgagaaggtctcgagcgcgcttgagtttgaaggcagcggccgctgcaaaatcaaaaggttggggggcgtcttcatttccttccgacatgttcctgttggtaaaaagaaagtgtcacaccgaacggtgatattttggacgattaatctgttgcaggatgtgtgccgcctcttccgggtgcccgacacgtgaattttgtctcttggcggacacgtatcatcaaataagatactcccgagggcccacggtaacgaacgggagaaacggccccgggacggttacgaccttgctcctcgacgggcgccctcgtacgaaagacctcgaaaatctgggggcacacctcgcattgaggttatttgatgcgtgctcgatacttatatcttcgtgattctgtgctggtacaacctcatatattttgcacgaagtggacttgtacagatcacttcacaatcggcagggtgaaaacgctgatgacggccccgatacacacaagcccataagcaaggaagctaatcgcgacaaaagaaagtagatgaaagcttcaaactgtgcgttgaaaacgtctctttttctaaattctcagaacaaaactttggcgccatagctcttggccgcaagttgctatttgctgacagcactcgggcggagtcatcaagcttccttctgcccctatattttgcacgtgcggacagccatg

SEQ ID NO: 1599 - DNA, 703 bp, Nannochloropsis_gaditana
agaccgacgaagctaccaactgttctacaagggcagcacaagtgcatccaaccatgtaacaaggagatctcactctttagaaatgcagcagcgacacctagtggccgcccatcctttctcgagcattcttacacacattgcagctgtatggaaccgccactcatccggaaaaatcgatcaagtattaaaataaaaaaaataaaaaaaaacacgtaatgaattcgaaggaatttcacttggttgtgcataaaatcaacgtcggggtgctgaaacacttcttccgacagaagtcagccgtagtatctagccgctgacctatcgatgaatgtaggaaactaaacttgcccccaattgaaacgcacacaactaccgcaggacaaatatgacttccagagcacctttatcaagacgatgcattttttgggccattcacacggcggggttgctccatcagcttgttctagttcgtgcgttcctcccccctgtcgtgcctcctacttccctgcactcgaaaagcaaaccgggaccgctatcaaccgcagacattttccccgcaccaaccatacaagtgcgcaaaacctggcatcttggtggctcctggaccatttcgtctcactacatacctcccaccgaagccacttctccttcctcatgcgtcgtcatgcaagccacctctgcaaaagaaacaaccaaagggaccatg

SEQ ID NO: 1600 - DNA, 703 bp, Nannochloropsis_gaditana
aggcatctgacatcgagacgcggaaaaagaaaagcgacgtgatcaggccaggaggagcattttgtttgataaagggatagtctcccccgtcctgaatttgcaccgtccccatgcccagctagcccgacacttacctgaaatccactggccaagaagaggcagccccccatcaaggtcgccttcaacatcgtcgtcaccattgttccagtgtatgcggttgagtctgtgcattatgatgccgaaaatggaacgcaagcgtgggagtgtaatatgcatgaagcagaagaagggtgagaccaggacaagatcttcttgttgccgtgctcgcgcgttctttcctacacctggtacccgagtaatcccacaaacagaggcacaataaccctcaaacgtacgactggtaccgcatcgtgtccaccatcgccctgcacacgtaggaagcgtatgtctcagcgtctcatgcattgaccaggatcgccatggcagtccgctgtaggcgagcctcgcgggcacttatgatgagagagacaccctcgatgcccacaccacgccgtcccctgcgagtcggcgcgtgcgatgttttgaggtggtaccgcggcaggttgtggctcatgccgggcaactaattaatacttttaccggacaacgcacaggggaaagtttgggaggattcgggcccttgctcccgctccgtcaagcaatg

SEQ ID NO: 1601 - DNA, 703 bp, Nannochloropsis_gaditana
ttactccaaaatttgaacagcaagacctgtgtttataagacctgaaacgaaaggtgaaggcaaggagtaataaacacagtcgactttgttgaagcatcttccgatttgaatttttgaaaacacgggtttgtatcagcattttccctgtattatccatgcagaatcatgttgatatccagttggccccgagaattctcatttatagaataaggtacttcttgaagacaggcaatgacctgttcttgtaattaaggaggactaaagtccttgaaggatccgaaaaacaaacggaaaacaacgaggacgacgtcacaggctcaacctcaaccctcaacttgcgcggcttgcgcaagaggtagccgcctttcagagacgcataaaaaggcttgtattacagtataatagaaaaattattactgtcaatagatgatgaatgctatacggtcatttttaattcctgcgcgcgcggcatgcatgtatcttagattttgcgacactgacattgctggtgctcaattaaggacgtatgaatcgaacgaatttcctcgccacgccttttcaacatttatcgttgctcacatctggtcaccacatatcatttacaacatgttcaggcacaatagcaatttctgggaaaggggagggcgtggggcgggaggaggaaactaaatagcataggagtgagacaaggaaggaaattatg

SEQ ID NO: 1602 - DNA, 703 bp, Nannochloropsis_gaditana
atcgcaaggtttagcttttcccctcactccccccacgtgcccggctttgaaaacaggcttgaccggctttaagtagatacataagtttttatcgcatattatggctgcgataatgctgcaacagccccagtgtaaggtgcctacttccctccttcccgtgtacagccgagctcaggggggacaatctggagacttggtacgtggattttcaagtcgagttcacatagcgaaaacaaaaagcgccccgctccacatgctcacgacgtgtttcgcaagtggacaggagatatgtcacttgcttagctgcatgagttgtgtgggcatgattttcatgtgacctcaaattattctctcctcctggcgcaggacctcaacatggagcagctcttggaggcgtacgtgctggacgaggggatggatttggactttttggacggaacaaatatctccgataccagcaaagatactgcgcccaacaatatcagtgatgtgagtctgactctttgatgtggagagtgaagaggcgccgtgacgaattgaggcagcgggagatattttttgggggagttactcgctttcattcatgggacagccccttctccatcgcttgactttgtttgaagaggaatgatttcttttaaagtaatcccgttcattttcctggctccattttcccttgtccgcaagttggacgaccttgatg

SEQ ID NO: 1603 - DNA, 703 bp, Nannochloropsis_gaditana
agttaccacaatatttctctcatggaggcgctgacgcattttttggggacggaccggaagcgcagctaattcgtcgtgttgctcttccttatcaaaaggcttgcccttgattttttacgcggtccttgtttattgcctaatgcttccaaacgtgttccactaccacagacggtattcgcagaagcactggtttcatctatcgtcagttactgcgcggtgttatcacttggaagtttggattctgtggagttatttggccgaggcaatacgcgcggctccggtctgtcgtcatcaacgtgaacacgggactaggcagcacgcgtgtcttgatttgaagctgcgacgaaaggcctcgcacaagaagctgtacacggaaagtacgcaggaaattgcgtgacttatcagcatctgtaggggcagtcgccggcgcagtgttttagcaaagcagcaacctgtgaagatcagctgctttagatctctcgttcataagtacacacagaaatcagaaaagtatccgagaactcaagcggtggaaaccaatgtgcatctgggtgtgtctgtaagattcttcctcaaacatcttgattcgacaaggccacttgaagcgtcccattcgcgctctcgatcccttcattgaggggtccttggattcaacgcaaagtttaaacccgttcgtcaggagaactcctcacttttcaagatg

SEQ ID NO: 1604 - DNA, 703 bp, Nannochloropsis_gaditana
ttgagagttttggtgataaatttttgaatctcaaaacagcaatgcgcggcaagtgttgtgagcgtgtattgtgcgttcgataaaaagcttgccgcttctcttcttggacccctccgggttcatcggagattggggaggttaaagcaagtgccgctgttcctctcctataatttgacggcaatcgtggccgcttgagtgagacgcagagatgcttacggcggtcagtctgggcatcaatatcatagctctgggcacagtgtgttacatgcgacagctttcatggctcacgcctgcctatggcagtgtttttattgtggcacagcagtaagattgaggaagcaacagcgacgaatcaaaaatcgagcagatacgccaaagcccgcgtaattgtggcgcttccatgaatcatttgtattgaagtttgtcgacatattctcttatgtgatgagaagatgtcttgcgtctgtctggagggatggatatattgctgccattcccatagattggtcaccggtggagcaggatgtagattttgataacgtgcacttctcgatacgtcttgctgtcgctccagatattcatgccattcagtccagtgacacgtccacaaacagctttcaaatgtgcgctttttcgtgcaagcgcgctttctaagaggtgttttacccattattccgacttcgatctgcacaggagcagcatg

SEQ ID NO: 1605 - DNA, 703 bp, Nannochloropsis_gaditana
cgacgcttcgccgcacgggcgacacagaggcatcagagtgtcgaggtaggctttctccacctcattccgtgagctttctgtcatcaccgcctaccccgcaagccatagcagcacaaggaaaggatacgaacggggggatgcaagccgcagaagggcctcccaggttgtgcaccgtctggggagatctcacattttacaataacaggaggtacgggagaagagcaacatgaccacgggaacctggaatgctgtactggtaaaagatctgtttcacttaagtccctctacacccaatacagttcagccgtgggctgggtggatgtcatagaggaagcgggcaagccggtgaatgagcccaggcttcttgtggtcactccgcagtcttttggcttgcttgtaaccccgcagtgcgttgtggtacgtgttctttcgttcacttcactcttactttgaaattattccataaaaattaccggtcggtatcgtatacctctactccagggaaatcttgggttcaacatgaatcaggtcaggcacgtggagcctggaggccgttctcaacgactgccagaacgagaggatgagacaagcctccaaaacatgagcgtgaacgacgaagggggaggctcattgactctatccgtctctcgtccagatggtggggagaaagacatgatattggctgttgatagcgagcaggatg

SEQ ID NO: 1606 - DNA, 703 bp, Nannochloropsis_gaditana
tttatgagatcgcgcttgcgtttacatgaagaggtaccactcaaaagatgcatgaaattatactgctgtgatctcttatgctgagatgtggacgaccttgtatgcaagctgagcgctcgacctggggctggaacgacgaaggcttgagtcatcgcggctcctaggaggcagattgccatcaaggcgagggcaacatttttttgtgttaagaccatcgtggcgcagtgtctgtgaaaattgtaaaataatcacattattagagtggtttcacatggtataagttgtttgggttggaaagggcagggcaagaaccggagactccctagcatgtattccagcggacgacttatattatctcaacaactcgccacctcatgcttccgacgcaggcatgaaaattatgtctcgagcacaattgaaagtatcccagatcaagactccaccattctttttctgctacaatattcgtgtgattgaggcttgattgaccagaggcatactcccacattggggaggggtttcatggatcggtgttcggagggtctcgcgtgatgcttttttacctgtcgcacacgatcgccaacctcctcacaatgaccacacataacacatataactacaccagcgccattcacaacacaccgaccagtttctggcggagcacaagtaggcatatcgggaggctatgtctgcaaaagctatg

SEQ ID NO: 1607 - DNA, 703 bp, Nannochloropsis_gaditana
attacccttcgaaacattacgacttgaaaaagggcggcgccgccactgaaaaaaacaaaaaagcggtttcaggcgcccagtattctcgtttctcagcactttctcatacgtggccgtcaaaaatttacaaacgttgatgacgcctctaccacgttactcttttctttcgatcgcgctgcggcgagtctgaccgcgacggaaggccccagagtctactcacaccaacgtccccgcgatattagccgatatggcgcgtgccagagtgcgctcaaaaatgtcaccagctatcgaagtcacagagaggtccggaggcttccagggtcgcttcacttggacagcgaccagtcggcttttaaagctcgctgggaacaacagaattgatgcctcgctgattgacgtttacggaggccccattaaatatgcccaccacaacgtgcgccgcatgagcaggcagagcgccgttttgagcatgacatcgaggaaaaatcggtgtggtacatattgggggtctgaagtgtctgtgcgcgcttttgcatgtctcttgtccgcaaatttcttccttccttgatggttgctcgccaaacctcttgctttcactcccgcctctcaccctcactcgcccgccttctcttgtttgccttgatattgaatctcgatcatgcgacaattattataataataggcccaaattttgtcgatgatg

SEQ ID NO: 1608 - DNA, 703 bp, Nannochloropsis_gaditana
acttgaagcctcggagagtgcagcaccgtcaaagtgacggtgcttgcccttctacgttgcatgcccaagaccgccttcgaggcagccatacattcttccttcatgcctacgaatttgggcagtatcatcacagggtgtattgcaaagacctgcgggaatgttcaggtgccagcggtcccattatgggacttcggggaccacgtactaccccaaaaatgtggttggacgtggctgcagctttatcccttgtctcccacgtctgtgctgaatgcttcagccttttttgtgttcccactcgtgccaggatttcccccaatgctttaatgggaccagtgcgccttcttcggggcgggaacactgtctagatatgtcccagaaagcccgtcgacgcccacggcctgaaggagcgagggttgaagcagacgggcccttgtcgcaatggcagacgtatgtcctgatcacttctttactcctgtgaatttctttggtatcttgaacatctccccttccttataggcgtcaaggtgtgggagaaaagttgcattgggatcaatcctcgtgcctgtcaggacttggcagcacggccatctctcgacatagtagcagcagcttctgcagcctcgactttgcttaccacctctggatcgatgaactggatgacaaacaagacgacagagggtgccttataaaaagcaataggatg

SEQ ID NO: 1609 - DNA, 703 bp, Nannochloropsis_gaditana
tacccaggtcctccaggtgctgggtcgcggtggataatgtctccagcatattccggcggtctttcggcacccatgaattcattgaacgggaaggtgattgcattttaaacgctatgattcgattccctgtaccgccgctagtggcgtgaccgcgggtttcgctgcgtgtcagtaggggcaacttgaagagaaagccttcacctgtgagtgccatccccactaccaaaaaaatgataaccggcgcaacgcataggcgtccggccatactaaggatggtttgaagaagttaagaaatgcagatccgctcttcacgggaggaggaggggattttttatcgtgtgagctacaatgcaattccagacgcgcctgctaccgatccctggaaggcgccgtcttaaaggaggccaatatcacgccaagcaaggacgaacttgattgttgggtgcccgctgatggcgttgtataccccaattcgcctgatttccctggggacgaggaaacaggtgggtcaatcagaagatggcgactcgcaggggtggtcgtctcgcacgcctgtcgcttgttcgcgagggggaatgttcctctccgcctgcctccggttggggcggacgacgcacatcacagcacttgctagactgccatgccgtcctcgtctcatgtatttgcacaaaaacagacgattgtgcagagtagcgacaagatg

SEQ ID NO: 1610 - DNA, 703 bp, Nannochloropsis_gaditana
ctgaacataagcgagagaggagcactgcttctttcgtgaggatcgggcgacacgaaccacttccgtcagtaataagtactggtgcagtcatgtagtatgaacagatgaggggtagattttcgagagaccgatgaacagccaatttgtgtgcatttgctgaagtcctagaggcaccttatcgccggtctcattgcacgcatcgagctcgagaaaagactcctccccaccccatccgccactccttcgcatgacctcggacatcacgtctccctgcctatcaaacgccacacgcgtcgcgcccgtggcgtgcaggtactgggtaccaagcaatcaggttgcacagccagagaaagtgaccgccgggggggggggaagatcgtatggtaaagagcgagccaacgggttcggaccacccccacgccaaatttcctccggccgtgggcaggggggaattatttggattgctggtgtcctgatgatggatgctcggcttggtggttgatatgatgcgtagacgctttttaagattgtctcgtggggcaggatgttgctttgtttcgggcactggcacttggattataatgccccggtcgtttgccagtgcaagtcagtcaaggacatcattaacagcatgattttttttgatcgcctttattatcccgcactcctagacccttcatttacatcttaacatatagaaatg

SEQ ID NO: 1611 - DNA, 703 bp, Nannochloropsis_gaditana
gtccgccgccttgctaaagaatatggggctcttaactacacacacaatgattgacttcgcgtatcgggcagtatattccccatttctgcgaacaagagaaatagctgctgtcctttttcggcgcttttgggacgagttacccctagaggagaaggcaacatgtgtggagcagatcactcaactattgccttctttcctttccagaggttcggatgcagcggacttgctacaggcgatttgcgctatattggaaacggagagggacaaaacgaagatccggagcttgacagaggcttttactcggtcatctacttataccccctatttctctgcttctctccccttctttgagaccctcgttctactcttggaaacccagcttcggagcataaagaaccatcctgccgctcctatatacgaagaattgcatgtgttgaacggccacaaaccccttccaaaatatttggactctacgccttgttcctcctgcgttccaaagtcttccccgtcgatgtctacaggcaagactagctaccgacttttgcctttggaaagcctaaagagcgtgtatcgggccacggagaactgtcttttcctgtccctacgctcgtgctaccaagttcgacggatacagctcaacataagcgacgcgcacagtcgttacgtcaaaacgattcgtctctatttcctacctcgacaacag

SEQ ID NO: 1612 - DNA, 703 bp, Nannochloropsis_gaditana
aggtggtgaacctgatgaaaattgtgtgacgttcatgctatcgttactggatgagacgctttcggtccctccatttttgcaaaggacgaaggatggcacaggcgataaagagaatcgagggtggataacattggggcagcagcgagtgcggaaagcgatgtcacacttactcttcaagtggaaggccagaatggcgagcaaggcaagcaaatgcatcgacaagcacggtggagatagaaaccaggaaagtaatgcgtcggcttccaccttgcacactttcacctttacctcctccctccaagattttccttcacatgaggattggtggctttaccttcttgtaaatcccaattcgcttcctctgcgtgtcgaagctggaaacatcatgttaaaccttttggagatggtgaagcgttatttcttgcgcctccaacgccaacagcaacagcggcaatttcgaccacttagcaagccaagcaccaacaatgtaacggctgaaagacaagttgaaagcacgagcgatatgtccgtcgacggagaaggatataaagaagggtgcgagaatgaggaaggagatagccgggaaaagggtggggagggtggaatcaagacacgggcatccgctttgccttggatatcctcgggggaatcccctcctttcgcttcacattctccaccttttgtgctgcagattcgcctgttt

SEQ ID NO: 1613 - DNA, 703 bp, Nannochloropsis_gaditana
ggaagagctaggcagcggggaggatggaagtcacgcagaaatgcagaacgaggagagggaccggacacaagactcgggcacttgcacgaccctccaggggcaagaggggcagaaaactgtgaaaaacagtgaagacgacacagttcgagtacttttggacgccctggaggatacagcgattctagatgttcttcgggcaaatccctcgttgaccaaagccgtaggaaggcttctcccattcttgacatacggtcgcatccaagcctgtgccgttttgacagaaaaaattgtctcggagattggctgggttcgatggcaagggcgagcggaagacaaaaatggacggcaaaaatcgggcgaaaaggaaaaagaagaggagttggggaccgctgccgcctcctccctccccttgctagtaacaattatgctcgaagcactttatggcctcacaggatgtcgacagggagggtctgctcctactacgatacgcgatcaactcttggagcgtggttttacagcggccacgcttgaagccctgcaaagcgtgttgcccattgaggacggcattgggcgtgcggtgcaagaaagtgggtctcatggcgacttcttgaagagaaaggaacgagtggagggagcatggaaagtgcgcctggctgcgccggtagttttgccggctttacgggtgcttgcgggcttagcaagg

SEQ ID NO: 1614 - DNA, 703 bp, Nannochloropsis_gaditana
tcttcctatatctctccccttgtctcccctccgtccctttttctctcccctccccccttcccgccctgccctcaggtcacctctcctacgcgcaggaccctcaggccctgcgctctcttctcgtccggcccttcggcgccgaccacaggagccgccacaccgacggcgacgcctccccctcctcctccccctccgagctgatcgcggccttcacggaggacccctttctcttggccttcgctcgtcatttctgcaccggagacagcgcggtggggaggaagggcatgggaagccaggtcagccctcctcctcctcctgccccgggctgcccccttccttcaccttcgacccctccttctcatccaccttcccccccgccccctccccggccctccctcctacagcgcgagagtcggctctgcgcgggcgtgctctacgagtgcctgacgcgggagaagccggacctactcgtcctccacttctccctcctccacgtcctccaggtcctcccgacaatggatcccgtggccgccgcctgcaccgtacgtgcccagacacaagcgcccggaagtctcctctccctcctcacacaggcacatgtctcctactccctcctctcattgtcttcccgctcgtccgctttccctcccctcccttcccttttccactcagacctgcaacctgcgcctcgttcttcgctact

SEQ ID NO: 1615 - DNA, 703 bp, Nannochloropsis_gaditana
acagtatgaccgaattggccatctcccgtagtttgttagccgtgcttcacgaccacatgggccgcgtcggaccggacgacatatcttcccgtgtaagagctttcctttgtctttcatgaataaaaatgacttttcctgtcattgtggacataatattgtccaccatcatctcttaatggagcttttgtcagcgcatatcgaccagcatctgagggggaaaaaaggcgggatcctgccggttcaaaacccggatgtctactcggtcctaccgcgcacaacggacctgaccacttttgtctctcctttgttccctttcataatagaaggtgcccactaccctcccttgtcgtctcaagagcctaacgatagtgcacgagtacaagacccgggtccaacgagtatttgcacggagatgagcgttcgggcaggtgcgtctttaaagagcttatcatacctgtgtctatgattgcagaccacttttacaattatgtgcttaaagtatcatgacaaaggtgtcaacggcgagattctctggcatattgtgagatcatggtccgatgataagcaaacctttctcaattccggtctttttcctctacgtcatgcgaatggttgcttatacaatgttcttgccacgtgttgcccattgaggaatttatcaatgtttggtttataacattggtcatgtcgtgcattccacatg

SEQ ID NO: 1616 - DNA, 703 bp, Nannochloropsis_gaditana
gtgagccatattcgtacagagattccatatttacgtgccgcactccgggcaaaggagccgccccgactatttctgagagcaggtgctctgactggccgtctccgtccaagatgcaattctcccccccttcttcataattaatcacaaactgcaccgccagcttggcatttcctggccatttaggatcaggagaagattgaccgtaccctttgaaattccgctgatgcataagtcaactgtgcttttgagtccaggcttcacggccagaactatggtaacagtgccgagggtctgcaactcctgattgaggggacggaggccttgacaaccacaggaaacaaactgacgttgtgctgaggacgggatttggaatagggtggacattatatgatgtgaaaaggtcaaaaaacacaatgcaactcgaactcgaggcggtgaatgctagaggtccatagccctgcacagtcaccgcctggcaagcagggtatgacgtactccttcccatcggggtcggacagagaggttcaggagggggagcccggacacagagatggtgaagaaggcttcagcagcagccagacagtggcaagatcaaatgtagaaaggcgacattacatgacgttcaaatcaaatgcatttcacaacctatttcaagcctctttgcagaaccccgaatgccggtctctcgatcggagactagatg

SEQ ID NO: 1617 - DNA, 703 bp, Nannochloropsis_gaditana
agttggtggtcctgccgcagagatccccgtcgtcccctcctccggaggcatgacggaagagtgaacagagtcgatagctggatttcgggagttcagaatgagtcttgctgtgcttgaggctcaattccccgcctggagggggagggcgggccctctcctgcgatgcaaagaagaggaaagatgatatgcatggccgagaaaggagaagtatcgaacacttggtaaaggcacagcctcgtgcccctctatatttatgtgacaccggctgtgcgtctcaagccttcgcgtcgaccaggccgtgggccgcatgggagtgtggcgatgatgatgatgagcgaggatatcgcaggatggtgggcctcctcgacggcccttgacctcaccgggctggtaactcggctcgatgcctaatcttcaacatcctcccctgcaccacctttcaaggtcttcaagatgtggcaggagggtgcgcaggctggaaaagctcggtggcagtggactctccttctcatattgcttacgacgaccagcctacagagcactaggctcgaagcccctcagcaacctccctccaaattgtctttgaaacgacgatccccgtgccgaagcgaagcaacaaagcgtcttaaaaatcgatcctatgcgtcctcatgcggttatgtgttcgatagtcatcaatcttttgggccgccggaaaaaaatg

SEQ ID NO: 1618 - DNA, 703 bp, Nannochloropsis_gaditana
cggcaagtgtggcccaagatggggcacagagagttgctgttggcgccagagtggttatgcaaggtattaaatcgccacaacgatgatatcattttccagagaagaaacaagcctctcgttaccaccggcgccagtagctcggagggggagagcggggtattgccgaacctatcatctgtcttgaaaaagaagagcaaggtttacaaaatgaaaaagacgccatcctaaatcattaagcacaaatgaaaagtatacgactaagagacgggcacgagcggggcctttcttgagacagttgatttgcgttgcgttgaacctcccccccccgtcgctgcctgacctcaatttcaatctttccccttcttggtgcacgcacataatcgcctcttaatcaaagacgcttctttgctgtaaacagtacattatgccttggtcttattggcatgtgcaaggaccagaagcacagaaatgctttttcaaggacggctgtgattgtcgtcaaatgtgctcttcgatttttgggagactgaggacgaacacatgcagtgcctttcttctgtcatggaagcgcttactgccgaagttctttctcatgacgctgattgcgctactatgggtttgtttaaggccatcagatgccttcaggcaacaaggctgtaccggcactttaacatatatccggcctttgaggagtcgccccatg

SEQ ID NO: 1619 - DNA, 703 bp, Nannochloropsis_gaditana
agtatctgcttaaacgtgccccatttagcctacctcttcgttcatcccacggcaggggtacgtggaagtcgcgaatttgttgctcgctggacaagaagctccgaccaggggctagtcgccgcctgcgtaggttctcacaggagctgatgcgtcgaagcatcattccgccctgcaagctgcacaaaattgatgtggaacgcacgctgaaagaggagactcgtccggatcgaagactcgttttcgcggtcgaagtagacactgcaatggcaggcaagagccgacggaccatgcctcaagacaccgcgacctgttgtttaccatataaataccacgacactgggagttagactgtcaagttcgcacgtagcctagctgtagtaagtcccgtacaacatttaaaggggctacggcagagcctcgcacggcaagaagtcaaaacttgcccgatgaaatgcaaccatggcactccaccaggtatcccaccgcgtcgccaagccggcgcttgccggcgatccttgtcaccgtgcacgtccaaatgcagtacatcagacgacacattatcagaggcggaagagaatgacctttgtgttggagctcgaggtgttgtcaggtgactttcggggttacatcgttccaaacgcgcctgttccccttaccctctacgtttccctcaacagcgtggtccaagcccgtcaggatcatg

SEQ ID NO: 1620 - DNA, 703 bp, Nannochloropsis_gaditana
agatatatcctgttacggttaagcaaggatgacacaacgtgtatatatgtataaatatatagtgcatagaagtgagagtatcagatatgtgcgcgcaccagaatatgaacgccgaaggataaaagcacggcacctgacaaatagcagcgtttcaggagatagggctcgatggtccctggtaatcacgttatattttcataacccagtgcttacatgtcaatgtatatgggcatcatcaacgctttgtgctacagctcttaaggagggggcagggaggcccaaaaaaacttgtgagaaaagtgttcacttacctgacgagtactccagacggtttaagtagaacctcagcactgtacccaatgctctcagtcattactaattgggcatttgtgattaagtatgacaggtaggtacacatgtttcctgactctggctgcagctgcatctccacgatcatgatgattgtacttcagtagccgtgtgagacctcgaccttgccgctctctgtcgtcaaatgaggtccatcacacgtcgccccaaaaaaaactgcctaacgatcaagcgtatccaaccatgcgacacatcatcctgtacgaaacaggtattcctgactttggagtttgcaggcactgttgcatgtccccggcatctgtgttaacctccccaccagcatcggaagggctcgtgtccgccaccatcgatg

SEQ ID NO: 1621 - DNA, 703 bp, Nannochloropsis_gaditana
cgagagtgtggtacgattaaattattcttcaaaaatatcaaaaataccatttaagttattaaagatgaaatgttgggccgtggcgccttgctgcggccgccagctctaagggttgacctcctgattggacagcggcggggaggcagttggcagttaattcataacggatatctcaaattttcgctcggtgatgaaaggcctgggtgctcaaccctccaaataacagatgcattctagcaattcgattcatgacttttgtagtgagtaacttgcgcatgccttgttttaacggcttcggttgtatcgcgagacgtcgtcatccaatgaatcggcagaagtccgcgacacgctgtagtcgccgtcggcgcccatggccgaaaggccaacggctatacatgggccaggggcttgctttcaattgatttgtctggcgagtacgaggggctgatcgcatcttttttcatgccaacttttaaaagtgcttacaatagttacgtacgctgcgacgatgaatgtgacctcgagtgtgcatctttagaatgaaggcaggacaagatgctcgaaacagagacgtgcggtgtactcctgctcctttctctttcttcacacgcatggcgtaggacccatattcctgcgtattcactttattgaaaaactctttttcacctactttcgcccacattcagaagtttaccaaaaaatg

SEQ ID NO: 1622 - DNA, 703 bp, Nannochloropsis_gaditana
taactccatatcgccaccggagtcaccgtccactcgagatggcgccagtcccgcttgtcctcctcactcccactttccgtcctacgctttatctatccaccgcataccatacagggacacaaaagtacttgtgaatttcgctgtatctttacgcgtcgagggggctactaaagtctgcgtaggccatcgatggacaggggggggcaggaggccgcacgcttcttcatcatactgttcgccaatcttccaatgggggtttgcggttttggagacgctgtggtaatgcatattgcgctgacgatatgtagcatggtaagcataagtagcatgcggctccataagatatgatgcatgcattttctcggaaggaaatatttctgagggtcctcaaacttcacaggaagggtgggtatcaggaggcataggacgtatctggttcggacctctctcgtagcttttatatctttttccgattttgtgcgactgaaccgtgttactcatgcatctcatacgcgttattctttcgctggcaaattcgcaatctctcgctttccaacctccgtgtcaagctgacctctgtgtcacccatttccatcttcggtttcattccatccgtaattctcaccagaactttcccggcgtgtgctcctccacgatctcggaagcggtttacaatcttaccgtcgggggccttgctgccatg

SEQ ID NO: 1623 - DNA, 703 bp, Nannochloropsis_gaditana
actctcggggaaataatgtaaaattttgaacacaatatgaaaattgttatccaccattcccatcaagctgaggctctgcctgtcagctcaactccagtgaagtgcacaaactctctttgctaccagtgtggaggttctgtcgttcccgtcgcaaggggtcattctgatccagaatgaattactgcgatgcacaacattgggcgtacaaaccatttagatgcttaccgaaaaaggctctttttgtgacttactttttgagtcgtactgcaggtctcagttgccccgccttcacctctcgtgacagtcgcagcgcttcctccagcatcaaccatggtgtcaccaccctcagctggctcaccgtcatctccgcgtggaggtgctgccatggaaatctgaccctgaagaatgtgtgtataggttccgtaagaagaaatgtgaagctcaccgacagacatctcgccgcctcatcgaactgtccctgcagaaagccgggaggaacgagaagagaacaagcgatgcccccgagcaagtatcttcagccagggagcgtgcattcgccttcaaaaaccaatctatcgacttcgggccacgactagtgttgatgttttataaatgggagtctccatgcttcaaaagcgtgcttcaacggtatctctggtgagcaaagtatcgactgcttgtgcttaccttccactgcatcatg

SEQ ID NO: 1624 - DNA, 703 bp, Nannochloropsis_gaditana
tacttgtcgcgatgatttcgaagcaccatcaatgcctgaagttgcagcgccgatgggcccgcggcgcacgcgacggcttatgaagggtttcggttttggcacaggagtcgcgcgagaatcaacgtcatcacgtgaggaggcttctctttcttcggcgctatgggatgatgttcctgaacgcagcggctggggcccgtcaaaaggccgccgacgcccctctcttgctagacattgccgtgtgactggtggtagggccggacctgagaaagagctgacgggacgaaaagacaaaggaaacgaatggaccgcagccggacccattgtcacaaggacggccgcaacagatgtaattttcatttatcttccgtgcacgtgagtatctgtcagtatgtttgagggataatgaatccgaaattacacattttaaggcgtggagggatcgaggcgaggcccttccgcttctgtctgctgggcgaggggaaagcgtaatatttactgccccttttactgctgaggattaaaagtggcgacgcatatttcattttcaaacgtgattctaggaaatttgtcttcgcagtgactatgacggccaaactttcctgtaagattccctgtgagagctttcactcctatctttacctccccacccctaggaattggttaagcatcgcagcagcacttcgggtggctgagctaaatcatg

SEQ ID NO: 1625 - DNA, 703 bp, Nannochloropsis_gaditana
gagtgcgtgacatatacagcagaattttacataaattaaagctcatacatatgtaaatatagcacacaaaagtatgggcatacagaaatgacttttatcttccctccaggccaatcaagcagtcgaccgaccttactgggtggctgccaacaccgctttgtcgacttgtccgagggaggacacgatcaagagttgctgtgtgcatcatagaagtgaacatttttgtggcgtgagatcagttcataggtaagctgtctaagagagattgtgttttgaaaggaccttgtccccgcagggaagcagcaactgctgcttaggccgaacgataccggcccttgcttggccacacaaactatgtatcaaacaagtgtgaggagttacaacgggcgaagcgtcccgatggaaggcgattattgcaatacacgcaatggccaatgatgcccggatacattacatgcgaggttgctatctacaagcaccagtgctggctcgccgcaacctctcgacctcctggctgaggcgccggcccacgggtattccgacgctattttaatgaccaaattgaccgtcgaggccttcgacaaacacacatctattctcattctgataaatagggtaacgacgtggctgagggatgttttctgcgaggtggagctgacgaaaatccagcgtgcttcgtcctgccgctctatccaaggcaatg

SEQ ID NO: 1626 - DNA, 703 bp, Nannochloropsis_gaditana
tacgctcaaagtttcgtcacaatccataagtgcagcccccgcaagcaacataccagttccacagcccaggtcagcaactgcacatccttccaagtcgtcgtaagatgctacgcagtgcaatactctcgcagccaaatgcggcggggtcaagtattgctcaaggccccatttgggcgcctcaaaaccgtccacctgcgacaggaacgattcaagatgccgcaatttcatcccctggcttctcaggccagcaacctgtaggagtataaaccgtataaaacacgtcattttaaaaacatgggaatagcgggatagctatgtcgccttgcaaagagcgccttcttgtcatcgtagtttacctcccctcttctttgacatgtcagagttagttttgcagctaaagcactcgtgagtcgaaaacattcaataagaagacagggcaggactataagcaccgatcacactcatcaccgaccaaagagtgttatggtggtttcgttattcgagtctttcgtgtccggatactccagaagcgatacctcgccctatggcaccgacccctcgaccactccagcggtgccctccgacaccgacagggcggctgcttttttaatatgatgggtcgtggtcgcagctgatgacttgtattcaaaatccatctttagagtgaccaatgagatgctaaaaccattgcaaatcaagtatg

SEQ ID NO: 1627 - DNA, 703 bp, Nannochloropsis_gaditana
tcttcctgaaatggcaaattgcggtgagcaaagtggaggacaggggggctgaatagtttcggcgcgaaagcaaggaaggccttacctgagctagccctaggccaaagcgcattttcgagcttcaaagaagcgatttccgatcacaaatcggaggcccgcatatttttttcggtcatcccatctggatgaagcgtcattcatgaatgaaatctcaccattgattggtttgctcagctaacttagctgaatagttttggcgcgaaagctgggagggcgctggagccgagccgctggtgatggggacactcatcttcatctgggcaggaagcttataacgtgcctttcctacacgatacaacaggctctaagactacctctggtagcgctttgaaaagtgatcattcccagtactcaagaaacgtttttgatgggtgcaatcgatggcgattatagaataagacactcgcggcgaggctgggctgtcgtctgccttgcatgtatattatcccaatttgcaattagtttagcaaacaccggagaggcagctcctcaatcaacaccagcatctgaaaatgtagatactaccatatacacatatgatgcagcgccaccatactcgcgggatagccggaaaaactctgagcatggtgctcaaatagatgtgaggcccgagcacgatactgggggtgagatcagccttatg

SEQ ID NO: 1628 - DNA, 703 bp, Nannochloropsis_gaditana
gcaagaaagctcttgggcttgtgcttacagtttaggcgcttaatgttttccctttcaaacagtgcgacatggtagccactcgagtttccaagaatacgtgcaccgcctgtcgaagtgccaaggtaagatttggatcaaggatgctgatgcaaaagaggatctcgtgtcacatttcacctcgaccactgcgaatcgagcgagtgacgttgttcatgtcctcacttatgcatggcatgtattgcaactgtaccatcctgacagatccgatgcaaccgtggtgaaccatcgtgcgaacggtaagagaaagtacacggatgtaatccatgattttaccacttaggagctcaatttgatttgggcatctcgaagaatgttcctgagcgttgagcgagtggtcttgtaggtaatcaaaaagtcacgtctcacaagccagaaattcaacgaaccgctgcagcaatacattagaaagccgactgcagtctcatttattgttggactctcaagatttgcaatatccgttccttccgccttacgcatttcttgcccataaaccctgacgcccgcacagatgcaccaaattgggtatcgcatgtattgaacaagtgcgcacccaagggcggccacgtaagacccaggccttgacattgctcaatgagatttacgagtcttcgaatccgcataacggcgcaccaaacccgccatg

SEQ ID NO: 1629 - DNA, 703 bp, Nannochloropsis_gaditana
cccgcaaaagaggtgacgacaagcataggaaccgtactttctccagctacgtcgaggtatgctatcacgactgtttagagcagtcttcctcaggccaaggagcatcctggcgcagaagtcccgcgatacgatacgcgggaaggacgtctatcacttgggaccgcggtcactccttcactcccagggcggaaacgaaacgtacaatgctgtgcgtgtcaatcaaacgaaaataccgaatgaggacgactgcagcgttctatcaagatggaaatggatgaactctggaaaaaaaaccatgaaagacagacaagttatgtgcctccgcccaaattgttccttgcagtcaaattcatccaacgtctcagaacatttccaacgccccccgcccgcccaaacccagccatgcctatccccaccatgtccaggacaggatgcgtcgtgcgagtgactggcggcaagcacatgcaacacatgatgtgaatggataatggacatcggttccctgtgcctttgtgacggcctgggcggcccgtggagatcactttcgctcctccgaccccccctacccatactaccgccacgcacgcaggcgttcctgttaccttcgcactggtcacatgcacccaacccacgtcaccatccacggcttaggttccctttctcacatgtgactacggcacaggttctttttccaggcataatg

SEQ ID NO: 1630 - DNA, 703 bp, Nannochloropsis_gaditana
  misc_feature (1)..(531): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcagcagcaacaacaacatgcccaacgatcacgagaatatgaagctgaaggtccactttctcgctggctcacatttcatctgcactttttttgctccctttcttcccaggaaggcgatgaaatcgggccgggcgatgccctgtgcgacatcgagacggacaaggcaaccatg

SEQ ID NO: 1631 - DNA, 703 bp, Nannochloropsis_gaditana
agcttgcatgtgtatgttacatggctggcgtccttttccgtcaatttgagggggaattaatccagcccggggctcgctcgagggaaggggatgatgaggacggaagaacaacgcccggccggcgcgcaggcaccctgattgacaacgaagcacatttctccatgcgcgtaaaccacgcgggtggtcgtgtgaaataaaagcaaaagcatgatgaagctgataaggtacccacacgtgcgggtggaggacctggtgttgctgtgtgccgagtttgttgccagcaccacacgatcgtaaggtagtgcctcaatcatgggcgaatcgtcgacaggtgatcctgggtcggtgcttttggcgttcagtgtacgcaatgtgcagaattattggtcaaagggcagctcctatcgcttagtatgcgtattatcatcaattaatggtgtactggatagccagaagtttttttttccatctttcatcgcgtgatttcagtgccttatggtcctgctcgtctttcgccatcatctagtctgaaaaaccaccgcacgtccaccctttcgatcacctttcgcagacaatagaagaaaatcctctttcttattgttgtgtacacattaaattgcctattgtccggtgatatccgcgaactccaccccatttataccatccctttttttgtctttttacgttacacagcaggcccatg

SEQ ID NO: 1632 - DNA, 703 bp, Nannochloropsis_gaditana
acgggcttatagtcacgtcacatgtatatcgaaatagaatggatcgtccgatcgtgaaacaagaaagtaccaccttgcaatggtgcagcttagtccggtcagtctgactgcctgtaaatcgcttcaaagaccgaaattccacagacatgtgcccactttgagcattttaatccatgtctccctgtgataggtgctttcggtcgctttacttcgatcatagcgcacggcattttttcacgaaaagattcacggtgatctccaaatcaaatcatcaattctgtattgcaggacattctcaagcatagtaaaattacagatgtactgatttttgcggtaaaaggtcaccaaaggacctgataacttaatttccgactcgaaatcacattgccaccgtggggcggggaggttcttgtcgagtaataagcaaaaggcctgaaacgactatgtgttttcattccagtaccatcgaagatctcgtacctgttatctcctacattacggtcgcactgtatgctcttcatcgttgtacgatcttatggaaagggtatgcgaaatgcatcaaaagaattcctacctctagccgatgggataataagcgatcatgcttttgatcaaagaaacgagtaaaaaccgtcaacacacgaatttttctcctttgtgaccccccacgcccattttgacaccttcaggcttaaataaaatg

SEQ ID NO: 1633 - DNA, 703 bp, Nannochloropsis_gaditana
tcaggcttacggtccaattcattgtttatttttatttttctacaaaaattgcacatctttcttttgtgcatacaacaggaatggcacactcggtagaaaatatacacgacaacagcctggtgactaaaaaaactgttttcttcttaagccgctatccgccgtgtgatagtcgcctcgcgagaagttcgtgacgtacgcttttaacgggagttgcatttgtattggggcgcgagtgagaaagaaagccgacatcggtatcaactctcgtcaaaactcaggagaggaatcaacatcaaaaattcttgttgtcataaggcgtcctgaagctcgttaatatacttacaattttgcatcattcagtagttttgacgggcatataggaatggcgtcagaccttaacggccccgatgccccagcagaagccgttatctcagtcttattttcctgtcatgtgttcaagttcctattctctgtcccccgcatctttgggctttgccgggggattttcgtgctctctgtaatttttgtacgtgacgagtgtgtttctagtgagcaagtacccagagcttcccgtcgttgggagctgtacctgtctacagacgtgcagcgtggtggtgcgggatgtggcgtaggcaagaaagctcttgggcttgtgcttacagtttaggcgcttaatgttttccctttcaaacagtgcgacatg

SEQ ID NO: 1634 - DNA, 703 bp, Nannochloropsis_gaditana
atgtcagcggagtacaaactggattggaaagaaaaaaagtaaattttatttcaacgcgtgcaaaaaggcggcaccacatagaatactgcctgttgatttcgtcatcaaattatattattggaaagctggactgctttcgttcaaaaatgaattactcggctgttaagggctattttcttgaccgcctttgttctttgcaattacagccgacaaatttttgccgggtccctggactcagctttcaggcttgatttaatacatttggccttttaaagatgtgtatagaaagtgtattcgaaaaggtggcgtgttttgtaggtcctactggtcaattccacacctcgtatgaaagtccacacgaaaggtttctaaattttgaattttcgaattttccgtttaaacgacctccgcatgtgcgttgcagccaccccaacggaccctctctctttatcctgtctatccattcgtctagattactcctgacgtccttctgtcattattgagaattctgtatcctatgctactacagtagtaatagtgcttttccaatttcagtcactcatttacgattttccagtacacatttatacctcttatttcacttttttatgtctcgtctcccttgcagtactcattgaacatattgccgctcgaattacaggataacttttggcagaaaggtatccattactaggaccctatg

SEQ ID NO: 1635 - DNA, 703 bp, Nannochloropsis_gaditana
ctcgtatcgtctgacaaagacgtatctcatagcattttaagacacggcggaaaaatcaaaattccaaaacttatcgttaacattgaattgaaaggaaaatttgtatcagatacgctgacgaacgttgacagtcaatcattgccgatctagaaaatgggaagggtcgtttcgacaccagctgctctgcggtcagctcatcagggctggtactgagtttccaatcctccgtgaattcgaaaaagttccgtgttaagcgccttttgaagcttaaaattacaccaatgacaacgtccgatatcatgacggtctatggtctattaggtgaatgcccccgatctcttggcacagccctgacatgtgaatttgagaatctcacactgcgcccccctccgtgaaaagaaatcaataaagttgccgttaaaacacggttatctttttagcaaaaaggaacccgtttcaatcttcaactcatttatccctttgggactgcaaacgttgtattagtgcgggaagattaacctcccgccctttgagaaacgtccaaccggttcgaggcccgctgaaactcgcggtaatctcaggagcgatattccttcccgatgtccaccgacgcacgaacctggctcacgagtacttgacacccgtctttttattgctcgcatgatgtgcaggctgtcaaagaaaagtctctatacaactcatg

SEQ ID NO: 1636 - DNA, 703 bp, Nannochloropsis_gaditana
tgatcgctcaagcaataagtcctctgagggctgtgcagcttactcgctgtgaagtcgacagtgctccaaaaccggtaatcgaaacgctgccgccatcctaacgcgttctctgtataatccgtagaaaagcaattgctgaacaaactaccacggtcgtggtccttttttgtcttcatctactggtttcttttcgccctagaaagcagttttctagtccaagaatgtttcacttaccttcgaaggggcctggagaacagcctgaatactattcaatgttaaggaggcaacaagtcgtggtctttcctccatgtcattttaaagcgggaatgaagcgtgcattgactcctggtatggacgaagaggacaggattagacccggcagtgcgatgccgatgacgtccgatgatgtgatgagaaaggaccccccactttccgcccgcggcgtgtgtggctgtgtagacccttccgcgagggggtatagtggcaatgtgctacacggatcatggtgcaattcagccaacgtcataataaggttgtgttaattgacgtggtcctcatcagaattttgtccgcgctctgaaaatgtccaaggttggcgtctttttttcgtcgcgtcgttcgctgcactatcttctgtctctgaatcacatctcactctcaagtttacttgcatttgccacacaaccaatagcaacctattatg

SEQ ID NO: 1637 - DNA, 703 bp, Nannochloropsis_gaditana
gtatcccccttttctcgccttatcctgtgatgccttcgcgcaagcccggggtccccaaaaaccaacggagacctaccccattacccgacaattctgcaaagcatggctgcgatatggcttccaagaagaaaaatatgtaaatggctatcatttcacttactctttttgtaaagaaacccatctctgctgtgataggacatcgcgtgtatattgggctaattaaaaggggtgggaggttggtacatcgatacatagttgaatgttaaagaagcttaaggatagcaaaatactacatgaattccagaatttgaatttgttaggaagagggaacaattgtatattcaaaggccacggcaacatcgaaaaaaagtgcgtttttcgttcaagaatggcccccctcccgattgtcgccggcgatcgtgtcggaaggctctccgtgttgctttctccctgcctgccccctacgaccctgtttcctgctgctgaattggcaaagattgcatgttatacctaagtctctcacattataagtagttaacggtggctagaaggcgctcgtggcatatttgcgtcgggtcttgtcgagtggactcgatcaaatgccttccattacccggccgctggcttcctggttccatgaacatgcctttttcgctttcccacgctaacaggcgtcaattacgcttgacttgggtgaatcatg

SEQ ID NO: 1638 - DNA, 703 bp, Nannochloropsis_gaditana
tctcatttgtgacgcaaaaacatgccaggatttcacgggagctcgcgaagattctggaggagtcgggaaaccaggttcctgctgccctgcgtgggatgggtggcggaggaggttatggcaggggccggtactgagcgccacaaccttaagatgaagacgtttttggcattttttcatattcgacgggacgtagtgcacttatacatggtacggacttgatggaaaagtagattatgctcctcctcagccgagggacaagcgcagccaccgtggtccctactatagaattatgcgggggtccgttccctggggcagtaaattttagtgagaaagctgtgcctagaatcaaaagtaagcgcgaaaattgtacgagggacgtgtagtgtgcgttggtcgacgaaaaaaaaaggataacagcagacgtgctatcgaggcggggaggttagcgctctttcttggttgtcacaagttgatgcggtttacggaaactctcttttgttcaccgtcattgtcagtccagacccacttgccctttcacgcccattttcgtctcttctgtttgctgaacttgcctccactttggagtttgatttcacggctcatccaaattcaacgtccatgtgcggtatgcccgtgatcgcacgacatgtcatcagtcactatcattcatttcaacacatgcaggcctataaagacgtttatg

SEQ ID NO: 1639 - DNA, 703 bp, Nannochloropsis_gaditana
ggaagggaaaggagggagggggggaggaggtagcacagatacccaataagtcaagtgaaaaaagaagcatgaaaggagctaaaaatgctggcttgccattgaaacatttcagtcttgctacccaatttaacctgcatgcgaaggactgggtgttgcttttgtagcgtcgcgcatgggccgggtgaggcctgggagctggtcgggggggcttggaggaggaaagaggagagaagactgccatttgccctgcgtggtgctcactgccatggcacgacaacgctcttcctccggcaacctgcgcagttgaatctatgcgtgcttgcatcatagtccatgactcacggggcgagtgcgacgcattttgaggatgtagggggttgaggcagctttaccatcgtggtatccacaatgatgcttcttaggaccactgcctccttcttcaccgtttcgttttcgcatttcaggtccggcgcattgcaaaaccccgctttctctgcctcagtatattgataatatttgtattcatgatggttttgtggctcgtgtggcatatacatgagagggaaggcatgaagaattcgattcttgacgggggttattgcttacggggagacgagtcgagaacacacgaacctgaaagaatggaaattgaaaggtcgtgaaaaaccctcactttcaccatatgcacttgataactcataca

SEQ ID NO: 1640 - DNA, 703 bp, Nannochloropsis_gaditana
gtatttcacacctacacccacgcacaatctcatcttgcaggtgcgctcaattttatcttttatctctagatgtacccgcgatgggcacatggtgcctcctgggaggaagagggagcgagccctccccccttttctaatccgatgacaccactcctcgcttataaattgacacgaccacatgtcattcacacagggcaagagcagggtgcgcaatttattttctcattgtgtaccttgagggcagtctgtcgtcggtcgcggaggcgtggattaaaaatgcgctcccagcgaacgcgaagaggaggacgaaagggccacgcacaccagcccttgtcaaagacaccaagacatggtcgcttccacgaagccacgcgaagaatagaaggaggtggaagcaacgcggcatctcttggtctgctatgctctttggtattcgtcagctcggttctgtgcctcctgtctttgcttcgtgccgctgatgccgcacgattcaatcggcctttcggtgaaccgcctcccccgccaccaccaatgggggctcggtaagtctttcaatggatagattgggcgagaaaaatgagacgttggaggtttggatcgcttggaatgattggaacgcgacatgtttgatctctctctctgaaggggggaaggagcggccggtgagggaaacgtggcatgtggcggttgcgagaaaaggatg

SEQ ID NO: 1641 - DNA, 703 bp, Nannochloropsis_gaditana
agccttctctcattgctcaaagagacgtcccgtttgaggttacgagcattcttgcagcttgacacttttgtcatgataattaccttagccgtggtggtgcgaatgcgctcatgctctacaagagatgtgaccatgttccgaagcattgcccatcgatgagatgacgtccgccccagcttgcggtacggcatctgactcctgtctcaagaaaatgggtcaaagacggaataaaattaggttgttttggacttcctcatctgtggacaggatacctcgtcagggaaagactgtgcgctggcggaacaagtgcttctattcaccccacatgcataccgttcgaattaatcaaccgatctttcgagaatcttttgaaagcatctctgcgggcgaccaggtagaaccatgcatgtctcaatacatggccgaaggtcaagtacctgcggaggagagcgtcatcgccgttggggtactattcaatcacatcgtcatcgcaattggggtcatattccatcacattgtcatcgtcatcatccctcactcgctcactcgcttacttgctccaggcctacgcttcgtgtattatgccaaggttgcatggttaaaacatatcaattgaggtatttcgattattttttcccctccaattgacagagcggcttcgccagatggaagagaagtaaatcaagtgtgctctgtgaagatg

SEQ ID NO: 1642 - DNA, 703 bp, Nannochloropsis_gaditana
agtactagccgcgacgtgtcctcagccatggtccttctttaggtagggtgtataccggggtcatgcggaaggtatcttgagggggtagaaatgagaagaagagggagagccagttcaactttggtgaggctgtcggccatggaatggtaggctcacggtgagcttcgacgaaggggcgatgcgagagaagaaaatagcttcacagaatgctcgcccctgagaggcaagctgaatgtctgtaagggaagcgttggaaataggctttgggggagagtgctgtgattgaaagaggacaatgtgaccgatcgtgtcttgagacgcatccatttcaatttgcccatcgggtcgttgcctgctgaagttagatgctgtgattacatagagaaaaatgagcaacgaatattgcggcaatttctggagagaggaacaacaaggtttgagggaaacacaaataattgtgcagctgagtatcctatttcgcgtcgcaccatgccaatacagttgtttcagtgtaaaaaatgaaagttttagcgcgtcttttcagagcacacaacgggaggaaatcgtaagagaggatacaacaaggccacgaagtgtgagaagggcatttgaatgccgactggatgcgagaaggaaaaagatacctctggcgaaccgaccattaaatgaatgtctgatactccttctccccttgccctgtgcg

SEQ ID NO: 1643 - DNA, 703 bp, Nannochloropsis_gaditana
gaacgataaaggtatgctatcagtgaggataatgttagaagtacaattttcccgatgtttcgactaatgatgcctggtgatggctttggaggtgacatgtccggggctccggtagcacttgtagaaggaggagcaggagccggagtggctggagaagccgtcgttgttgaaccggtgcttaggtgtcttggtcgtgtccgatgacgcatcacggttctgaaagaggacagcctgagcgcgttgttcgaggcttgtaccgtgtgtgaactttagttagaggggaaatgaaaaagggaaggcgttgcgttagcaggagcatggggatgaaacgcagaatgttgggccttgatggcttaccagatgaccaaccgcctcatgctgccactgtttcaaatgtttaagcctgtgcatgtacgttgctttgttaaagactgtgaagcggagcaatttctcaaagcaagtttccggggcagttgcgatgacggcgagggcgaagaggaaagatactgccctctttttccataggggcctggataaaacccgtcgcatggaaaacttgttgttcggagagtgcggcctcctagattgatgattagttttacctgtcctctgaatgatgccgtggaagttctctggttgcatggcgattgcctaaccctttccccctcttcgttatctctcgcccagcctctcattaaccatg

SEQ ID NO: 1644 - DNA, 703 bp, Nannochloropsis_gaditana
tggcagctgctctggccgcatcttgagaatcgccttctcatcccggccttgccaggtaaaacgccccaagagtacagtatagccgtcaggagatggcgttacctcgtctgtcaagacctcttccattatgaaatcacgaagatggatgaggttggtagcgctccacttgcttccgcttgaatgagtccgagtgggaaggcgaaaggggaaaggaggtgagggatgaaaagattgcagcggcgaatgataattaatggaaaatcgacaacactcctgcacgtacattcgtctccgcttccatgataatgcggcgacactcaacaatatgctactgacaagaaagaagctcagttgcgatgcggcgatgggcatgagacaagctgaggagggtggcgcaggaggcaagtagtcggaggcaatttctcagaaaccaccccttgggctatccgtcgtgccgtggatgtggatgtatgaaaagtgaattattttgtcaacgttgtagcaaggaggaattctggccttcttttagcaagcgccctgcaataattacgcagtgacttggggaggcgaccgacctcccccctccgcctcttccgcgatgacgcaactcagatcgatgcccggccacacgatcatatggcccgcttagtcatttctttcacatcttgacgcctgcgtacagtactacagagggccttccatg

SEQ ID NO: 1645 - DNA, 703 bp, Nannochloropsis_gaditana
tttacgcatgtgatggtgatagtttctgagataggggccgacgtgtggaagaaagtcgacggctactgatgatgcgcacgctcgcccgtcaaccctcctactcaattggaggttggcgcggtgaaatctggatcgctgcggcgcccaccgtaacaattgttccaaattgttggtgtacagaacctccttctacgccatcgttcaatgggaattgtcctgtaccagcctcacagggccgcctgcacggcacagggaccgtggaaaatgtgggtatctattccatcacattctcatatgggccctcaacggccgacgacgcctgcagccgggacatgctggagaaagtactcgtccgagcctaaagttgacgtacgtaagaacagcgcactagttcgcgtatagttatggcagataatggctgcctgattctttgaattctcgactttccgggggaggtggcccgcgatactatgctaatgctgcccgatgccatctcgtatgagacttggcgttaggtgccatgccttttcgtgacgcttctgttcgtagctgcaggcctctagtcttgcaaaaatcaatttaagacattaacatcatttcaaatatttttttgcccgtctcaacgttcaacagaaggatcgtcctctaccgtgccacattcgctagataggagacggtcaagcttcctcagtcgagcaccatg

SEQ ID NO: 1646 - DNA, 703 bp, Nannochloropsis_gaditana
cactgacttcggccaaggcacttccgaggtagtctttgtcgcgactgatgcggtccacgagctcgttaaaaataggggcggcggcaaccacgtcttcaaatgcttgggcagggaaagaggctggcaaaagggaaaccgggagatgtgtgtattgaatgggatggctctgtgctcggctactcgacggggctaccatttggaggcctttgatcgacgcccatcccacagcggcatcgactagccaggaaggcggtggcggtggggaggaaggggctggggtagagaaactccaagcaccgtcagggtatatcagaagtagagtaagagcgcttatttttcgtaaacacaagttcgtcatggtatttctgtgtgtgtcccggatctggcagaggggacaggggaggtaaaagtagatgtgcatgtcattacaaagagactgcgcacgcaatttgttacgcgctattaatcacgcatgtgctctaaaatcatttttcgatatataaatgctagtatgggggcttttccatgaatcatttctcctgtcaacggagatctcttgctggctgctatgaaaatcaatgggggcaggggaggttaagaggtgtggttgtgcagtataacattgtggctgccccgtggacggcaatctgcaacctcttcatttgaaaagtctttcgttataaatatcaacacagtcgtcatg

SEQ ID NO: 1647 - DNA, 703 bp, Nannochloropsis_gaditana
cattttttacacaaacaacatctttgtgtacatgcttctgggcttctgtttcttggcgaccctctacttcattaaaaccccccgggacaaaccagtcgaggccgaggaggtcaaacaaagcctgcgaaggaggagaaaaatatccaggtagacaacttaacaagatagaacgaagaaaagaaaaaaaagcttcaagataagaattatacgttcctctgctccagtaagggggtaagcgacgaagctcgttgtgccctgatttatggccactctcccatctcctgtaacagaacagaaatgcactacaaatcgaaattctgcgttgaggccgcgacttttcaacttatgaagtaaggcatctccggtcattttttggtgttcttaggttacactgtcacatgggtaaattcatttttcttgaaaaaaaactttgcaaaaatcagtgaataaatggagcaggcgcatcaaggacatgccgcttgctttccaaaaaataaagtgcttcatgctgaaaaaatgaagctgtaagacctggatcgacagaggctaaattatgtgtcgccgttagagtcgttggtccctcaccgccccacagtcaggatactcgcaccccttccatcatcgacgagcatttttatattccaattgccaagccttcatttgaccgccctcatcatatgaccgcattatattcaggaatatg

SEQ ID NO: 1648 - DNA, 703 bp, Nannochloropsis_gaditana
tatccttagtcgtgaaaaatgaaccgatccgcttttttttcggccctcacccgaaatccctacctcgaagtgatccagtcatacttgataacgaagatgacggactccaggagccaagacagcccccgggattgatgtacgcccaggctgtgcaggggatctggaagcagccgagcagaagcacgctccgccctactacagagaataatatccttctcatcattccgtaggcccgcctgtccgagaaaaagcatgaagaggagtatgtcacgcgccattgatgccaaaagtgtgacctcacataccccgagcatgacctctgtatgccagcggtgcgcttgcatcaccttggagaagggaagggaggtgtacagcaagaaaaagtggggcgacagacacagcgcaagggttctgaaaaaggatcaaacatcccgtcagaaacatccggccacacggccacacgtgctatccgacatgctccacgcctttggagccttcgcacgctaattttatgaggtgtcgatgtgccacggccggctgaggtggagcccgctgagataggctgccgtctggcgagagactcgctggcaagccccgcgaggaagacggagaagggggggcgcatccgggagcgaaatttgaaatactatccctgccatccacgctgacagtgtcacagcaccccatcctccaggagaagatg

SEQ ID NO: 1649 - DNA, 703 bp, Nannochloropsis_gaditana; identical to SEQ ID NO: 248

SEQ ID NO: 1650 - DNA, 703 bp, Nannochloropsis_gaditana; identical to SEQ ID NO: 249

SEQ ID NO: 1651 - DNA, 703 bp, Nannochloropsis_gaditana
caggacttcccggtacgcccttcgtgtttcttcatcattcaccaatccggcggctaccaggcgtttccccagcgtgggcacgctctcgtcggctgctaggagtccgcgccccggccgtgccatctgattcgcaattgtctcgagcgcatttttttgatgctgcgtcaattgcgcagccagcttcgcggcctccatcaaatggaggtgatacgcttcgagtccatgtgaagacgcgggtgcttggggggcacttgagggagatgctgtcgacatggtcgggccccgggtgctgcaaggggggaggtggagtaggttgttagcgtcgatctttcatggaagttaatgcaccgtgagagacatgctgaattaagtaagcgagtcttaaagggtttagtagccgtaagaattttggtgattctcgcttcttttttgaagacacacgttgctagcgtgttttgatccctgatctcatcagagatgagcgagcagagcacgggataagaagtccgttagtgacaagaaaaaccctagaaccatgccttcatcttcagcatcacaaacgactcacaagacaggactgctggaagatatctaacatcggagtatcgttcgacggtcgaccatcctggccccgattggtctcagggtcctgagcccgttgtcgtctgtcggctgataacattcttaggcgccagagagcatg

SEQ ID NO: 1652 - DNA, 703 bp, Nannochloropsis_gaditana
gtgaacactctcggatttactttctgggacgccttgttggcagtaggatgttttcgggatctccccggctcaaactttctctgccgcgcgacttcactttctctccacctcggagttgaagggcgagaaagcaggtgcgcacatgcctgactagcgagtcgtgttcaaccctggaaatggacgtccgccaaagtacctgtccaacccttgccagaaagcgtgaattgtgccattcatgttttcctgataagtcttcgaaggagatgttcgtgacacgttcgagcgtggaatctcaccaattcaccttctgaacctacgctttctcaatcatttgtgcacaacatcaggcatcatgcagccaccgcaacaaaatctgccaactcaaaggccgcacgggcaaagttctcatgcgcagtcaccgtcaagattacctgaaagctcaagtgcacactcagtccgccgttcaactgcaattaatcctacatcctccagcaccaagaagagggggcgccagaacccatcgacacggcgaaatttactgcctaaggattttttacaggactatgcactccctcgaggcggtgaattgggtcgaggcgcatttgccgtcgtgcgtcggtgtacggagaggaagacaggcttggagtgggcgtcgaaaatcaccgacctccgcccgatcaaaatgagggggggctcggacatg

SEQ ID NO: 1653 - DNA, 703 bp, Nannochloropsis_gaditana
tatccagaactttacaggtattgttgtataccacagatgaatgccgggaggtaggttgagtttgttgcttcaactatctattcaacgagcatacattcgtgggcgacatttaaaaaaacatgtactcccattaaacttcgcaaaatattcaatgtagtcattctggattttttggggaaagtgaagcaaggtgtgataccgtaatgtgtgttctttccgcaatttgctttttgtcacctctccgacatgcatgatgcaagcttcgtgcaaaagcacgaccgggtcgaattaacaaccccatgaaaaatgtaagatagaaagcgagctctgaactcacagcaggccacacgaatcgacaacaagttaacggtatcgaaatgcttcctctgtgtaatacttttattttccgttaaaaaccgttgtaaacttcaagtgccatggcaacgccggcaaacgatagggattagactgacagacaaatttggcgtgcggtggctcacacgggagcgtgtccgctgcaattttcgaggctagagcacataaggtccatgccacgttcttcaagtttttgattgactgaggctgcgcggagatggactgttgaataatagcatattcttcacgacagtcccgtcttccctcgcatcacatgtccatccaggaataagagtttttcgctacagtgcgctacatttatataatg

SEQ ID NO: 1654 - DNA, 703 bp, Nannochloropsis_gaditana
cgcaagtcatggacgtgtactacgtgctacagaacatggtctatcaggctcccaccattttctcggtcttgaacgcccggctgcggcgttgtgcccacatgctcaacaaagcacagaaaacgctgaatcgggcggtctcttacgattgcacggggggggggatggagggggagggagctgggaccgcgggttcgggaggcgggggcaaggggggcagcgatatgtatcgagtggcgcgacgagcgagtaaggaggggaaagccaacaagcgggctcgagcggcggctgtggcagccagtgcggagatgtacccaccctcctccccgcaatatggcttcccgccttactcttggcagccgcagtattccgaaggggagcccctggttttggtcgacgggctggaccctagctatgccttgccgcccatgatgcccccgcccccgttgcctcacctcctgatcgagccatcctctcccaccgcctcttctcctccctcaaaaagtccgcagcaacagccgcagtcggaggaaaggcctcgatttgcctcgcggtacccgggccccagtcctctggcggcagccatgacgcatccgcatcctgagaactcggtagctgtggaccgcgccatgggcattttggtgagtgatggaagcgagtggtgccgttgggagtgtgagattcgggcggtggggttttgattatg

SEQ ID NO: 1655 - DNA, 703 bp, Nannochloropsis_gaditana
gaggtaccttgtcatggtgtaggggtgccagccacacatcataattttgaaattaggcgagcggcgtggtccagcccggccaagaaaagcagagacaacgaaacagagtgcaggcatttccatacagttgcatgcaatacatgtgaaagtatggttagcgtctactgatcaccagtgccgggttcacctacaaactgtgccggtgattgattcaccggttgttcctagttgctgcttcttcgaagcctcaagacaagcagtcagaaagttactaggttcaggcccgtgcgcgcaggaaaaacatgaccgggccgtcccgaggacaggaatgccctttatccatgccctgtacatgtagcaaggatgtcagtcccaacacgtgggacacgaccgcgtacgagtggtggctccaggcctgcactaagcgctccccgtctaaaccatgacggcgcgaaaggggaaggcgagatacgcaattgagacacaaacgaggggtaacttggggtttgtagccgtagttgaccgtgcttcgaatgaatggtcaagcttatttttcacctttaattcctgcgacacaaacttcttggacgtaaaacacagggtgcgagggcaggatattggactgagtaatccatggatggttagtcggctgccctcaagactttcagtcgtcgccgcttctatctgcttcaccacagacatg

SEQ ID NO: 1656 - DNA, 703 bp, Nannochloropsis_gaditana
cggtgctcgatgacatactttcttacaataaaagaacgtatccgaagacttcacaaaactcgattgagtcgtcctctgcaactgttcatgtgaaaggtgaggaagaacaaacatctgaatatgaggatggacttgaagagccggcatctagcatattcgtcgggttgaacatgcagaaagggtgtgataaaagcagcttttactccaacaaaggtggaaaatggcattacttttgaaaattggctttgagagcgtagtgatgcaagcaaatgtggcctgctaggggtcaagcgtgagaacggggagacgaatacgtcgtgtggtgctcgttgaccttcgtctggttcgcgaagaacatggaataaagcgacgaaagacggaaagtatttggcacgtgcgcataagcgcggggcggtaggtggcgaaaactatcacctcatggcttgatctagcaatgaacatacagcgcctcgagtcctgagtgtcgcatatcgggcttcctgtccgtcatcatgtcgtcatcgaggatcctcgggcaccttttccatcacatcatccggcgtccaccatcgtcatccatagccttcgggtagcttttcgatcacatcatcagactttgccgtcttccccccccgggtattggcgtcttgcgccgggcaaaataatacattgaagccgaattaaatagttatcgcgcacaaac

SEQ ID NO: 1657 - DNA, 703 bp, Nannochloropsis_gaditana
gcctgttcagatcgaagcgaaggacaggtgacggcatgagcatccacttaccaactcatcctaagatatacataagagtcaacagctcacaaccttgtagcccacgggggatataattggcccctggtagctcgcaggccgcgctcagactgcggacgggcggctcgaaaggcagggaacgaaacggctcgaaacgcccggcccggaggctggcagtcgcccgccacctcaacagcgtacgtcttccgaaaacgtggagggctctcgggcctctattgccccgttcgtgacgtgcattttagcgcgggaggcgtgacgagtgtagtggtaaattgagcgcatccctgagaaacctaccgccccgctctcgacggcaagccccaagcactagcctcatgctggatggagagagatccacacttctggtcttccttctgaccccgcccatggcgtgttgacgcgaaatgcatcaacacgtttccgacacgaaaacagacagctttatatcattgctcctgtaattcaaatgtttcatgatgatccttcgttcatggccctgatgttgtatgaatcatctgtccatttgtcgctgcacactgtctttgaactcagcaaacgcaacaacacgattcaacaaactcatccacgccttcacacaaaaaatggacagacaagcgggtagattttacattcagatagcatg

SEQ ID NO: 1658 - DNA, 703 bp, Nannochloropsis_gaditana
aaggagtcgatcaaagattcaatatctacaatcgacaattcttcgcacctgtgtcctgtcaagcggctacgcttaagccttcgtagcgcccgtcatggaaggcagaggcaaggataacacgaaaagaaaccgaaataagatcgagaaaattaatgctttctccacggcttctgtggcctaacaatttgcttcgtttaaggcaaatcttgccagcccattgtcatgtctatagggtgcaagagacggttttacccttttttttttaacaagacgagccgcacacgacgagaggagctcaatttctcagtcacgtctcacacgtcggtctccgcagaccaaacgcgatggccggcgaaagtttcacatgaacatgatcgaggagctctgcctacaagacaagcatgtgctgacagtacagagatggtgtgcattgttgtcccagctctttcgtttggtgtgcgtggtaaagtgcacaccaaacactggtggaggtctctgctggctcgagtcgatcgggagataggttgtgatgatggtgtccgcagatcgttgtgccttgacgactcgttgagcatgtttctggattgaattgaccttcatgttgtacaaagcagggccagagtcacaaaggggatcatactacgcttggctggcctttcgtgatttgtgagtgcccttttcgcttgagactttcgtctccatg

SEQ ID NO: 1659 - DNA, 703 bp, Nannochloropsis_gaditana
cgtccaccctgcatagcgcaggactgtctcaaaatctggcttcctcggcctctgtcaaggtgagggattcaagacgggaaggagagaaataaagggtaatgataggagggaaggtagtatttccagccggtaggaaaattctgaacaacccgtgtattgcaccctttgcatgtgccttgctgctttggggtctgcttgatgcttaatcttgccggtatccttttccttcttgtgactgtggacatcgcctttcctctacctatccagccgaaggacgtgaagaccgagaacgggaggctgattgtggacgacagagagagcgttagcacatgcgcccgagtggtgctagagtggaacatttcaaagtatgagatcaagctcaagaagcgaaaaagtctcacagttctccgcagcatcgcgggccgggcggaaaacgggtcgttcaacgccgtcatgggaccgtctgggtgcggcaagaccagcctcctacagtgtctggccttgcggacgcgagacttcgagggcagtcttaccctgaacggtaaagcattgacaggggcctatttcgcccacacaggctacgtgcaccagaaggagctcttctttccgcacctgaccgtgcgggagcacctggtcttccacgcgctgaaccatctaagccggcacaaatccctggaggaatgcatcgcacgcgtcgaggccg

SEQ ID NO: 1660 - DNA, 703 bp, Nannochloropsis_gaditana
cgaaagtgggcgatcagaagatagggggcggagatttgtacctagtcgccggcatatcggggggggagcggaagcgcctgaacatcgccacggagctcttgggaaatccgcggattttgttgttggacgagcccacgtcggggctcgactcggtcatgggagaactggtctgcctcctgctaaaatccatcgcggtccaggccccccggcgcctagttctcgcagccatccacactccctcttcccgcgtcttcacgcttgtctcccatgtgaccctcctgaccagccacggcgagctcgcctactggggcccgcgcgacaagctgcttcttttcctggaaggtctaggttataggtgtccttcatatttcaaccctgcagactttattctggagctggcatcggcgaaagtgatcgcagggcaggcgggggcacccggtggggtgggcgggcaggaactggcctcaccagggaacgtaagtggctctctgctggtggagtccacctccagcgggaaattggtggctgcatgtaaatcgacgctttcgcgcgacctggcgcccctaggggtgaacaacaggcacaaggaggtggtgggggtgcaggggccgggcgcctccaactgggccgtctcctttaggacgaatctgtggcggtcgtggctctctcagcggagggagtatgtggggctggcggtggctgt

SEQ ID NO: 1661 - DNA, 703 bp, Nannochloropsis_gaditana
ggaaagggggccatgagcgtggtagcaagggtgcgaccatcgccgcgacgacaggcgtcattacagtccttacaacttctaagccactcaaccacattccgtgctattgccagtagcagtgtttgcagtgcggtaggggagaagtgaggggggagtcagtcacaaaactgacaaagtaagctccagtcatgactgggctgccttggtccgggattacgggaaatcggatgccgtgtctagtagtataccaatggaagtcccaacgatcgaagccacagttcgttgtttggatgacacaggatcgcgttacagcaggcgtttgcgagaagaggggaaattacccggtgttttgtacggccctggcgtggacggcgataaagagaggtacctgatcaccgtgaagcgtcgagacatcgaacgtcacatgcgacgactaggagactcgatcgccagcactgtctttgatttgcagctgggggactacaagcagcgggtgctaattcgagacctggatcgcgatcctggtacggccatgcctattgccgtgaactttctccggtatcgacccggctatcccgtgaaggtccccgtctgcttcatcaacgaagagctgtgcctgcctctaaaacggggcggcatgctgttgagcataaaccgcttcattcgtgtgtcgtgcgaaggagaaacacttcccgagatgctg

SEQ ID NO: 1662 - DNA, 703 bp, Nannochloropsis_gaditana
taaattctttcacagaaatgtactggatgaggtggcctccacttttcggaggaaaaagccttggttcgcttacggtcgcattcgagggtattacgaggagcaatgtgggcctcccccctcaatcgtctataatgccaaaaacaaaacatctagtgtacgaacaggcccatggtcctattgtcatcctcgagtgtatcgtgcatttctactggactacttcaatgagacggattttcgggatccgcgatcggaacgatggctgctgaaatataccgatcgccagatggtctacaaggcgctcgaactttccggtgacgaaaaagtcgccttcatggatggcgagcagccacatgtttactaccgtatgacgggaaactcaaccgtctacctggacaaggggatcaaggataaggatttaaagtacattcaaggattgcatgcagaacctacagcgttgctagagcccatccacattgtgagctgcgcctataaacgtgtttcaatattattcgaagtccttaaaacgaatatagaaaaacaagatgtagggatgcggcccatttacattcatatatgtaacaatgggaacgacgagcaggcaacaacaatccagtccatcctgaacggcatcaaaagcttggctgggtatcgtattcggactttcagggacaatccaggtggttttgcgcggtttcacatgatg

SEQ ID NO: 1663 - DNA, 703 bp, Nannochloropsis_gaditana
actccaagaacagccggaggaagcaacgttacacccccaaccatgtcatgagccagctggactgcgggaatcttgcgtgaaaactataacccgacatttcgacgttttaacactccaacgatatcgaaattgggtcattcctgtggatctcttcatgcagatattgcgagggtgccagtcgattgcgtgggtaaatttagcagacaccatgcttggagtggtgaaaaatttgccatgtctgcaggttcctgaagtcgacgaagtattctggaagacaatatgcgaagctacgctcagccctactacaccaattgctgtgccctattcatcactcgtccacaatgttgtgcgacatacggtgtttttgaggaactactcagcaacggcagaaatgaatggcggagtgccaggggatgcactaaaggaggaggtgtgcggacaaatggcccacatgaatgcagctagctttcagggccaggcatgtggtcagacgcaaaagaacggggataccacatgccttccagttaacaagaaaggcaaaattacgaagctcgaggggcatatcagcagcggtgaaggtttgactggccgtcttcacgaaagaaatatacgaaatgatgaatctttagacatcgaaggacaaagaaatggacataaaacgtcgagcgaaggcggaagctcttgcagcgccaccacaagaatg

SEQ ID NO: 1664 - DNA, 703 bp, Nannochloropsis_gaditana
aatgcatttacgaaagttggcgttgcatggcaacttgtccattgacaaatctactgccaaagtgtgacttccctgcccatggatccatgaatgatggcaatgagagacgagtccgagggggtcagaagtcaaagcctatgatggtggtgaccgctccctgggtttcgctcgagtgggtgtcagagccacacgcaaccctgtagcccatgaccgcttgcacgtgaaaaatgcaatcgacacgtgcaaagggaagacagacgccgtccttgccagtcgtgggtggtttttgcgtgcgcttggtcgcgctagcccgcccggcagcattaatacatcaattttaagtagtacctcatctgactacttcatccccgttttatgtcttctgtcacgtagataaaataaagcacaacgatatagtttatgtctctctgcattgaaattggagaatagagggctacgattgaaatgaagttgtatttttaggcatttttcttcgtgggcagacgtcgccagacaaaactggcagccatgtctcgcttaatccgctcgcccgtcttctcaatttttaaagcaacttgtacatcatacgacaggcatccctgcggcaagagataccttatcgttcaccataagaacgagggggccgcttagtcttgtttgggatttgctttggtagttttggaaggaggtcttgcaggtcatg

SEQ ID NO: 1665 - DNA, 703 bp, Nannochloropsis_gaditana
gatggcgtatacgcttactccctgatcctcggtggcaaacgccacattcacaacaaccaagcttgccagaaacatggtcaacgcgacaggcttaagcactgcccagaaggagttggccgagtaaaggacgtcttcaatgtcaaggccctctgcacgggacacgtccgcgaggggtagctggggtgagcgaccttcgtaggatgttgatgtgggttcacggcggacatggctggcaggcaaggaatcgggcaaggagggacttgtccgcgacatgagctgttgtcagtggaaataaagccgggcatcaaaaattgaaaaggcaggaaataatgggcgaggcggcctaagtcctcgcgctgatgatgatcgccgagcctctggcaccgacggtgtcctccgcgcgaaaaacaacgtcaatgcttgggtatgaaacatctataccctcaggtggcagactcttcatgctaaacttcgatctcatcaagcaattcaacgggcttgagggtgctatacgcgccgatttctacagacgaaacgacaggcgtgcgttctccgggtcgccttccttgtgctctttgtgccatcctcatttcttgttatgcttccaccatatcaaaagacgtctacccctacggcaagttaatcgtttccagatcggtagtaatatttaacttttatacacaggcgtgtggaagtgtcaatg

SEQ ID NO: 1666 - DNA, 703 bp, Nannochloropsis_gaditana
cgtagtgatggtggtaacgcccgcggctccggaggccttcatggctcaattagccttttgcctcccagctttggttcgtcgcgccaccatggacgaagtcgatgatgtacataacaccaagctcgtgaatatgctggctgcacgagcagccagtaacattttcaagcaagttcctctcacggacgtagctttgaaggcccatgaaatggctctaatcctggaccactctctgcgccgacgtcgcagcccccgggaagaagataagcggccgcgggctgcattctgcctttttgaagtcacgaaagctttgacagagtcgcctggacccagacacgtgaaagctgctctaccatttctgcttccagtggcgatggcgacgattgtagatgacaatgcggaggtccgcctttacggtctgcagagcttcaatttgctcgttggggtagtgcccctgatggaacccaaagactggtttgtggaaagcaaaagagatcatagctgcaaaaaggagggctttaagactactagcacgttcgagttgcgtcagagcgcactcctacacctcctactaggtggtcaggtcaagcttgcacacgcatcagagggctctcaggggaagaaattactgacgctgccggaccgtctgccctccttattccggaagggacttgttcttcgtccttatcagtgggacggaatcatg

SEQ ID NO: 1667 - DNA, 703 bp, Nannochloropsis_gaditana
agatgatggagcggcgaagggaagggaaggagtggaccgagaatccctcaaagagcagctaggagcgcaagctttgagattgctacagtatctgagattgctttgtgtgcatcctgctttagtgttggagtcaggaagcagggtccggggacagctgctgcgggagatagagtgttcaggtaaaatgttggctttgcagaacttactcttcgcatgcaacgtcgtaaaagatctggaggagggagacggaggatccagggatggaggcaacgaggagcaggctattgacggaaacgtcataggcttttgtgcgacagagggcatgctcgaaaatttcgaagatggcgtaagtcaaggaagtggtggcatgggaccggagggagaggatgaacatatttcgcaggaaggagaatctgaaatcgaagacattccacgtatgcacacaaatttacgggcacaatccccgaaggccatcgaatctacctctggctttccgtctgattttcgcgaagatctccaccgctgcctcatttttgcgcagcatcgcgtcacacttgatgccatcgagacatctatattggcgcgggctcagtggaatccggcctacgcggaattagaggatgcgagcagcagacctgaaacaggcaccggagaggatagtggcagtaccatcggttgtgagacgaggtcagctgcttctatg

SEQ ID NO: 1668 - DNA, 703 bp, Nannochloropsis_gaditana
ctggcggctgtctcgacgaccggggcctgtaccagctccaccatcattcccaccgcccctcctcccccccttcttcgcccccttcctcctctgaactcctaaatcccaccttagcacgcgcctcgcgcgttgccgccggctttgggtggggtcttattggctggatcgtggccaggcccggagggagggagggagggagggagggagggcgggaaggagggagggacgacggggaggaagccgaattttgaatgccaggaagttgtgatagcggcacgcttgcaggtatgaagtggatgggccccaaggaagggagggagggagggagggaggaagggagggaaggagggaaggagggaaggagggagggagggaaggagggagggagggtagatgaggagtctttatggaacgacccaaagatggcgagggacacgaaatgggctacagaggaaaggagcgcagcccgacgatgatgttccatgaaacataaagatagatagatatatagataggtaggtaggtaggtaggtagggagtcgatgttgttcaatgattcatatagataggtagatagacagacagaaaggtaggtagtcgatgatgatccatgtaaatatcaccccacagatcgaaagcatgaaagcctccgtgtcctcctccccgccctccctcggctccgccttcctgaccctggctgtca

SEQ ID NO: 1669 - DNA, 703 bp, Nannochloropsis_gaditana
caaaagcaccatgcatctttgcggtcgccgcaccatgttcacgaacagagggacctttccaaggcgagcgagttcctgtcaacagactgcacgaagatgcagggacagcatcgaccaatgtaacggaatgctccctgaatcagggagaacgcgagagtgggggtgaagaaaaggaagattacgatgagaaaaagggggcccgattaggtgacgcagtgtggattggagacgcaactcccaaagccttttcactcagtccggtcgacttgacctctccaccgtacgacacaagggccagcaagcggcgcaagagtgagcatggcaggatcagtgacgttgatatatcacccgcttcttggacgagaagaagtgctggctgtgatggtgcccaagatacatatcttggggaaagcaccttgcctgtgacgtcaggcgggaagatgtgcgtagaggacccgaggccgggggaaggcggggtctcagagaccataaagcgtgggacaaccaacaggagagctcgagaactcagtgtcgatggaggggaaacgcgtgtcgaacagtcgggagcagggaaggcattagggtgtggggacgacattgactatttgggccctccttctccaatatcgatctcctcctcgtcttccacctccagcccctcctcccccccctttccccctcacggcaacccctcccagctgcg

SEQ ID NO: 1670 - DNA, 703 bp, Nannochloropsis_gaditana
tataagttgggaaataaaaatcactcaacgaccaactttttgccccgcagtgacgtggcccatcgtcgaatgtcaaaatctactatcgtgttcgaaagtggtgacgcagtacctcttgcgttgcaaaagcatatggtgcgcggcaaacacggcacacatgaaattaatttcaggggaggttaaataatttccaaaaagcgactggcacgcaacattttacacggctttagaaaaattgtgatgaatacaatgtcagataaacaaattccccacagataaatcgcaacattagtttttacgtatttttcacatgcatgccgcgcatccttgatcgtagcgttcctagctgtccgccttcggagtcctccatcgccgactgcgtccagtccatgaagcgagcggaccattttagtgcactcgcgggctcaaggactcggcgcataccaccgccgactttcgcgtgcttttgcgctcgggctcgtccttaactcaaagaaaaagaggtactatttatgtcattggagattgacgctggtttggatatagaaagcagcttcactaggatgaccgtcttctgctaacaatagcatatgtttttaaaaagaacaggcaacatgatgtttgacgctgcgtaatttttaatttcgcatccgctcctccacaattacaggcatacataagcaacatcgatttgaacgtcatg

SEQ ID NO: 1671 - DNA, 703 bp, Nannochloropsis_gaditana
catgaacacaccttgcaagaaaaattgcttctttataataatggttggatcgacgctgctgctaccgctggatatggaagaggaggcgtgtgaagaagcagtgctactgatgtttctcacaacctcccacttcggatgaaaatatgctgacgttgacaacttgacatgctggagaagcgccatcacatggcgcatgccacgttcttgtaaggcaagtactgtggacgtgcaagaaatttgcatgaggcgaaaattttagtacaattcaactacagggtcgacgacagaagatcagatctttcagtcagacagaggaaagcaaccaatttgacgtaattcaaatcattggagtacaacgatggtttccctgaaaaagtatcaatttaagtatcgtatccattacccgtccgtaagtttgaaagtgaaacgctggtgtcaggatgcaatttactttatctaccggtagaagcctgcggcgaacggacaagcgagcacttaagactatcaagttgatctatcaactgagagtcaacatgccgccacttgaatccttcatgtcctcctctacatccactcgaacttacaatctcccgttccttccaaaatacaatatctataaggggcttccagctctgccacgggctagtgactgaccgaaagcgccctccttcaccttgttgcattcaggcaatttcgcttcatg

SEQ ID NO: 1672 - DNA, 703 bp, Nannochloropsis_gaditana
ataagaaagacattcgacattgcacgtcctttcaaaaagaccatgccctttgttgagactagtgccaaccagtaaggtttgccgcggttttcatgcaaccggatgagaaacaaatcaagactgggccacgccactcggtacgttggcgcgttcaagcaattaagcgcctgtcgtgacggggcagcggccctgttgcacggtaactaattcccccaaaaaagaactggacatctttctgcccccattctaggggtggcaacaaccttcacaagctactctctgtacgggaacggcgtttgtctcatattcatgcccgtgcggccgctgattcgattgcctgaagccgcttcaggttcgggcatcgcccgtcgagcgagagcccccccgcaaaatgcactctacgccttaataattgccgtcactgcccacgggaatgaggcatgaggcgcggcgccgggctccaaagccctgggaagcgggcgccctcgcgaggcacgcgtcgtgtgtttttgcacatgggacgaagctgggcttggtcgtgacagtaccggtgcttgtctctctggtgtcagtttgttgatcgtcggcggtggacggggtcaggaagaatgttgtcgtccctgggcgggagggagaactggaaggaagggaaatcctgccctcatcatcacttgtacaaccacgacaggatcactgcaccatg

SEQ ID NO: 1673 - DNA, 703 bp, Nannochloropsis_gaditana
ccgcatcccttcatgcaaacaacgatcgcaaaggctcgggaagggggggggtaacacgccgaggtgcccagttggcggcgtcgacttccccgtccccatccagcccgacgtctgtctcgcccaggtccgagggagtagggcccagcccctacagtacggggagctctgggagtaatggtgacgcggggaagaggggtgcgggaaggaagcgtggaattggctccgagggaggcggcggagggggcacgggaaagccgctcgcccagcccaagtacaggaccctgcagcggctgctgcaagacttggaggagagcgactatggaggcattggggcgtggggggagttcaacacgaaccccaggcgccgggtgtcgaggtcatttaactcggagggcgggggcggcggtggaggcacgagcataggtgggttcggggtgcctccgcagcagcagtactaccaggggccgggcggcgttcagcaacaacaaaagcagcaacaggtcggggccgcccacggcgaacaattgtcggggggagggccgatggagggagattcttacggccccccgccgtcaccacaccaaggcttctactggggtccttccagtctccatcaacagcaaccaccgccgccgcagcagccagaggggggggggggagaggggggggggggggcggccgtttgtacagggacgggcggatg

SEQ ID NO: 1674 - DNA, 703 bp, Nannochloropsis_gaditana
ggattctttcccgtccacgagctttgcggggcattcactgcgctcaacctcgtgcggcgggacatcttgggggaacgcatgtcgtggattcgcctgcttgcacctgccgtcatcctccactccatggccaatttcaggggaatgaagccgatatttaaatgggcttcctcttcgccgtggactgagatgcagctccaggcgttgagcgctccggactatgccacagctttgcaacagatatggaaagccgtttggggactggtgtggttcgcggtcttggcgcgggtgctggggtacatcatgttccgacattatctgttgagcaagcaagtccgactccggtatgctgactaccggttttaggggagaaaagacttgtatcgacacatgtataggttggttgccttggaatagcgacaaacagtgtacatggaaacaaaaaaaatgacttgagaaatagagcggcgtgagccgtaaaacgagccgtatcccaacactgaattaacatgagttaaatctctcagtgaattcttccgatttattttacctcgatcatttttgtcaatcagttgttccttcctcgttccggaaccattttgctcgctccatgacgttgtgccttaaatcttcgctgaagaccatatttccaagttgccgcacatccgatacccacgctagcactgcaccaagacagggattcatg

SEQ ID NO: 1675 - DNA, 703 bp, Nannochloropsis_gaditana
agcgtactgccgcgtattggtcattcaggcagatttgcagtacattcgcaggataacttatcttaaaagaatctttatttgatgctcctttttgttcgaaagagtaaaatgatatcctttcgctctgagcttcctgacagacagctacgtgacgtccgccaacagctaggagtgagagacgtggtaatgcagacgcgaaagaatctctctcgcacgacccttgatttacattgggcaacgtaaagattgtttccggactctcaacaccatctttgacggctagtataatgatactgtcattcgtcgaaatgtaagccaagaaattcccccacgtcgcgtaaagcatgggcctaccgtgaaaaagttaaaaatgtgttcgataatttgaaaccacaagaggttctcacagatacatcgttatccagattaaaaaaaaatgaaacatgactgtctcagtgtcctgctgtcaacgcagtgactcgacaaaaattgataactcaatttttgggaataagcgaggggcaggaggttctcttctaccgtgacggctcggagctgcttcgccgcaactcgctcaggaaaggctttactctggaacttgttgagctgtccgccaggctagcttcattgtcatgtaccctcaagttccgacatcacatgataatcaggcggcatacttgtgcgcgaatagctataaaaaatg

SEQ ID NO: 1676 - DNA, 703 bp, Nannochloropsis_gaditana
cgccttcatgtttggcttggagcttcgaagcttcgggtggaaagccagccaggatatttctgacaaatctacgccacgtaccgcacccgaagcagtatcgtgcccttcctagcactgaattccatgctgcacatggtaaggccatatcccctaccatccacactgtaccagctagtcgtcactggatcttcaataataaggcccacaagttgctttttataggcacgctggcaatgggccgttcgatccgatgctaagccgctgcggcagcctgaggctcgccaacaatatggccccgcctctctttgttccgggcttgaaggggtacgctgtcaccgtgcatggaatgactatgccattgaggccacttatacatcgctttggatggtgtgacgattatggtaggtttcgtggaaacagccctggcattcgtgcaatgagctttacagattcactccaagccataactgccgccaaggcctgaaatgagctgtcatccaacctcaaaatatgtaatgcggtagcaacaatgccgtgctagaccattcttttagtagcgattgagtctgtgcatggatgagaatgacttcattgcctgattaagatccttttgcagtagcatacccccctaaaagtgctctgcaaacgcatctctatttcttcctttcaatccacctccagagcattttcacggcccaccatg

SEQ ID NO: 1677 - DNA, 703 bp, Nannochloropsis_gaditana
aacaagggaaatcccgacaagtcagggttggcctcatcggttttcgcggactgctggtcgaacaatttgttcactgctcgtgccatacgcctattcttggaatgcaaggagacaagagccaaaaattacatttatatatagattactatttcatgcacgatcaccaacaaagcccctcaaaacactctcccaaaggcgcaaaaagttttggaaacgaggcccctcgatccgttgccagcggcccctctaaccgagcggctcggggccgggaggttgccttaagtataggtatattggctcatcttgcacacaacttccacttcacacatcctttccagctgccccctcgtcgagtcctgtatgggaacaggaaggacaaggtgacagctgttctctttcctatattgctgtgtgctcttcccctgtcttattttggtattgctccaggtcactatcttcttggagcttgtcgcgtgcaaagtcttcgtgaagggaagatccagttttgatgtcaggtcggctcgctttgctggtctgcccattgcgaacaaatacaaatcctctttggcttgggattgtttaagcacaaatttgcagtctgtcactttgcattcattgttctcgcgtcattgacaggggttggtgacagtccatcacactgcaatcttcagcacaaaggtctggtcctcgagctacgacaatg

SEQ ID NO: 1678 - DNA, 703 bp, Nannochloropsis_gaditana; identical to SEQ ID NO: 273

SEQ ID NO: 1679 - DNA, 703 bp, Nannochloropsis_gaditana
ttgactatttgatggcaaccatttgccaggggcaaccatgtgccagggatgtcaaccggtatcatcgagttcacggatgtgacatgcgctaggatgcctcgttgcgcgctgtccctgtcacattggcaagacctaaaggggcattatcgtcgatcatggtcgtcggggaatcctccgagacagctatctgcgaaggcctcgcagaaccacacatcactttgaagccatccatgatgtgtaagacagaccgggtgtctgtcaggcaaggcacttattttatgacctcactgtagagctgacatcctgtttatcgcgctctgtttgtgaatctctgtgtcttactcagtgtgattcccacaagggcaagcgcgtcgagcgaacgtcgttgtgatagacgcttcacacagctagtgtgagctcaccgcttgcgactttttcagatccttttcaaaagtgatacatgttcaagggccattttcttgattcttgctggacctgatgtggagtcctgaggcaaaagagtgaacagcctcactctggctcacgtgctctctcgtttctcctccaccatcaatcctctctcttcggccccggcatctgagaagggaaggagcctagtgggggccttttttctgtcctcgcgtttcaagcactttagaagcaaaattgaggatttggaagcacattttgagtttacatcatg

SEQ ID NO: 1680 - DNA, 703 bp, Nannochloropsis_gaditana; identical to SEQ ID NO: 274

SEQ ID NO: 1681 - DNA, 703 bp, Nannochloropsis_gaditana
gagaatgcgcagtaccgcagcatattatcttatgggtggctgctgtactacttgtggtgatcctgctcctacgtgcgtcgcttctttaccttcattttctcctccttgtgtcttcgtgctacgaaagcaaagagctagagcgatgggtagacttgctttggaaaggctttgcttgctcgttccaagtactttcatcagtgcattactaatttccaacccgtgtttcagaatctttctattttttctactgcattcaacaactcacgctgctgcacgttgttcttccacaagtcgttggtttgcgccgattttcttgactcaccttttaagcatcgttgccttacgatatgatagtcgcacaagtgctatccgagcagcatcctatgtcgcagtgctatggtcgagctagctattgggatagccgttacaccacgtaagtcccagtgccaagaatgcctcgtcgatgcgcgccttcactcctttttcatgcacacaccctgtagggatccagagccatttgattggtatcagcggtacagcggtctgaagggtctattaaagcaacatattcgcaagagtgattctattttgatggccggatgcggcaattcctcaatgagtgaggacatgtacgaggatggcttcacacacatcacgaatatcgacatttcacgtgtagttgtgaaccagatgcgggaatcgc

SEQ ID NO: 1682 - DNA, 703 bp, Nannochloropsis_gaditana
cgccgtgttcacgcacccgtcatgtttcagcacactgttcagccaacttcgtttgtgagatgcccgaccgacgaatccgaggcgtcgcacatcgaaaggggtaaaagctggagagtaggctgctgaatcagtcgcatcccgacgtcgcaattggccatatatttcacgttttctaaggatactggcacttcggttttgcggtgaaaagagggttgagggacagtccgcgaatgcttcccacgtgggtttgatactcatgggaaagttttaaacggacgtcttcttatctacattatttggtagaaaaaatgtacatggcattgtaaaaaagaagaagaaatttctgtgaaaaacgttgtagagacgaagcattcctcgctcctgcatcaagaaaagcggatcgatcctcgatcactactatcccccctaccaacgtcactctttcaccaccctgtgccacaaacaggtcgtcagtcctcacatgacaaggcggcgcttttccgtcaacaaatcttccatcacctatttcacgtggtgcttcctcttcctttccaattcattggcacgtgccgttctctgtggcatgcttcaatccccaactacagctttcttcttccctctccgacctgcggtgttgcgcggccggaccgttgtcgtcagctccctcactcgacaccaacgtttgcatagctttgccaccatg

SEQ ID NO: 1683 - DNA, 703 bp, Nannochloropsis_gaditana
tgcgacagtcgtctgatgggtcgatcacgactgcttatgcagcagagagggggagatggatacatcaagtatcagctgagaattgggattgctgcggttcataaacttttatcatcacatatttccgtacagagtcttatcaatatagaaatgctgctaaagcctcaaacgtacagcccgctgcgaaagtatgtgtgtcacggggggcaggaaggaggagcatgttgaattacaattcttaggaggcgagagaagccacaaggttgaatgaaaacacagttagattagatagctttggctgagttcaccccttcacgacaggtcattcatacctgggaaaggaaaaatgtggaaacagccaggagccgcagtattgtctccgtctctcaagccttctagccgttaggcacagataatacaccagaagcaagagggctgtctcacggaagattgtttgtacttctagctagcgggtaagtattgttcgtagacgctacagctgttgagtaggacgcagcgaggcggggctcgagcgatacggagttttttgtacgaaagtctcgagtcgtggggagacccgcgagcgtgctagttgacctaacatgtactctccctcggagtcactcacacttacaacagcatcaatgaatagcgtgcgaggattttgtcgtttcaattgtaaaaccggcacgctatcatcaca

SEQ ID NO: 1684 - DNA, 703 bp, Nannochloropsis_gaditana
tgctcatgatataaagtaaagcaaaaggaatacatttacgcttttaaaacgtatatttggcaatcatctttacaccatatcgctgtaacgttcaaggtcaattttatgcaagtagaatgattatgtattatgtatctcgcagagatgttttaagaaagcccactcagttgatttcagaatgttctctctcgttgcgtgatgggccagtgaaagggggaccgtttaatctttttcaaaatttcaaaccacattgacattccggactacgtacgcggctcgtcgttaggctgcataccaagtccctgcgaacacatcctcacgattcgtattatttttgttatttatcttttgtgcgatgctttaatctttctttgctttctttcttccttccaaattatgacatggctcgcaatggttcatataatactcttcgtctttcgaagccagaaggtcttcgtcgcatccccctggccctccactttctttgaagggaactcagcaaactgtcattcgtacgaattaatgtggcagtgttcagtccgtgattaaagtaattatgaaacctcaccataaatagatggcaggccttgaactcaagactgcggtaaatgtcactggacctcaactgtcaatggacaaggactcgtcgctgcctttggcaaagaccaaaagccatggtgacaggaaatattccatcgacatg

SEQ ID NO: 1685 - DNA, 703 bp, Nannochloropsis_gaditana
ttcgaggataagagcatcgacgcgaacagcggattagagcttgagcgtttagcacgccttgctacactccttgaggagatcaaatgcgaggtcctggctttactagaacgggacaattattcccgcttcaaggtaaatatatagtctttaacaatgctaaatttatcttgatatttaggtagcatggccgaaaaacttatttttgcatgtacactttttcacatgacgacacatagaatacgaaggctttcgcagaacttcttggaaaacttgcatcacaactacgcacggagcccgctctttccagccagtcggaaaaggacaacattttttgagagctgggcgccagcagcaagaaggctttataaggagtcacatgttatgatttggaaaaaccatgttttaatggcgatcaactaagatttacaaaaatcaattactagaatgctcaacttaaaagcccaatgcatatattgtgatcctgttttaattactctctcgtcattagagtagcgaattgatgtacgtttcctacagttggtgtcctgcggaggagtgtgcacggtggcaatcaagaggcaagaggcacgaagacttgcaaacgagaaagtcgcccatccgggaggctgcgggtagggttttacttcagaacaaatgccagaaaattgatagaaaggtgtctcccaaaattacaggacatatg

SEQ ID NO: 1686 - DNA, 703 bp, Nannochloropsis_gaditana
agccctgcaaacactaaggcaggtgttacccaaatccatccaccctgtattgacatttcagataatgcgcgtgaagcatttttttacaaagacaaaattatccaacgacgcgttggcctcaccatagccgccatgcccaatccaaaagctagtagaggaagcggcaaggccgcgcggacaaaggatgaggtaattccaatatctgagtctcgatgtgttccattggagggtagatgcgcggcaaagtgtacgtcccgcagttggaaggacactgaagaccgtcgacgatttgccatgtactccttgcttctaaaaatgattgacgagttgcgggggacgaaatgcttctttttcaaactaaacttattataaataatttctgtatatagaggaaaagaacatgcataattgtcattaggctttcagtccgtggcaccaacccgacgatcccgctaggactgcctccatagttgaagctgacgccagtgcgagcttcttccttcttcttcgccgcctcgcccactctcccgccttcccgccttccacgcttttcctagcacaagggccccacggcctccatgaactcatccacttcaatcctatctctccaatcatccccatgaatataggtatggcgccgtccagaaaacagcagattttgccattcgcatttgaatcttccacgagcaacacatctggtagc

SEQ ID NO: 1687 - DNA, 703 bp, Nannochloropsis_gaditana
agataacgatctcaaattcagcagaaagcgaacgacgaagcaaaaaagctgaggataaggtagtaatttgcgctcccacgccagcagcaaatattgaggtgaaagacattcaaagcaaagatattcgagcaacgtctaccgacaataatgatggcattaacaagaaaccaaaaaagcgccttcgcaggttagtcgatgaggatgaggagtcggatgacgatcttcgccttataaacgacaacctccaatatgctcgtgcggcacttgaggtggtagctgagcattgcggagttaaacactccacttcagatgggacgacggccggtggaatagagcatgcgaagaaaatggcggcgacggaggggaaaatgggcggcgacgatcataataccagcgatggtgagaatgaagatagcgcggaggagggtaaggtcgacaaaaatgggcaaaatggatcatttggagatgagaatgtcgataaagaggttcggcttaattccaacatagtgcagcctaccttggaatccagcagaccccctgtcaaaccaaaaaaatcgagtgccaacaaaagtaaggtgatcgcaggaacaacgaaagacatcctcgaggaaattcgcgggctgattccaggatattcaagtttgccttatagaacgctaaccaatgtcctcgcagcggttgagtccgtgactgggcggctaga

SEQ ID NO: 1688 - DNA, 703 bp, Nannochloropsis_gaditana
gattggagagaaaaacattgtggacgcgctggtcaaaagtctgggctgctccgccagctctttgaatcagaagggtgagggtgcagatggagatctgggcacagccgcccaaagggcgaaggcgagccagcggacactcaatttcggagcgaatccccctcccctgacttgccagcatgttctgcaaagcttccgggatatcgccatgtgttctggtggaaggtcgatgaaccagaaaatttcaataatacgtaagctgctcatgcgttgcggaaaggagggagatgaggtcaagtttttagttaggggcctacaaacaaagcttcgttgccgcctagccgaaccgacagtgcttactgcacttgcacagtcttttgttgaatctccaagagaagaagcactgctagctcgttcaaccaaaagccgaaagacagaccacaacaaatctctcgacaaggaagatattcatggtcctcatgaaagcgagccctccagaaatgatttcttggtgcatgcattagctgtattgcgtcagcctacggcgaaccgggtacaaaaatgggaagcagcggaggcgatagttaaacaggcttacagcgaatgccccaattacgatagactgattgacgcgttgatctcagcgccgctgactgacgttctgcgaagctgtcgactgtcaccgggcgtgcccgtcaagccaatg

SEQ ID NO: 1689 - DNA, 703 bp, Nannochloropsis_gaditana
tctcagccgtcgcctggcccgctgccactgaagagaggagacccagcgcaaaaagggtgtcgtcactctcatatacgttttccagagattgaccatattttggttttcctgtgcattgatattgactttatttcaataaacaacaagaatgcgaaaagaacaaagaagatctcgcgcgaagaagccaagaagcgctcttactctttcgatcgagttttgggcgaaaaagggaccagggccaacaaatagacattgttgtgaccactagttctccttccctgacctcagatcgtgctacttatcgtagtgaatggatatgtcggtgaatgtggacacgacagactcggtgtcgactcgacatgtcgagtgttaaccctgatcagctcaaggttgataaagcgcaaggctacccggatccatttccggcaacaaaaaccggctcaactcgttgcgcttactcagatgttccactcaatctcacagacccatcataaccgtgtataaagataggtgattacacccgtgtcacttaaccaacagtcgcccgctgggtagcttcaactattcgcgtggggaacgtaatatggaagctagatgtttcgggctttggcttctcgttgcctgctgctttatacctgtccaaagtttcatgccacggcctagcaagcaagtcaactgctgccctcatacagctcaaaatatg

SEQ ID NO: 1690 - DNA, 703 bp, Nannochloropsis_gaditana
cggcccatcgccttcggctcgggggccgcgaatcgcgttcttctactgattccttttgtgaaccatcattctgacgcctacaacaggcattactgtttgacagaagtcgtgaatttcctattaatcctttcgaggacatcattttcgctcctgcgtcagagggtacctttcgacacaccctgcccctggctcctcgtgtctgcccaacagccttccagggtatttaaaaaggttttacattacaaacgcattatctacatacagcagaagctctttggttccatgtgttacacggtgtcgggatacatcccgagctttggaatagcgcgcttcgcccgtgtccggcgcctaccacccagtcggtaacctcctctcgctctatccttccactatctacactgcatttcgcgatgaattgcgtgacatttttcagctggaatgttgcagcacttcgatctctagataaaggctcgggtatctcgtcgaatgcggcgtctaagaatgactggcttggatgtaagctcgcggccttgggttcacccacatttgtctgcctgcaggagacgaaaatatcgcgggatatgttgaccgaggacgtggcaacgctcaagcattatcacgccttttttgcccacacacatcggggtgtggcacaaggaggagcgtacgctggtgtggtcacgtacgtgagcaagcatgtcgg

SEQ ID NO: 1691 - DNA, 703 bp, Nannochloropsis_gaditana
cctaatcacggccgtgccatactgcgaccctccttaaaatatcacgcaagcgaggaggaggttgtcgccttcccggccccgcgcgcagggcagcaccaggtacaaaatcgtgtcatggcaggtttctatcacctccccccgctcctgccctcgccctgctgcttctttctcgtagtttagcttcattttaatattttaaaacatacactgtcccctatttgaagttcccacttttgtattcaaaggtggacagcccgctcagatgtcactatggttgacgccaccaatgggcctttcggaatggcttgtcggtgccaaagaatgcgctgcaaatgcagcacggagttggcaggatggtttatacaagcagtatttgcctgaaagtcactggatggcactcatagtaatcttagccgtcctacttttgcccttaatcctgaacatctggggatggatgctttggattcttctctcgatcttcctgggactttcccgtaccgtttactccattttcacggtgttacatgtgttgatggacgtgtgggcgctttcagtgatgaaaacgtgctacacaatttaccgctttctcgcggcgttccttcttcctccggctgcggcctccacacgtcaacgcctactgactgcccgcaatgtgactcaatatcaaaccttggccgagcaagtggacgctgaagatggcatg

SEQ ID NO: 1692 - DNA, 703 bp, Nannochloropsis_gaditana
ggaacgtttaaacagccaaagttgccatttatcgtgaatatgtttacactgtgttttgccatgcagccgacgttttttttgataaactacttatggtgggggggcgggaggccagcgtagagactgtctggacgcgaaataaagaaggacaggagccatgtgatctttccaacttgcctgaaggacaaatagtttcagtcattctcttatatgtttaatgttctttgctctattgtgtgagataatctgccaaactatgcctcctctgaacgtaagacggaggatgccaacactaggcgacccggatgaatgtgtggcgaccaaaaataagaagccaaagtttgtgagctagcgtggtatcggtgactccccacattcacggagaaacctaatgactcgctctagcacatgttcctcccgacgtttatcgaaaacataactttctctctttaacccaataacacaattttgacagagtgcggcgcggaagagcgacatagaacgtgaggggactgggagacagagcggataaacacgcaccgatgtgcaagtccggtcgtgtcatcctggtgttcgaggagcaagaatacctatgactggtcttgccagctcagcgtggatacaaaaaaggctattcactctcagaaataatacccagtagacaggagtggacgtagcacaaaggaataaagccaccgtcatg

SEQ ID NO: 1693 - DNA, 703 bp, Nannochloropsis_gaditana
ttgctcgtcggctccttccgagtgggggctttgaacaagtcgaccgggtccacggcctcccaattgctgtactgtccggggaagtccgtcgagaaaacgtgccccgtcacggatgtgacccttatacgtgctgattgtccttcgaagcgcccgtggaattcgtgcactggaggtgagcgtcctatggaacaaattgggcagcaaagtaccttgtgaagggatgccagagaccgcctatctgacgcactttcgatgaccaaggatgaatgcatctaatcaaatcctcagacggcttcagaatgtaacaaaacaaatttatgtccaatgccaacattccgacacttcccacttcttaatcgcacacatacctctcgtactcatttccgcccctgcacagagggcattggcaatagcattgcagatggacggcttttcagccaccatgaccacaagcctgtttccaccgtgattactcctgcctgccatatcttcctgtacaaaataaaaactcttgagcttggtgtagtacgtgatcaattgaaacaaggaagatgtcgaggcaatgatacttacagcgaggatttaagcttcgcctagagagacaacaacacgtacgtgccaattctacgacctccaagactcaatgcatcgactttctgaacccacacccttgatatttcgcttccatagaccatacgccatg

SEQ ID NO: 1694 - DNA, 703 bp, Nannochloropsis_gaditana
ctacccggccagggttgggccgtgcttggtcttttaatagtacttatatcgccagtattcgcgcttgagctgctggaagtactggagctgactgtgctgttggttgtggtgccaagttcgaaggagggacgcggggagggtcccctgcgggggtggcgcgtcatatttagccaccagagggagccagtctcacttgattatactggtgacaatttgttaagagatgatttcttggtcccgtcgctgccgtcttggacgcgtggtctgtggcgtgattatcggagggggcaagtatggggaatgagtcctatgaaggcactgcgctctagcatcgagtctgacgtgtagcggattaaaatcttcaataaaatcttcataagtacaaggcatggggacaggcgacgcagcgtggggagggaactgcgttacttgtttggtgtcgtcctaggcttatgctcctactgcagaggacagcacctagagcttctccactactagtacaaatagaaagtacagtttccaaaacaccaatgatgcaccatttatcaaggtgccatacaagtgcacatgtccgagtgattcgccatgccctgtcgatcacgagagccacgcctgtgcccggttcctgacgcgtgcatgcgcttattaatattttcaggctcagggcccagaagatcgacgcggcgtcgaggctatgttgatg

SEQ ID NO: 1695 - DNA, 703 bp, Nannochloropsis_gaditana
tgccatagtttttcattttgcttctgtgctgcttggactagtggagaggacgttccgatctgaatcgcagcattcgcgcggcgattatatttcaatttgtgccaaaaatgcattttcacatgtcttctgggtcttgttgtgttctcagggggaggccttaaaaaaatggccatttcctggcctcctaagagcttctcacatgtgggggtcagttgtgagggtctctttcgtgttgtgcagctctatttcgtcttctcgggccctactccaccgtgagacaggggctggatacccggaggcataacgtgttaatccatgccgcacgttggcttcttatggttgcgcatgtggtcaagcttccccctctttcagcttaacatctcaccaaaaacaagatttttcaaacagtatggtttgtgataaacggtgagcgtgacttcacgccttttttccccttgctcaattttcagtggccgtcgtgatggccctcctagctcccttattagctggtacacaggagctgtgtcattgattaagccatgcatggtgctacaacatctgtatgcgctacttgataagcaaaggaagactgtttgagaaaagagcgcacgctgccgtgctttcccagagtgaatagatttgaagctgaacactgcgcattccttcaatcttccatctcacaaggattacataaacagagatg

SEQ ID NO: 1696 - DNA, 703 bp, Nannochloropsis_gaditana
cctgcgcattgatatttgattgcatcttttcttctcgtaaacgtcattttactttcatgcttgatttcttaactctctagcctcgcaatattttatcagcacttaaaaatacttttcgattctcaaaccttgaacgttttgctgtcgaacatgataaaatcccgcaggtcttgaaagcttgctcgccgtagttacatgataaacctgaaatggatctaggaattacagcgcaaattactccatacgcttttatctggacatctataattgacttatgtccacgaaatgcgcatcacactgcagagagctttcttcaataaaggaattttattgcgttgccctttcctgaaccggtgcgacaggtggggggaggttaacgttcatttgccggaaaccccgagctgcgaaaaatggatttgcccgcctccccctgacattcatgctattttttcctcatgatgtgactgcacaggaaatgagtgcaaacattagaaggggcattacaacaacgtgcaggctcctgacagcagcgacagccgcgcagagacgacgaagtgccgctgaggcattttcaacagcccgacctctgtcaacacgacgttattcctcctctatccgactcctcacaatcaatctttcaacagcgaaaggaacatctcgcagctcagctggcagagacttaatcagatgtttctaccagaat

SEQ ID NO: 1697 - DNA, 703 bp, Nannochloropsis_gaditana
ctgacccttcgccgactggccgtgtgggtggaggaacccctgcagcgcctccgcctcttgggcaccatgtgcgacagcatgcaccacgtccgtgggggcgccttgatctcggtgctgcatctgcacagtcagcagggcgattctgtcgcccggtcgctcatccaccgcatgctttctcgggtctcgctgcccctgtttgagatgctccggcgttggattctggaaggggagctctccgatgctcatggggaattttttgtggtagtggtcgccgatccccaagggagggaaagtcggagggaaagagcccccgggctcggagccccacatactcaggacagcgacgagtcgctctggcaccatcggtatgccttgcgtccgggtatgattccgcgctttctccccgaggccttggcccacaagattcttgtgttggggaaatccatcaattttatgcgccggtgctgctgtgatcagggatggtctgactcggaaccccgtgggaatccttcttcctctgcctccaccctgctccctaccgcggaggctcggcacgctcgacacgccgcggagctctacgagttctcccacgacaagatggacggtctccagggagtggtggacggggtcgccgcggtcgtgaacgcccgccttctctcccttctgatgagcccccgctaccagctgatggcccacctccggg

SEQ ID NO: 1698 - DNA, 703 bp, Nannochloropsis_gaditana
atcccctccacgtcgccgcaaggtaattaccccgtccaactctctgggacagaccccgccgcctcgccatgcctgccgcacgtgccgcctcgcgatgtcgtgaagacgtgaggaagtctatgttaatagccttgcttggctgccagcgcgtgcacaggctttttaattttgacgtgacggagggaggaagaagagcgcggaaggggaaataaaccccaggctctctcgagaccgagatccaggcttttttttatgtccagagctctcccatgttcttccccatacatggcctggttgccacccagtccagctagcatgcgcgcgggaatgtgccagtggcaggtgtggtttgggcacgtgcgtgcattgtaggaaaaggattgcatatattcacgtgctgatggcctctctgctctgcccggtccgtgatggtcggagcagcacgtgatggtgtacaaacaagggaactcaacctgaccctgcgcattgagcaccaacgttgtcacagtgtgcgcatgcagatatgaacgctgacatatctatgccacggcgcgtgtacaatggtatttggttgtaatgcaagtgtcgaccgggtcacaggatcggctttggaaggaaagtctgagagaggtttgggtccgtatcatccttctaaattaccgcctttcttcccctccgcactcgtgcgaccgaaattttcata

SEQ ID NO: 1699 - DNA, 703 bp, Nannochloropsis_gaditana
gagcgtctgccgggtgctgaggggcatggcggacagcgggcgcctggtggtggcctccatacaccaaccgtcctcccagaccttctccacttttacccacctgatgctcctggcgggccatggccacattgcctactacgggcccacggctaatctgctcgcctatctggccagcgtcggcctccaatgtcctccgtaccacaacatggcggattttgccgtccggtgcgtcgcggtgccgccgggagagggagccgaggaggtcgccgcccgggtggtcaagttgtgcacagcgtacacagagtcggagctggcgcatcaaaaccaggcctggaagttcaaggcgaatttccatctggtacccccggaagccacgcccacgcatgccgggggagggaatcggagtcataaataccagcacctaggcccggggggggtgggagaggaggactcggtggaggaagggaggatggatccgatcatggccatgacggcaggccacccgtccttgcagtccttgacggtcctggaacgggacgcggcggagtcactggagggtccccacccgccgccgaagcggggggatggtcgagggggccgggggcacgagaaggtgtttgcccgcgagtacaacgcgtcgtggacgacccagtttgggtactctctggtccggcagctccaggccctgcaacgggacaagaaa

SEQ ID NO: 1700 - DNA, 703 bp, Nannochloropsis_gaditana
cttttcagtagcacgttgatgctcatccgaaaggatatgatatttaactagaatacgaggcttggcgcccgaccagtcggctttcgtatcctatcgttgagcacatgacgttgtgcaccacggggtactcgccctttataatgcagcttttttgacaaggcatagtcagacgtagggccgtgaattggagtccttgggtatagctgcgctaggttgggcaaggcagtgtacatgccccggaaggcacgcgaggcggcgaactagactacccggatgtctcccacctccaagccgggcagatgcgggaacggatcattgcattgaacgcacctcttcacgggtggtggtagctacgttctcctgtatttacggacaagaattcctgagtgttagcgtggatctcgagggcgggctgggcgtgaaattggacgtgaggtggttacgttgagctgagaccgtgctcctgctccctggggtcgtctccatctcgcgctgattactttggttcactccgttctctttgcactcctcacacacatagggcatttgaagcatgcagagctccctgatggcctgcggtcggttgggtacctctcgacttcaggtcacagcaccagcaacccatcacctttggtacaggtgcctctctgcccctccgcaaaagccccctcctcccccatcaccagaggaactagagaaaatg

SEQ ID NO: 1701 - DNA, 703 bp, Nannochloropsis_gaditana
atgtaccctcggactctttgctcttgactacatttccatgtgcccaatatacacccactatacacctcaacctccacacctagccccgctgacacgctgcagccttatccctaagtgtcccccccctttccaccctcctttcatccctccctgtcctaccccgcccctcccaccacccctcactttcgctcccagtacttcttcacccacggcgccaactccgtttccagcacgttccgagccgcttctcggtagtgcgcgccccaccgggtgggtatcgtcccgaccaagccccccctttcctcatcgaacacgagcaccggccctctgcggcccatttcgtaagtctgccgactttgttctcccaccgaccccaatggccattgtaaatatcgaatcccttgcaccgtcaagtcaatggggatgtgggtgtgcccaaacacatgcagatctggccgcaacgcctctacctgtcttcgcaggggggtcgatccaatcaccttgggcaacatgggctccaagaggaagcgtttttcggggcagagctcctctcgcggcagaaaatgcgagaaggagatcactgtagttttctccgccggggaaccttcccctcgcacccgcgtatcggcaaaaaaaaactcgttttgacgcgcgaaccagaccgccaattcctgcttctccgtctgcagggacacgaagtctt

SEQ ID NO: 1702 - DNA, 703 bp, Nannochloropsis_gaditana
ttgaggagatatgcgggcgtgggagtggggactgaagctgaagaagcacgcaactagagcggagggcgagcatcaagcgaagacgaaagttgacatacccagagccattgggcacccaagattgccatccgtacgcacaatgtttgccacatgcacgtttcttcagttggtttcaatgtcgacggatagaacagtgaagtgctttgcgtcttacacttttgcgcgttcgcatcgacgtgtcctccacgtctaaacccgttgctcattgatgtgcttgccttctcgcgtttttctctcatttgacatgttcattctttcacgtaagacccaaattcacactttacaggagggttgatcacattacaggcccatgtctggtgctggccgtaaaagtgcctaccgcaaaagcgtaacggaggaagtcctccactcatttcctgagcccaatgtggccgccggcgagcgagtggcccgtgttgtccagtcccgtgggggtaatattttgcaggtttgtctacgcacacatagcactgaccgaggataagccgtgctatcaaccggagtgggaaatttgtcccgcgctcgtgcagggaatggtcgagaggaagttttacgaagggagagtgcaatgggtcgacgcctatggcctcactgagcccttcctggccgataattattcctcctttccatgctctgataacag

SEQ ID NO: 1703 - DNA, 703 bp, Nannochloropsis_gaditana
cacgtgtgcttctccaatgagtgaactagcgcatttttcaagaatggtgtggttccaaccccaacgaacatcaattgcgtcatcgacatgactttgttcgcctaccacgcctcgatgatgagcatttcgtaaaacgaaaaggcgacgccatgtctcgaacccaaaaaaatacgttaggaagacggtgcaagttcttgagcatcatcgtgcaatgtatagtttcaaatagcttgttgtttgttccacggtgatcatacatggctgctctgcatcagccccccgctgaaaactctgattttagttttcaaactattgcctcattgaacgtccgatcatcccattcacgatgacacgaagcttgtataaagatggtgacgacacgtagacttgcgaagcacatgcatttgaatcatagtaacatttttactctcgagcctgatccacctgcctattccaccctatctgttcagtctttgcaattagccatgggtttgctttctatactcaaggtacgtggaggcttgatggatattgcagcgacagtcgttatataaatggaattatttgtgtgggaaacgcggcttctcatattacgtactttctggctctttcaatcttctttccgttctcgccattcccgcttttggatgcctgaatcgcgttataacgtgtgcagaaagtcaagcgaaaagagaaagagatg

SEQ ID NO: 1704 - DNA, 703 bp, Nannochloropsis_gaditana
tataatgctcgctctgccatgtccttttcctggtcctttgccatgcttcctccctcctgttcagtacctggaggaattcaagcacagcgacaacagcggggactgggctttcaacacgcttcggacaccagactctcccggcgaagcccgtcactttgcattgcaatgcctggccagtctcttgcagtctcggtggaaagcgtggaatgaggaggttcgactccagtttcgggtggcggtgatggaggtggtggcttccacaggggcgggacgaaacgaggaggtgtatttgcgcgaacgcattgccttgctggtgagcaaaatcggcgaggaggagtaccctgtgcgttggccagagctcttaagggagctggcggatatctgggagggggcgggagcgggctccccggctccgccaatcattgccttgatggcgctgaagaatttggcagaagattgcgtggattccgacttcaacaatttgctgccgaccgcacgccggacggagatcttgcgcgccttgaacttggagttgggggtgttgctgccccgcctgtactcgctcatggcacggacctacgaaggaaggacgcagcagatgggggggaacggcggggagggggggggggcgacggaggttctgagagcagcgctgcagactttgaagcggtttgtggtctggactccgcccgatttgttgatg

SEQ ID NO: 1705 - DNA, 703 bp, Nannochloropsis_gaditana
tattgctttaaggtcctacctgtgtcttatctgctgaaagtgtcttaagaagtaccccaggcaccatagccaaggcctcagcattgccctgcatggttgctattttaaaggggttcgggggagggattgggaaagacaaactgatgaaagaaagctgtcaaccgaagcgatctttgtattccgctgtcagagaaatgtgtcaggccatagaagacatgtctttgattcatgcgacgccgcccaaagcttccaaatgcctgcaactggccgtgcgtttggtaagcgtaagggcgtgggaagccttttggcccgtcgctaacggtatcgtcatctcgagcgatgcgggggtgtctggtcactgcagagactatcatgcccacgctgtgcttcccttgcatcccggaatgccccaaaggatgggtacattcgagattcaagcttatcgcgtgtatgatggacggcattgtgggattttcttgcaccttcggcggcaggagaggaagctgctgacgccaagagcttttgatagcctcctcccttccctttcccctggttttagccttttgtggtgtagttgctacggtggcatacacatctcgtgatcagcacgtcttctcgttgctgctgacgtgtacgctctccttattctgggcttccacttcttacgcgtcggtttcgctcacacggcccgcatcaggccatg

SEQ ID NO: 1706 - DNA, 703 bp, Nannochloropsis_gaditana
agtccggtcatttgagtcagtccccgtggaggtgtcggggagagggaacgttgaaactcgctcttgtcgctacgcctcgagggggcgaggagattaagacacctacaagtgcgcatttcgtccgcagtggaccggacacgactccaacctggtgcacaagtttgccctcgaatgtctctgtcgtaccaaaatttggcctgtggctgctcgtggcggtctctccgagctcattttggtgacagatagcgccgaagcttgcctattctttcgttcaacatgccgggcatgcgcaacgagcgacctcggcccaactcattttccacccacggcgctcttgctgcaacgttggggcataaccttccttcgctcatgcacaccgtaatggttttgtatactgctggtgctcctgattttcatgattcctcatttgtcctcggaccgtcccatcccataccccgcagggcaaggcagggaggatggatttctgatatagggacagcgtcctgcaagtcccccttaatacacctgcgcacgctcgtatacttgcaaggccgaaaaagcacccgctggtgtctcgtgctgcttttgtcggcggaagcagtggcccgaaccccccgcagtaaaacagtagcgtccgtgctccgtccaggaggaacgtgggagtagttcgacgcgaccagtcgtttgtcatccacgcagtatg

SEQ ID NO: 1707 - DNA, 703 bp, Nannochloropsis_gaditana
ggcagtgggggcccctggtattcttccttgtcgaggcactggccttgggcggacagtggatcttgtcgtggaggatatcaggtatgcttacagctggcgcaaacgcagcatgcgatatcagtgctttgcagcacgagcccctcttatcagtagtggaatgctctgcccacgagagcgtggaaacagagggcatggcagacaagataaatctggacgagccagagcaattggagagcgatgcaagcattttgagccgcctggcattctggtggattacccccttgctgagcaggggctatcggaacaaaaggctggacgcggaggacttgccggccctggagccgggggaccgacctgccaccacgcacgcggccctgaggcgggagtgggctcgccgggcagaaatcgctcgacaaagggggcgttccctgaaaccacaaggcggatggcttgtcatgcgggtgcttcttgcggcgcagtggcggacctttgtcgtctgtggggctgtcttgacgctggccaccgctctccagctctcggtgcctgtggtgctgaatcgtttgctcgcgcacattgaggcgggactactggcaaaagggggggcagggaaagggtacgcattagcggtgctcttattcgcccttgccgtccttcagagcgtgtcggagcaccaattttggatctggggcgtccggtgtggaat

SEQ ID NO: 1708 - DNA, 703 bp, Nannochloropsis_gaditana
ccttcagagcgtgtcggagcaccaattttggatctggggcgtccggtgtggaatgcgggcacagagcgccctgatgggcgagtgttttcgaaaagctctgtgcttggggcctgaaagccgtcgaaaatattcgagcgggcagctgataaacctcatgagcgttgacgcctgccgggtggcggatgtaaacgtggtgccaatggtgcactggggcacctggtgcgccgtactcacgctgaccatttccctcgtggccctccacgccttgctcggagcatcctctttcgtcggcgttataataatcgtcgtgttttggccgcttggctatttgctgggactgcgtgggaagaaagcagcgatgcatatacagcgcgagcgcgacaaccgtgccagcgtcatggcggaagttttagaatcaattcgccttgtaaaatctttacaatgggaagatttcgcgaactcgattataaagcaggcgcgtcaacgagaggtaaaggctcaaatacagcggtcggcctgtttcggtggcaacaatgcccttgcgcagcttgctcaagtgatgggtcctctggtgtccttcgcttgcagaatcctatgggagaaggagccgttgactgctgcggtggcatttacatccttggcgtggtttaatttattgaaacgcccactgaactgctttcccagtgcgcttacctctttcatg

SEQ ID NO: 1709 - DNA, 703 bp, Nannochloropsis_gaditana
aaagttcaacgtgatattaaaggagcgagccttagcgtcagcgcttgaaaaggtagagacagtaagacgacaacattgtgcagtaaatgtgactaatagcaggggttataaatcgcaaaagcgctgtgcaatttaaaggatcaaatccaaatcttgaaacggcatagcagggtcgcgcgggctgcgggccttgaacaaaacgaccaattactgaaacgcctttctcacggctctcgcaagcaacgagccgttgacggacatgattattctcgggcccctggagtgtcatggagattttccgctcattattattaaactttatctcttcgcaagaagacgtagagttttcccaagattacttctgtacagtgtctgacattccttttcaagctacttttcctcgtgaaggcttaatgtcgttaacggcaacagccaaacagccaccaacggctgggagtccgttgcgtcaatcttctctgagaatcattccatgctcttgttattctttgtatccccatctccgttatgataaatgtgtatatagactaacgagcacaatgttaacgactttacgaatctacatgctcccctcttcgggttctgataacttcgaaagtgaaaatacgaagcagatatggtagacagctaaatcgatcaacttcacttggaattgatatcattaaaaatcattacgatcctcacc

SEQ ID NO: 1710 - DNA, 703 bp, Nannochloropsis_gaditana
ctttgccaacaacttttcttcgtcgttgattgccaggagtgcctgtcgctttcacttcaagtgacggggcagagggttgtaccctggcgagtcgaacgcgagcgaggaacccgcacagatgcaacgcgcagggggacaaggcccaggacataacagcccactctcaccctttttttcgcaacaggaaatgctcaagcagcagaagcggggtcacatgtcgtgttgcctgcccggatgtgtgagcaggcgtttaatttgtctcctggtctcttccacagtgctgggagcggccgggtactctggcacttctgccagcctccgacaacggcatgcccccgacttcgcgggctttcaaggcacaaagaggcttttgtcttctccaaaccataaaatagtgacctcaatcggagctgcgatcacttctattgaaaagtaagtaaattgaggcacatttttttgggcaatgaggcattgaaatcgcccagacgggcgtcgtgaggaatgactgtgatggcttcttgtccatgctttggctctttaaaattaacatggtgaactgtgaaacttcatcttgtgataatttatggatctttgaatgtatatgatgcaaataaagtgtcacatgttgccttggaaagggttgaagaagcaccctctttcgagtcatgacctgccgaacgcgacctacggcatcaacaggatg

SEQ ID NO: 1711 - DNA, 703 bp, Nannochloropsis_gaditana
aagatgaataaagcttgaaaatgcttctctccgattcgaggtactccccctgaaatcaaggtaaaaatcatttgcttgtacccagagagctcaaaaagaatcaatattgatgtaaaggtagcagtgcaagattctatatcgtatttttcattggttgtattactcgagtattttagttcaccggctctgagtctatgaaagaggtgtccgacgtgctttatgaagggcgggaggtcattctcgcgtgtggtcaactgagttgtcccaattctgctctgccgggcagacgactttccgacgaagtgcaaagtgggtgtccattaacaaagcagtcatgaaaatactgctctttgggacgactgggcttctcagacaggccatcggtctgagctgcgcgcagggactgcggtgtgccacagcgagcgagcggtctcttctgtcccgttggcctttgggggagttgccttgcagcacttcatgtctctttatcacacgggacatgagtttttgcttgcgaaacagccaccttgtcccgatacacttcattggttgtcattcaccatcacccataacaatggtcaagccctcaagtagctcacattcctcccgcctctcatcatcatcagggcccatctctcgctgaaagccctcaaacccttggtcctatcaatcttcccgtgaatcataaagttaaaagctgatg

SEQ ID NO: 1712 - DNA, 703 bp, Nannochloropsis_gaditana
agacagggcgcgaagaaggaagatcccgagctttgctgttcatgttgccaggctttcgcgcacggattttgtatctgcactggtagatgaaatgagacatgtgagtttgtcgagcacaacaggcccggaccggaggaatgtcagcgttcctaacgaaaaagtcgattgtcatggccggaggcctcgctcttcgctccctgcctcgcctgactttgctagtttgcccctcattctccgtcctccacccgcctccgctgcctcgctgcctcgctgcctcgctctcgcctgcaggctgcctccctgctttccatctctcccgtcttatcgctgcctcgctcctcgctgcccccttcctcttccccactcgctcctctcgcgcccctgctcccgtcgactctgagaatctttgccttcccgcaccctaaccttttttaaacttcccgaccctctaccgcgatttgttcatggcttcttcaagcaatattctagccattcattcctggtccggatcttgactatgctttgttcctatgttgtgtcactgtgtcattgcgtactgcctgcgattgatgtcttctggcttggagagccttctcgtcatgccagctaatgatagcatgccacctgtgaacatcctcagtcttaccttattgtacgatctattgtcgcataaatttagacgcgtgatactcaagcaaaaatg

SEQ ID NO: 1713 - DNA, 703 bp, Nannochloropsis_gaditana
ccaccattcgcgtgcactccacctttccacattccacataggagattgcagtgttagcctcaacgatcgggaaaaaatcaaatctttgggggcaaggcgagatgaagttccgcttggcatctgcgacagcagtaactatcctgtcggtgcttgggctctctccttttcatctcgtgtgagtacctacaaaataaccatacgtgcaagaaaattctcgtatcacacttgtgaaatctgtgagccgacccctctcttaaactgtaaagtagctgatgtgcccggtgtctgggggactgatgagaccttccagcctgttccataagtcacgctttactcttttgatgccctcaacagagcagtaaacacacacagaaaatgcggaggcatttctgaaggctttgtttgtccaggcgtccgatcgcggttctaccaatggacgccttcgaaatcgaggagcgagagggaggtaaaagcaaacgtctttcttgtgggcagaagaagaagagtgtccatagctagaagcatagattggtttctattttcccaagatggggaggaagggggtagccagaggcttcagaagactactaccaagtccaaacggaaaaagagcgagaaagaggaggaggatgacttggaagtatttctggcttcactggatacagaagctgaaaatgtaaggcaagattacaatgttgacatg

SEQ ID NO: 1714 - DNA, 703 bp, Nannochloropsis_gaditana
ggctcacaaaaatgcatcaccaaacttcccttcaaaataccttaccggatagtgtgggtgcgtacatgtctgacaaatgggtggctcattccctggttgcatgtgcgcaagatcagagcgtggtgcttgctggcctaaccttgtgcaggaggggagcatgggagggactgagcgtttgattacgccttaaatctttgaatgtcctcttgcatgcctagactacccgctatggcgatcttttcacatgacgtgaacgcctcgttcaggagagcgggcaagtcgctgacctacagcgcctctgttgggtgttcccaggtttatgttcacctgcctcgccccgccgacccctttcgctcgcccgccggccgctgtctgactttgcatccagatccagccacctgtccttatttcacggtcccgcgcactcgttcgctttccacaaaaccgtatgattatcggtaaattgaggctctctatcttcagtggttttccgcttcgtgagcaatcattacctcgtgctggacttgctgacgaggaatcaaaaccgctaacgaacgtttgccctctcttgagtttaccctcgtagccatctcatgcgtcgcgattcacacaagcacagttaatctcactcctaatctgcaaagaaaggtccgatctcggtggtaggttcacggaagtcttcgaatttgcttttgacactatg

SEQ ID NO: 1715 - DNA, 703 bp, Nannochloropsis_gaditana
ccccccctcccgtccagcccctgcgagcttcccgaagatcaagtctttggcctcagcacccccgaaggagacccctgtatccccccccgtccccgacaaagcatctggtgccgggcccttcgctggtctttttggcgggcgccctctttcatcctcttccaagggctccaacagtatcgggaaagctaaggcaggtaaagcgcccagtaagcccttgccgcccatggcaatgccagagagcgccaagcccgcactcaagtcagcaaatgacagcaaaggtcagtttaccggcatatttggtacttcgccaacaaggactccttcacctccgaaacctcaaataatgaagcctgcggctattgatgacaagaaatcgtcacaggatgcaggggctagcggcgggataggagtgttcggtggacttttcgggaaagccaaggtagagacgaagaaggctcagcaggtgcccaagaagcccgaaggttcggcaaagtctgggaagttggacgaagtaagtttgctgtctttgaagcagacgatccgccgagaacaaaaacaagctttgaaatccctcgggaagaagaattaaggtgtcaggaacgtaagaaatggatgacgaagcaaagagcaatgatgttcgagccgtatgtgtgtggcacacaggtgagagtgcattttatgcgtgggctcaattcatctgtca

SEQ ID NO: 1716 - DNA, 703 bp, Nannochloropsis_gaditana
gctcgatctgcttccgatagaggcgttgcgtgtcgaggacggcgacgcagagcgaacattcccagtatgcgcgcccgacactggcctagaagatacgttcaacgccgtagtgggtcttaaaaaaggtatcggaggcgtgttcattccctagcacgtaaatacaactagatttagttcagtttttggtccccacgcgaggttgagagcagtcacctcacccgtgggccctctttaaaataatgtcacgggatttgctcgaccctgctgtatctccgctgcgtgaacctagagatcgacaacaacaatatggagtcgagaatctgctgtaatgttatctacccggtaatgacatgcgtgagaggggtgtctaggggacatggccggtcgctgggagagtttggcgagagactcggatgagcgagacggaggcgaggacgagacacgcatttcgacagacggacagggagggacccagaacgagttggccacaacggtcactcttcggatctcattagggacatatatttttctgcgctgtaagatgttgatactcatggccactgacattttacatgccgctcgcaaagctgacaagcgcgagcttacttcgtgtagtctgaagatggaagactcatcaacgaataaatttgtgtgatctttcaaggtgcaagcttaaccagttctcgacttggtaaatattatg

SEQ ID NO: 1717 - DNA, 703 bp, Nannochloropsis_gaditana
gtcccatccctccttcgaacagcccgatttgaggtgctgcactcagcatatacatcatttactaccccaatcttgcacacgtacaggaatgctgtgataatttctatcacatgcgttgggggcatttgtcagcagagttttcattttttccctcatcaaacgcgtggcacttgcaagcacccatatacgaatccagcagtgctaagccccatgaaacatttgacgctcttgtgatgtctatgtattatttcaagccactgcatatcggtagcaaactatcttaattgcgttataaaacatattggtagtctgtcagtgggttcgtatcgtgatctcgtagatgacacgtgctatttacggctcaaaaataatgcatcatatgttgtgtacgcccttgatgatctatttgcgtctgaattgtgtgatggtttgatagctgcatatccagtgcttaccatattaacttctacaatttgtttggtgacaaccttttcgagatgcgtaggcaaatgcagatgagggcatggtgccgtacacgaacatttgtgaatacattcggtccgcgctttgcaataacatggtcgatgcctcccgtcaagcatcacgattttcttcataccaactctgataggatctgacgtaattatctcgcattctattcttcagggaagcagcgtccacagacttagctaccaggatcatg

SEQ ID NO: 1718 - DNA, 703 bp, Nannochloropsis_gaditana
tgctgatggtgccaggctgtgtcacgaggcagaaaaccctgtcccgggggaggaatgtatgtctttcgggggtttgctaggataatatactggtcttcctcgcgatcgttccatttagtccgcgccacgtgcttgacggctgcgagtgctcccctctcaagcttgtacttcacgattccaactccaacctggaaaaatgaagattttttttgaagacttacgatggtacatattagaatagggggaaagctggtagaacgaaccttattcgcactgccctcaatgcccagaaagtactgggaaggcaacagatcctcgcgcggcagggggaggttaccctctatgccgctaatcccctccccccccgaatccatccagcgtctttcgaacgaaatatggtgctgtctacgcggctctgtgcattgaaagtgccgcctcatccatgaaacactttctctatatgtgtcctaccacatcgccttgtttcgtttcgccccctcgcgctctgcgtcctcctcgggtctccctcggacttcgaagactcgcctgaaccggcggaggtatgcccggcgattcaagagccgtgtgtgcactctgctttacatcgtattccgcttctcttttgtacatctactccctgtagaaccagccagtgattgatatctcactagtctcgctggacatgactcctgccgcgtcagct

SEQ ID NO: 1719 - DNA, 703 bp, Nannochloropsis_gaditana
acagcacatcgaaatatgcagcccacgaccagagccacatccagtctagccgtgtccgatgattacaaataataagaacgttgtccttcttcgtgaaggtgtcgcctgaaatgatcaactttacccccccaaaattttcaagaagccatgctccgaaggataaccaataagcagctatcgttgcctcccatagtctcaatacccgtctcacaggtgcatatggcataatcagcaacgcgatggcaggtggaagcattaaaaagtggcagaaacagaaagcactcaggagtagcggaaaaaggattgcgattcctacatgaattcgattaggacaagtcttgcaggatttgttacttctcatctagccatggagtgtagggggagtggtcggcgcattgtcagtttcaaggcatcccatgcagagtgtcacacatggacaatgagcgagggcggcgggctgggggcagtcttagtagggcaaggtagggcggcatcacggtgctcttccgcgcttcctcccagacggctctcattcttgctatgcaagtttgtgcctgcgaggggtaatggagagaggtgtaagagtttacggttcatctgatgttgtatttttcacgtacaaaacggatatttattgaaaaaatagcaacagattgcttgctccctttctcgtagcctcctctgactgctcatggagcagctc

SEQ ID NO: 1720 - DNA, 703 bp, Nannochloropsis_gaditana
tctactaaaagttctttgagcgccaagggtaataatggtgcgtcatctttgatgaggggaatttcggctgctcctttatgtgattgagcattccggtcacacgtagattctgcgtcctctactctttttccctccatccagttcagatttctgtaatttgttgtgccatttatgagactagataaataacacacagcgttcacagaaaaggcgccatgtttcttggcggcaacttcggcgactccgccggagcctcagccatttcacgcctgcgttccgcgggccccgaagatgtgaaaactgtgcgccggcgagcgactaggcttcgtgactgacatctagggatgccttttttgaaaagctcgtgtccccgtcgagcctgctacatgctttcacactaaggcgagcactgttggcagggaggggcacgggggggaggtctcaggatggagagagcgtgggcggcaagtctcggcctcccggcaaagccttcaatcaggccgttctttttatagtgttgcttgggttcgccctttggtatgatgacttcgatgaatatcctaaatatgttcacatcacactcgtcaatctgcgcaattgttacttgtgcgtggtccacgctgtctgaagtcacccaccggcaaccataaaattgatctcttattaagcacacacatctcattcaacattttctttttgtaga

SEQ ID NO: 1721 - DNA, 703 bp, Nannochloropsis_gaditana
ggcaatgaaaagttgactcacggacggtgcgtatcgatacagaggagtgctggttggtttgttgctcgacgacgacgtcccaaaaattgacacgtgatgcttttgtataaagccactggttgaaagatatttcccgagaaaaataatggaaaataaggctctgaaatggccataatggcggtatgtcataacaaaaagcaccctccacggcccaacgaggctcctgttttacgtgaaagtgcccctgtgtgaaggaagcgcaatgaggtttctgtgaacaaagcttatcaaaggccagtctcgtacagtttcatcttgacgctcgcacatggtgaaattgagtaaggaagagcagtagtcaggaggaaggggccggcaaggcagtgtggcagcgcagggtggatattatcttcctccgagtcgccgcctccgcccgaggcgagctctctgcgatcccacctcagacagggcactattttctaaagagcacgcggctattactctttcttcatcatcgcatcaggtttattttcgcagaagcatttatcgcttgcattctctacgaataacatcttgtcgataaacaaatcgtcttttaataccaagatcgatgcgccttttccacgctcccggtgatggaccactcgcattttagctctacatagttctgagaggcaattgaaagattgtttggccccaaatg

SEQ ID NO: 1722 - DNA, 703 bp, Nannochloropsis_gaditana
cacgcgcgcaccttcctcacaccgccgcagaaacgccatctgtgcttcatgtctttgattttttcgttgttctctgcgctgctttcgcagtagttgatcgttcttgctttctgaggttgcagcctgtaagttgagattgtcgtcctgaccaacctccccactctgcctgtttgtctcctgtcgtgcagccctcttggctgctttcttggtcgcttttttcaccttccacatctcttgtcgccacaactttttcgctacgcttttagaaacatctttcacgcgagacggttttcgaaataagaagaggttgccgcccttaactggtgttgaagaggacggagccgaggctgacggcggtgcggggatggataacgtgtcttcactcgcgtcgcgcacagcttccgctgcagagttggcagacctcttaggctccatttcacctagtgtaggttgcttggcgagatgttttggtcgttaatgagtccatgtagtgtgagtgcgtgtcgacagaggtcgagtgcgaggttgagcgaacgggaggcaaccctgtcgctggcgaggccccacattggaagacgataagcacccaagccctgaccagattttttgaagtaagacttgtttagctcgtgtccccgaccttccagagactgcatgataaatggaaggcagacgtgttatttagctcacaccactgattgcg

SEQ ID NO: 1723 - DNA, 703 bp, Nannochloropsis_gaditana
ctgtaaaggaggaaaaacgtcaagcaacaaaacaaaaagagccttccctaacctttagctagttcacttcaggcctgtagaacgggctgacatgaatccccgaatcccacatcattgacaacacagtactttaataatgcctttggcaaggagactcatggaatttttgttcatgcttttgcttgtggaaggcgacgggctggtcgcgaagatctttttccacaataaattgcctactcagctcccgtgttccacgatggcgtgttgtcgcagaaatccagcgaagaatcaaggtcgaaagggaggggggaacgagactgagcatgcgcatacgcaaccccaacagctttgtatccgaaaccagcatcacaaatccgcggaggggggggccgactttgcttcatccctcgatccgtcaagcaaatcaacttctcctcttgactctattacagctttcaaaccagacattttatctccaagttcttttattctcttcgcactcatggctttctacattgtggatgcgtgtctctgcgacctgtggctaccgccagctaatgcggtagattctagtctcataacagaaatcgatgtagctgggatcttgcagaaagctggaaaaaaagcgcttggaggggggctttcgggtgcggtcgcgtctttagtccaacttattacgttgatgtggcttcgcaccaccatg

SEQ ID NO: 1724 - DNA, 703 bp, Nannochloropsis_gaditana
gtgcggtcgcgtctttagtccaacttattacgttgatgtggcttcgcaccaccatgcaataccaatacagatatgggttgccgtttgcagccactgttcagcaactttacaaggagggcggcataactcgcttttatcaaggcttgcccgtcgcccttttccaacttccactttcccgattcgctgatgttgctgctaatgcgtttatgattgctgctctcgattcgtttgaatcaacgcgcggcctacctttacctctaaagtccgcttttggaagcatcgcggcgggtacctggcgattggtattgacacctttggacgtggtaaagacaacattgcaggtattattcgttatgtgatacggacctgaactacggctgggacgcatgaattgattgaatagcggtgtaaaatctcttcaaagagctcactcactaacgcatacacaggtccaaggctcaaaagctttgccgcagctcgcagcgcggctaagaagagagggaattccttcactttatcaaggagctgttattcaagcagttgccacggctgcgggacactggccgtactttctaaccttcaattatttatcgtcgattatccccgtaccaccttcaggtgaaatttttccgcgtctgggtagaaatgccttcttaggtaattttgtggtgtgccaaagaaaaagctttcgggttaatactac

SEQ ID NO: 1725 - DNA, 703 bp, Nannochloropsis_gaditana
acaaaattgaaatggcggtccatccgagttctgattttcgacctaattgcgagggcactgtaagaatagccgcagaggacgaaggggtggatcgagcaggatcctcgctgacaaacttagcccctggtgaaatgtacaacgtgccactcagtcttttgcgacttgcaatagattctgccgcgggatcgggatttctgccaagtttaggaaggctgtggatcagaccgcaaaaatggagagcttcgatggtagcaagagctcctgcaagacatcctcaatcttatgcagaagtccaatttagcacagaaccagtggatcttaagatgctggtggatgaatcggcgcggctatttacgacatgggctaaaactcaaggagatcatgaaccagttggagagaaatctcctgtttcattgactaataacgtcttgcagcgacataccaaacaccttctatgccccgtactacatgacgtcggtcaagctagtcaggttccttcgtacttttctactccatcacatgacaccagtaccgcatcttctgttagttattgtgtggagataatccggactaaatttaagaagaatgatgttgatggttgcgctgatgataatccgaataccatgaaagatggtttgcaaaggggagcaggaagtggaactcactgggatagtaagaatgtggagccaattcacggaccttt

SEQ ID NO: 1726 - DNA, 703 bp, Nannochloropsis_gaditana
gttccctggtgaattaggactgtctaaatttcaccacaaggtgaagggtggttttcaaaccaatacctctcgaatgtctacgcattttactgattcatacgggctatttgagctttgcgaagcttcgtttatgttcaattattccgaggaaaccccattaagcttgggactacagcgcttaaaaatcaaggtcaatgattctgcctggtcgaaaagtttttcgctggatacagttggagtcaatcaagtgataacagtacggcacccgcaatggggcgatatggaaatcgggttcataataaatgtagccccaggcaggctcggacaattcacaaaagttgtattcttttgtcctcggtatgtcgtctggaacagacacccactccctctatacctttctcaggactcaacatacttccgcctgggtcacatatctgatgagattggcagtcactgcatcgctcaggctcatctacctaggagctctgagaagcgtgtgactgtccaacttcagggtggctatgataaaagtgcacccttccttatcgatgctggtgcagacttatgcctaagactcaccaggcttactgatttatcgcgcgtaaggcatcttatgactagaaagaatcccgaattcgatattcaattgcccccagggcaggagatcgggctttggctagaaacagattggaatcacgaaatg

SEQ ID NO: 1727 - DNA, 703 bp, Nannochloropsis_gaditana
accaacgcaactctggaatgcatagagcggacaggcgggatctttagctgttgtagcgtcaattgcctgatgtgaatttcaggggtaaaatgtccaactatgcgtccggaaatatcccggccacacccaccttcccgccagtatgctggtaacaaacggggatgcaggtaatctagacatgatcttgtctcgcgtttttcaaatgccctgtatgattttcatgagctctaggtgtgtgagaccgtgagaaagatggaccgcacaagactgattgattgacaggattactcaacatgtagtttcttaaagtagacgtcaggcccccaaaacattgcaatgacagccgcctggtgtgctgtttgcatcttgagttgacgcgaaagagggtcaactccgcctagtccacgggggggaagtacacctcccacgtctggcgagtgacccccctgcgagagcgtccacttcctccctaagcatgctcccaattttacggacgatcagaatcgaatctgtggactcttcaattcgcatggacagatcttatttgaaccgcgtgccatgtctacaacagtctccaattgtcaatctctaactaacaagttgtaagcccgagcatcgcccggtataccatcttgagcctgaagttttaacaccatcataacacctatgctcgcacgcaatcatctcttacggaacaggcatg

SEQ ID NO: 1728 - DNA, 703 bp, Nannochloropsis_gaditana
cttgcgtcttctccgtttgcgagcgctgggacaacttatttcaagttcacagcaaatacattgtacaaaacgatctcaaatggtacgttaggcccccttacatggattgtgaatggtggtctggggatcatgggactcattgtcaaggaacattaataacactcatacaacccgcaaataggatggaccggaatacattacagtccaattgaaaccaatcgggccgtgtgtatacgttatagttggcaagctagatccacaagtaagcccgccctatcgcattgtgaataggacgaaaaatttcatgattcattataggcaagcgggttgtgagatgcacccgtggaatactttggctccgcacgaatcaagcatctatacgtgggaagaaccgatgaaatctcgtaagcttgatcttcgcgtcgctcctaggcaaggaatgcttggtatgcgagggatggatgctcatccagctgcaatacgggaaaggcagtcaagaatttttcgtcaaggagttccgaatattttgtttgccaagatacctggcgttcgaattcgattggacggaattggccgcgcgcaccccatcccgctccacgagccctatacagacgatggccactgtctcactgctcgcataggaacggaagggacgactcgggtcttaaacgtatcaaaagatggatcggctgacgaacgaatg

SEQ ID NO: 1729 - DNA, 703 bp, Nannochloropsis_gaditana
agcgcattggagctgcacaactaaatcgcaagaggcccacgacgccgccttgaccgcgaaacatactcagcgattatgcctacgacaaatttgagaagtggatagaataattgtgagtttttcccgaaagcgtgcgactttttccccttagagccttgattagctagagcgtgcgtggccggtctcaaaaagcttctttggggggaaggaaacagagccgcgcccatggtagagcatacttcgtcatcatttaaaaaaacgaagatgaagaataataagaaacaaccttgatggctacttgtagtcttgccctgtccggcgaatgatgcctggcaagtgttgaggaggccaagaacatggggcgtgaatctcgacgacgcgtattgtcccaatctcgccgccgccgcctactcgctcacaagccttggcgcggggatgaagaagaggaaatgacaagcttgttcaatccgcctggtatgagtgatcgtcttaggattgtttcgatgcacaatcaagattgcaccatatccaatgaaagtaagtcataaaagcatagcattggacacagcgacgtagaaaaaaaacctcccgattaccaacaagcttgacccatacatacgtcaacaggtagaacaaggtctattattcgtttggtgttcgatcttcaaggcctttcccgaacataagggtagacgaggttatg

SEQ ID NO: 1730 - DNA, 703 bp, Nannochloropsis_gaditana
cagtctttttcggcaaaaggacaggaatgaaattatgagaccggatcgtctatgccggctcaagtacgttttcattttgtttcaggaagtagatttgaaggttgaagaagccttcgtccatgccctgtggcagtccttttcgagagtactagtcgaccacttggttacatcctccacgctgtacgcccagcttcgacaagaacatggcgcaggacaacgagaagccagagcaacgtccgaagaacaggcacgacaagccgtaaataccatgacctatcaccaaatttcaaaagatagctctccatcccccagactaccgtcatcattccactcatctggttcagagggagaacagaccaatacggagggtgcactcttggtcccgcgcagccgagctttatacatgcaacctacggaaagtccctctcaatatgaagcccaaaatcgatttgttaccacgcagtcctccttaaaaacatctacaaaagacggtcctggtgtacgtttatgtggtaatggtgaagatgacttaaatcttgagggtgattcacatccttatgtgacgcagatggtatacattgaacgtttagaattgtgtccaatcaaggtaaatgtcagcttccacaagagcgcggttgaccgaaaggtatggcaggtggcaattggcagcaccgacgtggcggccgaagcagcactacgcatg

SEQ ID NO: 1731 - DNA, 703 bp, Nannochloropsis_gaditana
gtggcgggaatttggagaaaagtaacctcgtgacgacgcagtgatataagcgacattcgcacagtgaaaatgtcaaagatgttgtaaagaaattcagaatcgccttatgcggtttgatgactccctctggcattattttttccgttccctgacctctttttctgtcatcgatggtttgtgagcccccaaaagatgcgacctcctgcctcgtatcagacgatggacggatcgaaacaaagcttccaccgaatccaacctgtctccaccattcttgtccttaaaaattatgctggacgcctatgattggctcaaaggtcatatttgaatagcttctgagtgacggtcgggaaacgagccggacgtgtggtcctttgcaaagaccacgcatcttagacgaggcggccgggcgggcgaggcgtgaaagaagcgaaccctcagaatcgtgtgcctcttttttcccgggccaatgtggccattggacgcgccccgtgcatcttttatcggccagatcttttcgactgggaccacacgcattatgcacacgctgtttgcgctgcaggtgttgacttggcaattgatacctcgctcgcgcctgtgtaggaacggacatgatgcgcgaaaagccccgcctgctggctcacactacgaatatttgtccgcacattcttttaggcttcacaactttcacgctttgaaaacaatg

SEQ ID NO: 1732 - DNA, 703 bp, Nannochloropsis_gaditana
gcggccatcaagtgcggttgggtttgatagatgggttgtaacgaagggcttgtatttacaaaggcttcagatcttatgtaagattttatgctcagaaagagcaccaaaaatatcaaccaggaggggggtagtggggaggtaaagcggcaacagagaacccgaactcccattccagtcccacacaaacgcgctaaagaattggcctgagtcctgcacagagtcctgaatttggaatgggcgttgaaagggcaagttagcggaagcgatggaagcggggccgcgcaagtcctcgggaagggcaccggggtgggcgccagaaggcgatggggtcagacggtctggcctagtcctctcgccgcctcgttttctgctgactcatgccacgctcctcatcggatgtacgacccgtgacagcttcatcccacacccgtgtttgtcgcttcgaagtaggaataaagtcgtgtcggtgaatgcggaagcgctttgttgctctattttcccccatatctttctgactgctaaggcgctcgatctttgtgatgtcgacgcggcgaaagcgtggcaattagaatctccaacacattttgtacttataagtcacagtgcacaggagttcagcttcgaccctcagaggcacgagcaggccgatctgataccttttgccgccatctggctgtttttgcgccgacggcagtaagccatg

SEQ ID NO: 1733 - DNA, 703 bp, Nannochloropsis_gaditana
ggcccgcaggcataccatttcagcgcctccagagagggtctttccgccgactttttaagcaaaggaattaatggggacgaggacgcgccaaaatgccttctgttgcgtgttaaaaccgccgaaagtgttaaccgtggcaagttcacgaagtatgtcgacctggcaagcgtctcgagggcgccacgaggacgccctgggaatgacatgctctgttgcctctgccactgcagaatttaagcgtttcgccggctagtgccgcctgcacggtccgtctctaaaactcatgaagcctgtagataaatgaatagtcatcaacaggaaaaatatctacatttggttgtcatatgcccagtaagttaagcagccaattgagtgactactggcagcacagatactgcttgcctttgagcgagcgctgagcgaggacgcggaaaaaagccttgttcctctcttatcggactaccacttatgacttggacagtccacatgcccaccaaaatcatgccaatattccttgtataggaagtccttatagataatctagcgcaagggtctgtgatggcttaatattcggtgggacgagccagctgttggctagtagctgagccagccagccaggaggaggtagttccgggggcggtgaggagctgccggctgactttgacgtgacgccttcagggcgggtcacagctgctgcaaaatg

SEQ ID NO: 1734 - DNA, 703 bp, Nannochloropsis_gaditana
ggcaacggaggggacacttttcccgcttcttgtgtgggtgagtgctgctggaaatcgagcctcgagctggagtgggagattggagcaagaagttcgagcggctttgctccggtggcgagactggacacaagatgaccctgtccaaacgattgcagccgtcctagaagaattgcgtttgcgtgttcagcacggtgcgcgttgtgatctcactggtaggatgcttaaggtagacggggcttctttcgaaccagtgcctccttacacgctgtcaggagggactgggagcggtttggcctatcgtatgtgcctgtgagcaagtatgtgatgtatgcgagtcactgacaagggtaatggttagtgtccagaccagatgtgatagtgtgccaataaaatccgtagcatcgcatttcggacagcaatctaggagataggaagatgttcgtaagatgcaccgtttccagacaattaatggagtgcaaatgcatcatctgaggtaaaaattaacgtaaaatcagaaaagtctcgatgtggcatgtaggtagtatgggccggtgacgctttgcatgcacgttctttttctgggtgcagatcgatggtttacgcaatcgaagcacgttcagcataaggctcgatttgatagccttacgatgtttgatactatttgtttacacactaatatcccaatcaacttattggtaacatg

SEQ ID NO: 1735 - DNA, 703 bp, Nannochloropsis_gaditana
tgcaaaagctcccttgcatttcaaccaagaacatatgaagcgatacaaatacatttgctttattcttagcgtgagcttccaaccaagtcgattcgcgggtcttctctgatttgataaccacattgattttgatagaggtgagagctgtaggtgtgtgtttccacaaaaatgggtgaggcagaacggaggattatgacacgcagactgagtacggacgtgcgcaagtcttctctaaaaaaatctgcatgagtactgttccacccctctttcggttttttgaatcgaaaatgccttatggggatcgtgctacgcagaaagcaaggcaaggcaagtctgtatgaacagatcggaacggaagggtgacgtcgccgaccgggtccttcacgcatctcagtgcgcccgctttcacatgcttgccagtgttgttcacccggtatgctacaggatttcactatttcacgaggatgacattcaaagtttggcattttgccaataaaattagaatcttcaccattgcttgctcgttacaataccatggatcgttgttgttgatgttgttgttgttgttgttgttgttgttgttgaacaaggagtcccacagcagacgtgacgtcgctcgcattcacaagcaggaacaaacggtgggtgtgagaacaccggtccagggatccgattgtctgcagttactcaatgcacaattatg

SEQ ID NO: 1736 - DNA, 703 bp, Nannochloropsis_gaditana
gtgctgaagaaggccctctttgcgtgaacgaaaccgtataatcaatcatttcgtcctcaataattaaatcatacggctcactatattcagataccgctccgattcgtgctttgcgtgggccaacgcgtccccttcgtggcggcgcgtctccatggatgacgaacagctccgagcttcagcggtagcgaggatgacgcgggctcccgtattgcccctgctacaaggtgtgaatgaggacgcacatgatcaagaaggcacagatttatgtgcgtttgaggagctagaaggtattgccgcactggagccgcttcagacaagaacgcctcaatctcaagtacttgtacgaatttgcagctttatccttgtcacggagttctgcgagcgcttgtcttattatggaatcggggggagtttggtgttgctttttcagtcgcagctgaattacaccaatgcacaggcggacaatgcgtacgccgtttggtcggggctttgttattgtgcccctcttttagggggatggcttgccgattcataccttggccgtttcaagaccattggtattttcagcggcgtttatctactgggactcataatcttaattatcggtgttcttccccgcgatcagatggatgctacttatgcggacgcatcggctgcccgtactctgactgaagctttagtttacattgggatatacacgatg

SEQ ID NO: 1737 - DNA, 703 bp, Nannochloropsis_gaditana
cgggaaggacggggaggagcgcgtactgcgtgctgaagcgaaagtgagcgatctggagggggaaatgagccgattgcggaccgaaatggcagcaagcattggagaaggcacagccctgaaggtggagctggcgtccaagcgggaggaggccaaggcccacttaagcgccgctcaggaagcgcaagccgccttgcaagaactccgagcctccctggctgtggagaaggagctgcgatcgcgggccgaggggaaggaggcggaagagcgggaagagcgcgtggctgcaaatgctcagttgctggccatgcagcaggcccatgggacagagatggaaaatcaacgtgcggagaagatggaggccgtcaaggagtgggagcgccgcgcccaggatggcgagcaagaacgagagaggcttctgcgggagaatcgtgacgcacaggaagcggcgttgaccctagaaagtgagctgaagaccttacgtcgggctcttgaggatgcagaatctcgaaccgagcagcttcaggagctggcgcagatctctggtgaggctgaggtcctgcggcgtcgtttgctggaggcggacagggaccgggagatgggcgcggaaaagtaccgacagcaggtgtcggacctggagaaagccgtgcaggagggcgagcttcagcgacgaaaaatgcacaacctgatccaagaactgcgaggc

SEQ ID NO: 1738 - DNA, 703 bp, Nannochloropsis_gaditana
gcaacgtgcgcgtgtacgcccgcgtgcgaccatttttgccctcagatcaagtcgacgcttccgctcagcactgcatcaacgtgagcgcgcatgacgacagcctcgccatcttgaaaaaggacgggagcagcgatggaaatgtcttggaaagccatggattcacttttgaccgttgctttcccccctcagcggggcaggaagtgatttttgctgaggtgtcagaattcgtgcagtccgcgctcgacggctacaacgtctgcctcttctcctacggccagacaggctccggcaagacgcacacgatgcagggcttcgggtcggggcccatgaaagggatcattccccgtgcgatggaacaggtggggcggtacaagaaaatgctggaggctcaaggctgggtatatgagatggaggtctctttcattgagatctaccaggagcagatccgagacctgctgcggagccttgcaacccccaacggaggagccggagaggagagcaccagcaccacgcatgacatcaaaaaggacggaaaggggaacatgtttgtgacggatgtggcgatgatcctgctcgaccctaacgaccctcaggctgtgcagcgcataatggacgttgcaggccggcaccgatctgtaggggcgacgtccatgaacgagcgaagctctcgttcccactccgttttcacactccacatgcgtgc

SEQ ID NO: 1739 - DNA, 703 bp, Nannochloropsis_gaditana
ttttcgtacatgtcttttcttttaacgacccgtggtcggtctccaggagcacttgatcggaacgcttggacagctactttgccagcaacaggattgcttctgacacattatcatacagatagcatgtgtggaacacagaaagacatatggtttccgcggctctctagaagctggatcttggcggggttgccccacacgagcggtgttcttcttggcgcttctccgcaacgtcaaggccaagaaataaattgatcgatcgccctgatcctcgcgagcgccatgccaagtataattcgtgtaactcacttttcagcaggtgataaagcttaatacgactaaggggtggaggaggagcgaccacatagcatcgcaagaacccccgcatttttcattccgcctgagaggcttttatcaagttgtgctggtatggcccccctgacaccgtacagtctgttaaaaggaccttcaaattggaggtcgaaatcgatgctgctacatttagccattctttttctacatcattcttgtgcgaccgcggacagtgtgtcacccaagagcaatcgagtgtggtgcgggaggtcgcgcacgaactcaacatggacaccaattcctcctgtcccaatgggaagactggctgtttttttttttccggtaaagacaaaaaggaaaagacaacgagaggtccatcaaagcaatcaagatg

SEQ ID NO: 1740 - DNA, 703 bp, Nannochloropsis_gaditana
caacgcacaacgcttaactcatgatccactctatttaattcacaaactcccattctttgatgagtccgcagtaaaatagcttctcagcaattgccgctcttgacgtcgtgcccgagtgcgcctagtcattgtcatctgctctcatctagtgaagcccaatgcttgacatagctccaaagttcattgatgagtaaccttgaacatcatgcattccgcaaaagagcagtgcaagcggtgtgcgtgagaccggcaggcctttgtagaagcctgaacgtcagacggcggcgtcagctgtcgcccccccgagtccttggccacgcttttccgttcttgcttccctatccactgtgacacaacaactgcaaaaccgtacgttttcctcatcttatatcgttttcgtagttcttttcgaatgagttgaagcacatttatgcagacagctgtaaattttctctgacccgatttagccatcaggccgatttggccatcccttctgggcagtctggtgactgccctacgttctctgatcacgctcgtgattttgaggcctcaccttttgttacatctctatgcagtgcgcagacatgtcttcatggcatgagtaagggaaatttcacatttatgcgcggatagctttccatgagaccgcctaccgacctaaattccttccttctttctctccccctacaggtttcctcacatg

SEQ ID NO: 1741 - DNA, 703 bp, Nannochloropsis_gaditana
ggtagcctgtcttggggccaaaggacatgctgaagcctgggattgtgtttggcggggtaatgatgatcatgaggcggggtggtagcacggaatttcttggatccactttcctacacctgcccggactcatttaaataccctgcgcagcccttaaagacacagttcactacgctaagatattcgcattcatgagtacaattgataaattgaattttcctactccactacatcccttcctggaactaattgccacctctgcacgctgcctactgtcctgagcaagaaaagcctttgcctctatgtctcattgtgatgctgatcttccgatataagagacgtaaaggctacagaggtcattctaccccgtcagccgagctgtacacctttcagtggagatagtgggcgtctcctccaagtccatcctgtctactctattagtcgtgcatagaccacgtacctccctctccagccgtgtacctccgcttagagagcctctccctgggcgggtggtgcacgagaaacagaacaatgagcatgtgagttcgggcgttggtcttcacaaacatataatcctgcgtagcgatgggaaagttccattccctcctgcttgctttctcagagttagatcacacccttcgtcaagagagcctccctactcatcctttgccccatcgacacacgtacggacagcacagtggccatg

SEQ ID NO: 1742 - DNA, 703 bp, Nannochloropsis_gaditana
cgaccagagcatgaactagtagttacatagtctttatgggcgttgatcatgccgaccaaatccacgattggggcatcgaggctgcccttcttagacctgtccttacccccccctccttctccgccctgcaaatcaataagaatccgggccttgttttgatcaaagtcccgagtacgcttgaccacatccataaatttatgtaatacaatgtttttaacccgctgatatgtaaaattaaggtggtttagtcgacatgctatcgcttagactgtagggggaacaaaatatgcggcaggaggttttagtgcaaccaagcaattcgtttgtgccgataaaaaaagctatacaaatagcggaagcggaatctacagcctgtattgagatactggcggcttaactattattttgaaaaaaaaaactgaaacgccattcggaaaatgttagccaagtcaacttgtctcgctcgccacggaacacaccacgctgggttgcatcgatgatatcttttctctttatcctggactttctcaatatgccaatgcatccccactcatctcccattcaccttttctacacaacgtaatttgtcgataccatttttctccacccgtttttctctcaagttatcaaaagcagaattgcagcccaagaagccgcgacctagtgacctagtcaagggctcctaatcgctcagtgctctatg

SEQ ID NO: 1743 - DNA, 703 bp, Nannochloropsis_gaditana
gaggttttggcttcgaaaggcaggtgtacatgtgtaattgagcatatatttcaaacgtgcaagtcatgaagagacccagtgcttgctgtccaacctctaatggcggtgatccagcgttttaatcgagagcggtgggaatgggccgtctcggctcctggcatgctctcggctccgtcctacggcacaacacgaccaggactggagcctaacacccgctactacaactttcttccgtgtttgaagtcatgcgggcaatgtatgtctacttgccaatcagggatcctttcctgtgccctcactgcctcctgatggtgccgcaacctcacttgttatgacgtggaccccgtgggacgctcgcccccgtcgcccacgaccttgactttgaaatgctgtgcactcccggcccgcacgcaacccgctccctgcccgagatttttcgcccattccacgacattccatattcaggcgctgcaattgctccctttgaagatgtacctgtctcgtgcttggtgttttgcctctccggaaagtgtcagaaattgatctgtcccagcttgttccgtgagcaatatcggctttctgtacgaatcaaagaagctcctctttcggtcacaccaggctttcacgcaaatgccaattcaacatgtgcgcaaaagcattcgcctactctgaacctaacaaaatataaaccttttcatcaaga

SEQ ID NO: 1744 - DNA, 703 bp, Nannochloropsis_gaditana
gtcccgtcggcatcggtatcatcgtcttgcctgcagccccccgccccaggcatctcttcctacctggaaactccccgtatggcggcctcaaacgcatgggaaaagtatacaattcctcctccccaactgcctgtgcgagctgctagtttgtcgtctgttgctccaaactcacgcccaggaaatcctgccgcctccaatctctctgtgcgcccgtcctgcttgtctctgtcgctgagtctgaccgatgtcgagacacccgaggcgagctccaacgtggaagaatccttcgacttcaatgacgaacttgacaacgttttcctccgcggcgggtgcaggcaaaaccgcgtggggctcgccatcggcgccggcggtctggccatgcgcgaccaccccaagaccttccgagtagcctacgaggacctggagataggcaaagtaatcggtaagggctccactggagccgtgctggaggcgctacacaagccgacaggcacgcgactggctctgaaagtaatcaatgtgttcgacaagtcccggcgctctcagctgatccgagagatccggaccctgtacgacgccgcctgcccgagtcttgtcgcgttctacggcgccttctaccgggagggctgcatcaccctcgcccttgagatgatggatggcggggctctggcgaaccttgtcgcccaactcggccccattccgg

SEQ ID NO: 1745 - DNA, 703 bp, Nannochloropsis_gaditana
tccaacgtggaagaatccttcgacttcaatgacgaacttgacaacgttttcctccgcggcgggtgcaggcaaaaccgcgtggggctcgccatcggcgccggcggtctggccatgcgcgaccaccccaagaccttccgagtagcctacgaggacctggagataggcaaagtaatcggtaagggctccactggagccgtgctggaggcgctacacaagccgacaggcacgcgactggctctgaaagtaatcaatgtgttcgacaagtcccggcgctctcagctgatccgagagatccggaccctgtacgacgccgcctgcccgagtcttgtcgcgttctacggcgccttctaccgggagggctgcatcaccctcgcccttgagatgatggatggcggggctctggcgaaccttgtcgcccaactcggccccattccggagcgcgcgctggccaatatggtcttccagatcctatgggccttggcctacctgaagcacgacaagcgggtgcaccgcgacatcaagccctccaacctcctcatcaacagccacggtgaagtcaaggtctctgactttggcttgtctgccgagctgcagagctccctggccatgtgcggcacctttgtgggcacgttcaagtacatgtcaccggagcgcatacggaacgatccctacgactacgcctcggacgtgtggagcttggggc

SEQ ID NO: 1746 - DNA, 703 bp, Nannochloropsis_gaditana; identical to SEQ ID NO: 1396

SEQ ID NO: 1747 - DNA, 703 bp, Nannochloropsis_gaditana
ggtcgtctcctcgcctggtatgatactcctacaatccaacatttctcatccgcgcaggcacccaacggtgcagcatgtcgtgtcagaggaatttgaaacaaagcattagattagctccgtcctttttgggggggttggacagggaataactaaataacatcgtaatttgttttgtcagagtgcaggcttgcagcaattcgttctcggcgagggcgaggacaggaagaggggggcagcggagtgggataaaatatgaccgcttgccaactccttgtcattgttctcaaccatgcaatgcacgacgattcgtgctcaagtcgtaagtcggattatacaagtgctgttgcatgactgagctaggctaaaataaaagcgggcagggggcacgccccgggagttcaaaaccctagagatacgcgagtgaatgtgaagttgctgcctcggagtccccgcacgcgctttcccaggtgcccgtgcgttgtgtgggaaaatatatggacttgcttgctgtgattggttgcgatgatggtgatgggctgaagatccttgtcgacacgttgtcccgttcttgtttgtcgttgcagatgacggaagagaacaagaagcggggagaaagaagcgagaacacattcgtttgctcattttttggctccttccctcgccacttactccacagaaaatcccagcaaaacgccaagaaatg

SEQ ID NO: 1748 - DNA, 703 bp, Nannochloropsis_gaditana
aagcttgaaatgtactcggaatgcttgaccacctttcaaactccttgaccatttagaaaagcctccgccattcacaccatccctcgaaacactgttatccgtctgtgctcaagaatttttgttcacaacttgaaaagtaagttttcattcatcatgtggcacgcaatgagcgtaataacttttcagttttttgcggctacacgactgtctagttgtttttaggaatggcgtcactcatgtgtatttgaaattaaacggttcttggtgcattttattccttttgctcccccacaccctcgccaaatcaaaagtcacgtccgtcgtgccctttccactccgcgtctgcgtgattgtgcttccatcttaggcatcctactgtttctcatggccacaaagagaaaaagagttttcttcctcgatagatcaattgtctatcagaaatcgcaagtgcgtttctgtcgttctcactggtcgatatgtctcgtgagtccctcatcccccttcccgcccaaccctcgacttctcgtgttcccatatcgtacgacataaaagcactcatgcgcccgtgcatacacacaatcgctcttgcacggtgtctcaaatcctttttgagggacttcacacatcttgtctaatgaaaatctcattcattgtcttatattcctatcttggcagttcaacacacccaaactctcaaatcatg

SEQ ID NO: 1749 - DNA, 703 bp, Nannochloropsis_gaditana
gctcgctatcagctttctttaccatttctgtcatagcggcgtcagcttcccccttggcacggatgtaccctgccattgcgattgtcttcaaatctccttgtaagtatacaccgctcgcatccacgttcgccacgttgacctgtgggtagcaccgtgtcccgaatgataaaatgatttttttgtcagagcgcgaaccgatagatccccactatactgcagccgacctcccatcgaatcagtaccagctgcttggtacgaggcctttctattcaacccccccccatcgcacctgcaccgcagcgtggtctttggagtggattacgcgattcgtccaggagctgcacatgaagttggggagggaggtggagggtatgtaaacatgttctctcttcgttcgaatccatcaaagctaatgcatgagcttactacaagcgaaagtcacgcatttgtagtcagacccaactcaatttacattctctaccctgaaggacaatcgatacccttgcttctcatttctctcgcttctcgtcccacgtaccattttcggggaatgtagaggtccacattttgacctgcctcgttttgcatttctcaaatgattatacaataaatgtgaagttggtgtctgtgtgcgtggatggtggagagctcaaagatgagactatctgtggcgaaggctcgaagaagaagggaggaacgaatg

SEQ ID NO: 1750 - DNA, 703 bp, Nannochloropsis_gaditana; identical to SEQ ID NO: 1747

SEQ ID NO: 1751 - DNA, 703 bp, Nannochloropsis_gaditana; identical to SEQ ID NO: 1389

SEQ ID NO: 1752 - DNA, 703 bp, Nannochloropsis_gaditana
tgaaaaagtcgcgacaggaagggacgatgacttagtcgagatcggaagaacagacaagtcttacgatgaccccgactctatatttgccattcccgtacgagttgcgtgccggaaggatatgagttgcacagtgcgtgtccaagtcacctgcgcacaaagcaacctcggagtcggaggtgaagccgctttgctgggacagtacatagcaaaattttctgatatttggaacgctacaagcggtggtacacctctagtctttccgatgacatcgccagcatgtccgagaggaagtcgagcaattttatggcgcctgccattttcaagtctttgcccaccttgctccccatttattgaattaaaagcgcggcggcatctgtcttactctgtgccctaccttttctggcgaccggagagaggggaatgtcctggggtgggggcccaaaaagcgcgatatcacttacgaccacacgcccgtgaatatgccgagagcgacttggaagggcccgaattcgtcaacctggtcatggcacgcgagacaacgctggaaagtcgcttcccttacctcttagcgacccttatatgccgcccgtttttggagaggatggaacgtgctgtcgagggatggaggctacgtttggagcatgaacgcatccgccagggatttttttcttcgcacgccgaggctttgaaatctggacaaatg

SEQ ID NO: 1753 - DNA, 703 bp, Nannochloropsis_gaditana
tgtgtgtacacatgaagtagggtgagaagtctaggaagaaggttggggaggtccttgccggaaaaaaactcaaagcgcaggtacagagtttgcacagctgatatgtacgctgcatattgtcgatgaatataaacgtacaacacgaagaaggaaggaaacgagacgagcagaaagtaaggtctttcatggctatatgggccacagccctcgctccttgatccgtaaggatttcggcgccagagtcttgatccaagattgcggcctggttaaagtactcattgtccattcacgaaaccaatgcacttgattacctcacgtttgtgcataacgttacagatcaccctccgggtgtctcgttgtcgtgtcgcagcgcctacctgtcgggacggactgacacaccggcgttgctgtctgttgaggagcaggcgaggaaacgcctgcctttctgtgccccttagggaggagaggagggatggagtcgacccgtgcgaagatagaaaggctctgataatcacgtctacgcatagaattgcctcttgcatgttttcaacgccttgagcgaaccaagacaagggggaaaaagacgaacgcacaacacgactgtctcttgcggacaagcacctgacaagtcgtcaacaacatgtctggcacaaccgctagcagcaacagccttgcgggaacaggaggcctggggccctggatg

SEQ ID NO: 1754 - DNA, 703 bp, Nannochloropsis_gaditana; identical to SEQ ID NO: 1390

SEQ ID NO: 1755 - DNA, 703 bp, Nannochloropsis_gaditana; identical to SEQ ID NO: 1392

SEQ ID NO: 1756 - DNA, 703 bp, Nannochloropsis_gaditana
tctcaacagctggggctcagacgatgtaatccctgtcggtgtcggtgcaatcggtcttcttatcattaaaagtgtgaataaatgcgaagaacttcgctccaagtcgccaggcgtctgagactctggcttggcacatattctcgtgaacactgtatcggtgcctttccaggacatggacgcacctacgccaactaaggggtcgtattccatcacatcatcgccctgtggggtcgtattccatcacatcatcgccctgtcgggtcgtattccatcacatcatcgccctgtggggtctatattccatcacatcatgacatttccccgggaggtaaccctggcaaattcctaggtttccgccactctcttccccgtggcctcggttatgaaaacgcagggagttttcaagcccgtcgtttccctaatgccattttcctgaaaggcaataccctcttcgtcagagaaatgaggcagaaaactcgatatggcacgtttttctctctgtcatttaatgatgttctgcaagtggcacgtgcccgacatgtttctcatgcttttggaccttccttgtcctctcacgtttcacaggcatccacctgaaatatcagtcttccttgcagctcacgcactttagagaacctgcccacgacggggttttcatcctctgaaggcgtctctgttcaacgacttgaattgaagcatcatg

SEQ ID NO: 1757 - DNA, 703 bp, Nannochloropsis_gaditana
catacggaatttgtgtcttggtagacgtgagcttgttcacaaagagccgtaccgactcccccttctcgtaggagcggggcgcgacaccaggcaagtagaaaatacctttcgtcaaaggaagtaccgccaccgccagcattgcggttgctaatcctttttgtaggaccactgccatcgttctccacctgtctacgtaatcgtacagcgtgagtcggcgttgcacagactgattgaatgaatacgtcccctcgcatgctatcccatttgttgcacaacgggggaaaatgacagaaatcaacgatcaaaacacgatatgcgaatgatttcaaagccaagcaagacacgaaatgccggcgcacagagtcccagagggtgtcgggggaggcctcaagctgcctaagcggagggacatgggcatgggcgtgacggaagaaagcgagcgaagctagagggcgagtcggcaaagctgccccgacgcccagacactgccacacgggagagggcctctgtggccgcgcttgtgtcgacgacgctagggttcgacgtaagaggcacgtgtgctaacacgcgtgtcgcaagagtcgtagtttcttgtaggcatggtcgggcagagccatagggtcactcagaccgagaggatcttgctgtctacttcgagacctacacaccattcctatgttgacttctgcaggctcgtatcatg

SEQ ID NO: 1758 - DNA, 703 bp, Nannochloropsis_gaditana
tacggtagacaaacgccccacgtattatacgttagccaatccactttttcgtctatagcttggaagacatgtaacaaaggattgggacttgcatcttgtgataaaccactaaagagtgagggtccagaatcaaaaatgaagccgtcgatttcaaatgcgtgtgcggctccaccacaatggtagtggctttcaactacggccacgtccagtccgtaggtcgcagagcacaacgaggcacaacttagccctccaatgccggatccaatgacaaccacatcgtgttcttcaatcaaagtatctttcaatcttgatggcgcggtggtgctggcaaagagactggactgatgtcgactgatcgccatgggcagtacgccggaacagggtagggcttgtctgatggaaggacgatgagggacggtaaaaaagatcgctccaggtaaggaggcgatcagtaggccgctcaaaagctgcggaggtaggaaatttcgccgatgcattgcgttttcgtgtcctgtatcgttgcaggattgaaatcgcgtcacttgagcaggtccttcgagagagaacctcctggtccgaccccgcgacacacagcgagtcaagcacgtacgcccggtctctgagcctcgctcactcctgtcgccgagccgtccgtccaatgttcatgcgctaagacgtctagctcttaattattacattcaca

SEQ ID NO: 1759 - DNA, 703 bp, Nannochloropsis_gaditana
  misc_feature (667)..(676): n is a, c, g, or t
gtacaaagccctcacctcaattcgggagacttccctggcctatatatgtgcggtctcctcacatacgacatgccattctggtcggtgcgtgaggttttggctgaaagtggagcagagaggccggggctacaggggcgatgtcttgaagcaggatgggcggagtccaagcgggatgagggaagcggcggtagaaaggagaagctgaggcttgaacccgagagtaataacaacacgcttgaaaaatatctcatgatggctgatgctgtggggatcgcgggagggggggggtgaaaggtgagtttattgttttgtttttcttggagcgggaggggatcaaagggccccaggaaggttttggaaagtatcctgcctgccgccaaaaagaggcgacacaaatcgctccaaggggcatcccacgggcccaaataagccctggattcctcgcattcccaaacaaatgcgatctacgcgctgatagctatgctaaatgctccgacagtgtccatgttgctgacctattcaccctttgcaagcacatcgtaggccggacgccgttatcgtcctccttgtcagcgtctcacgccccccatcacgaaccctccttcgcgacgatagggctttccatcttcatgccgcgcgttctccttgcctttctggcacttttagnnnnnnnnnnccgcccccaccccaacggcccttgatg

SEQ ID NO: 1760 - DNA, 703 bp, Nannochloropsis_gaditana
cttttatttgagattccatcgatttcagatgtatcatcgtcctcaatattcaacgttgtcatcaaatttacgtgaccatcgccgatgtcgatctcttgaaaggcagccgtgttcacaccatcctccacatgactcaacaccccgtagttacgatggcaagcttcatgcgtgctagcgtcgttgtcaccccgaatggtaggagtcatgtcaccaaaggtgtcatccattggctcaaaacctactcgaagcgttgtcaaaaatattttcctcaacaggatcctgcaggatgggccgaggtatgtcggacatgtttagtcctgtgaaatgggggggaaacaacatttttaaaaaaaattatactgtaaacaaagcttaataatacgaaaagccaaacacatgcatgagttgcgcctcgaatgaccgcgattctacagctatcaaggggcaggtcgcgcgcgtatctggctacgtaacggctgcttgagatttccgcgacccccccaaccagccttgacagacaccaccagacctttcatgccatggcactttccgagcgtgcgagaccttcatagtttatggtggatgctacctcggtgtgtagagaggacagggacacgcattctgtgcgatgacgcaaggtctttatttcatggtttacagggagacagaggcacgaggacccgcccagccgcacgctatcatg

SEQ ID NO: 1761 - DNA, 703 bp, Nannochloropsis_gaditana
tccacgatgcatgtgtaccaacaccgcgagtcgcagcgtactgcaacatgtgggctcttacacgttttcggggggtgtcaaggggtacagcgtagcgtctgaaagcgagtcgtccagcgagcctgagggcgatcggcagccacgcccgaaggcaactaactccatgagcccgctcgatcggacgaaatcaaaaacgcctacccgacaacggtcttgaggaattccttggttttatgctttactggccagcgcatatttgccgttcgcgatcatggcctggagcaagtctttggatgcctgcaggcttggccaccacagcaaccgacgacagactctcggaggaaagcccttgacctcccggcctcctggactgcacaattgtacataagtctcgtgaggatgcctgttagagccagcacaacgtaatgacaacgctcacttttatcgacccgatatacttttcgacacagggggttgcagccatcgtgtttcccggcttttctgaagctcctgttgacggcccttcaggcaccgcagtgcaagcatgtcatttctccttaccagccgtcgaaagccactgctactcctcgtccttgctgtgctggccaaagcgaaagcatttcagtccggatcagttggaaaatatcattcgagaaagcacttgtccacccgagtattctcctccacgaccatccatgacatg

SEQ ID NO: 1762 - DNA, 703 bp, Nannochloropsis_gaditana
acatccacagattaaaaaagtaaaacggctcgtagcgccatgtcaaagtcgcagcaatcacagatattgccggttgacacggctatgattgtaaaagaaataaagcacatttctatgaagtgcgcatgaattctctgtgtttatttcattcctttaaaaaaaacgctgggaaataggggataacatgtatttgttgtaaatttgaagctgtcaacctcccggcgtgggagagaatggcaacggtgctggtgacgacaccggtagcacatcaagtgcgcttgccggcgaaacaagtcgttttcaacaaaagtgcacatttgattcagtcacctgctgtccttcacactcctcgtgcagcacagctacgcgtccttccatacgaattaaaggcagtaagcccttgtcagagcctgaccgccgtgtatgcgaggaagccgcttcgggaagcttagccacttttatctgcgataacttgctttctatcatttgtgccgacaaatgcacgattaaaaggaggctgtttcatcacgcttgtgctaaagtgagatggattttagcggggatggagcatcgggggtgccatgcaccaacatcaagacaaccgccggaaggctatgactgggagcggagaggacctcgatcaagtccgacgcgcgaccattcaccaggcctgcgacgagatttgacgggactcaaaatcgct

SEQ ID NO: 1763 - DNA, 703 bp, Nannochloropsis_gaditana
gggaaaactatcagtttaatccacatttaccttcctagccgcgggtatgcatacacatatcacacagctccatagcgggactcctattctccgtccactcaacaactttttcctccctctcccggctcaccttccaccacctgctatacaattgcactgtcccattctcccaattggatacgttgaccccttatttttcgtcgcgtgcaggcaacagagtaaacagttccttctcccatgttttttttcgttagaaacgccctctcttgtaggtgttgtggatcgatttcgaatcatttatgtacctcaagaaaaatatgatcgattgagccgcaagccattccaacttgtctttgcgctttgcttctcttacgcaatgtgtgcaagtcgtgacccggactatcctgattggcacgtcgaccacacaaaccgtacatcgcggcgaatctgtcgcatgtgaccgtatttgggacacatctatttcaggaacgacaaaatggcgccgccgccgttttcgcgccatttttcctgggctggggctcttcatcttcccttgctggatctttccacgcccggtgcttctcgcccgcccggccagacctggcgtggggggaatttgagttcccggggttcaagaatgaatctctgacccaccaattccttatctactgatgctgtacggacaggagaggccgggaggatg

SEQ ID NO: 1764 - DNA, 703 bp, Nannochloropsis_gaditana
tccaccgtttctaaaagcagcacacgctggtccatccgactgcctcgttttgcaaagtcgatcgcgtgggcgaggtcagggtcccggcggacgaagcggttgcgacgtttgttaacggggacgcgctggcgtcgatattgtttctctgcgcgccggtaggctgtgtcatcacgctcttcaaggtgtgagactttgtaccgattagcttctttggagcaggttggaggaggcatacgctcgcttgatccgacggcttccgagggcagagttgaggttagtaaggaaggatccgtcggctctgcgattggctgcaattcccctccctaggtatatctaccccttctttcgtctctgtacatgtacgggggggcaatggcagaattatgtgcggctagtgagcgaggcagtagtagggcggggcgaccgagggccgcgagtagaaggaattaaaaaaaatataccgcacgcgggagcaatacgctcaacaatttgttctttaagtcccgtacgacgtttggcattctacaaacagggagcagatgcggggtcggggcgggtaacttgcatcgactcggtcaacgccattccaagcaccaacctccccccctccagcactggcacgtagatggtcaaatctccgtcgctggctcacggtgacagcaaggcggacactgggagcgagcgactctcgtcatcgataccg

SEQ ID NO: 1765 - DNA, 703 bp, Nannochloropsis_gaditana
gtgctttagcggcgcgaggatcctctcgcacgggcgagagcatgcatctgcttcaaggtgtcaagccgacggcgccgtctgcggcctcgcgtgtcaataatgaaagaaaagctccacatcctgcatcatgaagcgagaggaatgcatgtgtgtcattgcttcatcttttttcgaatgtcgtgttgaatactgtgggctaggctaagcactttgacctctcagaggcaacctcccacccgatcccttccccccccaactattctgtagtgagatcctggggtagcccttttcacattgatcacgtgattttggataaataaccacgcacttttgggtaaatataaataggttttggtcgttcattcttgatctgctggcatcgtgtgccaatcacgacttcctataggagtcggaaatgcacttgaatttcttgagcttgagaaccgaagcagaacatcaacttggcctgcaagactttcacatgtgttttcctttttagatgaattgaattaagacgtgggaaaacccacagttacgacaaaagatttgttgagactggaggtgtgtcttccctcgaggattttcacacattaacaacttttattttcttcatccctcaacttcaagtagaagccaactagcacgcgcccagcaagggaaaagctctgaaaagaggaaatcaagaagaaaacgaaaaaatatg

SEQ ID NO: 1766 - DNA, 703 bp, Nannochloropsis_gaditana
ggaaacgaggattgcgagcaggacaaaaatggaacaaagatcaagggagtgggccggcaacagcttcgaggcggacgttgtcctacagtccggccaaagggaggctttaaaggagaataaacgggttaaagggctccgcctcctccagcgtgacgtttccctcatcctcttgacgacacgtgcccgggcagcctacctccacaccccgctgcagctgtcgtcagtgggcgtgcaaagactgtgtaggcgtgtatgaaatgaagcattcagacgttgctgcacgacaggaagttccatcattgctcgcgttgaggagataggacggaccaggtcgctctgtcgccgactttcgcagttcgacttcactaaccagtccattgcccctgtcctaatcgcaagccacaggtactgatccgagcaacgcgtatacacacgacgtagagggcagaattttctgcacatggccgcgcatccccggttgctggggcggcagggtcgttcattgcaattacttcagcagaatttggccgcctgcaaccagcctcggtgttcttttgctgctgcagcatctccgttaaacttggttgaaaaaattgctcggcgccacgcggtggacgcggacaaaaaagacattagtgcagggaatataatctccataaagccgaagcatgtgatgacgcatgacaataccctggcggtcatg

SEQ ID NO: 1767 - DNA, 703 bp, Nannochloropsis_gaditana
ccgtcgcgcttctcaccctccaactcacgctctttgcgcattccttgtcatcgttacacatacgtcacacacaaacagccaatacttcctgtggacgtacccagctatggcggggaacactttgaaagacctttgcgtttgtggtaagtggagcggtaggagggaggcttgaagtttgcaagtcagggaagcgtgacggtgctcattgtgatgaatacgaagtgagcaagcgcttccgcttaggttgtacgatataagtatgatatttgtcataagacgtcacaagagcttaaagatatgtttgaaatgggaatacaagagaggagaagtctcgaagccgtgctccggcatgaagtggtagacatcgcgagtagcgtattcgcttccctcgaccggacggctaagccattgtaattgtatttttctcgaaaatgaagtgtttaggggacctccagctttattggggaataccagagatagacttgaaaagttgtcatcgtgtgctcttttctcccccctcacctaggccccaagatccttcttcccttccttgggggagcagtcgcagccctcattgccgtctatgcagactgggcaatcttcaagcgccgggctggacccggaggcaagggcaatgagaagcaagaaaaggagaagggaggcctcagccttgatgccttgcctagcgaggtcaagctcctca

SEQ ID NO: 1768 - DNA, 703 bp, Nannochloropsis_gaditana
caaagtctcgtcttggggctccggtttgtcgtttaagccatcaacgtcgtcactgcccccttcctcggcggcggctgccttctcgacgtgctgcatgagtcgctgcattaagtctgctttcagccccttcacaggcaaatcgagcttctccaattccttcttaagctcagcgaccttcatgcccttaattgtttccagggtgggcagcgccatggtactatataggatgagaaatggtgctgcggtgtgatgtcgtttttgtccgtctcttggtttttcacctgaaagggtacgaacaaaatactgggttccatgaggatctcaattgtatctcaaaagatatactgcctcgatgggcgggctgcgggcgttgcacttcccgcctttccagtgccctcgatcctgttgacttcttctctgaagactcctctccgccttctctccgcgctcaagccagcccccagccgcctgtgtgcgtgccggggcttacggtacgcggactctgcagaacgcacgacccgtcgtcaacgcaaaccgttatgtctttcattacggccctggagaacacgccaggtctcaaatagtaaacctggaggggggcgcacccccacaaatactacaatagctcttcagtcgacatgacctcctaccctgtgcctcatctgctctcccacattgccaggtacttgcggcgcatttcatg

SEQ ID NO: 1769 - DNA, 703 bp, Nannochloropsis_gaditana
tatatgcttgtgatcaggtattagatgctaccggtggcggcacacataaagcatctgtcctctggaccgcacagggcgtgacatgtattcgtagccccttcctcgggggctgggatagggtctgtgtatccccctgtgccgcgactgatgggacgtctcattcccattcttgtgctcacatgagaggagaaggtcttaccactttcacaacgcgcctgcctcactgtccttggctcaacacgaaagacatattttgagtgtcattgcctctcccttccttgcactgaggcggatctcctggcctgggatcctgccaaccttaagcactcgggaaaagaaacaccaaatctttcactgaactgccacattttcgtcgtcatctgtcccgactcacatcagtaatgtgtacataagtgtgagcggtgatcactgatttgtcctttggtagcctggtctttgctgaccggacctctaacccgtacacaacaccataccatgcaatgctcatcccacgccgacttctgcacgcccgcaggctctctattttgactcttgtttgttgcggcattgccggccagcaccttgaggaggcggccacggcatcaacagcgggtgcaggagtgtgcgggtctcaaagcacagcctaggcttccggattgtgcagtccccatacgcacgtcagtgaagacggaaagggactatg

SEQ ID NO: 1770 - DNA, 703 bp, Nannochloropsis_gaditana
gtggggtaatttccttcacacaaaatagctcaaagctgtgttcaaatgatctccaccataaagttgcgtgtccatcaaagcatagattatcatcaatcttcctctttgtcgcggaaaacccgctcttcagacggcgggatggcccagtggcgggttccgcatacccggatgtggacactagccgttgagcttcatgggcccggtctatgggcccctgctgcgagagaaactattcgtggcttgtgactgtggctttctgcgcgtgtgatggactggaaggccgtgcccctcgatttttgcgcttccctatgcgacctcgtgtcctcttcctgttggcaactacccattgccgatgccaaatgccaattcaagcctcatgttttgaagtgttatcaccctctgaagcaaagtctcgaagaacaattcaaaattacccacccttcgctctcttacttgtgacccatttaaaatatgcccttgccattccattgcatgttttacagtccagaccctcaaatctacattttgattgttcttgtttgagcctgagggatttctatgtgccatatcgcaggaagtgttcaaatagcgaatcagacccctgggccctccaaatacctcgagacataaatcactgacttgtagccctgtatacgcacaacacagaaatcgtcacccaatctcgactcatttcaggaatatg

SEQ ID NO: 1771 - DNA, 703 bp, Nannochloropsis_gaditana
tgcccatccccagcctttgggccgcaattgcaccatgagacctttcagagtgacgctataacaaaccgaaaggctcccttgatgtccgtgaaagaagaacgcatgagcagagacagagagtgacgtctgggcaagtaatcgcccgggaaagcttgcccagcctcctcgaggctagattgcggatgggagatacgccaaagcaatagcagagagatagatgcgcaggcatgaacgcatgctggtggtgacagagacacatcatcttcctcagcgcctctccggcgggtcgtgggcgaggcggcgagcaggacttgaggcaccttgcatgcttttttaggttaccattgcactgcactccgtccgtcgaagctcatcacctatgcacaatagttcttttgtacccaagttgtttgcacatgcatgagacaacgcgtgagtatgttcggcttgacacgtcaactatatggctgcttccctcggaccttcacactatcatgcttcaccgaactcaactcaacttgcttgaaatacactgagatccgaattgctgtcaacaacatgttatggttgaaagatgcgtatgatatatagctgcctctttgactgatcgaagccttacgtaagaatgttgtcagccctccctcaacagaacttgaatattcctacactttctcagtacttcagaaaaaggggacggcgaatg

SEQ ID NO: 1772 - DNA, 703 bp, Nannochloropsis_gaditana
attcttcaggtgcacaacagctcgtttatcagacatctcttcaacccaaagtcgcgccgtaccagccaactttacctaatatttaagtcgattcaatcatcggtgagatatcgtcatgtatggcgtattcatgaccactcgaagggaagaaacaaggcaaacatcgtaaagtccaacccagcggaggtaactgtaccatcatatcgaaggcgagagtgtacccccaaggtttataagccgctggtagaggcgaggtgagtttggccacttgtgttgcgagacgatttagcttccggcaggtcatttttgacaagaaaaacagagcaaaatattcacttgagttcctgactcctcgcgcgcctacgtgctttaagcaagagttcttccgcttccagccaagcgacagccctcaatggggatggagaacaaagctacttttcctgttagcaacgttcctttagtaaaaacagagaaggtgaaaatagacgagacaggatgagttgaagaagccaagatcaaagtcccgccccctccacggcgtgcgtcgactgcgctttccttcatcagcgagaggtcgtaacccgtctacctcgtaaacccccaacactgactcccactctcgcaaaaaacagatgacggactagaaaagggaccacatataactaatgatgaatcgcaccccgcttttttggctggtactgct

SEQ ID NO: 1773 - DNA, 703 bp, Nannochloropsis_gaditana
cggcttttctaaagcgacaggagctgagagatctgcaacggaggggactcaacagagtccaagccgtgcagcaccgtttacagcgaacgcgacaggaatttcagcgacagctcgatgctgcagcggaagaagaagtcagcaaattgcagactaaagcggagctgctgacgacttacgcctacagctggaaacaaggggataccgagtgtgtatgcccagacctggacacgggggaagagatttgcatcccactgaaaccgggaaaatctgcggcagatgaagcacaggctacttacggtcgtattcgtaaattaaagcgaagtgtggatgccataatgcctttactgcagaaaatcgacgtcaaggtggcgtatgtggacgagcttgagtctagcatccagcaacttggaacctcggctcgctcagatgaagacacacctaatgttctaaacactcgaacgcttagtcaagatcttgcaatcatgcgggaaatagctgaagagctgggcataaattgtcttgatggtagaggtggaagctccaccacttttttttcaacaatactgaatcggctttctgttcccggaaccgagcagagtagcctgagcaattatcaaaatagcaaaaataacaagaggaaaaaaaaggacaagcctgtcagggataaaaacaaaaaaattcaaggcaaaagcacagatggtgc

SEQ ID NO: 1774 - DNA, 703 bp, Nannochloropsis_gaditana
gaaatataattaaagattatgaagtgaataagtagaaaaaaagttcacattttacgcacaatcaactgcttagatgtgtagaggacggccgttaagtagatacgttatttccctttccaaagtgcttgtgagtaaatttcccatgaaaagattttcttttagtagagactcataccttatgaaagcagtagaaagtataataagcttaagtccgacttggagtgaatggttgagcatcttgtagagacgattgagctgcactgaattaatcggttatagacttgcccttgtttctgtttgtggaacacaaggaccaagtgaaacaagagaaagtaagcgcgaaaacgaggaaccatggaaacaaaagagacattaagacgattctttctggtccagtgcacgatcagtgttgcaccggaagaaatcttcatgataaaatgcggtggacacgtcccggagggagaggaggttagactgcagacggaagggttcggaaaagatcgaggaagggctcgctttgttcgtactcgagggactaccggggacgctgcaacattgagagacaggatgttcccaaattactgaccaagtgacctattttggacacatccacttttctcgaacagtagtgcccccgcatcggcgctcttaggtaccggcaggcgccttcttcagggcgttgacgcagatttcctctctaatg

SEQ ID NO: 1775 - DNA, 703 bp, Nannochloropsis_gaditana
tgcacttctttgcctttttaaattcactcttgtgtcgctcacattgctgccacactttctttattgcatgctcacatgttagggaaggcaattgcatctatctaggttcagtttccggctttaccggcagcaaaagagaacctcagaaaatgataatgaacagtacatttcatgcatcgatccgagtttaaacaattttcaatgtaacgcttgcagctatgtgaattgttctcgatttgagcctccaattttgggtactttctgtacagtctacgttcccatttttgtggcagtagcccttcggcgatggcagtgcatagtaggagacaaagctgagatttgacgcccggcctgcggaacacacgctggtcgagtcgacagtggatcgcaaaatttggcacatcatgcatcctcagttgtgcgctccccagtcatacatcatacttgttctcaggtgacaccgcggatttgttccttcttgttctattaccatgccgcgactctgccttcgacttggcacattttgcacatgaaaaagccgcaactttgtagaaatgcacgatagtcacattcttgcttaccaccaacacgttcttctaatgattcttatcatcatggcagagtggacattgttgaaatgagtcagagacacacgtcttgcgcaccgacgccctcgagaatcataaggcacgggttatgcatg

SEQ ID NO: 1776 - DNA, 703 bp, Nannochloropsis_gaditana
ttgcatcctctctctcggactctctccccccgcgcggaccccctctggccccagaaagtagctgtctccctccgcgctcttcaagaagtcttccaatgccccctgctccagaccgtccaaatccgcccagtcctccaagcatgagtgctcgaaggccccccggctcccacaccccgacccggaggcgtctgtgggtgtggagagcgcgggttgcgatgctgggggcagagagagaggcaaaggtggtgggccaatgctagtaccggctgtcgttggcgccatatttctcatcgcagattccgcccgtgccacgcatctagttgagtccttgactacaccggatgcgtccacctcctctcttcctttggaggacatggccctgccgccgttgtcgcctttgtaggcgacatgaccggcgcaaggattcagacgcttggctaccgcgtctccgccatgcccacgcctctctttctccgctggtggatccctcgaggacggatacgaagccgctgctttccatgactcctggtcccccaaatcccgcttcttggtcgccgcccgccccgtggctttctcccgccgtcgcgtcgaagagttccacctgtgggccgggggggggggggtgggacacgtttgaaactttttccacgcgctttctacaccccagccacgccctctctcgtttcgtgcccacctgtttttg

SEQ ID NO: 1777 - DNA, 703 bp, Nannochloropsis_gaditana
ccgaagaaaaaaatacacgtgcgaagctacgaacgctgttcccacgaccccggtggcaagcagcaaagcgtccttcgacgtagtcgtaggcaacccgttcggtccgcgctttgccaaaggcagcgacggaaatgcgaagggccccatgtcgtagtcctaaaatctgtggtctgataggaaaataaggtgttcaaatttcgccttcgcgtgttcggtggcgtatgtgctgtacacaggatgctttaggcttcagaaacgtctcagcgacggacggcgagctcctggcattggcgcatttttacaagaggattaaaagctcatttatactcttgtttgtaagaaatgtgtcttttcgatatgtgtgtgtgtggttcattttcttcgtaaagtctatgtaagaatggattgtcgaaagaatgaattttgctgtgattttttaagcatttgctcaggctgcctcaggttattcctgaagccggaggtagttatgaaggtgctttgtcatattcaaaggtctttgcagcggtacaccgtgtttaaaactagactcttcatccgtagtcgcccagtgatgtaccatttcatttcctttctcctcagactaggtgttgcttgccttgtcagcatctgcgctccactttgcgggaagccggtgcaacacgtcatcgctctcatttgacatcggtggggaccacaaaggatg

SEQ ID NO: 1778 - DNA, 703 bp, Nannochloropsis_gaditana
cagtgcacgcgcaacagctgtagcaaaggtcaattgacgagagtgcagacaagggaggaaacagttagagatacgattgaacgtgcatctatactccagtcaaacaaatatgtctggcgagaggaaatcgtccttgtggccagtaaacggatagactccatgcacttggtaatgtgccgcaccattaatttgcgcggaacccgtcggccctgctgtcgtcgggggccttgcatcccatccgcgcccattgcaaaagggtgcagtatagtaggtaaaaggatggcacgacaacgagattgtaaagagggtcgatctagtcggagtttgcaaagcctcgcgtgtgtcgacgggcatgggcgaagcgagtgacaagagttttgaggtgacaggctagatgatagccgcaagcaggcgggcgagcaggggaggcagaagggggggtgacgggcaggagatctttgtccaaatgccaacgagacactgctttcggggaccaaggttgtcgaggccctccacgacgagtaatgtgtgggaacgttgtatgcgctgtggtggtgtccgagtgcggaagtgaccggcgtcgtgcatgtgtgctttcctggtgaggataaagatgccgtttctcgcaagatctgttgttctacgactaacacattccgtacacttcctcttcccccacagatacgaccacttaaataatatg

SEQ ID NO: 1779 - DNA, 703 bp, Nannochloropsis_gaditana
taaatgagaagacgaaggggcaagcagggtaggatgaagccaggctgctctctcgtgaggggggcggttggcgcttccgatagctttcttaggtgatttattttagacggaggtctgcttagtggaagcacggaaaagtaagtgtggatttcaatttgtcttgtggtaagaggttttctcgaccagtgtcgtagggaaggctgacgtttgagtcttttggtcatatcaaactgaagtcgggcagcctcgggcaatacccgaagcagccttaaacatgtaatttctcttcaaaacaaagcttgacgtattgaacggggataaaaaccatttttgttttgcttttttgcagccaacaattcgagctctacggcacgacgggttcaagcagcctagtgctccgtctgtcataagagcatatttgcgaatgactgaagaaagagcacctacatgaacattgtttcaccgtttgcagtgtctttcattcattacgttgtcgctgcgagaattcgttcatcaattactaggggtagggggcaagggatcgtaaaactcagcaacgtctactaggccgtcaggcacgtgggttgagagtgttttccgtgatggaacggaggactttgtgtcgttgatttcaaattacgcttcatgggaccgtgcgtatagtattggcaggacttttacttatttttctttctattttaca

SEQ ID NO: 1780 - DNA, 703 bp, Nannochloropsis_gaditana
aatgtttcagtctgtctttgctttaccgaggctaggtaaacaaatccaccaaagactcctaccttcaaatttcccttcggtggacgttccaatgtgcgtgcccatacttgtaaattgccaagtacatcatccgcagccactagcggtagcccttcctcttcatcctcttcctcgaactcctcatttcgatgccgctccttggacagttcctcttcatgcgcatccccttcctcgccttccctttcggacagctgccccacggccaagaggtgtccgacagattcatccacctccatagcaactatttagactattttatttgcgagaagttggccttcagttgagttcgattgatgtactctagaaagtcgcttaatggacgtcacgaaagatgtcccccctcgagaagtctaaacgttcccggtcgcgccattgtgacaagcttttaactcaacaagccattgacatgtattatttaactttgatcatttccagccaggcttgcagggcgataaattctagcacacaatttgtccgggcgggcttggccacgacatagacaagttagcttaacctcccccctccggttcaccaatgagcccgtagctcccagccgccgattcatatcatcgtcctcagggaagacacaggtcaacacatcccccatcccttaaaaataatagggagcaaaaagaagaacatg

SEQ ID NO: 1781 - DNA, 703 bp, Nannochloropsis_gaditana
gttgcgtccatcgagtttttcggggagtcggggcacgtggaatgcgccttgcatgcattggtcaagtacgagactttgttctccaaatcttatccccttgtcatttcaagtctgtatacagactccatcgttagctctattttggcttatcgaaagcaacacatgctttctgaaactgccttttacggggtggtgggtgtgtctaaagagcatgagcgtgaggcctttcgattttttttgagacgtactttgtccgtaaaggcatcagaaatgtggtcgaaattaaatgcgcgttttcccgtcgaaatggtggcagatcagtcacacaacacccacaaataaagtggttcaaagtagtgagaaaatatgatagttgcacaagaccgtacgcgccggagaggtaatcatatgtagaatagaaaatgggggttgaaagttgcggattatgtctggcgaacgagatacctatgaaatcattgaatgtatcaaaaattgcctggcaccgtgcatgctctattgacatttacttgcgttgcacggggaactttgtcgccggacgctatcgccaagccgctctatgcgaaggcgctcgtagtctctctgtcccttactgtccttctttgacttgcgtatgtcctctgtacagatgcatggatggatcttgggatctcaatataaatgttacatcttttacagggttatg

SEQ ID NO: 1782 - DNA, 703 bp, Nannochloropsis_gaditana
ggaggactcccgtcccccccttcaatgttacccgtccctacaggaagtactctaagctcagactacgctacgcatttcctttcaaagattgtcgttatctttgctgtaactcagcttcatgcccgtccgcgttgtgaaaagatagcgcactccgttccaagctccccgaatccttccagatgccgcccgccgtgcatccccccccacatttcaaccagttgtgttcaaaacgaggacttaccgagccatatcgatggagtaaagtgaagtttgctgtcaaaaagtgaaaggactggctgtggaagcgcgggtggggaagttatgttttcgaagtgaacgggtgaggtggcggcgccttgttggttactacggtaggtgccggccacgggcgcagacccaagataacttgccctgtatggagccacagggcataggacacgaagcctacacctgcaaagggttcacaatgtaccacacatgcacacaacctatctcacggacaagccacgccttggtggtgttgctacagtggcaaggacttgcgtccgagtgctcttgtcgtcgagaccttcaagaagcgagagaggtcacgtagactaggcccacgcgcatcagatatcctgacaaagtcgtttctttttcactcctacagggactgaacgcaccacgggctttcgaatatcaataactgagccaaggaatg

SEQ ID NO: 1783 - DNA, 703 bp, Nannochloropsis_gaditana
gtcttgcacgcggaagttcttttctccaagcatggaccccagagcccaggtccctgctgcagctttcgcgcaattttttgtcttcctcgccgagggcgtcagcggtctcgcggctccgagtcacgccaggcctatgggaggccatcccgatgcgcaggcagcaagctcgtgacaggcgcccgcaacagctgtctttctatgtccccctcccacgccctgactccgggcaccgcttgggcaccgactccgaggttggccgggcttctggagtgccggcggtaggtgtctgtgacttgtgtagcggatgcagtgatgtctatttctatcgtcgcgtccactgcgccccctcgcactttcttcgaggacaacgtcagacatgccgcctcaaagattttgttctgattccgcgtaatcaagcttgaggactgcacaccatcccttcccacgggccaaagcaatttgcgcttttatgatgcatgcatcttttgtgtcaatgatatgtcttgcacaacaatgtcatggcacaggcaacgtcgaccacttcatataagctgccggggctaccaacatccaagtccatcttaaacagcaagaagagatacgacgtcggccatcaggaaactgggtcgctgctcgagccaagaccaagtaggggggagaggcgggctgtcatcggcacgacggcgtcttcatttgcagcatg

SEQ ID NO: 1784 - DNA, 703 bp, Nannochloropsis_gaditana
gctcagatgctccgtggtcaagcaggacaccattggtcgtcaagttctcttttaataaggggattacgatgtctttctccgcagctacaacgcgggcaccgtgcttggcggctacagcagccacgagaccgcaaccactaccaagatccagaagggttttgccctttaaagtacctggaggaaaggctttcgggttgtcgagatatcttgctacacgcacaccacctgttatacaggggaattaacgtgaacattggttgaggacgcctttgagtttcgttcgaggcacgtacccggccattgagtcccacccacgcatgattcccctccgaattcctcttgaacactgagcttaaatgatgaaaaagcgtacgtgttctcccacatgttgtcggactcttcatcttgctcacaatctttctgctccgcctccctgctgcttgtctgcccctgccgccgtaatgctcgagccgctcgtttagcaaatgcctcggctgagtacctgacctcggacgccattttataattttttggctctgccatgcccacgtctcctccagcttctgcagagatgacggaaatacatgagcttgacagagaaggtggtgaggaggttaacctcccgtgtacgttgatgttgcggaaatttgattattaacgcgagcattttttttaatgccataaagcgtcgcatatctctatc

SEQ ID NO: 1785 - DNA, 703 bp, Nannochloropsis_gaditana
acaggattggcgtttatatctttcttatgtttccgtgcaaagtcctccaaggactctttgaaagtcgccataagcccagtgacgtgatttatattttcttcttgcaactcttttcctaggctagtaaacgcttctttcacctgctctttccgcttgattgactttactccatagcctcttcgcatctttataatcgaaaagaatatgatactgatcccttggcctgctccccccccaaaatgaggttcgttgatagagagggaggagtcgcgaggaagaggttaccaactgtcggtggaaggtcaacggggagaacaagcgcgaaagatgacgcgcaaaaagacaccagcacgcgtaaaatgaaaggagagaaggattctatacagagaaaatgccgcccaggcaagctaggacaaacgaaaaaagggaaaagcaccctgtgtcccacccaaatgccgtagaggcaggagcctctaaggaacaacacgtcatcgggtctggtgatgaataggggactgtcaaaacatctttagtaacggccttgtccgcaataacaatgttcacggcgtatgactactagtataccaacggtgcgataatactcacgtgcaaactcagcctttgggtttctgtggctttcttttccgtgcatacaaacgctcatagctgaagcctctctttccggccttgcacacagattatg

SEQ ID NO: 1786 - DNA, 703 bp, Nannochloropsis_gaditana
tactatgtagtgtattctcgcattgcaatgtgcagtcgtccatgagtaagcctttttggtcgctgcggggttcagtaagggtctcatcgtggacgggcggtgcatcagagggagttggtaggcggaggctagaggggtggatgaccttgctgcaagccgcagtgtctctggtcgctccatcatttcgaccacgttttactccccgtgcttcacatgctgagactggagacagttctttgctactcaggggagctccagttgatgtaggaagcgggacaggcacaggttccagcagcggcgactccatccccatgaattttattttgctacaacattgaccgcattcttcacatctctatgtgtctagatagtatttcgagtgtgagtgcgcgcgaattgtatggaaattttggagacaggagcccgcagacaggccccgcattgcgccaaagtgggcgatgccacggcgaagagattcctgctcgcgtcatccatgtgatggaataggaacccagcaccatccatgtgatggaatccgcccccgatgtcatttgtgtgatagaatgcgacccttcgcttgtcaccgccgcagcaccccgaggtgaaggcaccgattgcggcaatgctgcgatgacaggcacgattttctcagctcttccatttatcctgcacaattggtcacttatgacagttcctgcacata

SEQ ID NO: 1787 - DNA, 703 bp, Nannochloropsis_gaditana
atgccaaagagcgccacggccatcaccttggtgggtcgcgtcctggcccagttgccggaggggcgcgagaaggccaagcgtgccttccaaagggccctgagcatgaacccgtccacggtcgatgcccttttggccctggcagacttgcatcttggggcacaggaatacgataaatgtatacatctgttgtcgagtagtttgcaaaatagtgggcatgatttcttgcataccaagttgggggaggcctatgctatcagtggagatttttcaaaggctctagcatcttttaacactgctgtttccatgaatccatcttctgcaccagccacggctgggctggaaaaactagagaagcttttgcggggggttgagccagaggaggatggggagggggaggaggtggacgaggaggttgaggcagaggaggatgatatggtggagggcacgacagactagtgcaaaacggcatggcacactagtgcagttgcgaattattgatatgcatgcaaatcctcgatatgcaaatgtaaatagactagcgcggcaggggaaggaaagctccggaccaaaaaagtagctaacggataggaaggacggtgagcgcgtgcgtttccttatcggttgctttacttcactcgatcatgaccacgacgtcgcatcgacaagccacgctcactccattcctgcttcatgttacgcaaag

SEQ ID NO: 1788 - DNA, 703 bp, Nannochloropsis_gaditana
gtcataccgcttgacgagcgcaaatcttaaaatacggataaaaattataaagtccatcgcttagtgttggagcaatgatatggggacgtctccttcaaaccttgaagtccatcgagtcagtcccaccacatcacgtacattcggtttaatgcgctcattcgcacttgtttctgaaagtgagcgtcatactgcgcccgccagtccattttgcagcagctgtgacccgccctgaaggcgtcacgtcaaagtcagccggcagctcctcaccgcccccggaactacctcctcctggctggctggctcagctactagccaacagctggctcgtcccaccgaatattaagccatcacagacccttgcgctagattatctataaggacttcctatacaaggaatattggcatgattttggtgggcatgtggactgtccaagtcataagtggtagtccgataagagaggaacaaggcttttttccgcgtcctcgctcagcgctcgctcaaaggcaagcagtatctgtgctgccagtagtcactcaattggctgcttaacttactgggcatatgacaaccaaatgtagatatttttcctgttgatgactattcatttatctacaggcttcatgagttttagagacggaccgtgcaggcggcactagccggcgaaacgcttaaattctgcagtggcagaggcaacagagcatg

SEQ ID NO: 1789 - DNA, 703 bp, Nannochloropsis_gaditana
ggccatggggctcgctcagagcctcgttcgccaaaaacactcgaaccctgtgcagcgcgtgtagaagtacgcccccgcgctcatcgaacaaatattggaacaactcccccgtcaggaaaatacccttctcgaagtagttgacgctgctcttcaaaaaaactgttgctgttacggtaaatacggtctctacagcgacttaacacttgtagaccccgtatattacccagcggctatcgtgaaaatgaatcgacgggctaccggtggagctggagccagtatgagcggcacagatggtatcgcgatgggtggccttggcggtggcggtatacctacaacatatccttatggggcgaatgttaatactccaccttcagcggtgggagccgacatggcagagatgggcggaagtggctttctcatgcatcacgagaaacagaccatagattacgacaaattaagcaatcatcatcatccttttggtgcagggagcgtaacacaaagcgtggctcatgcgtattctcagtctgtgaacgtgggacctacagcctcgtttatctgcctggctggacttctgtgttttatcgtccttcccgcaaacttccgatgcgctgtctttatcttaacaatatgcgctcttggaacattgttcgctttctggttgtcacgtttcgtactttccaaagatgatgggagtgctgagatg

SEQ ID NO: 1790 - DNA, 703 bp, Nannochloropsis_gaditana
cgtcccatggcttactgccgtcggcgcaaaaacagccagatggcggcaaaaggtatcagatcggcctgctcgtgcctctgagggtcgaagctgaactcctgtgcactgtgacttataagtacaaaatgtgttggagattctaattgccacgctttcgccgcgtcgacatcacaaagatcgagcgccttagcagtcagaaagatatgggggaaaatagagcaacaaagcgcttccgcattcaccgacacgactttattcctacttcgaagcgacaaacacgggtgtgggatgaagctgtcacgggtcgtacatccgatgaggagcgtggcatgagtcagcagaaaacgaggcggcgagaggactaggccagaccgtctgaccccatcgccttctggcgcccaccccggtgcccttcccgaggacttgcgcggccccgcttccatcgcttccgctaacttgccctttcaacgcccattccaaattcaggactctgtgcaggactcaggccaattctttagcgcgtttgtgtgggactggaatgggagttcgggttctctgttgccgctttacctccccactacccccctcctggttgatatttttggtgctctttctgagcataaaatcttacataagatctgaagcctttgtaaatacaagcccttcgttacaacccatctatcaaacccaaccgcacttgatg

SEQ ID NO: 1791 - DNA, 703 bp, Nannochloropsis_gaditana
gtaccagtttataatgtttgtgttggtccgtgttggtgtggtagtccctggtagtatagtggtcagaatccctccctgtcacggaggaggccggggttcaattccccgccggggagcttctctttttgattttttcccagatccacctcgaattgatgctttttaccgtgcactctctcaaggcattgggcacctttacgctggagcttttctggcaggaaagttccatgtagaaacaactcctgcggcttagtggttatgtagagctaccgaccgttctctcattgccttctcggaacggacagagagcgagtgtcgttgctcagtcaaggatttgcatcattccctgtactgcccaccatataacttacaaattacggcggatttgttatcaatttatgtgcattattatcctttgtctaaatagcacgatttttgttctcctactaattgtcagcgttgagtcggactgatcttttgtgcgatctagagggaggctgagtgagagcggaacttgccttatgcgtggcagaatcatttgcacaacgcacatggcttacatattcaacgcataagagatggttatatttgtaagtggtcagttgagagatccatttggagtccgacttacatgtcttgctctccacacacacccttgtgctcacaattagggaaaggacacaaagaatctaaaaaggtcatg

SEQ ID NO: 1792 - DNA, 703 bp, Nannochloropsis_gaditana
cgtccatcaacgcacccccattttcctgggtagccttgacgatatcttggaattagagtcctatggggacgtgacacaaaattataatccaggctacagtgctctttaaagaccaaataacagcgcaaaggagaagggggaaatgtgtctcgttcgtttccatatttaccatcttaattgcgataacggctaggtgtaaataataaagtgctataatttcatgctgctcggtttgtatttcaaattcatttgttccagagagaagcaagagcacattggttgaaaatgtttttcagagtgtatttgtgcgtatgcttaacaatctttgcgaaggagcacggggccctaggggaacctcctggtccgcccctgcgactcggccgaacgaggaggatcggatcgctccgcacagcttgcactccttggggcctcttttcccacaaaagcatcacaacacgtcctagcaaatcccgaaccaagtaatcacatatgtacatagaaaatttcgtgttttattttaattgtgatatcaatgaaattcacaatgtatgggggaaagatgatgggacacaatgtaaaggtggatttggcccctcatctcgtttgtgcgcgcgacatttaacatcgtgttttgcattaaaagcaggatacaggatacaagacctatcaggctgaactttaaacagagcgacaagcgtgaatg

SEQ ID NO: 1793 - DNA, 703 bp, Nannochloropsis_gaditana
caagcacattgagtgatcacgctggacgccctgaagccgattgacgtttccagcatgaaggatccctgcggaaacaaattggagggcactacaaaatacttcgagcgcaaggtgtatcgagagagttgtggaggcatggatgtatcgaagtcatacgtcgtatttgcttcaaattgaagaatattgctactacgcatggaggttttagttaagggaataaaatgggttccactgtctgccgtgggacaagtacctggatcgtaggacatcaggcctagagtcgattttagttttgaagccttgatacaattgtgcgtgacggacatgaccccatgtctgccctggctttcaacccgtacttgcgcctgctggagggaggagtcagcgggatcggacgccatgaccaattggcacaattgtgtcgaatatagtagcaggaattcttgcgcgggtccttgatgaatcgtcctttaattctgttgattgattcagataacatgtttgatgcgctggcaatgttgacggtgacactttaggcaacagcttggggccatactcgcttgcacgtcgccgtctcgccccctcgcgcggctgacgagagcgaggcagcaaccggctaagcatttgttttctttacgctccactccgcgcgccgatatcatcacctctgacttcgtctttcaaaaatttcacagtttgtatg

SEQ ID NO: 1794 - DNA, 703 bp, Nannochloropsis_gaditana
ccctgatcacccctacagcacaagcgctggcacgcatagaattagcgggcccgacaccatcaggaagcaattctcggacctcagcggcagccctgtcgcccctgaacagtcagccccatcccccgccctcttggacccccacctccctgtcgccgtccctctccggcgaccgaaggcccttcgttgcgcccctcagccaggaggagctcgagagccccgaggccttccaggccggcgaggaggctgactcagccatggccctcatgctggaccggcccttgcccgcatggagaaccgccgcctccacggtcctcaccatcctgggcaacgtcttggccgatccggcacaggagaagttccgccgagtgcgcctgcagaatgcggctttccagagcaaggtggtggctgtccctggtgccgtggacatgctgcatgctgcgggcttctgctacacgatggaggaccaagagacctttctctccctgcccggcccggctttggaggtgcccctgcgtgctcgcgtgatttattaccgcatccagcaggtgttagaggacacgcaggaccccctagagctcccgcccttgtcttgactagagcgtgcacccgtggaaatttgaacgtttacggtgctccaacacgttcgcatgtttattgaataaggaaagcaatggtgaagctatgtgacatgagaggtggctat

SEQ ID NO: 1795 - DNA, 703 bp, Nannochloropsis_gaditana
tctaaagaggctttgccctggactcccgccacgctaaacctctcccgtaccagctgcgccactcgacgcatggttgggtccttcaatttacaatcgaattctggggaaggcgaggtcagactcgtgatcggcgaacgatctccgtgccgaatcacaacctgaatttgtttaagcttcctagtgcgcgtgcctggtggaagaattccatcctccccatccatgggggcttcgcagtaggagaattcatgtttgccgcctttgagcttcaaggttaaattaccatgcggcaattttgccggcagcaggaggcacgcgacaaagaggagactgcttgcggtaaatatcactgccattccacgcgacaatagatgagcgcggccgccatcacttcctccactctccgcctcgaggcgtcggtgagatatttttgctcgtatagacgccagtacacggcgatgcagcatcccctgtatttcaatgaggtttttgcgaagttctgaattccaaggatcactagccggattgtcttttacagaggacgattgcgcagggaggcctcatgggccggtcggtcgggttgcggatgtgaggcccgggcactttcacctcccggggagctcatgcatccacgccgatcccacccacccgctcacatcaaggcttttccactcacaggccgcccagtagatcagacgccttaatg

SEQ ID NO: 1796 - DNA, 703 bp, Nannochloropsis_gaditana
ttgcttgtcccctcttgccaagcgggcgccgagaacacaatgcagacgtaagtcccttgggcctgggtcacacccgaattcactccacccggcggcaggcagccatagaccaatgtgaagcactgaaaaatgcagaacaataacgttcttggggataggaaagcggccaaataccctcttgatgatgcggacatgggtacctgagaccaaggaggggatagtttgcggaggcatgagatgtcgaacggcaaggtaaaggacgcaattttcgattcgcacgactcgggtcgactttgtgattgagattatccttttattttattcatccccatgggtatggccaagggacacctcgtgaggctgccggtgtcaggctttgagggcggccaagcttttcgtccgtcatgggccaggccccacccccagcccctctcccgacctcccggctccgcgcccagtccccgcagcttggctgcgaggaccacaaaaggatttgccggtccgccaaaatgcctgtttccgcgcaacaacaatgaacaaacctcttctgtggagctacatgggttagggtcagggcaattttctcacgtgaaagatacaaaatgacacagggtccagccagttttgtagtgcgattttccgccccgcgctttttcaccatacatcacacacttgttccggaaaacgcccccttcgacgcatg

SEQ ID NO: 1797 - DNA, 703 bp, Nannochloropsis_gaditana
cccggaccaggcaacaatcctgtgatgagcttgcgctttttcgaatctacgctttcccaatatcacggacaaaaggaaatcatagcatcgcactcactcgtggcttcattagagcgtacgaatctcagggtattatcagaattatggtggcaataaggacgtaaatctttaccttctccgatccactgcatgagctcgtagtcgcccatgcacacgtctccacgttgctgcttccttgagggttgcaaaagtgttcaacatcgcagggaaagaagtttaattattgttgatagatggaacagagagactgataaatcaatagcataactctcctgactggagtcaactcataggatgtgtgatacgtggtcttgcaactcaagtgacaaggttcctttcctccacgtttgacgagctttgcgggaatcgacgatcttactctttcgtttgatttcaaggcttgtcattgttcttcactttgaacccccattcacttaaagctcattgaaatgtctcttttgtcacacattggcaaaggttctggtcactgccgccgtcaaaagggagttacttaaacgtgcacagatatctctcgatctcccgaatcagacaaggcaaggcatgagtgaagacgtcataccagtcgttctgtactcgatctcggcagctgctttgctttacgtcatccggacccggaggcatg

SEQ ID NO: 1798 - DNA, 703 bp, Nannochloropsis_gaditana
acgtagcaaggtggtaagccacttccaaaatatcttttgtgtggatgaaggatcgaaaatttcggatagcagatatatctgattgtcaaaacgatttcatctgcagcgagatatttatctattttgagtttaatctagatcaagcagaaaaaacgtccagtgatgagttttgaagcgggtcatcttacctagccaagtcaaatcgtacatggaaacagacatcattgcagcaccagtctttcgtctgattgattacacgcaactaaattatgcttcggttaacaagatcgatatctttccctttccctgtaggtcgatgcttgggctcgtccacttcattaaaatggcgtgtggatgaatacattactcttgagcatacccggaggttctaaaggccagatagtgtcgaggccgacaacacactgatacaagagtctttaaaaagctcatatccttcgtcttatgaagagtgcgcatataaatcttgatgcaggcactctgcggtacttgcaagacaaaatatccactcggctgtgtattgaagcatcaggtacctgtacctgacaagtgacatatgacagggctacttataattatatgatccatttagagtaacgacggagaattaaagcccaacgtttcacaagcatcgaacatttttcttttctacgcacctagtacggacctttgaaattgcaccatg

SEQ ID NO: 1799 - DNA, 703 bp, Nannochloropsis_gaditana
agagcagacagcgtgcattaaaaaatggaaattttccgaagcaagaaaatgggggatgccgaccaaatgtgctcctaccatggcgaatgtgatgtattccattgtcatgagctcatatgcgccacatgttgaggcgagtgaatatcattttcgcgtcgagctactcgtagacggtctgacactccctcccgtcgtctgtattgcaacgtgaagtcctgtatcaccgctttctctcctcccgtatgtgcttgccccacatgtaactataacttcatgacaatatggatgtttgtaatgaccactgggctgcgggagcatagcacatacggggcaactcccgtggtggtacgggaggttgttgacattgcggcgttgctgaacgattgtttgtgtcaattctggccgcatgtcttggagaaggaaagtgcatttgttggaaattacatggaaatttggacagacagtgggcttttggtgtgtttttctgtctttcgcatctttatttctgtagtcaaggctgcataaggcggtgataaacaagccctcacctctgataccagctatgtaacccgatcgctccatgcatcgacaaactgacattgtattcatataggccaaaatcttcgaacagtcctcttcgattgtttttccttccacctgcagcatttgttcacacgtggcattggctaccattctttcgaca

SEQ ID NO: 1800 - DNA, 703 bp, Nannochloropsis_gaditana
tgatttcaaatgcatagacgtcatgtaaaaatttcagaagtctaaaaaaattgctcgttatcgacccatcgacgttttttaaggaaatttgcgaagataaagtgcctcttagctgatgtagtcacttttcacaacagagccgcggagatttatttcttctcccggcaatttcccacaattccagggaatggtgtatacttaaattatcatttttttaaatgagctgccaaaactttgttgatccatgcatatgcatataaaaatataacgggttgtatcattacgaactcgtttgttttcctccttaatgccccctcgatgatcatgtttcttataatagtctggatgtgttttgaaagaaaatgaaaccgacaccacacacacaagccatcaatgtacaaacatattcgtaaatcacgtccaatttgaacgtaaacgggccacaaattacggaagatagggccgaaaagcgcggtttaaaaacctgaaaaattatgaacgaatggcggggcacatgggccggcgcgtgcctcctctgctctctccggcggcggatcctccgtcccacccctcgttctgggaattcaggccggcagctatcctttcactgggactgggcgggaattaaatttgaaacatgtccaacattttccacaggatttcgggctcgcggcctcatttccaagagcagcagaatcatatg

SEQ ID NO: 1801 - DNA, 703 bp, Nannochloropsis_gaditana
caggccggcagctatcctttcactgggactgggcgggaattaaatttgaaacatgtccaacattttccacaggatttcgggctcgcggcctcatttccaagagcagcagaatcatatgtgtctatatcaggggctacctttattgagcagaggctgaggacacatagcacgcgcccagaggggcgagcggtgacctatgggtatgtacacggcaaatgccgattaaaaacttcagcagtactcagtttctcgcatataacgtggaggtcgtaggtcatgtcgtttgggagaatgcgaacaacagtagaaaggggaaagcaagtcaaacggacgatgactgagactgcgatgagggagaagccaggacatagaggacgagagataagcgaatacatatcaacatttgggcagtacctctcacccactgattgaacactccttatgataattttcgcagagagtgacgaagtagcttcagctgggaaaacggctggtacttctggatcagatatatgtcattcaacacctctgtcgccgcagctcgcagggagcaccggaggcggctcaagcgattcgaaggaaagctcagatggtatccatgaatgtaacttatccatgataggaaatcttgaatctcagccgtccatcacctcacccccaaaatggggctcgagggaccatgagaattcgttgaggaagcatg

SEQ ID NO: 1802 - DNA, 703 bp, Nannochloropsis_gaditana
taattgcgacgaagcagtcaggtgtttgcgggtcaaggtaaaaaaggagggacagagggagtggaaggcatgcggcaacatggtagggcagcatgtcataatgttttttgattcaatgtccttatttggggaatctctattctttttgatgcctcctttgtactcttccaaggctggtgcccatttgaccctccggtacgtgcggatcaacacgggtaaaggagagctccgcccgaggcttttccccctgtcgcggaacaacgagagtgattttttcatggaccaagtcgtggaagtgagggggggcacggtgctcttggagccgggggcgaaaggggcagattttattggcgtcacattcataggcgatgagggaacgcgcaaggtgagtccagtctgggcccgacggacgagataggatgaaaaaatgaagcatttgagggaagaatgagctcgtgccttctgcgtatttcgccttttcaaaggggatattggtggttaagccttgaaacgagtcatgctgaccgatcaaaaccacgacaggaggtggaggaggcgctctcccgctcatttggacagtacgggtcgcgcgtttatggaggcaatgtacggatgaagacagttggggagggataaagatgagcagtataaggattgagaatcttgagtttgattcattccctctcgtacacaggtgttcatg

SEQ ID NO: 1803 - DNA, 703 bp, Nannochloropsis_gaditana
gtgcgccgcctcacatggtctagaagactcgtgaaagcacaatgtcattgatttcttgtacatagggtactcctgtcccctccttgttctctgctctgccaatgatgaagggcctggatagttggattacgatatccttggagtatcgctcgagcaaatgatctccgagaggtgaatgactggcttccccttcgatcttgcatgcagccacgcacccacactcgacccctctccatcaatcactagcacagaggaggagaaggaagaggaaaaggggtagtgaggaaatgggcttctataaatcgtcttcttcgtccactgagggcagtgtacagaccacacctccccagcccggcaactccctgatgtggggggactcggctctttatgagagggtcgaacatgtccaagagcaggaagagccgcagcaggatcatacacagattccgtcgcaaagcttcgttgggttgggccggagcttatccttgtctgcatcctctgtcctcaacagcgtcacctccaacgccagcaacctcctacttaccggagggagcaacggttttccctgcccgactcccaaagccgcgcacgcaccgaaggaaggatccagtgtgggcgaggaaaaagacgaggatgaggatgatttcgaaaaggtgcgccgtgaagacgcattcccccccccccctctttcggcacgtggatg

SEQ ID NO: 1804 - DNA, 703 bp, Nannochloropsis_gaditana
tagcccgcctgcgcgctcaccaggccaataccatgtcccatgagccccaagcctaccacacccacttttttgatgtcgtagtgtggcgtagcagcaagcgtccgacgttgttggacgtgacaccgtcgcggctcatcaggcttgaggctgagacgaggaggggcgcccaaggcggagagatgacggcttctataataccttcccatccccttggagatcggggagagaaaaaagaggacagccgcacgtatgataacatagcactaatggagggcgacactgtggatggattccggaggtcatgaaaagtgaggagttatcgctgcttgtatttctcctctcgcgctgcttcctctttgtcttccgccgcaaaatgtatgccctcacacgtggagtcccggtatgcgtgacccactcggtgccagacgcaacatactttcccctcgcgcccacgaccgccacaaccaccattaatgggcgcttttccaaggccgcatgccttgacttgagggaaagcgcggtccatcgcccacaaattgactttctgagcgatgccacatcgaggagaaggaaagggcgctagacgcacattttgtggtcatttaaggtcctttctctcccccacatgcgatcacatctggtaataatacattgatttcactctcacagtgatcccggtgtgattttttcccgcggggggatg

SEQ ID NO: 1805 - DNA, 703 bp, Nannochloropsis_gaditana
tcgcgatgcctcgtccaatatgtatttcatgcgagtctcccattgaaagggtgcaaagtacacgttccaagtcaacaccgagaaagctgccgggggtgttgggcacacaaggcgattggccgatgggatcataggcctcctgttagaaaaagaaaaaacatgttagaacataatcctcacaaaatcgcacaatgtttttagaacttcacgcaaaattgaaatattttgtcatatatcgtggtctctttggcataaaaggagagggcctcgttacctgcggcagctaagcgatcgaagctgagacagcgaggcgtcatgggaaacgcatttttgggcgatgccgcagagttatgagggcctcctaatgggaagaagtggcatgtttgattcgcaagacatacttaatttacctcaccaaaaacagtgctcgtacaatacgtggggaaggacaagcccatggaggaagtaggaggggaggaggttgatacgagctcatacacccaggtgcgtgccgtcacttttgcattgaaaactttcttacgtgttgaggcccgagataggagacaaaagcgtgcgtcctcgcttgaacgctactagcaccgcatggtggcgggaggtttttccaccgttgcttgcgctgtcctccctcgcctttaaataattcactgacacctcatcgcactctcagtttcttgagtccatg

SEQ ID NO: 1806 - DNA, 703 bp, Nannochloropsis_gaditana
gctcaggttcacggcgccccgacggctccaccgtcgcacctcccgatggtaaagggggaacgagtagcagacaccgccgcgattgtaagggagcaataccataacacactggacggattgatcaaggtatataatcgagagggtttccgtgggctgttcaaaggctccggtgctaggatcgccttcttcactccctcgacgatgatttccatgagcgtatacgataccctcaaaggggaaattcacaacttactttcctgatagaatagaaaaagaaacaatagatcaaaaagggaacgtacaactaattgtgggctggtcttgtgcacgagctctgtcgattttcatattcctagaaagcaataatgatggtgtgattttgacggtaaaacaacctcctggccatacaactctcaggaacgtagtcgcgttttaagctcgaaccttaccataaagtgagcatcttcctttacgattcagatgtcacctcccatataattgtggggactgggatctcctgaagggaatcaataagccgggaggacagcatccgtcaaagcgtgacgcaacggacaaatgcaacgtgaccatatgccctgcttgtagttctcacttccacagatcgtccgttcaggagccaaaccattttttcaccaaataaaaactagacaggcaaaggttgcaaataataaaaacagccatg

SEQ ID NO: 1807 - DNA, 703 bp, Nannochloropsis_gaditana
cagatttatcagtcgtcccctcgaggcgcgccgaggagctcgaaagggagctcaactccatcaagtcctgcgactgggaggatcgtagcataatcctgcttaggcgaggaggtttgagcgtgcatgcatttaagtgtagataaatttgattgtaggttggaaaaaactaaacaatttccattaatcaagggtgcactcatggcatcgcgaaggaaaattttcttcggaaggaaagaaaatattttttctatgaagatttcttcggaagaaaagaaaaggttttatctttgaagaaaagcggcgatccacctccacgccgggggtaccttttccatcacgtcatcgtctttctcattgtggacctcttccaagcccgggggtaccttttccatcacgtcatcgtctttctcattgtggacctcttccacgcccgggggtaccttttccatcacgtcatcgcttcatcccgttcttctccttcgtgctccggtgaaccgatcgtatttccaacctgaacaaaatgccggacgatcctcacgacgcgtgctcacacacaccaagacaggtgataaattcgtccttgtatccaagcgagtgctggcgggacggtgctttcacatcgggtgcgttggaaggatccctttgaggagtatagcagcagacgcaccttcacgctagcttcccgtgtagccgaagcatcatg

SEQ ID NO: 1808 - DNA, 703 bp, Nannochloropsis_gaditana
tgctcgacatgcacgcggaccaaatcctgaccatcaggacccctccaccgattaatgaggtgcgacgacagccaacttctcatctccgagccctcgtgctcatcatggcgtcgtttctcacagttggtaagggatttttccagcaatcacgtctaatatctgtgattttttcttagctggaactccgaagtgctgttgaaattaacatataaagcgagcaattccacttgagatcgtccctaacattgactttcccgctccacttgatttttccatcatgtgcgccttctccagggagctactacgtttacggtacgtgccagcctgccgtttttaagcgttatcgaaggaatccgttttgcttgtgattttgctttgttttcttttcgtcaagctcggaatatcttcactgtcttccacgtgtgaccgttgccaatgttcagcaattgtaagtgacccccaacccttcctgcagacacgccctcgtccctctacgcccaaatccaagagcacttcctgttcaacaacaacggtttcacctcccaagctgccacattccagctgtatttcaacctcctctattccgtatactcggtccccaatatcctcctgcccttcctgggaggccacctggtcgacacggtggggatgcgcgcctgcattgtggtcttctccctcctcgtcctcctcggccaactcatca

SEQ ID NO: 1809 - DNA, 703 bp, Nannochloropsis_gaditana
tcgtcaagctcggaatatcttcactgtcttccacgtgtgaccgttgccaatgttcagcaattgtaagtgacccccaacccttcctgcagacacgccctcgtccctctacgcccaaatccaagagcacttcctgttcaacaacaacggtttcacctcccaagctgccacattccagctgtatttcaacctcctctattccgtatactcggtccccaatatcctcctgcccttcctgggaggccacctggtcgacacggtggggatgcgcgcctgcattgtggtcttctccctcctcgtcctcctcggccaactcatcaccgccctgggcatcaccgtccactccatgggcctcatgctcctgggccgcctcatcttcggcctgggaggagagtgcctggtcgtggggcagtcggccttcatctccgcctggttccacagccgggaggttgccttcgccctgggcttcaccctctccgtgtcccgctttgggagcgtcttgaacgactggggcagcccctttatcgctgaaaaggcgaacgtggtgactgcgttctggttcggcgctctcctttgcctcgcctccactatcaccgccttcctcctcgcctgcatcgaccataaccatcggtctcggcaccacggccgccccgaccccgccgtccttccccccacagcacccacttctctcacctcggccggcatg

SEQ ID NO: 1810 - DNA, 703 bp, Nannochloropsis_gaditana
gcactaaaagatgcaaataattatacctccgacaaatctgtcggtgagagctttgcgaggacgacgtgtgacaggtccatttattaaaatcgaatatctgtgcgacatttttgggtcatatgagcaaacaggggtacgcgacgacaaattggccgacaacaacacattcatggtcgaggaaatggcattcatacaggaaagtcatcagaggcaacagccgggggggaaggaggtagaattttcatccctcgggtacaccagcattacatggcatggtttttggcctttactcagcgagaaaagctcgtgaaaattgcctcaaacaattctgtcggtcactgagaaacggggttagtgcggaatagttgaaaaagtgtacacgcgaatcccgtgtggctagcttctcgcttcttttgttccggaactgactactagtttatttaagcgagtcgccactgtcggcgcatctccctaatgcatcttcaacgctttaagggcctttgtattatgttcaaaggcccctaatctttttaaaattgcaaaatgagcaatgcaagcaatctgaacttctagttgcaaggttggttgtgacgcacgctgcacttgccacatcgtatcttttccactgaccactatcaggaacaagcacatagatagctggttcgcccttttaccccttcgtgaacctgcggcaggcagcatg

SEQ ID NO: 1811 - DNA, 703 bp, Nannochloropsis_gaditana
ggtctgtccatcgctattgaatacacccctgaggaaagctgatcaaggtaaaaagcattgaacatgtcctcaagtttcgtacttatagatgagttatcttaattcactcgttgagatcaacgttgagcactaaaaactgtttgtcgagaccctgccaaggcgtaaataaatttaagtttgcatcgatctgtgttgtggacagccgcctttttccggtaggaggttatgatcctggacgcatcagctacttatctaccaacagtcgtcttaaagtgatgtttgatggctcattttagcgccgtatgtttgttttacacctctaggtctttcctttatgaagcggcgtcgagaggagggcgcaggggcccgcaatgccgggaaaggtaatgattgctattgtactcggggttgacatgagtgggcggtacttctgaatacatttctttccattcaaacccaccactttctcaatacgattggaaacacataagatttatgcatatattaaaattggtgtgtggactttgccacggccttttgcttccattcccataaattctaactcccgtttacttgcatggacatcctctaagtaccttcatttgtgaaggcctctcctcgtcagggcggcgcttgatataattttcggaacacgagacatagcttaattttcaccatgatcctcaactcatttgtccccaga

SEQ ID NO: 1812 - DNA, 703 bp, Nannochloropsis_gaditana
cagactacggggggaccgtgttcaaaggacaagttttcctccacgcacggatgactaggttgcaattaaacctctacaagctcaaaaattgccaggtctttaaaagtcatgcaggaagatcaactatggacaataactctgctatcggctatctggtgagaatggaacagtaaaggcttcaagtatcaggacacgtaacaatgtcgccattccctctcgtggacgataaagcaataataagtgatgaatcagcaagcagaaaagtaacacatgtgctgttagcccatgttgaacccgagcacggacccggcgtgaggagggaaggcctcgggagccggaaccttgccatggaggttgggcacgggaggcaagaactaggcgttaccgtttaacggcttctggcgtcattcgcgccaaattcaaatcggaggccagtcgacggccctcagatggcgtcacggacaacgctcgctactctcgacggacgcatttcgctacaatgagcaaagattgccttttgttatcacgaattatgtgtgtaagagaacctggacgacgctctttgtgactgttctggtgcaaagaaccatccaaagtgcggccgatccgatccacgtagtccccctctgcgcacggcttgtttgttcctcgcacgttctttctcttatttctctgcattatggcgcaactctacacagatatg

SEQ ID NO: 1813 - DNA, 703 bp, Nannochloropsis_gaditana
aacagcgaatgaattgcggtacccaaatgcttctcgtttgcgtaaattgttttacctcagtgcctgtgaagggaggggcgcgaacatctcaacctccccgctccttcccgggggcacaccttgtcgggcagctcccgtgcgcattcatgtcacaccaacatgatacgtttggcgtagcgaacaaaggcactggcagatggcatcatgtcaataaggattgaattgctattcgttaaaaaaatgttatcatggctcagattctgttactattggcccaccgactctttaatgcacccacagatgcggggccgcctccccgacctggggctcacttggctatgaaaaaggacttatcaacatggagaccgtgaaatcaacctccgtgcaaagtcatgcgagcgcagccctgacctccgatttcgatgcagcttttgcattccaagttgacgctgacgacgacacctcacttcctgacgttacttgcagaaatcacgccaatgaaaaactcccaaccccttttgaattatggaagtacatttatgcaagcattttattcggtaatcctctcctacgggacttggtatggattaatcttgctgtacacgtcacattctggcttctcttctcaacccttctgtgggcagtattcttgggatacctgccattttctataactttcaaggcatatttcttcggatctatg

SEQ ID NO: 1814 - DNA, 703 bp, Nannochloropsis_gaditana
atctccagcaggttggcctggtggatgtgcgcacactccaggtctttgatgctgagttcagaggaaagtttcgagtctttgaccgacttgtatttgattactttggccccggagggggcctgaccgccttcctctgatgaggcaggaggtggatgcaacatgtcggggccgcggaaaaatgcgacttttttgtgcttccggctgtaaagggccagcgtcgttgcagtggcagccgagataaaaaataacgacgctgcgatgggcggatgagtttccattttggcctcggacgaaaattaagtttggtgtcgggggctaaatgaatccaggcggactcaccagaagccgaagggaagcgaggagacgcttttcctgtgcagattgcgtcgaggaaataaactttgaacaaccaaccacgcatctaagcaacaacatgcatcaatcgaagcggttggctgaccggtcttgcgaacggaggtgaagtttcgttctgaatgaatgattactagtggagcaacatgcacactaaagcctgcttaagcgagcgcagcagtatccgcgttcgctcaagaagcgatagctatgaaatagcatggcccacacacaagccgccaaactggggtactcacatccacctctatctccaagaaaaattgccgctgtctcatgcattcccctttttaggcatcttcatatttgcatg

SEQ ID NO: 1815 - DNA, 703 bp, Nannochloropsis_gaditana
atcgaaatccctgtaaccagcttcattgcagcatccaagtggacggagctttcataagagaacagagcacatgactagcagggaataggttgccaggactttcaccgcatcttctacttcttgtgctgcgtcttcattatgaataaccctctcagcaaggttgtagccaatgatggggaggtttcgctcatagatcaaaagatgagatattcgtgcgtcaagtccaatcactttgtgggtaattcaaaaagtacgtcgggccccaaatgaatcatgtttgaccattggtgcaacagtggtgcttatgcgcgttccacttaaatcgttaggctcttgatctccggagtcagccatactttccagggaaccagcttcagcgttgtcggtggagttcggggtgcaaaggcgtagaaagtaggtggctctatgtgtctgtacattctgtgtaccgtaggctatcatatgtcaagaccctttcttagacattcagcgcttcaccgtgagccctcaagtactttgacttttcgctgctgccttttttaccaaagcatctcgcgcacttttgccacctcctcgggagtgacttcgaggcctccggggtgagcatgatagatatctgcaacgcaataaatgtaaggcgctttccaagaataattagcttatcaaatgtaacctcctttttctcctctgacagggcccgatg

SEQ ID NO: 1816 - DNA, 703 bp, Nannochloropsis_gaditana
tagaaaaccatcccgctctactacaggctgattcaactacactcaaattcacagaagaatcaatttcacttcctgtattcgtctatacggcatcccatggcccaataacccggggcttggttcatgtggcatggtcctccggccgtcgccaaattctgcttgttgcaagtcaagtcccagccgcctgccagtttgcttctacagccatggcaaacaatgcgatagaatgtgtccaccctcgcttacaggagtgaattgatcgggttctgttgagtctggagttgaatgtgtgacgaaggaagttttttgttcgtcttgttctccatactggcacgcggacagaacccccccctgaaagaacatgttgaacgtttgctcgtggctttttttctatcaaaacatgtgaccttactcttgagataaagtcatacatggatgtaagccaagttagaagaataaaaatatcgacttcactgtacattaatgtaaatctagttcttgagaacgcggttcctggcgtctaaagtataggctgagacacgtgggtaaggaggtcatagcaagtagctacaacgttggaaatgtaaccttttatgtttctcactcctttaatgaacgcggcagcaaaaaaatattcagattcacaattacacatattctaccgtaccacatgcaggaaacgcatcgggtaaagccctggatg

SEQ ID NO: 1817 - DNA, 703 bp, Nannochloropsis_gaditana
ctccggccttcaccctggctcgtgcccttggaggcattcggctcttcccgctcccccctgttgtggatggtagcaggctgccggcgttgatttatacctggcgccgctgagtgtgatgaagaggatggtgctccgcctccccgggccttgatggcacgtggatctgagtctgaaacgacctctccattaattattaagacttgaagtgtataaatcatgtcgggcgaaacggcaggtgaggcaagggaaggacggaatcaatgggaaaaagaacgttcaaaaccggggcaaaatgactcacccattggagaacagtgccagaataaccaggagagagcggagtcttctacctatcgatgaaagaaagaactattctttgaggttatacaattttgcgaaggctttctcccgccgcgttctctttggctgctcctgtcgtccctgcccagatatgagctgccgcgcacacaagtcttcaacgattaatgcggagaaaaatgtaggcatcggcttaaattataataatgtctaataataataatgtagccatcaattcaaagaatgaggtagcaagaggcatgtgagctatttagcattaggcagacagggcctgatctccgcgtgatcaaactggtatttctaacaatgcgtttcaacctcccctctgctctcgcacataaactctccctttttcccttacaca

SEQ ID NO: 1818 - DNA, 703 bp, Nannochloropsis_gaditana
tcaagtgtgctgcattcacatgtcgtgtcttaatacctgctgccgattagctatttgaaaccacgccagaggtcgttttattctaattgtgtaagccgcagttttcaggcactcgctaaagcaacgtcactccgtcgctcccaagcggtggggaggttaattttcaggcttgggtattttcaggttccctcttacgactcgtcactttgatgaggaacttttgaatagaaagacactttcatcaatgatcacaacagtgcccttgataccaaccgcgttaacacgtgtgcacttgggagttttgttctgttgctgccttctgctcttgtctaaccatgctgaaaagaattcctacctttacatggtgcaaagcctgcccattgtgccatcgcgctgattttgacagtcaccaaggatgaaatcctgatctttctttgcacatctcatcacgcggcgtagattggcgtgaaattgcgtctcgcttgtcaacgggaaacgctacggtttgagagctaactacatcgaactttcattcggtcgcctaaatatatgtttcactgcaggagatctctatgcttttttccatactcactgtctatgaaacacacagctgagtgcacttcgggggactcaaaagatgaccgtactcaagcgcatacccaaggtcttaagcccccgtctgctacacgtgctggcaagcatg

SEQ ID NO: 1819 - DNA, 703 bp, Nannochloropsis_gaditana
gcaacactggtaccctcagctaatgctaccaggatgagggtagagtgattccatgatctccttaataccgatcaattacttaccgaaggccacagcagaattttgtgagaaggaggaagttgaggacaaagaggaaactgggccgtccgcagttgcaattccatccatggtcgccacatgtctttcgtcggcaggcacttccccttcttccataaggcgtctgcgccggagaaaaagaaggtgcgcgggtgagggacatggaaattcaagccttgcaaggggatcgcctagtcgctgagcaatattcaagtgttgacgtctttgcctttaagctctcggtccacacggcatgagcctcccgactggggtgacccgcccgcggtgacggcgcactttcgcgacatgtcctgcgacgaaggcggggacgacgacggctttcgtgggcgtgctttggaacgtgtaggaaagaggcggtgacttggtaatgctaattatgtgcacgcgggggaccggtcagggaaagatcccgggatcaggagggaggctcgtttccccgccacacgacttgccggtcaaaaccctgcttgctggtggaattttgaagcgaagatggaaaatacctcacaatacgccctacatatccttattcacagaggcaatcgttgtttgggattttttggtggctattcattgagaggtcatg

SEQ ID NO: 1820 - DNA, 703 bp, Nannochloropsis_gaditana
tattattcccgctcctttctagtcactgtcacttgttacaatgtctgcgctaagaaattcatgaaaggtatgctatgttcatgcatttccctcaagacgtgtgtaaatcagcgctcgaagcatgtttcttcagcattgacaccgggtccacttaacctttccccgggcctgtcggactttccccacatccgataaaatagtcacgcgcgacaaaatgccttacactatgcacaagtcgtccgtcaaaaagtgacaagcggcgagctggtctttgccggtgcctgtccttgtccctttccgacctttttttccacccccaggaacgtaaacgcccgatcgcccagctggcatgatatctccaaggattaaaatcctatctcgctgtcgtcgtaccgcttttggggcacagctgttgtcccgtctccgagactcaaaatcctgataggcacgcggcctttgtgatctgaagcacaatcagctcgctgaagtcattgccttcgatacttttggtgtcccggccgacgggctttatggcaaagtcgtcccgcttattggccgccgcacggtggagttctcggctctcgtgactcgtctctttcttctggacatgtatcctccgctcacaggcaattttatgcgttcgcgggacagtattcttcctccgttatcgtccctcacagatagcgaaatcaatgctgacatg

SEQ ID NO: 1821 - DNA, 703 bp, Nannochloropsis_gaditana
ctgctcacccgtcgtgatgttgttttttcccgatgaataaaaaccaacggctgccacaggccctcggaaccataccataattctttcttctcatccttctttttaaaccctctttgatacacacacgctctaattgaatttcaccgctacttatagccccgccggatcaggtgagggactcattagaatgattgaggtttgggctttggtataagtaaagaagcccgtgtgctgatgtctaatcctcccaccctacctccacccattttctgaccatctgcaggttaccgctggtgctttctcgcttcaggtaggcaaagtttcctctgtagatggagcaagcgtaggagggagggagcattttgcaaagcccagctcgaggagggaacaattagggggatgatgtatgggagtacggggttggagagcgaatgctgtttgtccagacgacctaggattaaaagcattagttcaaggcagatcgtcgccggtctcagaggagcattctgcttcttgtgcggacttctaactacttcctgtgtcgatgaggtctctgtcagcttcctagggttgcggcgcatggctccatgccctgaatatcgtccgttgacttgtttactcatggacgcaacctcttttccttccactttctacagcgcctcttccagcaactttaattttcacaccctacattccaaacatg

SEQ ID NO: 1822 - DNA, 703 bp, Nannochloropsis_gaditana
accatcaacaactgagttcgatcgatacttgacgaggaattgggttcttaacgctgtctgcaagcaatcctctttgctgggtggagcgaagaaagggggagggacacggatgaggtcacgttgcgttcttttcgaaaagagccattaacctctacggtcattgcgaagaaagaaaaagtggatggggcgattttctgaacgctctttaactttcgggaaaaacattgtcttgctcgatgaggagcacctcgagggtcacttaactttgtaccggccactcttttttccctgaaatcaataatccatctccctatagcgtcatttctagagatagacctttattgtgcccagaaaacccacaagagtactatctatatacttcaaaggcctcagcttccactttgtccttgctgtttacttgcttttggaggaagagtagtccaagctgggaaaatacgagtgctgtgagctaatgaaggagaagtataagtgttgtcaccgctgtccatcagtgtgacacccttatatggcacccttatactttcgcctcctcttggtacctattatgtgtggcatgcgcccgggaacgcaaaggcgtctatgtctcagagtcacctcgatgcttgaacctccccggtaaaatgcttatgcctgtgttttgttgccttttccaacgacttgatctgatactacaacgcacata

SEQ ID NO: 1823 - DNA, 703 bp, Nannochloropsis_gaditana
gtgtgacacccttatatggcacccttatactttcgcctcctcttggtacctattatgtgtggcatgcgcccgggaacgcaaaggcgtctatgtctcagagtcacctcgatgcttgaacctccccggtaaaatgcttatgcctgtgttttgttgccttttccaacgacttgatctgatactacaacgcacatacaacagcaacaggatgccacgtggtaataaagaattatctcttttcctctgggaccctctgtcacggtttttggcctcagctgccaatcgatggacgtcattcataccccccccgccccgccacccgtccgaccctcctcgacgcgtccttctcctccacgcgcatcccatggggacttcttctttcaatggcgcctgctttgaaacaactcatcggtcgcttcaagaagctggacacgaagtacagactctatctctctacgaggaaggttttcagccatgtatgcaagcaagtgacataagggagtatatgaagccgctctcagaccggcacgatgagggcacacccgataaagcggctctcctccgatatatcgacctccttaagtggtgtgatgccttaatttttgtatatccaacgtggtggtatgccatggtaagtcggaggcaaggcaacatgaaaattaccatagaaaaaaggatgttgcaaggagggagtacaagagaaatg

SEQ ID NO: 1824 - DNA, 703 bp, Nannochloropsis_gaditana
tatagaacatctgactgataggttaaaaatgaaattgtcaattcatagccacctctccctctctctcacccttccctcgtcgagtcccttcgccctctcgctgtgtttgatggcccgctgacgcactccgtgaccactcagcttcctcccttcactccccatttcccctgtctcccccaggccttcggtagggagaaccggaaagtgccggcccatatgccccacctgatcgacaaggagctcgtcacggagatgcaagcacggtggaaggaaggtaggggaggatgggggagagggggagggaccggtgagagggaaaagagaagcaaagatacgaaaaggcacctctggcacgcgtcaattggatggagagtgtcgggaaatcctatgtaatgcagatattccgccctttgaaagttattcgcaactgatccagaacctctaaccctccctccctgcccctctccctccatcccgttctccctgcccctctccctccatccctccctctctctctgcgctcagaatgggaccgaacctcccagcaccgttttcgcgcggccgacgacatgcagtactccttttcctatttctactacctcatgaatttgcagaaagcccatcctctcgacctcaaggtaaagtctgcccgcccaaccctccctccctcccccttggccgttgtcccccttctcggaatcat

SEQ ID NO: 1825 - DNA, 703 bp, Nannochloropsis_gaditana
tccctacctggaaacctcccccccttccctgttcaacacagccttcacggtgcccaaaggaatctgtcctccaaagatgtcgaacaaggtgtcaactgcatcgtcatgcacagggtgctgctgctgctggtaggttcttttttttttttttccctatctctgtaggtgagatcatgtaggacagaggcaaaaggggggaaggggagtgtggagacaggtgaagattttgatccaataccattttaaaaaggcgtactctgatgagcggtaaaacaatagaaagcacatgtacataagtgtgaatattgtgcaaaattgtgtatttttctttgcgtctggagagggtcgagcggactgagtgcgctggcgtatgcgtatcgctcagctcgccattaattcatgtcgtaatttattttgccagctggagcaacaccttccatgcctcgtgtatgcagctatatctctgcgaaaagggatatggcagatatccctgtggctgagtacacaaacacgtcatttatgtttttaacactgctttacgaacccttcaagattccaaacttcatcaacgcaaccacctcccgctcctcacgctctaataattatttctacaaataattgaacgatcaatgatgctccaaaaggccccttgatcggtttgcgctgaaggaacagaaatgtgtcgtcatttgtaacaagaatg

SEQ ID NO: 1826 - DNA, 703 bp, Nannochloropsis_gaditana
gaaaagccagcaacttgcgctccaacattggctccttctgtcaatcctacacaatctttcgttgtctttgccccgggacagcgcttttcacaaggtggtcagctagcgccatttgataatcgtcgtctgtcgctgcatcctgaaatgaacctagccataaaccaggacgttctttccttcggagacacgtatcatcgtcaattgcaacctattgagacgaaggatgactgttatgagtattgctcccttgtaggaggaaaaattgcgccgttcttcttcagctggaataatgccacaagccagtgtttctgctgtgcaactgtgtgcactcccttcatatacgatcctgcattcgatgtacaaaaggtgctcgtttctgctaccagcgctccaacatttactcctgccccatctccctcggatcaaaatcgccgcctttacaatataaccgctgtcaggacaattttggactatgctgaagcatcgtattcatgcaaaactagcgcctgtgaggcttggaattgcaggtacttctaggcttaaaatgtctagcatgaaataattcataagtcaagtcaaggcgtgatacgtcatgggcacccccatatatgctcattatacctctattttttgtctgcacgcagtacttgctcccgacacccggacacggaagtgaggcgcatttctgctcctgacggggatg

SEQ ID NO: 1827 - DNA, 703 bp, Nannochloropsis_gaditana
gccgtgagggggagacagggattagcgtaggcaaccctgccgaagagggagcgtacggcatttttattcacgtgccacgttctgatgtattccagtcgtgcggcctgcaaatttgtcgaatttagcataccgcggaattaaaaagagtgagcgtacgtccaggaatcgatgcatggcgtagatcgcacattactgtcactcagaggatgctgctttatttttatgcccagactctcgaagacatcgcttgctagatcacgatcgccccaaaaattcctgaaaattaatacactccatcctcctcttatcatgtcgcggtctctaacgctgccacgacaagatttaccctcctgttctcttttctccaagcgactggccatcaaaatcgggagtagctccttttttgaacgtgtgcaaatagctttcggccgctcttcttcatataatcttcatttttatctcccttgcttcagaggtttttggtcttctcatcaagtgtctgtggtacatgccatatgtccactccgacaagaagcagcttcgggtggattggaaatctcttgtctgctaacaggatcctacatactggcatcttcgcatcttcttttccgcaatcatgatgctcgccaagcctgccagcggcacgagtaaatcattagggaagattttgaacaagcaccccaccaagcgtcatggggggcta

SEQ ID NO: 1828 - DNA, 703 bp, Nannochloropsis_gaditana
acctggaggggcccgaaatgcggtcttcgagggctaaccagacacagggcgttggccattgatatttcgctccccccttcccctccatgtagccattaccacacaatacaaagctcccccgactcttactggcatgcttgtacagattttgtcagccgctacttgtagttatcgatcattggaggtagttgactggaaagaccacttgatacgaataccaacaaaacacaatacccgccgcatcctccgccttcctacaactatgcttggttcaacacgttggcaaacttattacgcgctattcagggttagctggcaatctctctagccccagaggtccctccccagctcctcgccgggcgggagatgatgaaaacgtgccagggagcggaggaagaatcacagcccgtgctcccactcgcaacaactgccaaacaaggcacatccgcccttcctccctcgcgctttggcactcatttgacatcaatgcaccctgcttacgcgcgtggaaaccggtgaccccaccaggtcttgtggcagcatgcattgcctctgatcttcccgtttgacctccgaaaccagagcttttccgctgacctcacgcacgcccgtcgcatttgtcctctttctatacccacccaggcgcgctgtcccgctccacgccactgagtgtcaaatagtggtttcgaatcctgttgtcatg

SEQ ID NO: 1829 - DNA, 703 bp, Nannochloropsis_gaditana
tctcatccacggatttcatgcgcgctaaaaatcccgcgtggcagggatgattgtgcctgcatgtggcatacaaccatggcctggccatcgcccgaaattcttccgcgagcgtcatcggagtcggcgaatggcggggcagcaggacgaaagggaggacaagcggcgtgaatttctggaatttggacacccaggcgaggcaatggtccatgtgatgttactatagagtatgaattttaccttttccatcattttttgagtttagatcaggtatttatgagacgtcttactggtgtaaagcggccgcacagcgccggggctgctggggcgcaagacgacggtggccgtaatgacacaagacggacatccgcgccacctttttttatgggtgctaacgactctggcagtagtagattaagcaggcgccatggagaggacggaattcagtttgctgagtcctcctacacgacaaccggagctgcagcccccgcattggcagcctcagcggtagctgacgacgagtcccctgcgatggataacacacaagaggtcatctggcaggcctctccgaaacgatatcgacccatgcaacgacattctactggactagtacataaagaattgagtattatccaggacatgctggcaagcaaggaaaacatagatcagacccgcctgttcgagcagcaatcggatcagcaccatg

SEQ ID NO: 1830 - DNA, 703 bp, Nannochloropsis_gaditana
gaggtcgagaatgagggtccggaaatgaagccctagacagtcacaacacgtcctcttccaatacatagacgtcctgatataaggacaacacacgtcagcctttgaagggcccctggtgtgcttgaatggggcatggcgcgggggcgagtcaacttgaagcaggtggcactccgatgagaacagccaccaccctctcgccaccccttgtccgctccacccagagaaaatcaaggcgcagaagaactttattcaggcgggccacacgtgctccatggcatggaatgtggaaacatgcgattcacaagcttgaatggggaaaaagtcatgaatgcaagttgtaaatgcgccggcgttaaatttttggcccgcgccgaccgactggtgatgagatagtcccagctgtcctacttgagttttccttcaaccatcttgacgatatgcacgaggcgtgtttgtacgtgatacggtgtaatttgaagatgaaacattgagtggggtagagtgtgttcgcattgccgtgcgcggcacgcgctttggctgagcgtttggtgctgccacaggagggaagacggcgcctcccgcatatttgatgtttcataatcgaccatgcacaatacatttacagtaaaatagacaatcacaccaacgtatacgtgggtaggacctttgaccagcccggtacattatttgaatcaacactatg

SEQ ID NO: 1831 - DNA, 703 bp, Nannochloropsis_gaditana
gtttttgcgaggttcgcttttatgaaattggagcgtcgttgaggtttggcagagggattcccttgctttttgttgccaaacgatgaaggatcatgtcctattttttgaagattccctgaggtttgaagtctgttttttacgaagctgttgagaatggttttgtaaccagtgagagcgtgccccctccatctccctcgagctttccacctgccccttcgtcagcgcccctttgtgaggctttttgcctccccgacgccgtctgtttcctttcgctttgtacacttgcctgctacgcaaagagaagtcgtcgcttcctctttcaagtggacgtccttatgatcggccctgtgtgttcgcatcgtactgcgtttgccttggaatttccttaggaatagacgaggtcgaccataccctgtgtcctttgcgtcgaaagctttcgcttccttctcctccttttgagctacgtgtgatgtgactgcctccgcctctgctcgctcctcttcgaaatccctgccgtgcctcgacttttttacctgcttgcctgtctcctgtacacctccgccccccttcgtcttcccctgtgcgatccctcgcccctccttgtgttaagagttactttttgcgtgtagcgtgatcatcattaccgtcgtgcaccgttgtgggtccgagtcagtgccacacacctgcagtgtcatcggagatg

SEQ ID NO: 1832 - DNA, 703 bp, Nannochloropsis_gaditana
ggcgtttgtagagggcctcccccgagacaggatcgaggttgacacggccaccaatgatggacaaacaccacggaatggtcaaaagcataatggtggaccccgctagcgccccgaccccgaccgtcaattcctcctgcgcgttatcccccatcccactgaagaggacaattgccccgtctggcacggcgccgagaacaggaaggactactgatcccaccacgcccgccaatgagggaactaaaagcaagagctccgacccctcacttatcatgctgctcgagtccatcaggattttcccgtacacgagcaacaggaacagaagttgtacggccccccctgcatcactgggcagcgtcgtgggatcgatgaatagcccactggtcattctggagtgaagacaaaagtatgaaaccacgtcaagggaggtgggtgggccaaccgttttccctaacgcgccttctgagttcgtgagtgcccagtgcccgttgcgacatagttttccatcttttttgtcacgtggttttgcgtgttcgagctttcgtcggcgagtcctctcacttctagcgacgcctccgaaaagcgccggcaaacctctctgtcttgctcttttaggagaggctcgcacccgacaatctttcccaacacaagtaaatcggtgcatgaggcgcggaacaaggtcaaatctttgggccgtgctgctgtt

SEQ ID NO: 1833 - DNA, 703 bp, Nannochloropsis_gaditana
catcactgggcagcgtcgtgggatcgatgaatagcccactggtcattctggagtgaagacaaaagtatgaaaccacgtcaagggaggtgggtgggccaaccgttttccctaacgcgccttctgagttcgtgagtgcccagtgcccgttgcgacatagttttccatcttttttgtcacgtggttttgcgtgttcgagctttcgtcggcgagtcctctcacttctagcgacgcctccgaaaagcgccggcaaacctctctgtcttgctcttttaggagaggctcgcacccgacaatctttcccaacacaagtaaatcggtgcatgaggcgcggaacaaggtcaaatctttgggccgtgctgctgttgcttgtactttcgggtggatctgcttttgtaaagttgttcaaggcgtccgtcgcgaggtacgtccgatgttcatgaagacgtacacgataactccttaatactgcaagaaaccattcatcatctcgaatgtgaatgattacgagggtgtctgtcgaccgctgaagccgctttcaagggcaagggacgagtgggatagttttcggatcaggcaattaggtcaggatggtttaaccgattatcgatccttttgatctaccaaccctcctctaggcgcccttgtcattttcggcgtacaaaccatcgactagtcatgggcaatttgctttctttttcatccg

SEQ ID NO: 1834 - DNA, 703 bp, Nannochloropsis_gaditana
cagcaatgtgatgatacggcacaaaaaggcacgtccgggttgtgacttagaggcttgcgcgctaatcctcgagcagcacgggggagaagccgcgggtccaatcgccccgtctgtcatgtgaatgaaggacacaacagcacgctagggaagtggagcactttcacctccttctgcaacccatccacaaggcaggggtgcttgggtaccctgtggaatgggttaatcgtggcagtgagatggaagtcagcatggacgcctcagaggggaccccgccccccaacatgcgaaatcatttgacctgccaaaaaataccatgtatgggaccgtccacaacgagattctgacaaagtacacgtaaatagcccagaatattggcagtatccactgtcatgcccagccatgtcctcattattgttattttgtcctgtcgccctagcagcgctggggcgttcgtgtccgaagcaacttgaagacttgaagcggcgaaattgaggctggcaaatagtatacttccccctttccgagggcgccacagaacgacaggtggattttccataatctcatcaaacgaccaaaaaggcgatggaagatggaacaatttttgatatatcgacctggccaagtctttcctgagcttacctccattcctccatcctccctccaggaggcgagctcgtctttcgacaatttggccgcagatatg

SEQ ID NO: 1835 - DNA, 703 bp, Nannochloropsis_gaditana
ctgaagggcatccagtctcgcattctcgtgtcgtgtagagtcgtgtgcgagctgaatcgtcccgttctatttcttccatgatcgtcacttacgacccggtgggcaagctgtttggtcttgtcctctattttgtatcgttgcactcgttcgcaactgggagcgggatttagtgcaacagacctcaacaatcctgcaagcgactcatgcgttgttgaggagcatgacaggcgacgagcgaaggtttacattaaggcaagcagttcaggagagcattgagactgggtgatgggtacgacaatgtcaggatattaccagttaggaccgtgtcgatgcttttggttgcatctaccatggagcgtcatacttggtggatgacaacagcattcggaggatcactcgacggccggacgacgtacgcctggtcaagtgctcgtatatcacaaagccttcctaataagaccgatctccctataaattcacggcataccatatcctgcactcaatgtcatatcacttcagtacagacattcgcccttggaggccagggctcttgcgggcggacggacggctatctcgtcgctcaagtggacttgctaccgagtaccctgcttgcagacgttgcccggtgcggtagctcgtgcgtagcctagcctttgatcagagtgcctgacgtcctggacactcttcaatatttagatccatg

SEQ ID NO: 1836 - DNA, 703 bp, Nannochloropsis_gaditana
tcacgagcccgctgcctccactgttctgaccactctgtgccccgctggataaatgccgcaacgggagggaaaggaggcaggttgtcaaggcgagggtgcagaggacgcgcccaagagagatcacagactcgggggaagagggagcccgcaggccggtcaaccccccgctgcccgaggggccatgacgggcctgcccccacaggttcaggttaaggtgccggtggataagagcaaggaggaccatggcagcgaccgcggagacgaaaactgcggcgggaaaccccgctcccacctccgtgaaaacccacccaaggcccaggagagcgccaaggaggataagtgtggctacagctccggtcacgcaccggcgacggtcatccggcaggaccatgccccgcagcgacatggtgatgtagaaggtttgcctggtgagggagggcgggaggaagaaacgagggggaagggggggaagacggacgggttacgtgtctcggaaatctttgtcgagacggttgtgtcacccatcgaattgcagagcaacaacgtacctgctcagaaagacaaatataacagagaccaccaccaaattgcacttggggaagcccggaacgaggaccagcaacgtcttggcgttgcttgtcaaccacacgtggtgctgcattaggtaggtctccaaggttactttcccgatgtcgtggagcaa

SEQ ID NO: 1837 - DNA, 703 bp, Nannochloropsis_gaditana
ccgcgcttagtgcccggttttgttgcttcacaacgtaaaaattgaacggttcccgctcttcagtgttcagcttctcgaagccagacataacttctatgtgctagatatgtgggtgtcaggctgaggcacccaatactgagtcccacgagcgcagaaggagacggtgataccgtcaccctgtccgatgtgcgattgccccttttcaccccaattggacgcaaaggcgaagagaccttgcccgcccaacgggaagaggtgttcccggaccacttgttatgacaaatatgacaaaaatggaatgagtgtcgttagagtgtttgactcggaaggtgtgcgctgtagtggatctgaggcgcatgttttccgctcgacctcatagccatcacaaaccccgtgtgcgtctaacattgtcatccaaaccccccaaacccctccaatcccggatgtttgtaacatacgcaaggtactggataggcagcaggtgcctcagttctacggaaatggcacggtgcgtggggggcaggaagcaaaggagcgagtggatggcccgctttcgcgccacaacccgcgcttgtggtcgaagggcaagaaagtcacgaaaccctgaccaagcgtgctaccagtagggcatggattattttatcgttgctttaatgaccttggagccttgtacccacgcacaggggtggagaatctcatcatg

SEQ ID NO: 1838 - DNA, 703 bp, Nannochloropsis_gaditana
agacacgcgagacatgtgttgccggacgccccctgccatctccctcggacccattgctccgtcggcgtggtgataaacaactacgcacgctaccgttgtccctcggatgcgtgtcaatacgctccctgcttctctcccgggcccgtttcctcccactgccgccatcacgatcatgcctgtcccggtccctctcccgatgacgatggccacgttcatgctccctatggctatcgcgcgcaaaagaaccgctgtagcctgaagacggcatatttgttctggtggatggtgcgtggaaaggggggatgcggcaaatgggtaatcaaattggacttcgatagtatttcttatcctcgcaccagaagagcaaaaagaagtctggtgcgggctccaggtcggcccacatacaacaattttattcctgacactgccaaaaaagcttgacaatgtcaaccggaatgaagaacccttcacggaaagtgttgggtcgcgcggtagcacttgtatgttggtcttttcacctttgttttccgtcctcaccaccgtgtcgcccgacatcatttcatggtaaacgtcccacccgcgaaccgcctgcctcacctcccctcccctgtcgactttctgaattttttcgtgctctgtcttatgtaccagcgaccttctcattctcctcttctacatatgacaatggtgcccacaaagtatg

SEQ ID NO: 1839 - DNA, 703 bp, Nannochloropsis_gaditana
ctcgatatcgtcaactggaggaggaacgtaatactccatctttgaaggccgaaacatttcggggtccatctcttcaacttcctcgaaccgcttctcatcacgcagctcatccaaattgaaccgttcaaaatccgcatctgagtcacctttccgccgccgccgcgcatggaggacaacagggctcgatatggacgggcgagttgaactttgtccgaaaggagtcatggcaccaacgctgcctcttatccgccccgcatttagcaagggaaaggtattgaaatgaaatgaaaagacaggggagacgatatctaggagaaggaaggagcaaaaaagcagggtagcacaatggcggtgcctacttgatgctgctggtagtgggtggaaggccttcgtactccgcatcgacctacgatgaaacaggcaggaatttaaagccatctctcacctatattggtgtaacaaagatatcggtcacgacgtgaattttctgtgcggaccgaggcgccaaaaggagcccaaacatgccatttaatggatgataaccaacggagaaggcttctggctgatgctcgctgaggctcgaggggagggcttccgtgttcttgaaatgccaacacgcatgcctgttctgccaggcaaaccgacgctcactgcctcatccgcggacgcacgcacgctcaggccacttttttgaagggaaatg

SEQ ID NO: 1840 - DNA, 703 bp, Nannochloropsis_gaditana
ccatgtaaagttcttgcacccgggtctccctgtgcaacggtgatgctgctttttcctttctcaagaggggcagccaaacgagccttgcggtatgcgtttagacactattgagtgcaccaacttatgcaaaaaatgatccaacacctgcttatactcctggatggagaaaaaaatgtggtgggggatgagaagcggtcggtgtgagggagatgagggggaggaagccgcacggtaaagataatcaacttggaagggaggagcttcaggcagcaggcgaagacgaaacagtgggcacatgacctttgactagcaccacgccttgactgtccaggaatagcccatctatattgtgccaccacatttatcatgcagagtacattttcctcccgtccgtacgcgtgtatctggttccctgtccctgttgtggcctgagagtggcacctcgcgtcaccccctccgtgctgtctctagggttggaaaggcttgctagcaactttttttcccacccaaacctctcaatgcctctctatgaggggcttatacatctcattttacaaaaatcatgctctggtgcacttttggtgctggataacacgttgtctaatcatgtccgcgtggtttacctgacggatgcggctttctcatgactctctctacaggagggaggcagaggaggtctgcatttaatacggccgcggggatg

SEQ ID NO: 1841 - DNA, 703 bp, Nannochloropsis_gaditana
gctgccgcctttcttcgaagttcttccttctgcaagtttctggcgatcacctgtaacctgaacgcatgcctcccacccgggcccgccgtgcgcaagggagggtcatcgcgccctggcgccatggacgatgtgtgtgtcatggcggagggtgcactggtggcacgagactagcgtgcgaaagactcgtccgactcttccatccttgtccctcccccgatatcgggctcaaagcaccacatcatcctccctcgtgcgctaagtgtccattttgcaagcccgtcgcaggcccgttccacatgtttggcggttagatgtttcttttgatcgttaccattggctagagattggagagaggagcgtgtgcagactgcatgtggattttatgtcattacgcttagtcttatgggtgcaaaaacggcaccggctgcggccgttagcttccatgctcgcagtagagcccaaccaagccctatctgtctcgtgtacacgttgtctgcgcgaaactatcatagccttcctcttgaaaacgagatgcgttgttgcccttacgatgctgttcaagtctgtcccgagtcattcgaccgaccctttttctgggatggtcccaggtttgtcatcgaagctatcaacctcatccacgcgtgttttcttccaccaccagaccaacaaaccaaaatttacacaggttacacgcgagaacatg

SEQ ID NO: 1842 - DNA, 703 bp, Nannochloropsis_gaditana
agacgcaaataatgggcatggacacctaccgccaggccggtctttacgtcctcctgcccgatcacgtatttttccaaaccctcgtaaatttcacgcggcgaaaggacccggaacgctttaggtgggaccaccgcggaggacaatgttgatgtggggggatggctagtgctcaaattctgggttctgcccccggggctgccatgacagactgcagaccatgtcggacgcttgacgcaacggcgtgccgctgccgcggcgtagggcctccacatccccctgccgcgtgttatattggtgctatcgacggcgtgcgcccacttgtgagtgtgtgcccgttgcctgtaaaaatatcacgtcctgagagggggaaaggaacaacatggcaatgagtcccagcccccgcgcggtttcggaggccacaaatttcatcctattgattgaatacctagcttgctcgacacccctagcgcgtagcacagcttggattgtttccaattcccgatcaaccattctagttaggacctgagaccggctccaggtgccgcgggtggatagcgggaattctggcctggggtggcacgtcttcagcgagacgagaacaaggagagaggcccttccgcttccactgtctcactctcgacgaccacgactgtcaggccctcttcactcacgctcgtcatacatctttatcctacgtgtgcag

SEQ ID NO: 1843 - DNA, 703 bp, Nannochloropsis_gaditana
aggccctcccagatgatggtggtcttgttgaaacatgaccgactttgtaactaaaccaccgcacaatgaataagtaactcaccttcaggcatatatcgttgcaatttgttcttgcgtctgttctcgtctccacgtgcaaacgccttctttccatctcccctcgacgaagccgtgatggagggcaatcaccccacgccgaaggaaggcggcggtcatgccacaggacgcgcaaagcgcacaaaagcaaagagattacattgctgccatgttgaagacatgcgacttgcctgatctcgcttactttaggtggggggttgggttttacagcacgattgcgaagagcgcggttggggccttgcgactgttgtcatattaccaaccgacacccggctgcgttgatcttggctcaggaaatagctttcggaacatcttttcgaggccaactcagtctttccccttttcttgcccaagtcaagcaagcggcctcaaccagctagcaaagccttcagctgcgcgtgcacaggcagatttttgaggcccgcttagcggcagacattatttgacatcttgaacaaagcaatgcatgttcatgtgttgaggccaaagctgcgccaacttagcgccctgctgctcgtggggttctgcagcgccttctccttctacagtagcagcagcctgacttcgagaagtaccttcagtcatg

SEQ ID NO: 1844 - DNA, 703 bp, Nannochloropsis_gaditana
ttgatatagaagtttcacacagactcgcaatgaggaagctcactaagtgctgcccaaagtctgtctctttgtcccttctaaccaccttccaccactctgcatttcgcatgcgggtgagttttccctgacattacaacctacctatgggtatttgccggttccgtgactccttgttctccgccatgatcgaaaggatgacagaagcacttctgcagcgcgtgcgcacgtcgacaagtcttaggtcttatgttgcgctgcaatgggaggtccgcccttcctgttgccgtttgcctccttctttcgttgttcacgacaaaaacttaaacttactacacctgtttcacgtgcaggatgcttgtcagcaagtctttgtcagtacattatgcgcaaaaggagtgtcgcaagatgagaaaagctaccgtcgcgaggcagggaagggttgctggcggcctcccactcgctgcctggcaagggagggcgacgtgcacagagactgaccagggtgggcgattttcacggccctttctcatgtttgcccgatgaatttcctcgcgtatacatcgcagatattcgtcaagaggcgtgagatcatgcttaaagtgacacaaagaaggcacgcggaggaaagcgtctgaattacgtcaatcttcgtcgcgacctcccctcccctccctccttggcgccgtgaactatccacaacatg

SEQ ID NO: 1845 - DNA, 703 bp, Nannochloropsis_gaditana
tcaaaccgagtaccgaacacggggtctcgaatggaaaggatctcagggtctatctcggcatgcaacagagagtggttggtgggtggacaggcatcctgaaaggtgaaatttctaccatccgcaaggcttacggttatcgttacgtctcgcgctaaactttcattcctgtgcatgggagcacggcggattacgcggtaggacggcacagaggcggcatgtcgaggtgctacggccatgacccgggggctggcattcaaaattgaaaatctccgcacaaaggccgcatggcttaaagagatgttattcacgtgtaggagaagtaagacaggaaagaacacctttgccctcatcttgtcggtggcacctgccatggataggttccctttacctcctcccccgccccagcgccgccgcccgtgtcgttgtaccacgtctgcactctcccgtttgtaaatgagacacaacgatggctcgacgtggtagcttgtttataaattttgtcctgttggtgattgtgtgggttcacgtgtgacaagtgctattagcctccgcatttcataaaataactcgcccgtcgcctggccggcctccccatcgagcgaaggggagttggaaacggccggccaataagccatcacaagcatcgaaatcattgattgcttccctctcatcttcatacaaatgatacagaggaagcttcatg

SEQ ID NO: 1846 - DNA, 703 bp, Nannochloropsis_gaditana
tggcaatgcttttatgtaagaccgggtaaactgtaatcatatgacactggactgcttgcacattaaaaaaaaagacgcatactgatctttctgtggaaatagacgatggcaagacgcgcaccagtgcccagaaaaggtttgaaacttcccccgaaatcaggtcgcatgggccggtcgtgcaatacgtcattagccagcgcctttctcgctaactcaagtggcggcatgcacgtcttattctcccacgccgcttgagcgaggcccctcaagtcacccaccacaatttaccttggagcccctgaactcagtccgggaatgaatgtaatatcatgatgggcagtacacttaacatagtctcttgcacacgcagcacaggcttccgcaccgggagatgctgctagctgcctccgcaacggggcggcggcgactaggtccagggggaactactttgcttcgtttcgggctcagccagtcagaagacgactgcgactcacgcctgaaggcacgattgttggaatggaagaagcagcagctaggtgtatgggtttgtgctcgggggaaattaccaactcatcctctgacacgaccatggcacacaccttacaatgctgcataccacatcagtgcttgggctttggaaagaagacattggaagagaagaaaagactttagaccctgtggcgcgcacgtcactcaacaaatg

SEQ ID NO: 1847 - DNA, 703 bp, Nannochloropsis_gaditana
tcacattgaatcagttacttattgctattgccaaaaatgtggtcaaacagcaacagaagcagaagcacaccgcaaagcaaggacaggtagcgacccgaggcgacgcgggggcaggggagacttctcaggtcggggatggcaaagggagcgaggatgtggacgtgaaaggcgaaggcaatagccaaaaaaaataaagccgaagatgaaggcacacatgtaaaagaactggagacgaacaacgcaacatagtgatggacactgaaagagcatctctcaggccttcatcgcgcgtgcctgtcttagctcccaacatgcgtctcagtttgtccaaaccggtcggcattgctttgtccttacctctcctggcgctcacaaggaaatgctgccaaagcattttagaaaacttaatcatgccttaaaacaaatgtcgatcaagggctgaaggctcggagggcatggcaattgaagtcggccttaaagtgccctcgccggccgctccctgttcctgggcgaggggtgtgacgttcttcagggacgctcagctttagtacgagcattcgtagtcctattgtccgtcctatcgtccagagtgcaagacgatacacgcaatgtaaactttgaactacaaactcaccatctgcattttcatcgctttataacgcacaagttttattttcctttccattttttccccgacgccaca

SEQ ID NO: 1848 - DNA, 703 bp, Nannochloropsis_gaditana
gaatatataattgcgaagatgatccccaacgcagagcctttcactcaccaagctggtcttgcacattcagttcctcagaaatcatggcaagtgcatttgctgcttgactgtgcgtcatgaccttgcggctctacaagatcggtataagtgatgaggactcaggtttgcggggaaagggcccaaagacaaaagcacctcaccataagaagctgtaagaacgcctgtcgggcctccaccgcagaggcggcggaggcggaagtatttcgagccatcttctctccagcaatcaggcaaacatctgtgtcgcacctgcaattagcgtggcaaaacgtggggtcgacagaaatggtcaggttacgtcgccgtgtcgcgttcaagttgttctgcctcgccgagtgccagggccgccggcatgcgaccgcgacatagggcccgccgcgctcctctcaactcactcgcggagctctttcttcaccacacgactaggctgagggcgttctgctgtcactcaggtgttttccctagcctggagggtgacatatagttcgaagggcgggtcgggacagaaggacgtccgtgttgccaacgcgcaggaggcagctcttatccggcagtgcatggcgttggcttgtcaatgtcaaggatctggctgattcccagggcctaaatctcgccggatagagcctctttaaccaaaaacatg

SEQ ID NO: 1849 - DNA, 703 bp, Nannochloropsis_gaditana
aagggacagtccatttaaaggttccccgtgattattcacccttctcttatttgacgcgcgtgagtagcgccggccatagaacatgagttgggcaccttggcatgaatgtcagccgttttgcgaccttcccattcacagcagaggcattgtcttcctcaatggagacagcaaggaatgaaagacacgcatggaaaccagaatgtggtcactcctattccccttgccgggtggcccatcggcgtcgtctcggcttgtctttcctgtagcaggtccgatcgagaaacatcgcctccgctcgtgtgagaaacagcacataagcacctgatgctcgtgttcgcctcctcctcatttatctatgcgtcgccatgaagaatggtcatcctttgaattttacaccattctgtcaatcaaagcttcctgagtcaacacatgtgtggcgatcatctccgctgaccccccgaagaagaagcatattgcatgaacatctgtggtaaactagggatcaactctagctagagcccgcgagcggcaggacggtacatcctgtgttcttcccggatgacctagctagtacatttgtatattcctcaacgtccctcgtggctcctgtctacgctcatcctactctcctcagaccccctcaccaacagaggcactgcatactttttcccatttctgctcgatataaatagacaggagaatg

SEQ ID NO: 1850 - DNA, 703 bp, Nannochloropsis_gaditana
catcatttgaaattggaatcaaagaagtgacagaatcgaaatctgatgtgcagcgtggcgtgtcagtccaatttgcgagttgcaagcgtgcagaaataatacgaagaggttggaccagccaacctcctctccctcccttgagcatgctgctacactctgatgtgatgcgcaagttacttgttgctagaaaggaaatggtgcaggatgtccttacagtatgttcgaaatttgaagtgtgctaatacagactctcaacgtggcaatgccggccgaacggtcatttgtgaatatcaacatcgatggagggcctccatgcctggcctgattttgcacaacttcccaacatatcattttttggcttttgcggcatgagtgccatccacaacgtacgaaggtagaagtacgacttgaccatggagcttaactcgttgccggcttccgacagcaactggttttcatctcatcgagacacatacttcctagcactttcaaagagatcggtcgaagcaagcagctcgcagcttgaggaaaattaattattgggatcaaacccttgaacgcccctgggcgctcattaggtgtactcatcgtgcacgtgtgtgccttgagccaccagaatccgtcaatcgtcgcatcaccctctgttcctcccagggggcttcggggctccttcctgattcacagtcccgcccttcaggcgatg

SEQ ID NO: 1851 - DNA, 703 bp, Nannochloropsis_gaditana
tagcttcctgaaactgctgaagtcttgtgcaaaaatcgttcatggtatggaaacatggagaccgcaaagtgagaggaaaggcttaggatggaggggaaaacaaattgatcaacaacagagaccaaacgcttcagaccagctaagtttgtagtatagtggtctctttagaatctaattacgcttgtgagatcgatttcaggacactgaggtgcattaatgctgagttgcaatagacaagcaggacatagctgccttgagaagcctcggaaccgcacgtactagtatctttaggttaccgtccacaaaaagtcaagcagaacataggccacgcctgggtggcatacaggacttttcaggtcgatgaacggatagagagagtccaaacaaagaccaaaaccgtattaaagcgcttgattgtccaaaaaacagaaagtttaatgcacgactcaagcttctagagcttaactgcaggcgactgggtggctcgagctgctcgctcgcagctgggtgcgccactttcagccaggccattccgagctcacattaaactacctgagagatcacgccttttgaatgtgtactggaggtgtgatttatcactttttcgctgtgtttcaattctttggcaatccacgctggttcaaatccttcacttcgaaccctccccatctctactgcaactcgctctcaccacagcaccatg

SEQ ID NO: 1852 - DNA, 703 bp, Nannochloropsis_gaditana
gcactctcgaaaggcaaccaatggccagaggccaagatgaatatgttttgagcaggattcacgggcattcatggggggggaaaggaggagaagggagggacagcaacgtccccgaacctcctcctcgacctcgccctccctgagcggctccagccgagcgagcgccctccgatgcacacgaggccacgatgcctccgaacggggccccgtgtcccattcagacgtcttggaggaccgcatgtgcatgtgctgtgctcttcttggcgggggagtgcttgtctgggtcctagtgcgctcggtccttggaaggtttaggcaacacacgtgctaggtcacgagacgagatcctctttcatcgtggaaggtgtatatcccatcgcaaaagcatctctttcaccgcgaagaaggggtgaaaagatttcgtgccccttgttgcgcatgcatgtcgagacacatgctcttaaattgtgtacgtggcttctccttgttgaatgtttatttgctcgattctggaatgtggttggtaccatagctgccgtcgctccgggcgtttcgctctttgactcagccagagcccgtcctacccatagtcattcgtacccgttccttctctttcaagcttcaaatgcaccgtatgcggcgaccatgcactcattgtttgtgttgtgccatccacataggaaatttaataggtacaaagatg

SEQ ID NO: 1853 - DNA, 703 bp, Nannochloropsis_gaditana
aactctttcttacgacgatgtcggcgcatcctttctctccgagcgctggtcatcagcgccttcttcgcctcaattttagccattttcgtcttctttgccgccacaagatcgttgcggctctggactgatgatatgcttgacgcctcttgtccgcacgctcctgtctgctgtgagctgatgtttgaagactctgctcttctccgtatcgcgcctccttgcctgcgagaaaaagtggcgagtcgtcggtagcagatcggtgggagaggagcagggagcgcctggacgagagggaaaggatggacttggagataggtgactttcttgcatgtgctgcccgctggaaggacgaacgcccgtgcgtgcctcaccagaaggaagaaggttaaattgatgacgggtaccaggagaggggacctcaacatgagcggaaggcggctcagaggggcgacctcgaagagaaaaagctctagttcgaggaccgcgacgaatgcgtgcctctgacttgtacctggtacatggattgaaaaactaggagtctctttcctgcatgtggtaatgcatgtgtcgttttgttttggtaaaatgaatagtcatgggggacgttcgagttgaagcagtctcttcgcccttgaagccgttgctggcctcaagcaccaaggcgatagcgtttgcacgtattacgaatgccgcttaccctcgcacg

SEQ ID NO: 1854 - DNA, 703 bp, Nannochloropsis_gaditana
ggctgcaatgtattcgcagaccccgtcacaaggagcgaggttggaaaacttgggttgggccaaaacgccaatgacggggcccacggtcggatcgaaaaccgaatggaggccagcttccggcaaaattcgatgtccataactagacagagcaacagcggggacatcgggtggggtggcgtcgtgtgaaaacaccaaagagtctgcggcattccactgaccggtgccccgtgactctgccacagccacgcacgcggcaagcaacggccccagcaggagcaacgcgcgcctcataaaccctcacccgtccccacgatccacctgtgcgaaaaaaaggtaggtgtcagtaatggctccgtcccgacaaggtcccaccccaggaagggctgggtcttcccatggcgactcggtgcgctcgcccatgcgaggaaggggtattatcgtacactgtttgttgcttttctctcggtttgaaacaagcggaaaggcttccgttgttgttccggaggcataatactctttggaatgaattgctcatctcggtgtcgtctatcccatgcacaggctctaccctatgaaagaggagacggagctggcccgcgcgcgacttttcttcttcgcttgaaggtgaaggtccttctggacattcttctttttgagatcaaggacgccaagcatcctttcatccactacgattgcacgtatg

SEQ ID NO: 1855 - DNA, 703 bp, Nannochloropsis_gaditana
cctcccaacacacatcgcccatccctcgcactacactttggttgcaatattgacccacgtgccataacggggcgtcccagcccgatgctgtggcttggtgaccgcgagcctccccccgggcagccaacggctgttctactgtttctgccatcaggcgtttggatccacctttgtctcctgcacctatcttcctgccgttcaaaggaaacacatccgggcgcgcaccaccatgcgcgaactttgttgtttattgattgtgtagaactttgatgactgtgttggtttggtaaaaatgtgccggtatccttgcgcttattcattcttcgcctgtattttcccacccgtgtagaagaaacagtctgaaaacgcacaagctcgtgcttctggttggaaattgaagctcaaacgctctgctcagtatcagtgtatggatcattcgacagctgtaccagcctcgtccatcacaagcacaactaattttggaggtagcactggcaacagcgtcgcctctgccaacaccagtaccatcatcaaaaccggcaagcccagcatcatggcgcctggatttccttctccgcccttcagtctccccggtgcctccctctacggcatgggtttccctccccctgcacattccgggaacgccacccacctccctcaaaatctcttcgctcccccgcccggcgtgggcggaggagtgatg

SEQ ID NO: 1856 - DNA, 703 bp, Nannochloropsis_gaditana
aggccactgttccgtgaaccccatcacacgaaatgagagacccacattatacagtcggagtttgtgcacatgtgccagatcacccggcggcgtgggagacagcagaccggcacgatgcccgattattttttgcaaggctttcaaaaatggcgtgcaggaagatatcccggtccgagccgtcgatgaattttacgtgtccgtgccatcccgtaacttccgcctgatcgatgtcgtctatgctgtgtttaatatcatggagcaagccatgccaaacgattaatgattttacgaatacgactgaatgcatcctggtgtcccgtcgtcggtcgtggccatgctgtgcgggattaatttggggtccttccaggggggccgttttcgcgcgctctcggctctttttccatctcgcgcttgcatcaccttagcaggcccttggataatggcccgtgcatgcacattgcacgggcctgtgcgtcaatagggtggaaattctctgccacgcgtcattattttgcgttgtgaatgcttttgcaaaacgggaatgccttttcggtgtgtttcggcaatgttgcagtttgcaaccgcgacggtcaaccgctccgatttcagaccaacttatcccctctctcctgtcacgtacacttgtcacacacatcacatcagcctccttgcaaattgtcaacactcttccattactgccatg

SEQ ID NO: 1857 - DNA, 703 bp, Nannochloropsis_gaditana
gctccgttccctccgttttcgattccggtcataatcacgatcttcttctcgacctcttcgtcgccggccactgccgcgactgaccgaaagacagggaaagtggtgagtatcaagcgcctcgagcgggtaaccccccgagcaagtcgaagggaggattgcgagcccggaatatataactcacctgagggaacgggaccggcttcgcggcatctttgacacgctcgcaccacctggaaaaatagtggggggtccgcatatcgtagttggacacgaatgagtggcttatcgttgcattggaaaggtagatggtatttgacgccttgcctccctgttaccctcccctcgcccaaaaagctcaacatgttccaccccctgccctaggctttttttcaacccaattgcttcacgattcaccgtcacaatacgtccatgccagtcactttgaaatccgtccttcgccctctgtgtcgtgcacatggacttggtttccgagctgttcctcgcaggacacgaagacgagaagccgcccattcgtatcaccccagctttgttggatgcaaatttcatccaaagctgcgacgatcccaaggtcctccgaggcatcttgcgcaggctcaaaagtgggaaagacggtctttccgcagatctggagcgggaagtgaaagaccggctgtggcttttttcgcccgcgcaagtgcgaggt

SEQ ID NO: 1858 - DNA, 703 bp, Nannochloropsis_gaditana
ttgtcccgcccgggcctcgtagtccaaaagacctctggcgatcgccgcctgcatcggcgtcagcatgtccatgtcttcaatgatcccgtccaagacaccggcatggatgcccgcccccagggcgactgcttcgtctgggtcgacggtcgtcctcggcgtgatgccagtgacggctgccaccaggcgtcggatcgatggcatcctggtcgccccgcccaccatcaccacctcttgaatacttcgtccttgtgggaattcacggattttcaggcccgggttgcgtttccgtacagcgtttaaattcttactgtacgtgctccgggctttgctcaccttgcggccggtcatggcgcgttcccgcattaacgccgccagtttttctttctccgattccatcccctccgcgtccgccgctgccaattcctggtcccgcatcaagacctccatggctgctttctcccccccgtccccaagggcatccaccagttgccctcccagcgcatccggcaccacttccccaccaagagtcgcccctgccatcaaggccgcctgacgcatgggctccagcagccgatcgtacagatctccgcacagcttctccattcccgccctcgtcagcgtcaacgggcccaaatccttcccttcgccccccagcgccgggattcgaacctcggtttccgaggcctgtgacaagcgcaccctc

SEQ ID NO: 1859 - DNA, 703 bp, Nannochloropsis_gaditana
ataagcgtgttcgtgaagaggcctgcccttagactgcatttgtcttttgcacaagcagtaagtgaaggagcaggaatgggaaggcttcaagctactatgtcgacaagcgacgtccagtgttcggataggcatatcttttagcgtgggaaatgtcgcgtggttgagaaatatttcatgttgatgtgtgcgttgggagagggccctctttccattcgtaaaagcaggacgaaagcaatagagcggggggttatagagctagcagcacaatgcgagcggacgcgcttattcggtcgttgcggtccagcactttgattgcgctcacggacagataaccaggtaaaggcggggaatttgtacgaatcatcacatctattttacctgtattctacttttgattctattgggatcagtaatgggactgcaatcacttttgtgtacttttgtcccggtgcttttcatgattctctttgtcttcctaccgaggggcaggcccccactgcagacgagctgaagttgacaaaggacacctcaatgtgagtccgggcacgtgctctgaatggtatctattcaaccattctttccaactataaattttgaacatacagtctgaggccattacgatctttgggtaagatttccatctttactttaaaaagattctgcgggatccgtcattcagccctcgactccgacgaccattatg

SEQ ID NO: 1860 - DNA, 703 bp, Nannochloropsis_gaditana
tgcgatggtgaatgcggcgcggacgccacctctttggcagcatcagtatcatggtcctcgttcgatgccatgtgcatttgttctttaacctattaagcgacagctgcggtagaagggatactaccgcacatacacgcaccagaggaggtgctgcgcggatccttcctgtgctgtacaacacaagccgcaatgaggaagacgttttgtccaaccaaaaccacaatcaagcacctccgtagcactttcggagaaatacatgcatgacccactaggaacataaaagaaattcctacgcttgagacgaccagccggcgacgggcatggggcgaggatctgagagagcgagggcgagggttgaactatctccgtcttcacaaagtccgatagggggggacgagcaaacagcatctgctgtggttaactcggcctttgctgtcatttctgcatctgaattgcctctggtattcgccaggcagctgcagcgcattacctgtagcgcgcctcattgacaagctcgtggatcactatcgcaagcagatctgggaggaggtagaaggaggaaagcagaaagtacacaacatttgtagatcaagttcagcctcaactcactcacagcacatgaatctccactatgctttagattcgttttccatcctacgtttcaaccgcccgcgccctccatgaggacagcgggagcggcagg

SEQ ID NO: 1861 - DNA, 703 bp, Nannochloropsis_gaditana
ccctgctgcacctgagcggagacgctcgctacacgtggtgccacggaatacgcccaggggtaacgcagtctcagatcagcgatttcaatctggggggggtgatgtcagacgagatggagggagtcgaccaggaggctgtgaggacgctggaggggttgccactctgggattggtggggttctatgaaaaatttgcggcgtcgaggcccggagcgtgtgagcatcatttttgcgttcgcagacccagaatgaggtagcaaggaggtcgcggtaaattttgagggggaaatgaagacgattttgtagctcttgcctggatcactcgagtgagccgcattttctttccaattacttttcgaatacagctacgacgaaaaaaaactcattttcagatcgtgggacatttaacgactcttatgggcttgacgagctttgctgtggggagtgagctgcaaattcttaggtcgagagtctcccctggataaacctacccggttccttgatccttcccatgttccgtgttatctcgtgtttgacaagcccgtaacacaggcttgacatgcagtgcaacttttgcggaaggatacgtaagctatatgctaataattcacttccctatgaatactgcattttggaaaatacaatgcacacaggttcacagcgcagtaccaaaaggtacaacctcctgctctcgtcttcggatg

SEQ ID NO: 1862 - DNA, 703 bp, Nannochloropsis_gaditana
gcttggcagcgcgcaggacaactggacaaagaccatcccattccggtccagaatttggcacgtgaggcccccaatgcctcctccagcgtgccatcggtgtgaatgatatggttgtggtcgaaagatgcctctgattcccgtgtggtaaggtaccagggccaacccaggcttcgcaacccgccagcagcaatagcacccccagcagcatgatcagtccacactccgcccccatatggccaggcatgacacctgatccctgtctcagtgctgcgccgtgtgggtgcatcaaaaggggtcgaaaggacgtacacgcgcgtgagtcggtgcgatgttgcagttgaaggggccaggggagggaaatgccagggtgtgtggatgcgacggcccgtcatatgttcatgatacgccggaaagccgcgggcgaggctgccgaagcttgaggcgagggaaacgcacggtagaggccgctttgtatgcttggccccatcgccgtcacgcatgcactgctctgcgagcaagtgggtatttgacttggtcatttcctcatccttctatcccccagggacagcaacaaagagcgccggccggacgcctcactgtcacacccctctcgtcacggtactgaagggggccaggagctcgtgccagcttatcgcacccatcgattttcgacagcgtctgtcgaaaacttaaaaaagtcatg

SEQ ID NO: 1863 - DNA, 703 bp, Nannochloropsis_gaditana
cggagggacccgttccttcttgcagcctcccccccggcccaggcacctggccagcacggatgccttccctccatccccagacacatacacgaccagcttgctgacaaccaccacggccttagatcctgtgttggcggtgccccccctcccttcctacgccgtgctcctcccggaggcggacggtatggaggaagaaatgggggaggagttgggagaggagtcgaaagaggaggcatgggggatggagacaggagagccagtgaactcctctcctcccttttcccccgaatgtacagcagaccggccccgctccaaccgtccttctccttcctgccacccctttcccgcctccacgacgcccttctgggggtacgaggtcttccaatgcatgaccgttgccgcttttcgcgccattcttgccaaagacctcaatctctcttcgcccaaccacctccgtctctggatcgtgacccagccctgggcggattcgccggctgccccgcgcgagttgatacggaccgttcccctacccgatcaccccgccttgcccgacgacttcaattacgaagagctgcctctgtccgttctggaggagcaccagacattagccatggccctcggtgcccacatggactgcttggatgaggtgcgggtgtgggcggaggtggcgggggacgggggactaacggtggcggagggagga

SEQ ID NO: 1864 - DNA, 703 bp, Nannochloropsis_gaditana
ggggccgggcggggacgggggcgtttgggcggaggccgcgggggacgaggtaagagggcggacgaggcgtgatacgatacagacatggcacggaaggtgcaagaatctggacaaggaatagcgtctcatgatttgtcgtccttccctcgcatctcatcacatcggctgggtgtgtgcacaggctacggtcggggggggggtcgtgatttccgcggcgggcggggggatcgcggcgggcgaggagggaggggtgagtatcgaggagggggtggaagaggagataacagaggcgggcgtggagggggagggggacgagggacagaagggcctggaggcaggcaataaagaggggtatagcgggatggctggcaacacccaaaagaaggggcaggaacgtgataatgtagcaccaccgaaaacgccaaggccatccaaagcatcgaaaggcacattggttacttgatttgaagcgtcttaggcctttaataagcttttctttcatggttatattggggggggagggaggccgttccgagccgctcatttgctttcttctacgagctaggccttaaacagagacgtggtcaagtgcggactcatacacgttacctattatgccccttgaggccctacatccaattatcacaccgtgcttcttccaggaaaaactcatgatgcctatgtatcctcaggtggtaccatg

SEQ ID NO: 1865 - DNA, 703 bp, Nannochloropsis_gaditana
tcaaagcccgctctgtcttccggactgctttcatccagaccatttatgtcaaaccatcccggcatcggaaagcctccattcaaggtgatgggccgggtgggtgcggtgggaaagatcatgcgggtggtggggaatactttaggatcaaaggccccggcccacccttcgccggagtcgcctaggccgtgcatccaaatgatggaggactgagcaggcccgcctacagggttgagggttataccagccccgccaacgttatcgttacgagacgctctgtgggtcatggcagcgagcccgcgcgtacgtgtatcggcagggaaagtgctggtcgggtacgcaaaagcggtacttttcgctgtggccaagatgctggagacagagaggcagatagcacggcgggcgctccagggcaaggggaggctcatgcactaagaaagaggtaaaggacaccctgtcaattttcagatgttgtgcagactccagtaagttcggggcatgacacgtaacaacacgtgcatgacatgtaatggaataaagtgacgactgggagcatacgaagtactcagcacgctctgtctctctcggctgtcgcggaatcgccgtctcgaacatgcaagaaatgcaacaaccaaggcactgactgaccttcagaaattgaacatttgcaggaatggtctggcgcaccatgccacccgcaaacatg

SEQ ID NO: 1866 - DNA, 703 bp, Nannochloropsis_gaditana
gttgcctcaaaactcctgcaccccaactcctgcacccgttaaagagtggcgcatatgaggaaaaatcagacaaccgcaatacattctcttgtatcagaagactgctatatgtagagaaggccgtgtgggcctgaaggcatctatgttatgtcaacgcaagcttcgacttaccgagcctctcttcccttggtccaagcaacaatatccgtccgcgcctccaaaggggcgtactcgcgagcaggcaaaaccacgtcggacttctttcccataggatactgtagtgatagaggagttgcagaggattggaataccaaacagggcaatatgaggatgctcgttgccgaggggacctaggacgggcaagaaggctcagagagagtccatccccacctcgttttaagattcacttccaccgcggtgcggtcaccgcccagcccacgagatgccatacgagtcacaccaggcggaggtccggtcatcttcgagtaaaggaaaggatccttcgtgttcctaggcaacaacattcacacctcgtcctcgcctcgctcccccacttccagctctctcgccctcctcagtcctctcagctctgtctctgctttacatggcagttttcgagtctcacaccttcatgtccatttttaatcattcgtgacagggtcgtagaaataagtaaaggttttgttccacacgttcaggaatg

SEQ ID NO: 1867 - DNA, 703 bp, Nannochloropsis_gaditana
ttcttcattgcgaggcaggatgtgtgcagcttgcgtgattgcgtgagcgtggcgcggtgtggccgatgacgatgccacagctgcgcgccattgattcggtggttggacgcgttgactggcaggatgtctatgagaacaagtcgcacaacgaatgcacggcccagacgcgcccaatagtctttggcgaccacattctttgtacatctgctgttcatggcaggtgcgcagcgtgtgatttgctgcggataggcatgttgaggctcatggctttccgagaacaataaggtcggactcgaggatgttcgatgctgcctgaagcgtttactcttcggagtctgccactttgcaaaccatggactcgtgagcaatgccatgttatcgtacatgtttctgtcgatgtgcttaagtcatgcttgcatgctcgtgtcgcgccgacttctctgcgctcaatcgttgggagactggggttgtacatggaatgcggcggcaaggatgatttagaatttgggaccggtgtttgctcatcatgaagggcgttccactaccccgataggtctgttttctctgacgaagtcacatcatttaccatgtattaaacattatttttttcacgcatcgtgtcatcgaacaggggagactccgggccagaaggagagcgtgcagagaaacgagcagcaaaagtaagaattgctaaccaatcatg

SEQ ID NO: 1868 - DNA, 703 bp, Nannochloropsis_gaditana
ccggtcacgaaagctgtgtccgtctccctgcgtgacaggacccgcttaccatcctccttcaacactccgcccaatgtcttcacctcctgctgagccgctttcagtcgtgcggtgagccgctgcgaggtatcctgaagctctttctctaggttgcccctgtattccttggcgacgagctggattggtgccgcggggtcagctcggtccgtagcttcatgttgctggcccttgcctccttgccccgctggcccgcgccactggtcgcacaaagtttccagttccaagttcgactcccgggctgtacgcatttcaccatgctcctcgccctcttcggcatcctcttcgtcctgaaaatcacgcgcggtcgacaaaagatcccccgggtcctctaagctattttatgtcgtcgggccataatgtggggggttaacgtgccgttaccatctctttcgcctactcagggcaccccgaaaacacatacctgtttcccatgcctactggcggtgattttatgtgaccatcgtcgctggtgccgtcgtccatgcggcctgcttccccccggggtgccgtgagatgtcccttaaaggcgggtatcgcttgctcctctgttgctgtcgcaggaggcggcagcgtaggggaactaacgcgaatatagatcagcacgtggcgtgaaccccgtgaccacacaacacatttcacacag

SEQ ID NO: 1869 - DNA, 703 bp, Nannochloropsis_gaditana
actgggtcggcacccaccccatgaccgcgaacgtcctcgcccaggccctcttggaagaggggcatgtcttcccctccctgccgcgcatcgagacgctgcggaaggaggtcaccatgggaaattcccgctttgatttcgtggctacccatgcggatggcagcgtcacggtggtggagaccaaaaatgtgccggtggcggataatttcgacgggaccaagaaagaacgagcagccttgttagcagcctgcattacgcctccagacgcctaccataagatcgccatatttcctgacgggtacaggaagaaagtgagcgaccccgtttctccccgtgccttgaagcatgtgcaagaattggaggctattgctcgagaaggggaaaagcgtgcctgtctcctctttatctcgcaacggacagacgtcgcgtcttttgtagtgacttcaactgatatgcagtaccgcacggccgttcgaaaagcaggagagaatggagtggtgctgaaggctttcagcgtgcgttgggacggggccagtgggagggcatttctgcacagagagcttcccattgtctgggatgcggaaggcgaatgaaccataaatatctcgagaaagaaataatttcgtgaactcatgcaccatgagtgcttatcacagcaggaagtgcaaggttatgaaatgggcggaacatatattttgtcaagatg

SEQ ID NO: 1870 - DNA, 703 bp, Nannochloropsis_gaditana
cacaaggaagataatacggccacgttccgccacgtccaagccagtatccgcgccagcgtctgtctgtcgccacagagcctgctacagtacatgtgtcgtagtcgtgagatatgataacgagttgcctgacggtctcattcagtaagcgcggaaactagaagtgaaagtgccgtcgccataagcgggttgatcgactcgctcaaaaaagaagaatgaaaacccgaggggtaacatacagggatcagaataaagcaaacggaacccgcgcagtgagttcttttgatgtgcgtgcttcttacgtgttcacttgctcacagcgtggagattgtatgtttgggccgtatggtttgaggttttcaacctgtcaccattcctcctacctcgtcttggcgcctttcagtacttttgccgagcggctgccaattttttaatagcacaggacacgcacacgcatagcccgtttcatacgactgacatgacctgacaatttttgccacactgacgtacacagctctccgccacggggactacgggtgaacttttcaggcgtcctgcacgtcgaagccctccttcagctggcgccggcacacgttttccaacttcttgcttactgttattgagccttgcattgtcgataatcaacgccgctgccctcccaaccaccacatcttccagtttgtcatttcccaaatccatttccatg

SEQ ID NO: 1871 - DNA, 703 bp, Nannochloropsis_gaditana
taaagcacatcgtttctccgaatagaagcaagacataaatggacgccatgaaatgatggataattacttgccaatgttgcgcaattattcgaaatcggccgagaggtacggtaagaagtgacgtgcgctggatttccgtacatgccttcaagcacgacgacttaaagcacgagaggcaacgtaacgccgtcccagccgttgctttcctccaggagaaaatgaccgctataccatatttatcgctcctcgttaaattctgcttcactcatgaaagcatgtgattcaggaacgtctttacttaaggtttgtttggaagtccttttttccccacaattcttctccaaaagtgagccagcgacgatcgcgactaagccccctcagatcgtgctcgggcgcgatatgcacgcacaagctccgcccacttgttgtgtcgcgcaatacaatgccggcagcacatgccacgttgaagaagacgacatagacaaggggagaccatcgatccctttgcgtcttctgtctgtcttcacatggcgctgggaatcgcttcggatccgttgcaagaccggcgagcttcttctatctaatccagagcttacttctgtcccgtgcctacgtgcctatgcaacctcaccacagttaatctcgtctgccaagtcgcttgtcttgtcttgctgctatcggaataccaaatattgaaggcatg

SEQ ID NO: 1872 - DNA, 703 bp, Nannochloropsis_gaditana
taattagggtccgaaattatgacgatttggaagctgaggtgatcaaaaaggggagagtgcgccgcagaaaacaccccacgaactagcttcgcaacccttcaccgtgtggcatacacgcgcgcaggcctgtatgcacgcgtttcagccacatagtgaggccgcctcgcccggaaatctgacctcatgacctatgttttggtttcgcgatgatattagagccgctaaaggagtttgtggcagccttccagccagccttggcaccggcgtggtcaatggggagcccttttcccacggggcgtgccgcgcgtcatccctcacgcgggacggagggtgcgtatgtatcctttgtggatgcacggttagggaaaagtgtgtgtttatggtggggatggcgttcgcctgtactccactaatccctctggcaggaccctccctctccctccacgcaccaccagccggatggatacttgagatgcctcccgttttcgcgtcaattgtaccctaccccgcaaatctacccctcgtatatatatcaaccgtatctttccgtgtttatgagggcaatgatgtcggtcgggcatcgtcgtccctgaataatgggacacgtacaaggttcaccttcaaatcgatccttctcttttcatgtctcctcatctattgccccttgcactccattacctttgcagactaccaccagaaaatg

SEQ ID NO: 1873 - DNA, 703 bp, Nannochloropsis_gaditana
gtccagcgaacaaggcaataatcacagaggagttgacttatactttccgttcgaaattatgagagcaacctactgctggttcttatccgtgatgtgatgcagcaacaagttgaccacacgtgcaactgttttcattgaacaggacatttgttgaaatactgctgagcctcgcggcagtcgttattgtgatgccttgatccgacgtacgtaagctctttttgattacacctttcaatcccatttctctttgcatctcgtaagtagaatgaggaatatatctctatgtttggctattcttttagtagctggatgcgccgtcgccactttgccgcacgcgtcacctggtcaaagccccgaccgaattcctctccttggcgtttgcgggggacgttggggtcgtacagctcctacgcccccgccagcgcccgaggttgtcgagacaccttcacccgcccaaccactttctttagcatcgccgtacgccaacttgcgagctttggcaatattaagcgctgctgcagggtcctgggctgtgctgcgagctcccaacgtgcgggagtggttcgatgacgtccgccccctgcaacctaaatactttcccctggcccggcaccaagtcctcattcttctagcctggctgaccaacaaaatcgccgtgcggattccgggaaggtccgacgggaaaagctggaaagatgccatg

SEQ ID NO: 1874 - DNA, 703 bp, Nannochloropsis_gaditana
aaaatgcacgttgtcctaatcgggcaccccccggcttacagtgaaatcggctatggcgacaggcgtcaaggtgtcctccccacccgaacgcacgaccggaggccggtagggcctgaacatgacggctacggactataaaatcgttttgctgagtttgttgtagcctgcgactctgaactacagggcactcgcttcagcagcgaaaagagtacccggccagggtgcgacgtccaggcgtcaatccctggaagtggctgcggtcaaagatgtccatacaccccacgccgcgtgcaggctgtctctcctgtagtacagagcgaatgcaccgggtaaatgatggaaaatgaagggggggaaggtaatttgtaggcggctagttgcatttcgttgatctggtcatgtcggcatcgcttctagcaacgaatgggccgcgcagttgccgtctttgtcttggcaacactctagggacttttgcgcaccttcaattcactacccttcttctctgatgcatagaggtagcatacagaagcacgctggcggggccggaggcgtgttgcttgtgcatgaaaaggaagcaacgcttgactgcggggacgggttcttcataaattgttcgatggaccccccaaacgagcgcttctctttgtttaaaacatcgcacaactgatgctaccctccacacatcgagtaaaggtatttgatg

SEQ ID NO: 1875 - DNA, 703 bp, Nannochloropsis_gaditana
gaaaggggaagggggcgggaaggatagtgttaggcggtcgcacggccggcgtggaggtgagaacgcggagggtggaggaggtaaagctggggagaagaaggagtagtggatcttttcacgcagtctccgaggcatccgggtcggatatatcgaaaagtacaaattcagtactttagaaaagattaaatttagtatacctttcgattttatgcgtctgaagctcatggtttccaaatgcgaataggatggcttagattctcctcgctttcttgtttgacgtaccgattcaactggttgatcaatgttttatcgggcgaaagcggacagttgagtcacagtatcgtgcgtaaatatctttgatctttttaaagattgctttgtacctctcaacaaggttaaaatgtttttggaatgcttcaacatgggccactagtcttttcctgcgattcgcccgcatctcctctacgacagcgagggagggctaccaaggtggctttcctgctttaacgacgtcgctgtcccccgtcagaggataccaaaccaccgaaatcctttccaatatatcagaacttatttaagcgaggcaccgtgtgctagagcaggctgctaatttgtctcatgtgcacgataattataactcctagttgccaatcctaacgctttctcccaaacgccgcattcccgaagtctaccctacaggatg

SEQ ID NO: 1876 - DNA, 703 bp, Nannochloropsis_gaditana
gggaatacaaagacgtgctggaatgcggaatctctcattgcacgctcgcgcgacttcaaccttgacttgtctcccgtggtgctcatggcggggggcgacatgatcgcccccctcctctcttcgggcgtggccagctaccttgagttccgacccctccacgccttgttcatcgcatcgccgtctgcctccgccatccgtccctcatggaaaggcacccaccaatccgaagcctcagaaagtgccagcacaggcgaggattcgagcggtcccggcgtctccccctcagtggctttttacccggttccttgctccaaacccgacgtattctcctcccacctgctgcctgccaaagagaaacggcaactgatgaaatttcttcaagcggtcgcagactggggctttcgcgctcaaagtggaaaaagtgcgcagcaccgaaacgaaatcgagttgggccaagcgcgttccctgcagcggccccagaataaagtcagcgtggagctggaaacagacgcctacttacaacgaccattgagagatttcttggaacatagtaagatggatgagcacctgcagtgggtcgtctggcatgcccttgccttgcttctgggtccaggggagggagggcgggagggcggggacgagggcgagcggcaagtcacgaccgaggaagggctacgacggatttggggccacttgcaaggct

SEQ ID NO: 1877 - DNA, 703 bp, Nannochloropsis_gaditana
aagagacttgtgatgagttatttctggtcttcatattaatttgttccattttgtcctggtatacagatatgtatatgtcatttccagctttagaaatctctctgaccatctatccaaggccacatctactggtcccgtggtgtaaagagctgtttctcagcatccgactgttccatgctcacacttgttcatcccccttgacaaaccagtcgtaatttgccctcgaaagggcaatgtgtaaatccctactcgcatttgaaccaaacagaaaactaatttcctactgaagtctttctgaggacgggaggtaaacatacttgaaggacagaggggcacgatcgcgccaaaattcgtttctattgacatgctcaagttgtaacgatttttttgtttcaaggaatgtagaaagtttgaattaaaaaatcgttttgaatttttggcccatccatctcgttaatgctccaggcagcgactcgtctgcttgcctgctcgccaaaggcgacgggtcgcactcgtatattgctgacttgaaaatcgtccaatgccaatatccaacacgatgcaaacaaagagcgcaacaaagggaatgctgcggtctgataaggcatactacgtgctcgttttgtttttggtagctcccttggaaaccatggcacgcgctagatctgctggctgcgtcattcttcctgcgttcaatcgaatg

SEQ ID NO: 1878 - DNA, 703 bp, Nannochloropsis_gaditana
ccgattttcctgagtagtagtcagtcgtcgggagttctaccagctgttcgtgtgtcactttctcctcgcgacacagagaccaggcttcttaagaaagaaacttgcccgcccctcgattgtccccaaccatgctgttttcatgccaccatgtacatgtgcagccttgtggcaatgtgtggtgtcgtgcatgtagtgggaagtaacggggcaggtcacagcgtttcaagctccccgcgtttattttttcggtggaacgcgaaggcatcatcgaggaaggcggtcaattccgcagaagttcagtagaaccggtgcatcactgaccatggccatcgttaattattgtgcatcatcacgtacatgacaggatcgttgagtttttaagaagtgagcgtgtgtgctgcctgctgcaagcaactgcctccttcgccctgccctgactcgcgcctctatctgccgagtcaccaacaaccttcgtccatcgagcttgatttacgccaagtcaaactaggacggcgaaatttattcaactatcagtcagcgccttcctcttcggtaatcctgtatttgaagcatgaaaacagctagcgacagagcctccatatcaagaagggctcggctcctattcaccacgacagccgcctgcggattgacgctgtgccctttggtgggggcataccacccttcttcttccaccatccgcatg

SEQ ID NO: 1879 - DNA, 703 bp, Nannochloropsis_gaditana
gcacgtctacagctagggcgatgaggactgggaggaggtcctggaaaaatgggtgccgtgacggtatttccatggggaacaaacgcctgcactaggacgcccgtcaatgtcgcaatcaggcagaagagtaaggattgcctgtgctgcgaatgttgtaggtttgcccgccacgccgagagcttcatgattattgtggtacctgcggctcgaacgcctgacgttctcacagtttagtcgtgtttgcgccgctctccttccctttcccctgcgagtcctgtaggtggacgcaacgagaggtcatgattcgacaacacaccgcacctttttaattctttcgtgactgtcgggattgtgaccacattttcgggggcgcctgaagatagctggaaatcgccagctgcgtgtcgcccaagagaggcgttctgaccgcttctcaactcaagtctgccaccctagttcccatgttcaaccttttcatgaagacgtgcattttttgcttttgacagggggagaatacacgcgtcgccacggaaaagtctgagaagcattaggtttctcaaggttattgcgcggcgagcaaagcatggagctggtaaaggacgcagcaaacgcggttccccccctaagacgagttaccgcgcatattttacggggacgcaatgccacctccaaatacttccgtttgtggattctatctacaatg

SEQ ID NO: 1880 - DNA, 703 bp, Nannochloropsis_gaditana
tagagaggatgctttcggtgccactgaggacgtagaggctgggagggcatgtgtaaagagagagggatgtgtcgtcgaaagtcagtgatgggaggccgctttggcagactttgcggttcctcccggcgacaccgtccacactagcaccgtctcaatacccctcgacttgttgtagaacgcagtgcaacttcattcccacgtctcttcatgtactggtgcgtgccatcacattacataccccgatcgcgacttccatggacagtgccgttattgtcttccggctcccgggcgcgcttcatcactttcaattggcaccgacgaaggtcctgtgtttggacgagaaggggcactgtaagtggataccttgattgccacggggccgtatgcgcttaaaaagactgaatgctcgcttgatttgatccgtctctcgcggtgtgtcttcgccgctggcgttccccttcctgagctgtggaaaccaggcaaggggacaattttatgatgtgctttctcatgttgttgttggatcatttatcaggcctttacgcaaggctcatcacggctttctgaggcgtcgggtcgtgggaatcggtggatgtgcgtgctccgctttgttgggggcggtcgggcgagtatcttttccgatttggggctcactttccacctcaatatacctttcaatatgtacaccagggagcaggcaatg

SEQ ID NO: 1881 - DNA, 703 bp, Nannochloropsis_gaditana
actggggccgttgcgggaattggccgtggacggattcgacgcggagacaatttgggagcagttgcaactacgaaatcccgctgtgcgtcatttcgtttcgaaggttaccagaaagctgctggagaaaggggaggaattggtcttgtgtgaggaggaagaggaggaagtggaggaagcggagcatgaggaggccgaagaggaggaagcggaggacgacggggaggaggagaggtttgaagaagacgaagtggtggaggaggaggaggaggaggaggaggaggggaggaggagaggaagaggagatgagtccattaaacttgccggagggcgatagtgaaggggaggagaaagaagaggaggaggaagaggaggaggaagaggaggaggaagacgccggtaaattgagagttgaaaatacaaacaagagaagaatatcgggagagaaaggtgcaggcgtgaagaaagaggctttgaatgacggcttcttcgactgggacgagatggagaggtttgcggatgagatggaagaggaggagtttaaggacgaggacgaggacgaggaggaagaagacgaggaagaggacgaggaagaggttggtgaaggcaaacgggctgggtacaaggacttcttcggggacagggacgaagcggagggcgagaagggggaagaggaggaggacgaggaggaggaagaggaggagga

SEQ ID NO: 1882 - DNA, 703 bp, Nannochloropsis_gaditana
cttcccgcaaaggtgatccaagatgccaaggcgccgttctgagcaccgactgtctcttctcggaaggcactgaggaagttcaggggggaaaggctgagataaagcaaggaattgaccattcttttttgcgagaaggtgatgaacagttttgggaaagtgctcgtgacaaaagcgctggtatgatcacagagagagcgctcgttcgagaaatagcatgtacaacgagcaatagcaacaacatcgaaggacgagtagtcgaaagtatagatagtgtccgggacttgtcgcaaggcgacatttgcccaccatctgctgaagagcacctaaagttgttgcggcctccgactcaatgcaaagacatagcgttgctggacttgcgggctttggccctcgacaagttgagacaaatgcaaaaagactgcgacaggaatgctggttggaatgaaaaaggcggtggacaaaacattcagggagggcatggaaactacgcaaggctgaatttatgtgatcttggagtatatccgggcagcgttgctgcccatcttctatcatcgtatggcgtgaagcaggcaacattggcactaacaagcacaaatgggcataatttacgcttttcaaaggaggaatcaggctttcccttggttatggaggatgctttgaatgttactgcaggcacgttggaggaaaggccagctacatcatg

SEQ ID NO: 1883 - DNA, 703 bp, Nannochloropsis_gaditana
ccatcgtcgacgtcccggtttgtcagccatttgtgcctcgttggtagcattcgaagctgtgggacttaaacttaaaatggcagcagcagccaagggaggcgggcgccactcttcgttgtaaccctgaaagcttcgcttgagtagacagttggcatcgctggctaaaaaacgcattaccacggtgatatgctgatgttgctgccttcgaagctcgttcgaaatcacatgcaaattgcatattatattcgtgcgtgtaacggcggcccgaatcccacccaggctctggcctgctcctggacataaggtccgtcgcattgacaccagtggctgactgaagagccccactctttgacgataattgtgcctttcgtgtgtgtatgtgcatgtgtttcaatattcatgaggtgtgctctttccgacgaagcaaagggacgcgtcgggtttgggaacgtgcacggagcggcggctggaacttcttgaactgatgaacgcgtcgcgccgtatcctagatctccgaccccgctgccatgcaatgcgtctttttcctgctcaaggcatcccatgtcattcactcacagtaaaacaggccaactgtttgacgcacgcgtgctttggcccgacgggggtctatcttctcgtcgttgcaatgcgtctccccttccattgctgttgcctcctagggtggttgacaaccctcatcatg

SEQ ID NO: 1884 - DNA, 703 bp, Nannochloropsis_gaditana
tgatccccggggaccaatcaacaagctgaagaagttgaaatcaggattgtctttcgggataaaaatcttctcccgcttccgcggctcttccgattccccgtccccaaaacgtcgtttagtacctccacccccaccctcgggacccaggcttgctgtgaggcgagcagcgatggcctttgccctcgcaattgcgtcgtccggcaggccactcatctgtccgttgcccttgtctggtgatgatacgaccaccgccaccactgggaagcccctgcctttcaagtgaaggacaaggagtggtagaaaggtgaaagaggtcacttcattcatgtgtcacaaagcacgctgtcacgtaggccaagaaaggaagcgaggggcctgcatacgacgagcgcggggctggcgggtactttttctgcgcccgtgctccaagagtatctttccctgagaggaaaggagcgagacgaggccagaccccaccgccccgggtgtagcatgctaagacgggggccttgagaattcgtccttccgcgttgcgtgtgtgtgcagtgtgtatgaattgtatgcttgtgcatcatgcacttggccagcatttgttttttgttcggatttcaaaacgcaacacaacgtttacatgttaagaaccatggtacttatcaacgcctcgatttccaaagattaattgccctctgcagacataatcatg

SEQ ID NO: 1885 - DNA, 703 bp, Nannochloropsis_gaditana
caaccggtattcgccggtatcccctaaagatttcgctgctcacagattaaaattgttatcgagaatggcgttgtaggagagtagttgtcatttctgtaccgacgaggaatgactaagtagtccggcgcaggcgccgccatcttgatagttaatgaacatattccggaaaacctgcacaaacaggcaatcaatatacaaattataccgtgcgttttttcccttctggatcatgaagagctggtggttttagattgagtctattgtgatcgattttgacgtcttccgatgatattcactcgcgcccagagatcctttcatgtcgtaaattatccgcgaatccaaatttgatgataaaatcgatgatttaatcaaaattacaaacctacctatcacggcagagtgaaacaagagcttaactgaatcgtgctcgtattctggttcaaagctttggctcccttgtgttcacttcgactgccctcctgcgacgtctctctcgatcgagaaacaccaagcagacggggtgagtgacggccgaggggaacaggtgacctttacggtcacttcaaggacgcttttcctacattgcgaacgaacataacactcgataccacacaacaggagaaactgacgagtgtcgcaggcaggagatattcgcgggactggttagagctgtcatcgtcgtcaccgttgccctcatacgatg

SEQ ID NO: 1886 - DNA, 703 bp, Nannochloropsis_gaditana
ctcctcgctttttccgagtctccagtgtcctagacgtatgatcatcgaaaatggagcgggaaaaacgtgcctttcatgcccgtgctcgtaagaatatttcatgaccaacctctttcgtgaaatgcttctccaggtcgagcctcgtctcacaatgagctcggcctcgcctctgtctcccctcgccctttcccttccccctactactgtatatgctccctcttcaatgaaatcattcctgaccccgccgatctaagttatgttgtctttcccttccaccttctcctttcatttcaggtggagcatgggtgcgccgtcgtccttgcacgggctaggggcggagaatgacgaggaggaagaggaaggctggcatttgctcggggacgttccattccgaaaatggacctgttacccagcaccattgccatgcttggaaagcctcaacttggacgagcacattgtcgttggggcggcgcatggcggtcccttcgctgtgatgcgtgacgccaaaaatggggttgttctcggttcggaaaggccttcttcttaccttcggatttactcgtcagcagggttgctattggggcaggcgccttgggatctagggtccaaagtcgtgtgtatgggatggacggaaagcgaggctttggtcgtcatctcggaagctggccacgtgcattggtacactgtgcttggggagagcatg

SEQ ID NO: 1887 - DNA, 703 bp, Nannochloropsis_gaditana
gtttgtgaagcgattctgcctctgcttccaaggcggcaagtgaacgggagggatgtaatggcgcagctgtagccccattcattcaggaaaaagttacgcaaatcactaatgagctgcacgagaacaaggaaagttgggatacctgtcgatgtaaaaattccctcagtgtgttgtgaacaataaaagtttaaaggatagaacgctttaagggtgaggaggttattggaggagagcggtatgtacatttcggtaaacactcagtgcagtctacaaggcttcaaaatgttaatgcatcggtggcgtaggataccgtgcgcttctccttttcttactcgcataacttgcccaaaatgtacgccaagaaggtcccaatgcttgctcagcagtagaaatgtgacgccacgtatgcgccgaagtcatgtttctggtaaagtctctgtcacacaggtgctcgacgagttttggtagaaagcggtacaccgatagatgtacttatctatctataatattacagactttcttgtcggagggttacgtttgtccgatgagttgaacgtgcaataaatccgtaccgcattcggacatggaaattgcatgttgcctgatgcctcaacgtgtacacattatcataaccacagctcatatccatacacaacgtgcataagaaatttaagtaagtacggccggtactgaacgaacgatg

SEQ ID NO: 1888 - DNA, 703 bp, Nannochloropsis_gaditana
actctgttgctttttgcatacgtgggtgtttcaacgtttgccttcattacctcaacaaagtcgttcaagcagcccctatcacctctacctcgtcttcctacgacaatcacaacgactctgcttgcccacggtcatctacaagctgccctccagctcattcatgacacgcatagctccatttcctcggtaccatcaggtactgctagagatgccacaccaaaaattgggcaagcaagcccccatcctccacctcctgcggttcttttctccatgttagcaatttgacctgccctgttatcatatgactcccctttcctcgctacgatactgtcgcgcattcaactttttgaaaatttgccctccccttatgtccctttgcaacccatacatcccccccccagatcaataccatcccccttcgccagccctggaggtgcatcgtgcctctctccccgatccggacgtggttgacacgacgggcacgggggagaaggtaagctttggcgcccagcacacgaagaaacacactggaccatccgtgactagttacctggaaataagccttccgaccaagagcggtaagacatgccatgaaagcgttcgacgaaaagcatgacgggactgtcgtctggtgacattgataatcgtaccatcttgccaggcattcatcactccatggtacctcccctccttcctcgctctc

SEQ ID NO: 1889 - DNA, 703 bp, Nannochloropsis_gaditana
ctgccagcttgctggatcggcatcgataacgatgaccaaaatgtttggctcttcggcttccaggcccgcgtcgaccatgccgctgcgcttggcttcgtggagagtgttgtgggcaggttaaatcgttttttcatcgattcggagacgagaagttgcgagaaagtcaataaatagaaggcaccaagaaaggctatcgtcgcaaagcagcccttgctcaaatcgaaacccacgaagcccactcatgcccatgctcatcgtccctttgaagacatgacgcgcgcggacacgggtgtagggacccttttcccgagtgctatgtgtgaattatggcggtgatgagcgaggtgagaggcttgactcgctctccgccgctcaggcgccttattgtgtccaccctcttcccacggacacaccacgcactttgtgcgcccaagcaattgcattcatagacgtaggacttgctatatcttgtttcttgacatccctcggcaatggtcacagccctgctcgtcttgaatgtcgtgctcgtggaaggtcccacctcccagtcgagagcgacgatagaatggagtcgccctccatctctttgaccgcgcacacggcaatgccgtcacctctgtcaccgttctcggcacacccatgtccttctcaacacgttcctttgcacgcgactcacaggtggtagcttggtgggacgatcatg

SEQ ID NO: 1890 - DNA, 703 bp, Nannochloropsis_gaditana
tctgaatttgaacactttcctgtggaaccaacggggagagctgcttagatatgatcacgcgtatttcagcccgcattacgaatgtgccctccctgcttgtactcagagacgatgaaaaactacctttgcatgccccaggtgaatgtatgcaagagaagattagaatttggcgacaaaaagatgagaattgaaactctcgcagacatatattgggtgcgatctgatgatcgccgtgctgggcggtaaaacctcctcgagttccgagtcttcaagcctaataacttgcaatcaggctaaacccctttctgtgcgacctacagggatgccgcagtcactagtttcttcaccaagtcgactctgttcaccgttgttcagttttgtgggcctcatcctctctgcagcagtaagctttttgaccgtaaatgtcctagcctcgcatgcttacctcctgccagcgccaccccaacacgagcaacagccgtcgttccaccagcaggtgcatccaaactatcttaataagcatggacagacccagtcattcggctattcctccgtagaggtcaaccgtgcccgcatgccctcgaatatggtagggataagccaaaggataaaatcatccttattcgctggaaggtcctccgcgcccccctccacatccacttcctccagaaatgtggtcgtactcacaagagaagcaggaaaa

SEQ ID NO: 1891 - DNA, 703 bp, Nannochloropsis_gaditana
acgtgattagattgaacacgtacgacacggtgccggccgactggaccgacgaggagatgtccctggctcaatcttgcgctgtcgtgacttttgccagccccagcgccctcaaagtctgggctgcgcgtcttggaatggattttaatatggcttgcattggtgagacgaccgcgacagcagcaattgcattgggatgggatgaatcgcgtatattctacccaaaggatgcccctggtatagatggatgggcaagtgcagtcatggatgctttggaagcgaaggacgaggaagtagcaggatgagcgaggtgacggaggttcagcatcgactggattcggacgaataacaacaaaaatgcccaaaagcccccataactaaattaacttgcgccatcaccatgtcaatcgcattgccatctttcttccttttaatgagcgcgcagccacacacgtttaaaatgctagtgtcgtgcgtttcagcccaatttgaggcgaatatgggccagggacgagatacccttctctctcccccggcgcgctttgtcaggggttgaggcactgttctggattgagagcatttacatcttttttttcggggcgcttccgggatatcacacttctctgttgtttccatgttaacgcttttgaatcattatggacccttctctggttttgaatttctggtcagcaccgaagtcagcatg

SEQ ID NO: 1892 - DNA, 703 bp, Nannochloropsis_gaditana
ttaagctgcccaattagattccagcacttgcaaagattgctctaatattggatgaaaattcacttcatttatcgtgcaataactttgaaatcgcaataacttgactgttgctcaagaaaagtgacctgaaccgagacatcaacctgctttgcttatcaagtggacaacgactagcttgtcaatgagaaccaccaaacaaacaaccataaacacccaatccatactggtatgcccgaaaagacgtttaaaacccaaaaaatgatggataacctgattatatctggcccatgtagagttcctaaaacccctgtgcgccccgccaactgccccaactgcaactaccttttgttcaaaatcccttcaatggacaggacgcgagtgatggaaaaagtgataccgggtctccctctttcattccactggcgtgtcaattgtgtttggagggggaaaatcagtcggtataatgaagtacatggtttgcgggtggggagttggtggctgtggtggcatgttggacgctggcgtgcgtatgccatggagcgtatcctccctgctgttgatggattcattgcgaggccattcgttccattatcttgcggtaacgcgccctgccaacacgtgcacttacattttctaacatgtacatctttgcttgttctctccacagcttttacttctcgttcctctttgcaagtctagcatg

SEQ ID NO: 1893 - DNA, 703 bp, Nannochloropsis_gaditana
cgctgcgtttgagttcgcctttcttttcctcgacctgtgtacggcaaagctaaaagttaacatataatgccatcatgaaaaccacgagatgctatgtgtacttaccttcagctccagcattcgctcctctgcatccagtgcagcatgctgccgttgcaacgattcaagtgtgcggcggagagatggcacgtcttctgtacttgtcaaagtggtcatgacaccaagagtcctgcgtggagaggggggatgacggcctcggatcaaaaaagaaataaggcgagcaacgaagccatccctcgggcatactcttccatgactgtaacaaaatagtagttggaacactgtttttcgtagaacatgcaatctggctacgtcccaaagccaaaaggggcagcaaaggcaaattttcggctttggttcttccaattattcttgttctcccaaggccacccctaccattccttgccccagcccgaacttcaactcggagcctgacaccagcattccacaccagactcgaccgcattaccggcgtggaaacgcggggaatccccactcgaagatctcttgttggtctttgtcccagcttttccttgagacgatttctcacgtatttcaaatgcatttgatacctcaattctttgacggcacatagagttctagtgttcaacaccctcatgccgactccctatctcgctacata

SEQ ID NO: 1894 - DNA, 703 bp, Nannochloropsis_gaditana
aggggtctggaagcttgaagccaacaaggcttgagttcacctttgtcaaatgccttcggaatgaaatcccgatgactgcatccaatacacttgcaggatatctctcttcagtaacctgtcgaaatgcgcgcataaaagacgagggtaaggggaaatggattacgatccacgccgtttgcaagcctgtgttgaaggagctgcaagactaatgtgggaaagcgatataacacaacagagtaagccacccactgcagttttccgttgaccatcttccacattcctgtcatttgatgcttgtcaagaagttggaagctgcaacacggacagtacgagtggcagcagaggggtagggggaggctcgaggcgctggagggctgtgctgggcgctcgccgccagacgcgtacgtgtctcgccgctttctcgccccgcccctcccccgcttttttttgactttttttttgttctgtttatgtaccaactccggggcaatgtccgaatgcttgtcgcactatgccatgaattttcttcggaacctcaacgtgaacagtgatttttcaatttttggggaccatgcatttcttatactaagaagccacgactagggctgttagtcatcttgcatttgttgtcatgcgacaacgtgctaatttgaacctcccacagctattacaactagtcaacactacctttcgcgaacgcatg

SEQ ID NO: 1895 - DNA, 703 bp, Nannochloropsis_gaditana
ggcacgaaattggacattgctccttacagagctgcgctttccgaaagacggctccctcaggagaacacgggcactccctgctttgccatcaggcaatggcctcagcctggtggctgccattaaacgccaacaaaaagacccctgacaatggtgttgcaaagcgacccacgctcgcgaccgcccccctgggctgcgagacgttcccatggctccatcccgcgtggtagggttaggaaccccttctctctctcgccagtgtttctcgctcgacgcgagacaaagcggcgtgaccagaaatgtgtcgaggagaacgtgttagcggccacgcgttctgcaaaaggaacgaaaaagatgtggcatatctatggtcccagacacctacttctcatattattcgcgttcacaggccaagttttccttatccattttccgacgagaaaacaagtgtggcaagactgaattggaaatacggaagtagtggtgcttcctggaaaaaacacaagaccagcagcactctctcacaagcaaaaagtcatcaatgtcgggcagaggacgtggaggtggccgtggtcgtggtgcagggcgcggccggggtggagataggggcagggacgggcaagatggactcggaaggcctgggaaggaaaggtgttcaaataataacgggagcgatgttagggaatttgaggacgaattcgacatg

SEQ ID NO: 1896 - DNA, 703 bp, Nannochloropsis_gaditana
agtccagcacagtggtttgagtgtcagcgggcaggggcaaggagggaggttgactctccgtggcgacggctgagagagacgaagccggcgttgtaaataaatcaaaccacaagcctgcgtttctaggtgggatacgtagcattagcgtcgcgattcagttcctggaaacgcagggccagtcgagagcttaacacgttcaggcgtcatatgaacttaatttttcagaccgccggcgatggcgcgagaccgtatcagcattgtcatggccctcacctttccttggtttaacatggaattcgaaagacatagaggagcattcacggacgccgagttctataagacagtacatggtgtctgagtgtcccatgttggcaagcgattattccaggagggcacggtgccaggtggacatacaaatagtacagcatgcttactatcgtcatcatcacatttggttcgttttcacttaccgctctgtcacaggtacaaagcctgccaactggcatacgaggaaaacccgttcgcagtggctgcagtcaaaggactgtacaccggcgtaggtggggtgtggccgttatcaagcgtgttgtcatacaagacctgtcctttaggcgtgaggtagccgccttcgtggccctctcctgtgcatccttcctccctttcccttcgctgcttcatctccgtggagccccaggcaagcatg

SEQ ID NO: 1897 - DNA, 703 bp, Nannochloropsis_gaditana
caccagatttcgacataccggcggcactttttagcaaatcgagcatggatttacaggcagcatgctcacattcctcttccacggccgctaaagggttgtcaattcgaggtggcggagtaggggggggcatggctgagctggacgttagggcctgcagcaatactattttcacctgtttagaacctagaaactggaggaaaacagaaaattttaagatggagagaaaattcgccatggttggacgcctgctttcaaaggaaagtggcacccgaagcggagggccgaagggggcgagtctccctgctcgcccgttcccagagaggaatgaggcattgccactccttgtctttgaccacatacttaaatataaactcgacccgaccctatttcaatggaatgactgatttgttgagaaccatacggttgcattgttatcgtggcgtgggataggcctgcgagtggctttgaacgcaagcagaccctttttcctctccgagtggacggctgcagcaacttgccttcggactgcaacttgcctccttttgtgcccttggttattcccgtccacgttctatcatcgcgtacgaatttatagaaacaggacaagggcttactcaaaagctgtcatttaacagggtacgctttggagtcggtggtaagcatttgggcgctgaagtgctcaagatacacagcgtggagaatg

SEQ ID NO: 1898 - DNA, 703 bp, Nannochloropsis_gaditana
aggcttggaagaattatttggaggaaaaagatgcccggaggaaagcggggcgtgaacgggcgatgcgtcggaaggcgatgggctacgatgagcacaatgacaattggaaaggaccaagctgggtagaaggaagggagggggggagggagggaggagggagagggtgggaccgtcagggcaccggggtggaggaaaagtgggtgccgcgggcagaaaggggtggaaggggggatgaggaggaggaggagggagaggataaggaactagaaaatcagtttttagaccggctgatgttcgacttggataagacgccgggcgcggagaggaggggagggagggagggaggaagggagggagggaaagagaggggtagggggatagggagggagagcacgcgtgggggacgatgaattggatgccttgatccaatcatctcctgtcagcaccccgccagaagaggctcagcgtcgaggtggagtagagcgggaaggtcgattcggtggaagaggacgcgggggaggggcgtggggggggggccgggggaggaactttgagcgaggaggaacagaaggaattggacgtgtggttgggaatgatttcgagtgggagagggacctccgcctcctccagtccttctgcactgtctctcttcaaaggccctgcctcgctcccctcctcctcgttcactccctcgccgggaatg

SEQ ID NO: 1899 - DNA, 703 bp, Nannochloropsis_gaditana
gggggggggggggggggaggaagaggaggatgtgcggattgagggtacctttgcctaccttcctcccgaggtggtccgggacggggcggtgcctgacgcgctgagtgactcgtgggccttgggctgcttgctcttccaactgttgatgggtcgcccacccgtgttcactgagcacgatacaagcccggatacggacatcagagagcgcgttgtacgctttgcagaagggcaaaaggttaatggagacttcgtctttggagaagctttcctgaacacaagcaggactgcccttactctcagcgacgacgtaaaaagcctgataaaatccctgcttaaagttgagcgaaacgagcgcatccccgtcgaagccgccgccaagcatgcttttttcacaaatcattgtgtaaatgtgcatttgctgtaccaaggacctgcagttcaattagttcacggggcagccgggcccacgccagatgcagcatggaatcgacgccaattttcagcaatctgggcgcctttacctgggaagtataattttgtttccaaatcgtacacactgggtcctattgcagagacagacattgagcgtgactcactattctgttacgaaaacaataagcttttggaggaagaaaaaggaaagacgcctgaaaggtgtaacatcggtctgcccctgccacccaagagacctgacggaaggtaa

SEQ ID NO: 1900 - DNA, 703 bp, Nannochloropsis_gaditana
ggcgggcgggtgtctgcgctcctgtggttggacatgcaatatgcggtcagcaaacacgatccagcgacctcccccctccatgacgtcataacgtcatggcccatgggcgcgccccgggcaaacgggcccgtggacggcctgaccggggactctgccgcctgatacgtgtgttaccgtatgaggatgcactacaattggattttggttcaggtttagatgctttggtggttggttgtcgatccaagcggcaaagcccggaagaaagcagacgagaagagaaatatgatgaaaaaggcaccctctcagccccgaccgactttgactatcctaccctagtctgtgcgaaatactgatttgcttacgcgtcatgaacaggcctgaaatcaaccgaaatcgagatactgttttatacaacgcgtacaacgcgtcaggctattcctgtgacgaagggtagcctccctctgacaacgtttgttttggggaaagtcgcgcccatcgtcatcaactgtacgcccccaggaacggggcaggaacaaattttagaccatggcggcccccagtatagcatcatcgctccataaagagcctgagctcctgcgacaagaagcaacacgtgtgcagcagacgcttgaggcactatatcgcagccattacacgacaattattgagaattacgaatgtatgacctttattcaggaacgag

SEQ ID NO: 1901 - DNA, 703 bp, Nannochloropsis_gaditana
cgaaaacaataagcttttggaggaagaaaaaggaaagacgcctgaaaggtgtaacatcggtctgcccctgccacccaagagacctgacggaaggtaaagagatgagataccttagtaagcacgcatgaacgtattttcaaattgtacaaagaatttactccctgtgatttcatgtattgctttacatataaatatatatatctgttacatgaggtacggcccgcatgctaagttctacgttgcaatggctaaaatcaataagacccgctttctcatcatcaatagccctctttagagacagttctactctgctaaagaaataagttcccgcgatacagctgtaaggttggggagaaggatgtattgagcgacgtccctaaaatatgacggtccaacactgccgacctcgggttcagtcatcagaatacccgggtcggcccaacctcccggagataagtggagagggggcgacgcgacaagtaaccgcaaacagcacacacgtgcggagacagtctcattgtgtttgcctctgtaggagcagctgaaattcgtgggcacgggtcagtaaagaactttcggtgatattttcgtttccccctgagaacgttgcggacagtgtccatgttaccctgttcgcttcctcgatctgaccgcttaacaatgtactaaattgcatcaaaatttaccgtgcagcttgtctatg

SEQ ID NO: 1902 - DNA, 703 bp, Nannochloropsis_gaditana
gtggagctgctcgaagtcccgcaagtcatggacgcctgtcttcgaaatgggctgtatgacgaggcggtggaagtcgtcgcattcgctaacacactagagcgtcggcacttgcgatctctggagcaggccgacccctactccaacagtaaaagcagaagcatgttcgacgaggggggacgaggtaagcacaccgtcgtcatcgcgggcctggtgcaggaactgcgcgtccttcaaagacagttgagggaaaggcttgtctatcagcttcggctgcctatccagctaccacggtgtctgcagatcatctcctgtctgcggaaactggacggcctggctcttgacgcccgttcccaggggccgcggaaaaggcagctctccctctctgctgctccggcgacggtcaatcgcggtcggatcggggccgcacacgatgtaagcgggcatgatgagttggagaaagagttgcagaccgagtttctggacgcccgggatgcctggctccagtctgagttggagcagggcaggagcggcgcgtccggcgcccgcgggcacggggtcggggtcgcggatctgatggccatgatcgaggcgaacaggacgcattggtttgagatcaccacccagttccgcgccatcttcttggacgacgggttggaggcttccggctcgtcctcgtccacgcactcgtcctccacctccctcc

SEQ ID NO: 1903 - DNA, 703 bp, Nannochloropsis_gaditana
accacgccaccaccatcatcatcaacaacaacaacaacaacaacaacaacaacaacaacaacaaccaccacaaccacaacaaccacagcaacagcaacaacaacaacaacaacaaccaccaccaccaccaccgccacaacaacagcaacaacaacagcagcagcagcagcaacaacaacatcaacagtttctccaccgacaacaacaacaacaacgacaacaacaacaacaacaacaacaacaaccacaacaacaaccacaacaacaacaacaacaacaacaacagcagcagcagcagcagcgacagcaaggtcagcatacggtgtattctcactcagtccatccaccgccttcccagaaagctcacacatcgagctctgttaatgcgattctctctctacccaacggctctggcggcaattcttgtttagtcaaccattccaatggcccttttgctaattcttcgacagcaaggcctcattctgcgcttcctctctcagcttccaggctgcaacagcaacaacagcagcaatcgcaccgaccccatcaaccgcaacaaggccaacaacactcaagtcttcagtatcaagcaaaaggtattgacgggcaatcagctccgattgcactccgcatcgtaagtaaccaagtgcctgcagccaatcccgtggctccggcagtacttcagcggaagccccccacgatg

SEQ ID NO: 1904 - DNA, 703 bp, Nannochloropsis_gaditana
actccctccacatttgccacccttgagtgtcgccgtagtacaaagcagcgggcatctggtttggtcgttatgaataagtaagcatagcttcgtacggtcttgccgtgtcgaggttaaaggaacggataaacaaccgagaccaagcgaagagcgatatgcgtgcttaaggaaaggcaataccgcgatagccccgtcttgagcaattcatcaaaaactgagtccaaacaacacagatcgcaatccgcatgcaacattgtcgaggcaatagtaatggcaagaaaagaggaggatactagcgcgagacgaacgacgcaagatttcagtctccctcttctcgtactgctactcagccggctccccctcgcgtgcacgtttagcactcccacaagcagcagcgccatcggcataaatcatggcgatgtgctaaaaactctaaataatgccgccactatccccctgatcgatcgagtcccgacttttcggttttatcaaggtggtgtgtgccaactgcagctatcagggcgaggcggcttagccgagtgccgggcccgcctgcatgtggcgatctctaccctgcttaacaacaaaacatcgtccaaacaaacggaacgtgaagaaattcaccatgaagagaacggagtctctcaaagatgtttagtggctgatatcgtggaaatcgagtcacttgagatgttggagggta

SEQ ID NO: 1905 - DNA, 703 bp, Nannochloropsis_gaditana
gtcttgtcgagcttaaaatactatattactaatatgtacgatctatcatcactgtaagaatatcgtctgtattttcaactatatatcctcttcgtaagatacaagaaagcaccagtatcgttttgaatccctacaagacctgtagcttgatcaaaattcagtgttgtcgccagaatttctacaaccgcaaattagccttcgtttttcttggtggtgatgtatgtgtccgtagcaacattccctgcaatgcaagccaactcttcttttatcatgtgcgctgattatgagactgacgatgcctatttaaagtaccttgacaatttaaaattttccatcaaactattttccaacagttcttccgaaaaaggactcataaacttcttttaaagaaaagaaaaagtccgttgggctgtcgtcatgcttccccaagtaacggctcggttgggggggcaaacgtgcgaccgttttgatttgaggttgcagctgtatgctatttgactccccgacgatatttcatcttctgtcctacgttcatctttgtcataacaacaacgtcaagatccactttgtcttgatgactaagtcttcatgttgcctattctgtctccgactcgcctctcacaacgccatgtgaccgggcccattccacctcgacgtgcgctctatcttatgttcatttcatgctttctcaaaacacacgcaa

SEQ ID NO: 1906 - DNA, 703 bp, Nannochloropsis_gaditana
aaaccagcaaaactcatcggcctaaagttgcgggaaggcgaaagtgtgacatgaacggtcaagtgaagatcaagtaagacgggagaccacaggaggcagaggcagggcaaagggaggactgctcatgggttacagcatgcgcgtacagcaaaaaaaagtgctagcgcgtagactacagcgtgattggtgtgcgaagcacctgacaccgaacaaaggacgtttttatcctggcccctcttggccgtgtggccgccgatggggtctggcctccgcctcgctgaagtcgaaccgaaaccacaccgaaaagaaagccatgaccgatcccaccaaaatattgggtttagcgcccgatgccagcgaaaccgcacttatcacgcgcgcatcttgctcactgtgtggatgaggtgcgcgtgggggattctgtttcttttctactccgtgacttcaatgtagtcacaggtcttctagcattgtgccgaggttaaataacgatcatgaagcagttgctttaattcctgagggatctaaccgcgacttccccattttttgggaccaggtccgggcctcctacatcatcacgtccctacaaagactgttttcactttagacggaacgcgagacctgggcgtcccacttgacggtgaactgtgtgagagacgttgtctcttaccatttgagctcaccttcctacttgtcaaacatg

SEQ ID NO: 1907 - DNA, 703 bp, Nannochloropsis_gaditana
gttagcttcgaaattgatgtcacctgacgctttctgccttcaggggatgcaccataaattgtgccagtctccctcttgttgatgtgtctggtattgtgggtctgaattttccagctttccgtttcggaacagcggcattggtagatgactatgtaaagtgccgcattcaaggtaagatagccccaaaatataattaagaaggcagcaaccgcgtaaggagaaagtggaagcaaatgtgacatacccttacgacgccccaaacaactcggagcaacgcgaccaaagcgcagatcgataaagaaagactgggctatgctcgtttctggtgagctatgtaagctttgataggacagcaatggagtaaggggggttaagtggacggatttcacaggttattgctggcgtttgggcattttttgttcacccagagtaggtcaacctcccggctctcgcccgccgcccgctccttggtgccggtgataccgcgaggcgtttggccatacacatgcgtctaaagtcatatacacacgtgccaaacattagcttctgccttatggatacgaaaaccgtagaggcagtaccgcactcgtggagtgattatcttcacgagtgtttgaattacgctaacttttgttcaaaatgctcatggacccccgtcctctgtggcggtacccattccccacgaatgcacatgaaacctcta

SEQ ID NO: 1908 - DNA, 703 bp, Nannochloropsis_gaditana
acataaattgctctcaacctcacccgctttcatttttatgatgatacggcaccaaaatggagaagaggtgatcctttcccgcgaggctgtgcacggtgcgaccagcaggctgacgtactcgcggcaccaaaaagacatagtcttggttctcagcgaccatccagcggtccatttgcccgcacgagcaattgctacgaaagcaggcatgggggaaatgctgttcgttagggaaggtcgatcgcgagcacgggaccggagtacggaaaaaagaatctgcaaacccatgcattcgatgacgcttcttgcccgtcctggtggccgctcgcacgactttctttgtggcttccagaatatcatcgctactgtgctatcttctgtgcagcttcaggccgtgttgcccagggtggcgagcgattgggaagcacacctggctcttgtccttgtaaatgtggcctgctggcaccgagacttgccaggcttaacattgcttttcttgggtatgctgctcgttgcggaggcattcagatggcataccattgagattgtactgggcgaaggaggacgtgatcggcagctcctgcgtgcagtgccttgggattgggaggtgaatataggaagatgcctgatgcgctggcgccgagtaagctgcgcttcaccgagaatatcaaaagccaggcctgcaatcactaccaggagcgtgatg

SEQ ID NO: 1909 - DNA, 703 bp, Nannochloropsis_gaditana
ttccggtacgagaatcatcacgctctctcacgatcggtgactcaaggactgcatgtgtgcagattcggaggcttgacggcaaagctactggtgcgtgtcggaggatgcaaggtcaacctgtgttcaatcaccttttctcacttacaaggaaacatagggctcttttgcggcacttttgagcctctcgttgtgcttacatagcaaaatacatgcacatgtattttcctaaggcctctccgtgatcgaatacaaaccccgccgcgtaaattaaggaatactgacattgctcgggcatgacaagcgtgtgacattaattgcagcactcagcacccacaacacactggagatcttgtcattgcaaggtcatcaagtattcccaaaatttatttcatttgaatcgtcgaggtacgtgtacacgggtaaccaaacgggagattgaagggaaactttgtttccagaacttcgcgagaggagagcgtttgtcaaccttggttctctttagctccataaaatagcaacacgaaagttatgatgagattacggacgaggaaatagaaataaaagaggctgaattcaaaaagaaactgcgagactcacatccttttgtacctatcgccacatcagggcttacacggcatgtgtactggctaaactgcctgggaaataaataataacattttttttatttcaagttccaatcatg

SEQ ID NO: 1910 - DNA, 703 bp, Nannochloropsis_gaditana
cctccaccatccacggtagaattaaaagtgagactagccatcctatcacctgaaaattgtgttcgttaagaaaaaaagtgctgagggtgaattaaaggatgcatgcgattgcactgggcggttcgctagccacaggggggggctcgagcctgggacaggaggttatagcgagagatcccgaaattgacacgttgtgggacacccacatgaccgccttttctacgtggatgacgcgaggtagactgtacacattgagtggggagctgcatgtcctggctgcgccatctcaccgcgagcaggcttccccgaagaggcgaggcgatgtggtcgtcattctcgctaacagccgaaaagctgtagctcttagggagtgcctgaagaagggtaggtggaagagagaaagtacctccgttttgttcccgacctgtgctacttgacccaatctgccgcatcgtattaggctacatctttgttaaatgtcgaggcgcaaatttgtagtgattttgaggaaaggccattgagaagataaggtagacgaagttgtgataatcgaaattaggattttacagcgttcgtaatcatgcgtctttacaggcaaataaaaaaggcatcaatgtcgcgctcaccagaagtcctgcaaacgtcgaactcagccctgtcttatgcttcaccttcgcaagcaccttcaggggcggcaatcatg

SEQ ID NO: 1911 - DNA, 703 bp, Nannochloropsis_gaditana
attgcctccatgggcgcgccacagtcctccaccagaagaaaatcggggtaatgtgcgtcgccgtactgtcataaagtaatcaaaaggatattcgcgacgctacaagcgcccttcctcaaattggaaaatgccagtccagggcctcagagccgttcctggagtgttcttgttcctctgggctcagcgagaaaaaggagaatttgaccgcttagtctcacatcatcccaagtcatggacaaagtgggctagtctatccatcggccgtggattcataggacatcaagcttcacagtgtggtcgaaagatagtgagcgatgagcacaggacaggatagaaaggcagggcattgcggcaatgtgaagcacggggtgcatggaacaaagtcgagcgaaggggaaggcgtgcaattgagagaagcgcgagtgatgcgttttcaatatgcaaacttctgtgatgctaacctcgatcaaatttcatgaacagggcactttccattcttgccacaacaattagtcgactgatggctaatgaaccagcttccgcttccttgcactcacccgcccctgtgactgatcgcgcctccaatgagaaagacttaaataccctaagcaattatgaagcgatcaaatcccagcacttgagactgcattggaatgttgactttgagaggaatgttttggagggatgggcggagcacaccatg

SEQ ID NO: 1912 - DNA, 703 bp, Nannochloropsis_gaditana
cacgtcgcacctcaccgcgaaaaacattttacagcaagacgctcattgaatccacgcataagactagatttttgatgccggcactgcctttgcgtttggccatgatgaatctttcatgccggggcatagacattgcctcgtcacacgaaaagcccttcaaaaggagagcgatatatttctttgtgatcatttgtggtcattcccaggcacaacaaatcctgcacaagctcgaggcctactcgcaaaaatggaaagaggcagcaaattagaaatgcgcttacgagacattcttgatatggaggaggatgaaaatgagaatctcgagcatcttgtagagcgcatgtggccattgataggaaggtacagctaccagagccgggaggcggggatgtcgcaaatcatgtatattatggatgaagtaggttcacgcttttgtgaagtcttgcctcgacgctctttgggaatttcagcggctgatgataaaaatccaacggaggggaaatcggaaaacgaaaggaactccgctgcattccggtgtgcgttggtcttccaccccgacacaagagaagcattcacggtcttttggccacgacgggacgttactgaaggtgagattgcaacttgtgacaacctccctcacggccaagcagcccgcttagcccgtcttcaggtcttaagtaacgctagcgtcgacgacactatg

SEQ ID NO: 1913 - DNA, 703 bp, Nannochloropsis_gaditana
cttcgtcgagtgttttgcgaaagatgatgttcttgctccgtccaccacagaacgtgttgcatctctctgaacaaatgcgggtttgaaatacatggtcagtcgttcgagtgacatccgtaccacacatgcaagacgtgtgctgccttcccttgcgggagggcggggtaccgtgtctcgggttgacgtggtaacgattttaccatttgtgttgagccggtctcttgttctcggtgcgcccggcccgccccctgcctggtccttccctgtctcgaccaatacgtccacggccatccaaaaagcctggatcaaacgacggaaatagatagaaggatagtcacagaagcgattgtgtcgccgggcgtggtcgcggcgggacggtttgccatgtaaattccccggtgatgtgccctttccctcctcaagtctttttcgtgttcgccccgccccctgcgcgtacccaggcgaagaacgaaaagcccaccgggcgccaaatcagatgacttgccctcctggtatgcggaaaaccggacacgacgctcgttgtctaccaaacaagatattttcaatcccaatgtcatcattcgcatactgccccgcgcttcttgatgtccttgcgtattctcttgcccaggacgacttatcatggcaccgtccgactccacacctccccgttcttacccaccctcacaggtacatcgccatg

SEQ ID NO: 1914 - DNA, 703 bp, Nannochloropsis_gaditana
ggtcttctgtaagcgatggtccgtttggcgacgaaactccgaacaggagcttgttgtctcgtgcatacttgtaatctaattctgcatctggcattccattgtaaaaagatcttttccttctcgtatgtgaagggtagtcgatatatgaacgagcctaacttggatgctgtgcgcgtgagatctgacaaaaaattagcggctcggatctgcctcaagcaaagcgtcgcgggcgagatgtacatttctaaatcgcactcctgttatggcttcgtcagaaatagagtactttacagggacagggatttttttctcccagagctagtatgaagtcatgcacaaccgaaatgtcgttgtcgtcgcgttgcttaggtaaatgtatttgtaggtcggcatatagcacctcacatgcttcactgccacgctcatatgcttgcaggagccttcacgttttctcagcgatgccattccatcacaggtttagccacattgactcacattaacttgtcgcttacacgaacacaaataggcataattgcattgtgcgggagtaaaccgttctcgatctaccccatttcggacgggcctggctcgcatatagctgttgactaccataaacttgcctactcacttgcctgtcctcactcggatgatcatagcggaccacgctacgcctgcatctttgtagcttctttgctcgacaatg

SEQ ID NO: 1915 - DNA, 703 bp, Nannochloropsis_gaditana
cttaaatgggcctccaagtaatagtcacgtgcgattgccaaataaaactgcatatattttccaagtggctgtatgcattttttggacagctgatatgtgcgcgggcatgtacactgacgttctattgttgaggtacttttgtcggtgatatgaaggcaaatatcagtgtccagttcagctttcgtgacatattattccattaagttgcgaaccaaattttaatatttcgagcaagagtggtttggggccgagggaccctaccacggaagctaaaatttcatttttcttttctttcgaaagtcccatgtgcgaaggtgttttcgtcttcctgtcacgcactatcacgcaggcccccacgcccctcctctttcagtgaatgatcatgctaccattatacataatatgatacccggcaattagtggggctgaagctctcacaccgaggctggaagtacatgtgttagtgtctgccgctctgtatgactttgcgaccactatctctttgtctactccaaaatgcgcttgataatttatgcgcactcattattgatcgtagcaatcccgcatatagctttcctcccagatgctaccccgcgagggtgaaactcgtcgagctcctccctgtccttcattgtcatactaaagccagcaaaacaaggcccgactaccatttcggttcggaagtcttattacaggcattatg

SEQ ID NO: 1916 - DNA, 703 bp, Nannochloropsis_gaditana
ctggacgattcagccgtcccttaccgttgctttcattcgccttcaagtgcctgtggcttgctcaatgcctcccggcgttcggtttgtgccatatgacgaagagttggggtctgaagagggaaagtaagcttgatagtgaaatatcttgtcgattggcagaacaactctattcataatctcactgaaagcgctcttaaagcctgattagtatgtctcaccctacatggcagcgccgggcgaggaagtaaggagtgagggacgtaatcatctccttaaattgtagaaatagtcgaaaattccatccattgatagagcatgatcgctccattcctttttttaaataagggaatatttgttctactcccatttatggaagtggaggggatcttaaaaaaaatgctctgaagtgcgagcgcatgtagcaacggtggctgtcagggtctgcccctgcaactcggtggtggtggtgcttggcggggtcttgggtctcgcaagtttatatgtgtgtgtgactgcataattctttagatacgaagtttttgccctcgacatgtttttcgctatagggcgcgtgattttcaaaacgagaagaacgttgttcacaaggtcagtgtccaaagggttcgcggcgccggtggtctcaccttgttctatcttgcctcgcaatatttccaatctctccttcccttatttgggggagaca

SEQ ID NO: 1917 - DNA, 703 bp, Nannochloropsis_gaditana
attgccacactttccacgtccttgggtgttccacgctttcttgcctcccggacaactttctctcgcgtactgatcacatcggcagcttcttctccatcagcaacccagctgccagcctctttcatcaatttactactggtcttgccgcttccatccccgctttttctgctgtggctggtgtagccgagggtagcacccttcatcatgcgtgaggtggggccgcccaccaggcgctttaagcctcctatttaacaagtgcgtccgctgtgtgcaggaaaaaatcaaccctgtgcaggagagcatgttgtaagcatggtcggtgggtgctgtcctacttctcgtgactctgaccgcagatgaccgtggacggcgcggggtctgtccggctttcgcgccaaaatgcgctcgccccaaccgccccagagtttccgggcctgggtcgagtcacgatgcttaaataggacccgtgcagaccaccctcccgacgctggacggccggaccaccctgcgcacgactgtcaaccgtgctaactggtcatgcttggatcgctcaacgaataatttcgttttttggcatcctatgtgcatcgtcctttttgtgcaatgaagattcacttgctgatcctatgtatttacaaacatgttcacaggctgagatacgagaatgcctgctaccgtagaaggtacgggaactcaaagcatg

SEQ ID NO: 1918 - DNA, 703 bp, Nannochloropsis_gaditana
tagccttctaagcgccgcaattcatcaactgaggcctcgcattccatctgactgctgtcgattttttgtggtggacgcgcggttctctcagagcaccgcagtatccgtggccacgttgcttttcgtcccttgttcgatgacatggatattttcccccggtaacaagacggccctctcagaagtgaagtagccacgcgtcgaatttctcctggtgccgcgaggaagaggcgaagctagaccttggcgactcgggcgagcgggacgagaaacccaattggagatccctggagatgtctggaagtattgagcagcaagggacttggatgagacaatcgcgggcaggtacctcccgggatcctgccgagtacggccaaaggcaggaggaaaagagaccgtcttgcatacagtcgcgggacagggacgtgtcgtagccagaggagcgctcaggggctggaggggcccagtacgcggcgccggaggtcttcagcgtaggctcactttcattcacttatcacctcacagctctttcccgtgccatcctctatggcgtcgtcctgactataaatctacaatcccaattaagccgctcagcagcaccccctgtcccccccctgcatccctctgtctacctccccacctagcccctcgcctcctttcctccctatctcctgctcaatttggcacctgtgtatctgcaacgatg

SEQ ID NO: 1919 - DNA, 703 bp, Nannochloropsis_gaditana
gctacctatttatgggcaagcaaaacgcagccgagtgatatccaattcctgctctgtgctcatgctcacctccctcgctgggagcgacgcttccgcattgtcacgagtgcgtggcgcgttgccgtgtcgctccacttgtcgctccacgcccgtgcaaggagcttcagagaaccctctttataaggacgggccgtggcaaagtatgacacggaggactaaaagagtcaccgccctttctaagctcatgtgacgttcattcagagcatcgtctttgatccggggcagcatgaaagcgtggcaggtattcccagctttctccttgaaaaaatacgatcatatgttttttgacccgctttactcgtgaggaagcattcccttcttgaaaattttctatcaaacgtaagtcaagcgtgaacgaatcctacttgcttgggcttttgcaaacatgtaggagattaacctccccgtctgactcacacaacacataaaaaagagcgcataatataaagtgaggggtcatgcgttccaacgatgccatgagggtactacaaggtgccactttggtggttgagaatatgatgcgtgaggtaggttggacacgatgtactttatacgtccgtggggaaaactttgactacacctcacaaaaatcactccgcattcccaatcccactcgtagaatgtgaatgcaccacgcagaatg

SEQ ID NO: 1920 - DNA, 703 bp, Nannochloropsis_gaditana
tccagtgccgcctcgcatggaaagataataggagcgcgtctcttggttcttgatacgctagtccttcactgttccattgcagttcacacaccacataccagtgaacacttgaggataaacacatctcctcggcgaataacctgtgacttgccaacgaaagaaagtcaacgtcctctgccgacgtgaatccctctgaagatgttcgcacgcggcacgtattctttgcttacgcacgagacacggtgcgcgcgtggtgcaaaccgatttaggtgacacagacctggcaggagtcccaccctctcgtgccacgcgtcccgtagctatatgcataggtccttataggttgacaatacccacagagagaagcaaggtacagagaaataccaaagaggtaaaactatgacaacaccttcttccccgagaaaaagtctatactcccctgcgtgattcccgccgggtggtatagcggctcggctcggcctggaagatacccaaagtgcgctattctgtctacacatcgagaaacatctatcactcacttatagcgcgatggttcggtgcgtcgagttagctgccacaacgtttcgcttgtttccagggaaaaggtaaaactctgtaccgatcactgttggacatcatcctcattgtataaatgacaggtagcttgctcttgtaggccttgtcgcggcttctataatacatg

SEQ ID NO: 1921 - DNA, 703 bp, Nannochloropsis_gaditana
atggcgaggcacaatttgtcatggttcaatctcaatgtgcgaacgcaacagttatgcgaccgtctgctcgttgcaaggcgagtaaggcaacagaacggggattactctcgcttctggccccttcctttatttagggttgcgccacctcttctgtttggtctccttgtctggcgagtcgacaaatgtatacagtgaaattgcggtatttttccgcgtatttggttcttgtctaggtgtgttcaaaaattttagcaaacgaggcagacggcgtgcatacgatagtctttatcggcaccatttcacaactgctttgttgtcgtgacatttgcaaagacatcctgttcatgtttcgcacaaggtaagggagtgcatgattaataccaacaggtggcctgggtgcctatggaggcgcgtactcactccttgagaagaggtgcgtgacagcatacagcaacgtaggaggggtacaatgcgtgaggcgaagacatgatgcgttcacccgatgtggatgccgccccaggcatatctcaagagcagaaagagatttctttccttttgaatgacgataaacacaggaaatggtatctgatgcgtcttcgcaggacttggcagcgatcgaaaaaatcatgaaacatcatttgctcttgaaagtgtgatgatagctcatttcgtatttcataccttacgtccactctcacagatg

SEQ ID NO: 1922 - DNA, 703 bp, Nannochloropsis_gaditana
tcggaatgattggaagacggaattagggggaaaaacagtgaacgaagatgcgtaaagtgaattatacgcgactgagttgctttcttctttggttgttcctttatcatgtgtttgccagcggctttcctcgtgcacgggaatgtcccgggatcggcctttccggtcattctgccgccaggcgttgcccgcgctcgtggctgctttgcacaagcgggacgatggccgcgctcgttctctttcacgaatttccggtccagagcttcatcgttcaatactcccatcataatcaacgggcctgggtttttgagctaggtttgaagccagcttatgcgtccgatctaggatcgtgtttgaaaagagcctatatgtcttaatcgtcatactgaccgacgccatgactcccgtgtccgtgggaggcacaaagctacccacacacctagttgccataaccttgaatgaattatatactgattcttgcttcggtgaagttttggagaatgtggcttggaaagtcctagctttttatctcagacatgcaatgctatcaggaaagatttacccgacagattcctgcacgtaccctattgcctctttgcatgcatcaccccgtctttcagagagtacctctttgggaacagcggccatattttctctttggctatcccttgtgctcatggtttctcgcccctggttgcacaggatg

SEQ ID NO: 1923 - DNA, 703 bp, Nannochloropsis_gaditana
ggaagggggtgaaggaaagatggagggagggagaaagagaggaagcgaggacgcgagggagggagggaggtagggagggagggaagccaggagggaggttagggagggagcgagggagcgagggagcgatggagcgagggagggagggagggaggaagcgagggaggggctgacatggaggtgagggcagtgcgtggtggctgtaccgtggcactcgcgttaaatcatacctgtatcaggggcgactcgtacgaaaagatctgtattgaactgcgaatgaggttgacatagtgaaggattgcaccgactgttgctcggaaattctcgaggatatggtaacagccacgaagcaacagtcgtaacattcacaagatcgggacacgcatagctcttccttctctgcgcagctttgttctccttccttttcacacattgtgacgctgtccatgatgagagcatcctagcgtagattatacttgccccagggtaattgtgccagcgccccaccaatcaggggacagtgacctcatttcgggctgtgcatccgtctgatacacacacagggctgagaaggtagaggcaggcgatcgcggctcatctttccctctcagggtaacgcacgcatcaaagcagcaagactgcgtaccatagaaggggctaagtggatcatcacatctagacgaaaaatcaagtttgcgaaatg

SEQ ID NO: 1924 - DNA, 703 bp, Nannochloropsis_gaditana
taagggccgcgtttggcgtggcagtggcggggtcgggctccaactaaggccgacaacggccggtgacaggagatgcgccctcggggaaatcgacccgggccttgaatgtgtctccggtccctagaacaagtaagtgcattacaccgtatcagaataccccacacgccaacgatgccagcgtgcaagcgccaagtcgaaagccggggacgtgtgcgtccgtccctatcactagaaaagcgtttgacgaacgaaaattgagacgtcatgtcagacgtgattcagtggaccagtcgacaccagactttcacgttgtacatctcagacgatagacaagaaagccaagcacatgtgtaaatattgcgaggtatcctgttgaaatagtcaatatgtatacatagagagagtgtgaagagacgagtggttataagctttccaccacgatacctccatcatagctttgcgtcttcacgttgcctactatcctcataaactctcacatcattttctcctggcatcatggtaaatcgttgggaaaggcagcttttttggttctggcgaaaatttggtcgagtcgacctgatgtttgtcaaactcatctttcgctgggggacagacacccgttttcaaatttcctccctcacacctcttgatcccaactgcgtaggttctagtccacagagcgttgcacacttctgggtgaatg

SEQ ID NO: 1925 - DNA, 703 bp, Nannochloropsis_gaditana; identical to SEQ ID NO: 830

SEQ ID NO: 1926 - DNA, 703 bp, Nannochloropsis_gaditana; identical to SEQ ID NO: 834

SEQ ID NO: 1927 - DNA, 703 bp, Nannochloropsis_gaditana
aatgatggcagccttttatttgtctgttcaaatgtatatgtgtgagctgcgaatcaactacagcggtgaatccaatgtccgacgagccgcaacgccgggaacatacgatttaatgcctgccgctcgccttcagctggactcgaacgccagcgacaggagcggtctgctcgcgtgctcatcgcccccattcctacccatccctactccgtagcaacacccctggacgacgcttaaggcctaaacgagagccggcacgggtcgagggcagccgagggtgccatgcgcgaaagtgtctgcccgcacaatggagtccagcctccgactgagcggacggggggcggcagcaggtaggacatgaaagtggttgggggttgcgtgttatctgccgtcccccgcgtactggcttcgtagggagggagacagagttggagagactttgttgttgcgggagcggctcgggattcgacccccgaggcgtgtattcatgcacttttgtcacatttcttggtgcacactttggaaacgtaccccaaggtgggttctctcagagctagcattagaaggcgtggccacttacaggtatgtctccgggtcctcgacattcctggatcgtgtgctcaatcacttctggaattgggccgtccaatggctccccctgtgggtcgcgcccaatctggttactctcttgggtctcgccttcatg

SEQ ID NO: 1928 - DNA, 703 bp, Nannochloropsis_gaditana; identical to SEQ ID NO: 836

SEQ ID NO: 1929 - DNA, 703 bp, Nannochloropsis_gaditana
agtctgccccgctgtaatgggcgactacaccttgcctaggcctcacagacgagcagaaacagattggttagtgcacatttacatgctgaagacacaggatttctattgtgagcgacaaaaaggtggacaaaagcggtcgcgctgggatggcggcagcacagggagaccggcggacccgaggcgaggcggggcgtgcgagagggcaccatgcgtggaatgcccttcctctctgttagtgccgcgcaagctcaggggcgcgccgccaatccgccagccaccgcatttacagtcgttgtcggggaagtgaatggattggtgagacggaggtagggagaatgactgaaggcaagatgcgggacatggaggggttgggggcccgaggctggctcatctctcatgtctcccggtgccggtcgaggcaggaacgcggcctttgcctataaccattcttttggttcccagggtgttcggattagcatgtggcatgtgcgcctcgatgcttgagcgatcaacacgaccccgggccccaagtaaggattggcttgtcctaagagactcggcatcttgatgcacagggatctcctgtctcgaagcccatctcttctctcgcacccgtctttgcatgagtgagcaatcactggcaacaatctaatttctcgcaatcatacgtgatttagatagtccgatcaccaagagagccatg

SEQ ID NO: 1930 - DNA, 703 bp, Nannochloropsis_gaditana
  misc_feature (1)..(582): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtagaagcttgatcgtactctatcgtgacccatctattagtactcacttataatctctttttcttctgaataaaaacctacttctcggaaaggtgcgcggaaacagactccagaaggatg

SEQ ID NO: 1931 - DNA, 703 bp, Nannochloropsis_gaditana
acgaacaaagaaaatgagacaatgaagaagtatgcctttgtggagtttaccttatttggttgttgcaagctcacatgcattcatcgaccatcaaaccttaacctcccaccagccaaacgtcagcctgagtgtacctgggcagggcggcgatggagactgggtctacttcttacatgttcagatgcgtttcattgatgcactagacgaacaacaagacctcgctgttcgtaatcttgcaatgcacttcctgactccagggcactagtagctgtaactcccagcgctttctttccttggggggcaagaactgcaagttggtatcgaaacgaggcatgcatctcgatttttttcgcgaattgtttttcaatgctggacgtggcgcaagtgtcgtatcgtgccgacgcgagttgcttggcaagatgcggcgatgaccgtataccaccctttcgcgaggccggaatgcgaaagcgggcattactacgccgacgcacttgacagcatagaggacaacacccaccgaggtggcgaatgcatgatgcatgctacttaatgaagtgagtggctttgttcaggacgcaagcaaagcccgcaagaggccatcgctccccttcttccagcgagagcagcgagggcagtctggactggaacagttgtactcgtttgcagctttacttaccttgcacgccaatcactccctgcagca

SEQ ID NO: 1932 - DNA, 703 bp, Nannochloropsis_gaditana
ggtacggagagagcatcctgactgcttcgactcccggcacccatgcacgcgcctgtcctgccaccctccttcatgaatgccgccctcccaaccctgtctccattcttccacttccacaacacagagagagctcccggtctcacgccgtcttcacggtcgtgttggagtcccgggaggtggacaccatggacgggattacccgcgctcgatgcgcgtcattcaacttggtggatctggcaggctcggagcggcaaggacagacgggtgcgtgtcggtccggacatccagtggccatagactggaccatgaaaatggcaggagataaaggccagcgtctcttgccctaacgctcgccaaccctttgaacattctaggtgccacgggcgagcggctgaaggaagcaagcagcatcaacaagtccctctcggcgcttggcaacgtgatcaacgcgcttgtctcgggccgcacccgttatgttccctacagagactcgcgcttgacgttcctcctcaggtgagtcgagatcatggcgagcatcttcatgcctcgggtaatctcaccctttctgctctcctccccctgcccgtccagggactccctcggcgggaacgcgaagacattcttggtcgcctgcacctctcccaacgatgaaaactttgccgagacgctctccacgctcaagtttgcccaacgggcgaagatg

SEQ ID NO: 1933 - DNA, 703 bp, Nannochloropsis_gaditana
agatcacgggacctataccacggtagaaccccgtaaatcagaaggacactcaaatttcttaatatttcacgttgtgcaataattaattgtcgtcgatgaatgcctgtacaaaagtgtcaaaagtattaggttacgcgctaaggggggtaggcgagaccgagattcccagggcaaattatcatttgatggatccttatacgtcggacaagcctttcaaacgatgaatgtgcagtaaaatgacctcctgtcgttgctctagctccgtgatgagccctttcaattgtccgttgtgacttatgcattagtaaataagagctcgccggttggtcgatctttggtctcggcggcaaattctcaccccgtctcaatcctttctttgagcgacgccacggtatgaaggccttcacagacatacaggatgccaaatgtatcacgctccgcgaggttgccctgccttttcgtgtaaatgcttcacgggcactaaaatgctttttagttccagctggcaagtgtgaagtgacatatcctagggcaggggtggatgcagacgatcagatcgaggttgaatgcacatctgcccgtcttgcacatacattctgtctttgttcgatccaaaattgtcccccaaatactacaaaatcaggacagtccacaggctacagggaagaagggtagacgcatttcaaacctccaaaggtttatg

SEQ ID NO: 1934 - DNA, 703 bp, Nannochloropsis_gaditana
aattctcccctaccttcttccgcccccccggggaataaaaagcttcaaatgttttttaaaaatgcatgctacaagaacaatcagtgcaggcctttcctttgaaaaaagaaagaattcgggctctttatgatcgacaaatttaatttgagatgcttctcttcttaaatatttctatttgtcaaaaaacagcgtttcatacttgcgggagtgtgtagtaaaaaatatgttattccgtcaaaagtttgaacacaaggggtaatgtaaacgaagcaatacttagcgctctttcggaaaatttgcctcgcgactgtcttttccccaaggagaaaaagcgaggaaggacgatagtgaatggaaagagagacgcaacgttggcgatccgacggcagtcaatccccctctgagacgccatggatcttgataaatgtctcattgtaccgtgtagcataagatattgcacctataggcatcgcaattcacctgtcaaagatacatagccttcaaattgtccgctcatgaacttagtaacgcattatctgaagaccttcccgccgcaccgtcaccgccacacaattcgttaggattctattgcgtgcactgaaccctggcccctccattacgacgcctgcagcttttgacacggcatttatcgtcctttcacgtggaaccctctcgcataccctgcattgctcctcatataatg

SEQ ID NO: 1935 - DNA, 703 bp, Nannochloropsis_gaditana
tgaaagttgaaaaaggaagtagaggataagctgtgcggccctctgctgaaaggactgcacttaaacgtgtcgaatcacgacacaaatcacaatcaaatgaagcgcaaagcacggggtaaatgtcatggtcttaaatttcggaccgacattttcatgactgtggttgagagtgatcctcattgcgcgcaatttactttttgaggtgagagcaacgtgaaatgcaagggaagaggctgacaagaaagctctccatctcgcttgcaccatgaccagcaaagcctctccatgcatgatagccagtggcatgtgctcacacactcgtacaatcgacactagcgattctttgcaattcatttttccgggcagacgggccagctagcagcagagagggaggaggttggcagtgcgtatcaagtctgagcttgaagtgggcaattgttccatccaagactagagatggtgactttcgatgcggtgcgatatcatacatgcattaccaccacttcgacaggaacaaatatacacctccgctgcttgtttggatccccttgcgagtacaaatctgtcagtgagttattcgcacgcatcctgagtagccccgcccggattaccagatggcaccctgtcggaatgccctcaccgtagccctgctcacgagcggcgcatttacacaagctttttgggtcgcgcctgccacaccatg

SEQ ID NO: 1936 - DNA, 703 bp, Nannochloropsis_gaditana
ctgggttctctcacgatccgtccaatgataccaatgccatggcccttacctgctctcgtcttgcttgtggggcttttgcgagcctattacccaagcttttcgtacttgctctcggaacaaatgcggcatgcgggggagtcccggaagcaacgccatgaagacagcaacatccgaggagggcgaccaccgccaacaatttgaccataaatatctgcaatttgaagggagcatttgaatgtcttctgcgaaaggttggactcatggctatgctggtccagaagtcaggtctccgcccccgtgtgtgaagtttaatggggctaggaagggggtacgcaagcgctgagctccctcggcccctgcaaggtgtgtggcagcagtgagagggggacgggcgagacacttttatgtgagcgatcaaggcgaatgggatgccctgttggcccttgcatgcccatatgtttgcgcatactgacaaagtgtgtagctaagaccatggcgtggccctgccagtccggtgaaggagggtagtggggccgctatcgagctcaggatatcagtctctcacagcgtgggcgaggaggcgatgccacaggcacacaagagggaaagaatgcagcggagcacatcatttgtgtccttcaaagttaagacatggactaatgcatgttgcacaatttattaattatgtacatcacctcatagt

SEQ ID NO: 1937 - DNA, 703 bp, Nannochloropsis_gaditana
gcttgtaaggtggtatcattcccattttacgcgtattattccgtccagtttcccgctcccagggtcgaggctcgtcgctagaaagaaagaaggcgagcaaaaaacacactgaaggacaaaaatgaaggctcaacaaagtgatgggatcattctgtgaatctcacaatcgacgagaagaacgtgcgcttttcgtcaaagtttgtttgtgaggcataccttcggacaagagaagtgcgtctggtttgggccatgcctagctagatttctttctccctcgtccactggccaaatcagaccaagacgactggtcactttcacagctcacgatctttaattatagcaacagtgctctttccgttggtagcactggtggatttggaatctccccatgaacggggcaaatttcatgaagcgggataaggaatggcacgaagccttggagggtacgtttatgggggcacgtgctttaatcacctatttccattaaattggggttatgagtccgagaagctcctttctttcttggcagagccaatatatgcagtgtagaaggcgagtatagctcttgtcatgcgccgcttcgtaatggaaggcttaatattcacatcccgctggcgtgactccagcatccgaactcaaacgagtgtccaacaaggataatactccagagttgtctcatacgcccattttcccgaaagccatg

SEQ ID NO: 1938 - DNA, 703 bp, Nannochloropsis_gaditana
gaagcttttcaagcatgagctaaaaactcgcaataagaagccaggaagacatttacagcagcagcacgagcaacaagagcagcaacgaggtccatcctcactttctgcaccatgtccgtccttagtaggaacacattccccaccaaagcaacagcaacagcaccctccgtcgtgctatacggtaaagcgtgacaaaatcaactacatgtacggccgcctcctcaagcaacaacagcagcagcatgctgctgcgagcgctgggaatggctctcgtgctctcgcagcctggggtgcagcgggggatctggatgaccttgaagagaacaaaggaatggaagaagacgatgatgagctggattttgctcttgcagcagaggaagaagagcactcgttgattgaggggtatagaataccatggagccagcagggggacgtgaggaagcgtgctgggaggaaaggcgagcgctcgaactcggacattgacggcaatgatatgaaaagagaacagggaagtcaggtcacactaatgtgtgcggatcgattgctgcaaaggagtctgcgtgtctgcactttgggagcaacacctttggacacgctgactctcagccaacccgctgtcgaagatgccgaggccctttaccaactcttgcgggcggtgacggatggttctttcctatccaagcctcttccgacggccacagca

SEQ ID NO: 1939 - DNA, 703 bp, Nannochloropsis_gaditana
attagacgtgccctggtgttacaaattgtacgctgctgagtctatgtaaaccaaaattaacaggtgtaagacccatctagagggcaaaggctcacgttgtctgtgggcgattgcccatggcctctgcggcggcacttgcatatttgcccccctccaccggggagcaagaggatgcttggccatgggcgctttttggtctcagttctgttggggcacaggaattgattctaccattcctcatattctgttggcttctctgtgagggacttttctaccttgtcatgatgttagtgcatcggcgcttggacgtgctcaccccacccgaacggtaggtgcgacggggaagaaggcggtccttttggtccgaaagctttggcttagccattcatttctctggctcgcttagcaatggatatatagatgagaaatcgggtttgtaagaggtaacacgcactcgcaaatcacggcgaatgtatcagtgttggggtgtggagcggacgctcatggcttcagagttgtctacgtgcgccttgttgaacttgaaggcaccgcgattacttctcgatgtaggcagcacgattgacatatcaaatttgttgattcaacatctgttgttgtcctaagccgtagagccattcattctctttccttcatcccgagtagaagtcaacatgaacccgagacgtacgtgcgaaaagttatg

SEQ ID NO: 1940 - DNA, 703 bp, Nannochloropsis_gaditana
atgacaggctttccaagatcctccaacatgaaggctaacgcgcttgcagagtaagccaatgtatctgtaccatgtacgactacaaagccgtcatactcaaaatatgccttctctatgtcagtggcaatcttgatccagtgctcaggccccatacatgcactatcggtcagaattgtccattccaacacgtctatctccggaagattgcggtgacgccattctgaagatgctaataactccgaaaggaagccaggacacacatctaatgcgccatctcccgcgtttggcttcatgatcagtgttcctccagtcacaatgaccaacacttttttggccttgttgtcatggcctaatcgagcatgcatacgccagtcaaggacagcttggactatagagtgcctgtaaagtgtgccgacagcttcgggaatgagcgacaggttcgatgaagacggtagtacaatcctttcgagagtcaatttacggttggatgctctgccagcaggtgtcgtgccaggagctccaacctgccatccgactagctagtgcacgagatctgtaaacggggtcggacccgctagccgttgccagcctcggcgatgacggccagggccaaggagacactttattcacgctgtccactgcgtttcgtctccttcgatactctcttgtacaggtaggaaattggaatcttcatgatatagca

SEQ ID NO: 1941 - DNA, 703 bp, Nannochloropsis_gaditana
gatcgtcgcaatacaatttcagcacacagaggtatggatgaggaacttgagacaacatctgacggagaatgcgccactgcatctcgaccaccactttcttttgtccttgttgaagtcgtgccggtgatgagcacagaggtttgaggaaaatcaaggcggggaataaaggcctgtacaactttggaaatcatgaagacagcggccacaaggctagaagacgccgcgaggcccttcatattggtggagaggacctgtgcatgagtgggggcggtgagggaagatacaggtccggttgagcctcgccagaccctcgccctttctcccactccgccgactcctcttcaagtgccccgagtagcaagttcccccgtggcgcccttaaaatgcctttctgccctccttcaagtgcctcccgtgttctgcgatctcgctacgagccgaaggcctgagcggccccgcgcgctagctgtactttagtgtttgttgggcttgaagaggtctttctgcttcgtggcgcgcggctcgattcagcatgatggttgggagggaagtctagcagcttgatacttgggagaagacgtgaagtatgtgttgattgtaaggggtttctcacaagggactggcattcagccttttctttgcatctcgactcatttttttatcattggcaggcataattgcatacgccattgacaaagttatg

SEQ ID NO: 1942 - DNA, 703 bp, Nannochloropsis_gaditana
tctttggcaaatttcttcagaggctgaatgatgtgcgcattaacgtcagacatgatgacaaagtttgccaaatgccctgctttgtgttctctgtctctatgtgcgatgacaaagatgagcattatggagtaatttgtcaatgtgatgtcgagagtgcgctgaacgtccgacactcggaacttccgaaatacagtgatagtcctgactgcaccatgctggcaagaacatggctgtactgcacttgcccttgtcccgtttggcgtccatcggaaggtgtctttttcaaagagcccacaaatcggtcctcacaaatcaagcttccgactggaacggccgtcacaaccaaagcagtacgcagatggttgcatggaggatctgaataggcactcgagggcttccgtgcacgtccttgtgctcaagcctaagacccctacaggtgaaggcatttttgcgtgagagggcagggctctgccagttcaaaagggcccgggtctcggcgacggggaaactcgctcgcagccgcacacgcgagcgagcggcggaacgacggtagggagtgtctctctgtcgaagtcctttgtctgtgtcgtctcaaaagtgaggctttctcaccagtgtagcgccctcattcaaatcctacgatgtgcaaaatttacaggaatcgcaagtcctcgaccttcatattgctgtcaccgtcaagatg

SEQ ID NO: 1943 - DNA, 703 bp, Nannochloropsis_gaditana
caacctcgctcctgcagccacgagggagcggagcgagccacgaggcagcccccgaattgaattacgacctcttgtcacgctcgcagcagctatactcccacactgctccccaatagcttgctggtcggccacatgagtacggggaagcggaaggaggaagtgaacgtgggaagcgtggtagtgggtgaggggcgagggcatggctgccacaaactcgggaagggcgggcccagaacgtgccagcgccatgaccgtttccgcccctttcccttcaagctccctttgctttacgacgcgaccttacttacttcccggcacgctcctgaatccacatttcgcccgtgagtatcattcgagcgggttgagccaatgtctatactgttatttactcgcgtaagttgtgcatgaaagctagcaacaaggcccatttgtctcctgtaagcgttttctttcagaattcttagggaagacgagaactgctcatatagtacacccacccactggcagcattaagcctacttcagcattgattgcgattggtggaaacttattttttgatcagcccacctcgttattgatgatcatggtcaatgcatatttttttctcgccttgccactccttcgcaagaccttccttgcttttaattgcatggcggaaaggcatccattctcatagtaatttgcccaatatcttctctctagg

SEQ ID NO: 1944 - DNA, 703 bp, Nannochloropsis_gaditana
acgtgctctactaagacttcagaaagtgcacgctgtacgtaacgaacaatggtctcttttctgtggtcaggaatgattctaacgtgtttcttattccatcgttatccagctgcttgtgtttgggttgctatcatgcattatagttccttttttatgttagcgttcagtttcagagccaatcgctgcttccttcttgacagatcgctcagactgcgttctcgttcgttgtttccagaattgaaggccttcttcatgccgcactccttccccccccttttctttccctcattctcacttttgcgagcgcgttgcaccacgactccgtgctcatcagcagcttaaagtttcatggcatttcactttatcgtttagagcgtagggaagaaactctgttgaatgtgcccgtcgccctgtaataccattagtttacttactactgaggttttacgcttacctgtcctgatattttaacatgatccgctcagcggtcactaagactgcttagctggtgttgtggtatgagatctttctggcaaaatttctaagataaaacggatgcctctccgtcaacccatgtagctctcctcagacttggtcttgtaatcctgttccctctcctacacaggttacgtcgccaatccttcccttgcggtctccgtaacattaattcattacaaccttagaatcgcgattttttgcgatg

SEQ ID NO: 1945 - DNA, 703 bp, Nannochloropsis_gaditana
gcagcgtggatgactgtaaatctttatcttacctggggatcaattattagtaatgcaaatggagcagttgctttgccattttgtacaatactttgtgaaggtttcgcgtcgttaattcgcgatggtgttggctcatgatggacagcggacatcaaatatgtgagcttttctcttgggtgtagtatagatcacgtctcaaaaaaggtacactgaaaggaagtaaacctatgctattttgtaatttaaagataagaagttctctatgaggctaagaagactcttcctccagggggcccttgagtggacattggttgggggtgcttcagacaccagaaatcgcactaatttttggccttctttagttttacttatttttggccttctttagtttcacaatgaagcattgcaggaaagtgatcttaataaaaaatggtttactgtaagctgcgttcggaacatggaatgcgaagtgttcgcgtcaaacgatgagggagcctgctgttagctcaatgcttgcgtacgcgtcccacagagtctgccgcttcaagtcttcttcatggattcttcctacacactagggctacattttacttctcccgtgcgtcatttagtgtactgtcttatctgaacagcttaaaagtactaaatcgtgacgtggaattgattgtcaacgttcgcccgccttcatcagtcgaaacggatg

SEQ ID NO: 1946 - DNA, 703 bp, Nannochloropsis_gaditana
ctccaactgctaacacagcccaggctgctatcaaagtgccaggtccacgcatcgtgatattcgtaccggctattgtaccacttatagaatgtgcttggatctccgtatcgtggtattgtgttgatgctgggaaacagaacctaacgatgacctcaatctgcccacgcacgatcttcacaagaccccttttcaagtccgctctgtcctttgaagtatgcttggacagctgtagaataggatacggaatcagtgtgagatgttttttgaagagcgcgtccacggtgattggaagtgggcatggcacaaatttaggtcgtgggcggcatggtatgcccatgccgggtgttgcagttgcttcaaggggtcccagccgggcgagagcgctaatcaatgcatcctcttgagtgataaatgaaacaaccaggataaacaacaaccaatctgtatttttttaaatacaagtccttccgtccctttccctggctccttccacccgaactaccttcttctttgcattgctctagaaatcgcggcactattcccgtcccatccggctcgtcggacgagtcctcgggctcacggcgcccacgccggccatgtgccttcctgggccggctcccacgcgaactcaccccctgctcatctgtcgtgatctcccctgtacacaaattttcttcaactttgccgcagagctaccgggatg

SEQ ID NO: 1947 - DNA, 703 bp, Nannochloropsis_gaditana
gcgagttgacgagtttcgggggtcatggagcaggtagaaaagcggacagaacactcaaaagtagcgcttctgattggtgtcaatggcttagtcaaaggcctagcgtatatttttttcatccacaagaagatcggccgcatagtcgaataatgcattcgcgggaaggtgctatgtctcgttactcagtagttatcgcactcgctggggcgggaggttcgcatgcttaacttctttttaactgaatactgtcaagcgatcatatcctgtcgaatttgcgatggaagggggagaggattatttaatgtcgcgtgtgcgaggggccgctctgtcgggccctcccggtgcatgagccaacgagaatattactagtagggaaggacacaggaaagccccgaattcccccacaagcttttgttgtgcaatcgtaaccgcagtgcgatgaccagacggtaaaatatcaaatgagcgacatccagctgcccactgctttcatggttgcgtttcccgttctctcattacagacgcacggagagaaaagcgtatgtgcgccgaaagctgtgcagggggggcagcgaggggcggtatcatgcttatgcggaggctcgccgggaggctggcggcacgtgtgatggtgatcaggcgggagtcccgcgagcactcgatctgcctcatccatcgcaattgtctctcaatgccacagcag

SEQ ID NO: 1948 - DNA, 703 bp, Nannochloropsis_gaditana
tggctacaccagcattcaacgctcttcctcctcacctggatacttgccctttacccgaccacgaccccgcctattgtactttaattggcttctgcccatgaactaagtctttgaacgactaggctgagtctgttccctgtgtcggatggtttgtgagaggaagaaaataaaatgaaaagaaatgaacggaacataaacgagtcagaaaacctctcctctgaggtcaagttcccagcacatcctaactcgaaaataggatggtcattgtcatcaagcctctgccacaaaaagtggcgggcagctttgatattcagccgtcctcgtttcattttgtctcggaatagcggcgcggggcgtgcgggcgcagcctgcctcatcctcctgcgtcctgaaagtctcaaccccctggccgccgcgctttcagccgctcccgtcgcctcactttaaattttccacgtcgccagaggcgcgctcttgaatggaatgttgcgcttgcaaacaatacggtatccgtgccttgtttgcagggacatgcgctgaggacgaagggggcgagcgtgatttcgattttgttggtgataacgcttccatcgccttccatggcgtcgtcttgagcaccacaatccatccacagtctaattgttggcctcttccacttagtatttcagggctctaattaacttgtgcgaagtgtaaacatatg

SEQ ID NO: 1949 - DNA, 703 bp, Nannochloropsis_gaditana
tacgacagaaacttaatcatgaaggaaagacgacggagagggaagaaaataatttatattagactctgcagaagccgtcatgtgctcacacatcaactatggtcttgtttacgccttgctgtctcgattagaataccattgtaaattgcaaacggggaaacttttataaatttcaagcaggaagtgtgtaactgtggcgcaaatcatctcactgagcccggtcgcctgcgacttcccgtatgctcacgcgctttcgtgcctattcgacttaacgtcttccccgagcatcatccatgtgagagttagttggctatatctcatgaggtcgccaattgtgtctttgttggaattgatagcgcctttattgcacatttcgccaagatcctctgcgtgttccgccggcagtgggatccagtcgagatccgcttggattatcttctccggtaagcgacccggaaatcatattcatctgggcagggcagggaccaaaattagagcatcttctttgtcctattccaatgttgggagtaacgtgactgtactcacgcgaggctcgtcatagtaccacgagaaattgggcctaggattagtttcggcctcgttcttcgcatccctttgcctttttggccagcgcaagcgagaagctcaacggaagcatgaagcattatgtttcagtcttatgcgtctcgtcttgtctcacagg

SEQ ID NO: 1950 - DNA, 703 bp, Nannochloropsis_gaditana
caataatcctcctcgtcgatcacttcttcgtaaatgtggcgttgttcgttctgccctgccgaccagatttcggaacagagtcgaggaccctggggcaaaatgatcgcagcgtcggtaggtgcgagcgatgaatgatgttgaaggccaatcatttccctgtcatgcgagccagtgagagtagatcttcggggggtgctgtcagacctccgactagtcctgttcccgcggtgtgccgtactggcacgggaggtagaggagcaagtcctcgcggtgtgccgtactggcacgggcggtagaggagcaagtgctcgcccaagggcctcggcgacccttcctccggccacggcctcagcgtgggcgcccccacctgcccgccggccttaactcgttcgctccaaaggaaggcgaccatgctctcagccaggaagacttatgagaaggatagagcgtactcgactcctcggggctgtgtaccttgaaaactcgtgctcggtttctgtacccgtaccaacatcgctagcatatagggacagcttatatattgtgtagcaacccactcatttgcctgtccacgaatgtcaattacagcttacacctaggcacagtcttcgtattcacggtgtagagtttattgcccacgtgcaattgttggggagcaaggtggcgaccaaactattcggtcatatacggcgttcgtttgatg

SEQ ID NO: 1951 - DNA, 703 bp, Nannochloropsis_gaditana
cccacactgaaaaacattcctttccgtttggctctctccacccgtgccccctctgacaggccgatcattcaagtcctccttttctaagcacgaagcgttctcccccccgccaattacaccttctctaccatgaaaactttttgtctcgcacctggccccctggtccaacactggatccggattgtatccgtttttgccatgggctggaacaccaccacgatcggcttccctgctgcacacgcggccgtggccattgcgacctccgcccccacgatgcatcaccgccagatgccacgcaggccgcagggctgctcgctttagcgtgcaacagctaaggctatggatgttggtgggagaggattggcaggttagagcgcgtcctttgttcctagtggaggaggtcagaggtggaacaggaggagcgcgggcttcggaataaacggaattgtcaaggcaacccgcttgcgtcccctagaatgcgctctagtagttgtcgcaggaggctttctgaccacggatcgagctgaaagtatcagcggatgcgcaacccgaacaaatgcccaccgggcgcgatgcatgcacagagaacagagagcccaaggaggactcgctcctcttcaccaaggaggctaagttagtcacccatccagtcgactggcttcacgccctcactgtccttttgacacattcattcacgcacata

SEQ ID NO: 1952 - DNA, 703 bp, Nannochloropsis_gaditana
ttgcggacacggtggtgcaatacgccgagcctacgcttctgaataaaggttggatggccatgaatttgagcgcggggagcacctggaagcacgccaagtacctgttcaacaacgccatcaccgaggcgaacaatcgaggcggacagaatctgatggccatgctcggtctcgccatccatgcttttcacgtgaacacgcctgccgaactcaggcgggcgcggaagctcttgggcgaggtgatccgccgccatccccagtgccccgcggaagtgcgcgtgggcttcggcctctgctgctaccggctgggagaggttgaccgagccaaggctgccttcaagcgtgcgcttgtcttgagtcggggcaatcgcttcgccatgctggccttggcccgggcggagctcgccgacgcggagccggacgagtacttggacactctggatcgcgttgtgaggatgcagacggccgcctacgtgcaggacgagaaggatcccctggcccttgtcagcctggccacctactaccttcacaagtggttcccggtgggggcgcaagccgtgcgggtggtggaggggagcgagaaggtggagttggaggccgccaggggggcgggggatcgaccccatcgcttggagcggggcgacctgatacgcatcgggcctgtctttacctgccgggtgttggacgtggtggacgtaggggggaa

SEQ ID NO: 1953 - DNA, 703 bp, Nannochloropsis_gaditana
tacagtagctatcaggtcttctcaactcaactcccaagtcctttctccgccacccatggcctgctccttttcctccgacgttctcccttaccttgacaactatcgacttatccatcttgtccgagataaccacacccaccaaggagttacggggaggcttgggattttccagcacttcatcttccccttgaatactttctgcagggacgtcgagatcggcggcagggctctctcggggggtggaaaaccctcttgagaaggccatcaagggactgccatggtgatggtgatgtcgcaatgaagctcgattacaatcgggaaaaacgagggaactgcttccgtcaaaggtggacacgaaggcggcgaggcttctgctggtgcaagtgagggtgcggcatggaggaaagctaatagcatcaggctttgttgtaaatttgaccgcattgccgacccaacgacggaggcctaggcccgcgtgtccaagcatggtaaatgcctgtgatgtataacaatttgtttgatggagaaatgttcatttaatcaagcagagcctgtgtccatgaccagcctcccccctcgccatccctgagcaaggccaattatcgcccagtcgcccccttgatatgtttaataatccctctcccacatgctttttagagaaaaacgtcactcttattttccctttctcctccgatcatgaagc

SEQ ID NO: 1954 - DNA, 703 bp, Nannochloropsis_gaditana
aggttaaaaaggaagagaaccgtcataaaaggtgtttagaacacatgtagtctgtcctcccccttcctctcgaaagagtcggtttggcaattgaaaagtaaaccatcctcggccaagcacatttacataccttgattggccaccaccctagaagaggaaaggttgcgatacccccctggattttgccggtgcccccgcagcctctatttaaataggccccgtcacacttcggaaagtttttgcagggaccagcagacttgatgacagtgtctgattctgccgaggaggtgtcactggacactgtcgaagaggaagcggccttttctagggcgtcggtgctcatgaaaaggatggagtgcgttctccttctcacgacaacttcaggagagggcttcgtacaaacaatgaaggcctccgatagcagcatgctagccagcaatgagataaccgcaagcaatgaaagcgtatacatgggccgtatagggaaaggttgacgtgctgtactctttagtatcacagcgtaggggaggggggagaggaggtcggagcgtctccggctgggctctgtttcattcatgacgacacgaactaggtgagaaggcatgtctagctgtttagtactatcagggaatcacatattaaggttcaaggtctgtttgtgtgacgcgcctttccgtagaagttctggttgtgaacaaagact

SEQ ID NO: 1955 - DNA, 703 bp, Nannochloropsis_gaditana
cttggaagcaggaggcgttgcagagagaaggacgacaacgtcacgtggacttgcggcctgagcgcaacgcgatcacacaaatcgcacggcagatagggtaggtggaaaaggcatgggtaaagaacggataggaggcagtgctcagaaagatttacgggtgcaaaagcaatcaggcgtagtgtctcctttccctcaggcgtggctcaccctcggaggggcctttcgttgcatgcctgtccgggatcgaattggccgaccacagggtgacattaaagaggaaatgcttccaaatgaatccgtaacttttgatccgccgcattgtcatatacccccccgcaacgccatccttacccccggccctcccccccaggcaggaggccacggtcctgtgcttcgacgagtttcaggtgacggacgttgcggatgccataatcatgagccgtctatttgccgaactctggcaggggagcggggtggtggtggtggccacctcgaataggcccccggaagacctgtacttgggaggcctgaatcgaccttacttcctccccttcatagacctgctcaggcggcagtgccgggtggagtccatggagtcggagagggatcaccgccgaggctttgcctggcagcaagggaagtatttcacccctactgtccacgagggggtctcagaggcgaagaggagagttggagaggggga

SEQ ID NO: 1956 - DNA, 703 bp, Nannochloropsis_gaditana
agtgtagtagacgaagactacgacggccacaaacaggagaaaagctcccaccaattgatcttcctgtgacggaattaagaacccatgaatatctcggtatctgcagttggagaaatttcgaactgtcaggcaactcacccccattcacggcacaccgggtcctgattttgtcttgttcggctttcgcgtcgctcgttgcaactcgataggcgctacttcctgccgggggagttgaggagtccttgaagtcagggggaagggcacaaatacattcccgccaacctcccactcgtgctggcatgtgcatacccatcgtaaaatgttgtcttccatgccatgtcttgcaccggtggggagccccgggacgccacgcgtgtgcatctaacatgccaggcaggggggagtcggcgattggaagatagatccaggctcgcgtgccgtctgctccatcacgcgcttgggctgcgtccattttaaccacggacaaaggtgccgaggccttgccgggcacagaggcagattaattacaaagcaaaatacaacttgaagcggtttattacatcgagaagcgactttcggtgcctcacggctcgactggcgtcgcaggcacgcagatcgtagtcagaccccccgcacagagggaaaagccgtcctgcgcttcgacatagttttctccttcctaacctaagaatcaccacccatg

SEQ ID NO: 1957 - DNA, 703 bp, Nannochloropsis_gaditana
ccacaatgtgggaagtaagtttagcgattcaggcgaaaagaagacaaaagacgagagcaatacgaggaagatgtttgcatcgcatgctatccccggttagggaggctccaaatgcgggctttatttccaatcttttactgacctgatctcaagcgagcggtgacgtagatcctcgactatgccctagcgaggtgcaatgcaagtatccaccacgacagcagtatggagaccaggcttaactgctcccctttttaaaaaatgtcattgatacatactaaccgatttggctgcgggcccgcacttgaaatccggttcgcggcctatctcgtctttgcacttgcgtcagacgccgggacttatcccttcaatatcagttacattgagaaaataagggatttcgtatgacatgcataactttgttgggtgtctacttttatcaaacagcgagcatcaccaactttctttcgtggacggcaactattgcagtgtcttggctcataccgcggtaccatacccggaaaaaatgttagctgagcactactagcaggtacgcaactcatcggtttgttctcaagcaaggcattaattaaccgtagttccatcctttcattccgctcgacgccgattgtgacaggtgacttgggagtccagcttccctttctagcgtttataactcatgattatgaaacgtcatagcaccatg

SEQ ID NO: 1958 - DNA, 703 bp, Nannochloropsis_gaditana
tcatttcctggatgtagccaaggcgggcgagcttgcgtccggtgcagcggttggggtcgcactggtcgaagtcccacatctggagcttgatgggaaaatgcttgcgctgatgctcccaggcgcccatgctgctctgtgcgttttcaaagttcgtgccaagattcgcctcctcgtcatggacgacttgccccggggggaggggaaagccatccgagggcggcccgtcccgatactcccgtgtcttgaaacgagaaccgcggtggtggtggtggtgactgcccccgctgtgaccaccgccgcgtccttttccaccgcgccctcgcctgctaccggaagtggtccttccctccacagcagcgtcggcttttcggctgcatttcatgctgcacttgtgctaatagcggaacggcaagtcaaagggaggtggtaggagcttggcaggtgacgtgatttcccaaacttcaaggctgaattaaggcccgtggtccgcagtcaggatgcgcttagctgtgcgtacatacaatagaaatatcaggagcatgtcaatttcattgcgcatagtctcgcaaagaagcgcccaaggtgggttccaacttcgcatttccagcctcctatcgcccggtcacgtcaacaagtcgctctccgtctcattcccatttcttcaagcctcattttcttcctgccactatctcacggcgctcag

SEQ ID NO: 1959 - DNA, 703 bp, Nannochloropsis_gaditana
cggccgcaacctccgcggcggcctcgtccataacctcgctgtcgatcccttgccgctccaagctctcccagacgcgcggagacaccgtgcccagcttgacggcggcgacttcatgcacggaagcaggtgacaaaaagatgaaagcaggtagaagaagaagaggcgtcatttttaaaacgcttgctctttgtttcctccttgtcaagggaggcattgcgatgtcgtgcggaatgaaaattgctggagtggaaaggcggctttctaaagtgagggaggtcgacgacgagtagtgtagctttgcaaccaaagaagggaagcctctcgcgggcgttctgtgggcagggtgtgcgtaaagaaggcaccatgcttgtgagacgagtcaatgggaagccagtgggaagtcttccacagttcgcgatcgcccggatgccgcccttgcggcctctagctagacatggcattgcttgcgtgctgctgacctcaggtctcgctctctcgccgttttacgccgcccggcttggcggcgtcaacttgactcacccgtccttctcgacgacaggtcgcgccgggacgcatgcatacttcaagacaagtaaatcaatcggctgacctccagtactccacagtgttgtgggaggcggcctttgacgccaataaaaatgacgacgacacggaggaggccgacctcagcgacgaagagatg

SEQ ID NO: 1960 - DNA, 703 bp, Nannochloropsis_gaditana
acatcggcccagcattgtgtctcctgccagagccaaccgcaaaattctgcgcggatgaattgtgcgcggagtatttggtggcattgttgtgttgctatccgatgtcgaagccacggttgaagctactgtgattgctgtagcagccgatggtgcgtggtgactgaagaaaggagctgataggacgaacgagaggagaataaatccagtcagccttgtaaaaagtatagaaaaaaaagatgataatcgcgaaggactcaatctcgaacatagtgggttacgcaagtctcacaagggagaaatgaacctccccacaggcgcgcgacgtaagcactgagaaagttgctgcgccatggccccaaattttgcacaatagcattctgaacttccagactgtatattttaagcagtgcggggtgatgcacatcctataagtaccaacgacagtgcacacacaatccccacgcgggctttgcgggctcgacacgtaaagaacgcgcgcggctagttctttgcttcttttccagcgagtctgggcgactggtatttgctgacgaaaacttcaaattaatgcccgaggcccttagccttaccccccgctccggccacttgccaggtgtgtgctttcatacgccttttacgtcattgcttaagtaagtgcgtctcctatcattgcgccctgtctagacagcaggtctcttccatg

SEQ ID NO: 1961 - DNA, 703 bp, Nannochloropsis_gaditana
ccctaatcacatatgaatgaagttgggaggcacgaagtgaatgattgagtgaacatcgggccgattgaatgaccaagttggggacagaggaaacctcacaaaagttgctgagaaaaacatatgacgcaaccaaaagagtcagagatttcgaagaaagatctaacaacaagtttagctcatcttccttaaaggtggcctcgttttgatttgtgcgcgtaggcatttaattttcgccaactcgtcatcgcatttgtcaaaaagctgcgaggaacacagcgcggcatcatcccacgtcgaggctgacgagacgcagatgggcgaccgcaggatattgcaatgatgcaggcttatcagccgatggcgactgcttttcacgactgatttatgttttgacggcaagtttagtcgttcccctcgcacgtcgactcctggggtcgtgttgcagggcaatgagtgctcttacccacatcgccccatcgatgccacccctcgcgccggcgctacttaatgcaccttcatctttgaagcagttcgccagggacatgtaaatgcacttataaaacatcaaaaccctcgggatttgagcttttgagactggcttaatggtcgtctttgtcgcttacggaatacctcctccccgccccggcacgaagttttcccgcaggcccgcccgtcgccattgttgcatagtaacaacattatg

SEQ ID NO: 1962 - DNA, 703 bp, Nannochloropsis_gaditana
tgtacttttcctgccccgccgtgtcccaaatctggactttgacagtctgtccatccagctcaatgactttgctcatgaagctcgctccgatggtgctctccgaaaagggtttgaagctttgcgtgacgaagcggaggactaaagaactcttcccaacccctgaatccccgataataacaagcttgatttccctgggacgggcagccatcttttttcaacgcaacacaatcgctagaggaatggaagaaaagaagcggggacatgaaaagaaagaagaaggcttgactcaagtcggacgtgtacggttcgactccaaagtgtagccgtgaagtcggtgtctgcgtgatgaactcgccaggttcacaagccacataacaaatcacagaatgcagggcaacaacgcagcaatgtccacggcagacatttaacaaactaagcatgaatagaacaccgtgtgttcttaagtctaagaacactaaccagtataagccgtcgggcgaggccacagggtcgcccgcgtccaggcaagaggatcgcgcctatcgggcgcacacctttgctttcgatcccgcttttgccccacaacaagcccaccttcccatcaatctgccatacagtaaaacagacaatttggttgcatacttatttgctgggtggcagattcactcgtgaacttggcctatctatttccccgccagccatg

SEQ ID NO: 1963 - DNA, 703 bp, Nannochloropsis_gaditana
tttggagcaaccggtctggcacccaagggcatggagtctcccggggcctcgctccctggttcctgcgtggtcgacagcacagacacatctcgctgcctccacgatggccgctgaaagcgtacgtctcctccttgtgatggccgcatgggcaaaacgaatccgtggacacagcatagtgtcaacgtggcggtcacgtacagtgccaccagaaaagacggacgaccaaggtcacacatgaaagtcgactttcgggattcagccgcttcccttctccgacaagatgccataacaacgacccacagcgctccgacagggaccctgtggttttcagggttcggactgtggagtgaaagatgtttggtgaggggttagttcggccgtcgtgcgggggccaaccgagttgtccaagcccgtcccgagacgtgcgcgtgcaagagccgcccgcggtgacctcaaaggacatgtgagaattgtttgtagcatccgacactcgcaagtggttatcaaatgcggtggtgaatgtatggacatgtgctgtgccgcaccggcaaggtcatgccatgaagttcaaagggggacgttgcgggccggcagagccgacatcaagcaggacgagggggtcgtacctcggctggatctgacgggcttcttccctctctttgtcccccgacggtctcaaaaaaacaagcactgaacacacagg

SEQ ID NO: 1964 - DNA, 703 bp, Nannochloropsis_gaditana
aaaagaagagaaaacccacaaaacattcgacaaaaagcgcgagccaaaaataagtacactcttcttcaactcggtttgcgccattccaggcggtgaatacaagagaggtgagtgaggcgagcgaagcgaaggaggctactcaacggaaacctcttgcaggagtagaagtacttcaacgcaatcttcgaatttgagatttcaaattgaaccgacgtaaacgacgcgctccttcagaacctaacaacgacgaccatttcgcaagacgcccaatacatagcctacaacgaaaaacgcgttgaaagtgtaaagtataaatgcatgactgtggcgttgtaccatgtgccccggggtcttcccccgttcactacgacacaatttgtaactgccgtgagtggcgtaaatggtgctgaccctgtccccccacgtctctgagataggatgcacaacaaccgtcacgcaccgagtaaatcttatgtttttcttcgataaaaaaagtgtccaattctgggctttgtaggatacaagttacgagatcggactctgggaaccaggcctcaaggcagagggcaaagtcgtacccggaagtatcttcttccactttcatgaaggcagcgcttggggtgtgtctcaaaactgtcccgtcgttcctgtctccaagcaaagatccaggcaaagactcaccaagttcacacactactgtagg

SEQ ID NO: 1965 - DNA, 703 bp, Nannochloropsis_gaditana
  misc_feature (387)..(396): n is a, c, g, or t
cttgtttacgtcaggcgccccgtctggctttgactcgtagccgatcagctgccattgaagctggtacagcccgttcacgaccgtccttgtccaggatatcacgttcgacaaggccttcatcaaaggagctgcgcctcctccagacgcccccgcgtccccgtgtggtcctatccccaggcccaggccaaccccgcccctcgcatcgcttcctgcctctccgccgcctccgtttacggaggggagcatcgctagttgcgccgtttcctggaggagggagtgggagaccaccggcatggccaaatcgatggagttccgcgacagggtgtgtcccacgagggagatgtcctcgtccccgcctccgttaacccctccaagcccccccccccnnnnnnnnnnccctcggtaccgatcccgcgcatgaaggtggtgatgatggtcgtgggcaccaggggggatgtgcagcccttcgtcacactcggcctcgcgctacgggcccaaggccaccgcgtccgcctggccacgcacgccatgtaccgacccctcgtcgtggaggaggcggggttggagttctatcccttggggggagacccgctcaagctctcggcctacatggtcaagaccgccggccgcgtcttccccttcaagctccccgaccaccaggagatgaccaaggacgtgcccgagcagcgggccatgctctcgg

SEQ ID NO: 1966 - DNA, 703 bp, Nannochloropsis_gaditana
cacgccatgtaccgacccctcgtcgtggaggaggcggggttggagttctatcccttggggggagacccgctcaagctctcggcctacatggtcaagaccgccggccgcgtcttccccttcaagctccccgaccaccaggagatgaccaaggacgtgcccgagcagcgggccatgctctcggagatcatcctcagcacctggccagcctgcacggcccccgacccagaggaccctctcaaacgaggcttccgcgcggacgccatcatcagcaacccccctgtctacgggcacgtgcactgcgccgaggccctgaacgttccgcttcacatcatgttccctcagccctggagcccgacgaaagccttccctcacccgctctcgggactgccctaccacgggcactggtgcaaggagaattattactcgtacctggtggttgacaagttcctctggctggggatccaggacattgtgaacgagctccgggttgctcgactgggcctgcctcccctgcggttgggcgagcatggcggagacttgttgaaccggtaccgggtccccttcgcaaagatgtggagcccctgcctggtgcccaagccgaaagactggggccctcacatcgacgtggtcggccacttcttcggcccgcagaccacggggacaccccccggtgccgaggccctccaggcctggctggagcccg

SEQ ID NO: 1967 - DNA, 703 bp, Nannochloropsis_gaditana
cctggaggtcgtctgatctccttgactttactctttccccccggaatttttagccatatagatgaggcgtataactccaaaaaatatcgcggtgtaaccagcatggcttagcgccgcggtgtgccctccgcgcttgcgacgtggcacgcggctgccctccccagaagatctgcgcagtcggtcgatcacaaacatggttggacacttgagttgctcctaaaagcttcccacctctcttaatcgcctcaaaatcctgtataaatcagtatgaatagaagttattttatgttgatcacgaaaaaagcaggttgagtctattgctcgttgtggtagcagcgccttcagcctcgccgcagaagatactcgtgagcacggcttgctaggagtcaggcactgcatttgcggatcgtggacctgccgcaacttgctagtccggttatttttattaggtttaggagtatgcacccaacgcgtgactgtcgggcatcacggtttaagtgctttgcctgagaaagaggaagcgtgagactcgcccttcgccctcccgtcgcccgtcgcgcctcctgcagtgccactcgctgctacgagcagcagtacgactttgctaccacacgcactgcacctttcctcaaccttcccaaactttcgcgacttacgtagtaaaacgcatggaccgtaccatctagatcgtcgcgtcagcatg

SEQ ID NO: 1968 - DNA, 703 bp, Nannochloropsis_gaditana
aaaatgaaaagaaaaggaatgtacaggcactgtggccattcaggtgagaggtgtttacattgattttctaccatataccatacttatgtttgcgtaggaaagacaggaaaaaagcgcgagtaggtcgtgagatcgtcatgtgccataatgcatgttgcgccactcattggacgggcatgatccatcgccgggcggccctcggggacacatgcttcggcgcccggaataaagtggcgcgttcgaagcgggcggaaaagtttttgtagaatgatccttcgactgcacatacccttcaggaggattttgagctctcgtgacttccactgaggaggccacgtccggagtgccctcttttcttctttaaattgcttacacaataggcacatttctctaaaaaagactgattgtggctggcacgtgagttggggcagatctcctcagttcgatttcagcacgtgttcgcagccacttccttgctgatagcatttctcgcccctggaaagtaacctgtcccgctaaccattgcctttcgcctttcattttttttggggggtaaaaactggtcctagatttgttggctgaaaggatcatgtgatgtctttgatgcctacgttcctatatgagctgtcatgcgcacgagcatggttattccatggtgagacttgattttttcattttgacaggcaatcacagagtttctatg

SEQ ID NO: 1969 - DNA, 703 bp, Nannochloropsis_gaditana
atcatcagctggctgcggcctctttgcctccggacattggcagagaccgcccgatcctacgtgtgctggctgccaggcacgcccttggcctagcggcggacgtgcgccgcgtgctcttggtggcggcggatggcgctgtcaatagaagaaggattcacgaggtatcaggagagatggagtgtagtagagagatggggcgagtgtggaggtaaagcgtgacggcgaggagaagaggccaggcaggtgtgcgggcggacatttatgcgctgtatctcaagagcatgcgacagaatgttgtatggctcattaacaaacatgactcgttacatttacgcagctcgttggcggcctgacaagcgttcccggggctcctgcctatctgctctacacagccgcactgctcgcatggcccgcgactgactcgcctaagggggtagttaacggcctcgcgccgctccttctccgtgaatttttcacggccttagcagcagttctggatttgcttcagattttaggtgtgtcctcggaggctgcctcagggcctggctccgctgctcgctgtggaccgcggaggcccatgcctggttcactctctaccattagcttgctgcttgaggtgcgttgtggcaagaatgactagagtgtaatgcatcaaaagcagttatcgtttttgaaattttttatcgtcattctttcacaggca

SEQ ID NO: 1970 - DNA, 703 bp, Nannochloropsis_gaditana
atgatggtctcatttttcttttcctttttcttaacatattctggaatcatgaggggttttttgggacgtttctgcccatcttgcaggtacaccaaatatgcctaacgacacggcacttcacaaatcatgtcacaacggagacctagatgctgtacagcgtatgatagagggtaaagaattcgacgttaatgaaggtatgtccttatatttgttgggggtaagggtggattaaagcaaatgttgaattgagatgtctaaagtgggcagtgccttgcactagttttattccatgtcctatatattccacttaaagccggagcgggggacagaagaccgcttcatcgcgctgcaggaagtaatcatattgaggtgtgccggtaccttatcgagaggggggccaaaattgatcaggtttgtgagcaagagtgcggtggatggaaactcttacaaggggccaaatgtcgcggacgagcaatatgctgcggctccatgtcctgctcactgcttttcaaaaattctccttgttctctgcacctcagatgcagtatttttctcagacttacttttccgtgtacgtttcttgcaggcagataaaagtggacgcacagcgttacattgggccagcattagcggacaccaggaaacggctgagcttcttgtagagagaggtgcgaatctcatggctgaaacttcttctaaaatg

SEQ ID NO: 1971 - DNA, 703 bp, Nannochloropsis_gaditana
cggcaaatgccgagggtgttttgtgcgcgcctcccatcctgacgatgctagagccagttgggagctcgacagcaagtaatgcgatactcgggacagaattcccacctaggctgaaaagtaagtcccaaaagaatctacatatgaggcattttagcctatgaatgactgcggcaaaacggcttgcggacacgtcgaagacaagtgggaacaccgtgccacacggggagaggcagaccggcaggcccatggcaggctcgggcttggagcaagttgaagttccgttaccgcgagccgcctgattcgtggcacttgctacgtgctccccgattgccccgcccttgtcttcctgccgcgacgcctgcgaattcatttatctgaaagtcttgacacagtgaccagtctcttgtggttgagcttcgcaaccaagacgtgcttccttcactcctcgatctgcaatattgcagcttgacggggtcacaattcaaatactcggcccttgaagcattggtctcatgtcctccttgaattcccaagtgagactcgaaaacaagtcaagaacatgctaacagatatcaatatactattctgtctgcaacgtcgtaagcgcttgcatctgttgaccccgaaactgcctcatcaaccccaactctcgtccctaacatgaacaaattagtgaagcccacaagaacctttttatcgaatg

SEQ ID NO: 1972 - DNA, 703 bp, Nannochloropsis_gaditana
aggaaaaaatgctgtccagacatgaattgtaaagatcacggcgaccggtatggttttcaaaaccattcgagctctggcttgacagtgaattgttcattgcttccctctccttctgtgctttacttatttttttgtttgctgccgcccgctgcccgcgctccccgagggcctcgccaaagctcaaacctctcaagagtcgaagcaacagcacgcgtagctacatcccgggatgtttcgcagagcgcaatcctggacatgcaccccttgcgcgggcgggcgagctgtcacacttataaactgagctgtttttatttcttgccagccctggtgtggaggacagggtgcaaatcgggaaacatcgggaatagcaacgttatctagatttagcagttatcaagatggggtgggcaaacatgtttttgaggtcaaaattttcaattagttaaacatcgggtaaccttctcatcctttgctgttcgggccaaaaccgttctcgtaccatcttctcgtctgcttatctccgtttagtttttttttcttctaaaacataaatgaatgaccaagcccccaacgtttaatggaatgaattacagacctcttacacaagaccaccccggcatgtgtctcaggtcaaataatcctgttcgattgggttacaagaagttgagaaagccaatattggagacacaagtccgcctgcatg

SEQ ID NO: 1973 - DNA, 703 bp, Nannochloropsis_gaditana
tttgattgcagaaattgatcttcaaatgttttgattgtctgtcgaaacgtatgttacagtagcaggtctctgagatccgtagatgcgagcccagtgcccagaatcatgttatcaacctcctgcaagcaaggctgcagggacgtggcgggcttggacatgcatggatcttgaacaacaaaacaaggtcaagctgactgcaagtctttgaaagaatagcgggataaacacagcaggtttgtacgacactacaggcctcgtgaaatggccatattcctacattctgtgaacatcacgagatttacgatcatgcttttagcgatcaagacgagtgatctgaaatcgtggagcgacacatgatgtgcaacgtcgaatcccacgcacactcgtgtcgcgtcgcttaaaagctcacttcttgtaagcactaggagaaggaattgctttctgtgttcaccggtcacatttcggcatggttcgaagcggcagtgtagaagtcagtgtggatcgtaggaaggggcactatagactgagcggcctgcccccgccttacaaacggagccccgacgacgcatgcgccgagacgaatgatggctgatcccccgtatcaggacgcgtcgctcttcgtctcgtgcttgtcctgatgccacctgaacccgcaacacgtccggtctacacatttatacaggtcttccaattcctgtcgatg

SEQ ID NO: 1974 - DNA, 703 bp, Nannochloropsis_gaditana
ttcttcatagatcttctgctcttcctctgctgtggctttctcctccatctccgccaagcgagccatttccgtgcgtcggtgcgcccgatatatatggaagctgctgctgctagcccccgctgtacttcctgtgacattttccagcttttcaatctagagatatgttcaaaggcgtgaaaaggtgtgatgtaaacagaagcagagaaacccactcgtgatttggttccattgttacgacaaagaaagaggcgcgaagaaagacaaagaaagaagaagcagtactcggggcccgggtcgtcaagtcaacacttgcgccggactatcgcgtgcgttaccgtctcctcctattttcttttaccttgctgcgctgggggttgccatcgcgatcctcaccgccatcataggcaacactggctatcttcgggttgttatcgccgtacgcttgtacgctagtgtagcgtcccatgatacaaaggatgatctcttggaatctggaacacaggagatggtggtgagcgtgagggtgtgatttttgcggcggcctgtgtgtgcgtggaagctgtgggaaagccagtcaaggactcgctgaggtgaaggagcgagcaggaagtattcgtagccgcgctatctcacaggacttccgcctcgaacttcttcgaacagggacattgacgggacagccgctgcttctgtgttgctgatg

SEQ ID NO: 1975 - DNA, 703 bp, Nannochloropsis_gaditana
gatcgccgcctcaggcgccacaggcgatgttcgcagtcgggtgacgagaaatgtgactcaccaagtcttcggccagacagcctactccccaggaaatatgctacatcgcatggtgcggcggcggccctgggtgtgtggcttaacagagccggcgacgtgcctgcgattgcagcctgaggggtcttccggtactgcctcagccaagtttccctcttgccggggctgccgccatcccaaatcccatacattttctaccggcgcggacactgccttgagtatcgtgcggacgcaatctggaaatcgcaagctttctgagattctgaatgaagctgagaaagcatggcaagactcacagtatccgtcgaaaatcaccttccaactgctgcatctccatgacgagcttgaagaccaagatacggacggggcaattcaagctactgcgccgaccttgatcgccactgctgagcgcaatcaacttctcgatacggatttgatgacaacggaaagaggcaaccctgcgagggaaaaagaagagctctcatggaagcacccgagcaccgcaacatgcatcagcgtcgcccttccccacgcccaggaggttgtcctctttcgatgccacgacgcctcattccctcaactccgacgcaaaggagtacaaggtgccggaagtgacggtgcggatgcatcagcgttgcaggatatg

SEQ ID NO: 1976 - DNA, 703 bp, Nannochloropsis_gaditana
acaatcgtcgtaggacatcaaagactcaccataccgctcctacggtatgctccattctgaaataacctcccccccctctgatcgctcgttccctcccgcggcccgaacccaagactcgatgactcaacacactccctcgcgccgcgcacgacaacaggaagcgaataacaaggaggaggggtcgacccttcatcagtggtgcttgtgtgagacgcgcctctgttaggtgagtgccctggcacttgcgaggttcatggaaaaccacaaaactgcactacagctctcctgataatgtcccacacattatttgatctaatgatctttatgcataacgtacactcaaggggtttctttacagactgtcatgcatccaccacttcaacggccacatcctgactgtcaacacgtaagttttgattttgtcgtctgggagcagtgactgcgatttccacaaggctttctgtcagtccaagacaaaaaattaaacattagtgttcctgttttgcgcgctcgacaccttcgtgcttgtgctgatcgaaccacatttctactgaagcgctggtcgactgacctgttcgacgactatctgctaatccctgagagctatgtcgaaactcccctctccgtcgataagtgtaagctgtcaacgatgatgatgagatgctcttctctttgacttcgtggttgcttaccacacgacatg

SEQ ID NO: 1977 - DNA, 703 bp, Nannochloropsis_gaditana
gatgctgcagtcgccttcgcgagggccgcgtgatgcatgggacggacaagttgagagttcgaaaacagtaagcgtggggagcgtcgcgggggcgcaaacagcggaggaagtcatctctgtgttattcaggccaccagcgcgatgcacacgaggaacagctcactgactatatggcgtagaaggttttctaactaggagcttcgtcaatgctggaatcttgctatgttgcttgtcacattgtcttgtgtagcctgctacatggcgacgctcgcttccagagtgggtggcaagctaccttgctctacctcagtacacgcttgctgtatcaccttcctgctctccgtgatctgatcctccatgtatattgtacgcatgaaagcatgtgtctgtgtaacttgtcatccatgcgatacgggagtttgcgtttgtttcacttttcactgttattgcatggatacgcgaagagatctggttaggtaggggggatgcacggtgttcaaggtcgcgtgcatattcttggctcaaagaaactcgaatttcaactcgtctagtgtagctttgtttttggcttgacgaacaatagcaattcatgtggagtcgcctctattatggctcttcctgcgcaaaggaaagccattagctgcagggggtggggggcaaatctcacttcacgcgagccaacgaacacctgtgacactctaac

SEQ ID NO: 1978 - DNA, 703 bp, Nannochloropsis_gaditana
tccgctttggttgttgacgagatggcatgctcttgatgcccagcgacctgtcgtatgcggcggccagtagctcctcaaactttgttgtcgatagtccatgtaggtcatgttgtcgttgaggctcttactcccgtaggttcataattcgattaagtgccgtgagaacatcctccgtggatttcataggggactcttttaagctgagtcgagtggagggcatccgagtaggataaaataggaaattcgggttcctactcaccaatttatttctacagcatgcagagagtccataaaagtctctaatatgtttcctaaaggctttatgaggaataatcgcactcactagtttcaagccctttgaacggcttgatcgtcttcctcccatccacctcaaatctaaacaactggattgatttatattttatctaaaagaagggctcacaagtatagatgtgcatgggtgggtccctacagaccacctaaacaggtttgatatgaccacatgacctttgctatgaccagaacttatggcaacactttcaagtgttcgcgccactcgccgaaaaagaacgaggactgcctccgaggggagagtctctgccttccaggccctgaccacggccgcccacagcttcgcctggaccacccctcagatccgaccatcgcaatatacagctcaccatcccatatttttatttttcag

SEQ ID NO: 1979 - DNA, 703 bp, Nannochloropsis_gaditana
caagtgtgaaaaatgttttccttcttcaacttcgctctcgatcttttgttaatgaccccgtgtcccatggagtggacactgaagcgtagctggacgcgagttaggcaaactgtgggcagcctcgagcaaagttggggatggtttgcgagcatgcgaggcccacaggaaaaggacgagtagaagttgcatgacgtagcacatagcctccttagccgaagggaatcaaccatttgcctgtcccgaaccataagagggatttttaaatagcaaagcgtccatgtgtcatatggctgaccgatgcgaccgctcgcatgagatacgcaaggaaaagcacaattgattaggcaacgtactgctctatttgacatgatagtacgtagcacgtggcggagagtgagaaccggagtgtggaaccataggctagccgaagcgaagcgagaagacggacaaggttgcgtgcaaggaggggagaaataatcattggccagtgcatagatgtcatgtaattgctgtgtcctataggccagttgaacacatttctggtcactgtacacaagagcacttcgagtatggccgtcccccagcgaggcctatcgatcgctcacaccctggggtgggctcagccccgcctcgcggcagtgttaaaggaaagtcattatactcaaccacaatacaaatattccaatctccatgcacagcaatg

SEQ ID NO: 1980 - DNA, 703 bp, Nannochloropsis_gaditana
tgtcatggtcatggtgccatgtttctaattaaaacaaactcagatattgcatatggaaaacatattgcagccaaaaggatgctgttatgatgtttcatatcaggaacttacaggattttacaatttaagaaataatcgtgcgctatttctcaagtcatctgtcacagaagctcgactcggaagcctggtgacagttcccttgttttgttgcagcaaaaaagcactttgagcatatgtcacacacacgagatttgagtaaacattaaagcaagtttcttgttttgcatgagatatgctttgtgacagcaattattgcaaagctccttggtaaacgatgatccttcgttaattggtggtgactcacgcggctaccttctcgcccagcacgggacttctcatacccggaccaaagctcggacgccgacagcatcacatatgaccatgattcgacaggtttcgtagactcagatcccattttggccttcaatgtctgttttatcaggagagataacctgaagtggagtgcatccttaccttggacacggcagggttaaggatcatgaggcaccagggcgttccagtccatccgagcgatgcggtgcattagagattaaaaaggtcttcattgtatcctcttgaagcgttgctttcccgagtttaactctcgctatgctgacgttcgttttttcctcggcaggtcatg

SEQ ID NO: 1981 - DNA, 703 bp, Nannochloropsis_gaditana
gacaaggagtggacgttgaaaatcggcgagcccaggcgggaggaggagggggaggctggggaggagacgaggggcggggaggcggacgagagggacggcactgctcagctgggaaagtgggagccgttgcttccagcggatccgtccatggtcccggatgtgcctcgcttgatgcgccgcgtttcctcctctgtgggggtagatgggcttgcagccaccctggacgcgggcgggatggggcagtgggcgagcgaggtggcggccgagggaggggaggggggaaggcgagaaggaggggagcatgtgctcttgaatgtcagtcagctccgacaagcccaggagcaggggcaatgtgaggagagtaaggaggcacagcggggacaggggaccatagcatcccctgaggcggtaggggggaaggcggagtggaagggggaggccgggctgggggaagacgttgagtgaaagcgcgctgggagcggcgcagccggcggtcgtggaagactacggcaccttctccccgggcacgtcccccgggaagaggcggcttgagagggcgcgcgaagggcgagagagagagcggggccggggccgtgggagtccgcggacggaggtccctgctccggtccacacagacacgagcggcttcggcggccaaggtgctggcaggagaagcggcagcagctcaggcacgcttggcatg

SEQ ID NO: 1982 - DNA, 703 bp, Nannochloropsis_gaditana
tttctccatggcttcttccacgctgtacacacgcacgtcaaagaagggcccggacaagttcacggcacctgccgccccccctctggggctggcggcgtcgcatgcttcacccgaggggggagagggtggcgaagcgggcggtgcggaggacgaccacggggagccccctgaggacgaagacgaagaggatgacgatgacatagcagagtttcggggtcggagggggttggagaacgctgccccgcagagggaagatggtatcaggtggccttgcctcaccgttgacccccgccaagtgctaccacgggccacccgggacgccaatgcccaaagctgatgtgccatgctagtacctttaggcaccatcgcatacaaacctgcggggggaaacagaagtgggcggacggatttcgatgggatgtgattcagtgcacgtcggaaggtcatcatttgggaccgccggccttagttgccctcgcggtagttacggcgcagtcacggcgcttggatggaccgtggtcacagccaagtctgccaacctacaacgcgctagccttgccagcttctggtcacgcgcatgcgttgtgcgactttttgggattcgcaacaaaacgtgatggggccggagaccctggcgccaaggtcagctagcgatgccagaccagcgcgacgcgcagacttggcccgccggtttttcacgatg

SEQ ID NO: 1983 - DNA, 703 bp, Nannochloropsis_gaditana
gaaagaagatgctttccttgcctcgcagcacaacaaccccaagaactctggcggcaagaacgtcaggcaggccgaacaaggacaggagggccggaaccacacagatgtgaaagctttgcagctgtcaagcccattttctcgtgataacaccgccactcttatagcggatagactgtcagctagtgtacgcgagacaagtcacgagtcgatcggtgccgctgcgggccctcccgtgcctgcagggacctctctcccgagtctgggaggcaacaagggcgccccgagcagcggtacttgcatgactgccagtgaatcccacacagtggctccggctagtatgtgtatgacagccaacgtatcagcagcagcgaccgcagctagtgttgggaagaagcggccccgcaccagcggcttggtcattgaggagccccccgcccaccagcctcacctgcccgcctcgcagaagagccccgtggacgacggcagccgtcctcccagcatgtctccggggcgcatggcggccgatggcgtcgggaagactcgtacaatcgtctcctactttcacccttcaggggctggcggaagcagcagcagcgggcatgcggggagtggattgcagcggacagggagcgaggcgggacgggcccaggcgagcaatggcggaggcttcgacgtgggtccccacgccgtttgtggcacaatg

SEQ ID NO: 1984 - DNA, 703 bp, Nannochloropsis_gaditana
ctgcttggtcggaggccccgccatcggcaggatctcggcgtgtctcttgacctctgccgccacatggcggcctccaggaggccattcgcgacctctaagccttgtggtgcatgtatcggctgttgttcctcggttgaaggacagtcgctcccatgaacgtcgtcttgttgagagtatatcagctctcgtaacgacatgctgagcaactagctagagaatgtctttgaatactcgcatctcaccaagagcaccttaaggtttgtaatttccgtaaatacgaagacaaagacgaaattgaagcggcgtcaagaagtcgcaaggcatcgcgagcaaggctgttttgtttgtgtctgtgtgggtgttgtcctgagggttcttaggcgaggcaaccgacagagagcgaggaggcgaggtcacccttcacgtcagagggcgcaacctatccacacgaatatttttttttctgaatttctgggagtgtccccgcatacaagccgcataattttgcagggaacttgtgccggagagagcgtgaccattcccgggccggatactgccagacagtccccttttggtgggggcaggaggtcaacgctgactccgctctctgactgcctgaaaagcacgcctcagtcgcgcgccgcacgccttttaaaaacattactcacccctctcctcttctctatacatgcatagaagcatg

SEQ ID NO: 1985 - DNA, 703 bp, Nannochloropsis_gaditana
tcgagtgcttcgtccttcgttcgacatcgtgtaaggtgcggacgcggtgaccatggattcttcgatgtactctccattcccactttcatcggaagcgtagctctgattagcttccaaaatagccgttgccccaccgggagacctgcccgcgctgttgttgggagcacgaaggcgcggaacaccctggccgcgttgtcgcttgttccctcgctgatgcattcataagaaggctgcgtccacctgtttcgcatggagtggaggggaccaaagggtgagcatgggaggtggggaagggcgggcgccgggctgcctcctcgccgtttctgtcgccctcgctgctttgcctgcgctcccgccttcccccgccctgctcccagcaacgagaaatttgcgaaggctttgctgacgactggtacaattatttcccccccaacagaacttatggtcgtaagtgaattgccagggcaggtttgatagtgcaggcagctcgacgaaaccctcagagatgaggatgggaagggagaagcgggttggggggccgaatcagccgtctttggccattttttttggaaaaaagccaggccgcaagaaacacgagacgagtcaagaaagagtgagggatagcaatgccgaagttttcgaggtgtgcccttcacgcgagaggatagggactcgggttcctcgatggcgcaatcggtgcatg

SEQ ID NO: 1986 - DNA, 703 bp, Nannochloropsis_gaditana
caattgactcaactccctacgtgccgctttaaaatgatatgacttacctttaaagtcgataaaaccactcgttcgcagctctctatcatcgtcgaacgcgtcccgtctgtagcttacattcctacgggacctgcctcccacactggacccattccccggttttctgtcttccctatcgctttcactcaaaagagaacgatagtctttctgtgaggatggccaaacgttgccacggaatgcgaccgacttctccccacgattgcgctctctttcatgtccgctgcccccacaattgttgccctgattcattttttcactctcgcgcgtctttctgtacgagtgaaaggacaatgtggcagttcaagcttaccacatcgtgcacgtgtgacaatagtatgacataagtaaagcccgcagttaagttccgaaaggcacgctctccattacccaagagacgaacttactcctctcctccatgcgaagtgattattattttctagataaacagcacttcattaccgcttctagggatctttacacagacttcattttcatatagctcaacaacgtaccgtggctcaagctagcaaagtatgcagccaataaatacgtgggaggacgcagcacacctgcacgagctgagacgctcgggcactactcctcagcctgaggccaacgccagcatatacaaagccccgaaatg

SEQ ID NO: 1987 - DNA, 703 bp, Nannochloropsis_gaditana
aaggaggatgaattgctgctttacgatcccgcctgggggacagaaaagcaatcgaggccggcaggacgacatctgaagggtgaagtgccgaccaagcccgtcgttttggaagcttttctggggagaatcttgcggccacaccaacgcgagggcgtcgcttttctttggcggtgcttgacgggcagggggcagcctagccggatgggccgcggggcaattttggcggatgacatggtgaggtgctcgggcggaaacggtgattgagagaaagatcgaggcttacgtagaaggacgaagagagtcagacagaccacgaaatgacaatatgatatggagctcgcatagtatctcaccagcttcccctctgatctctctcccttcctcagggcttgggcaagacgctacaaaccatcgccctcctatgggccctgaccagacagtcccctttccagcaccggtacgccgacgtggaaaaagccgtggtcgtctgtccgtcctctctcttgaaccagtgggccgctgaactcaagaagtggctacaggtccggctctccttcatggtcgtcgactccgccatggggaaagcactcgggaaaggggatgccaaggagcaggtcaacaccttctgtacttcctcggggcagcattccaccgtcctttttatctcctacgaggggtaccgcatccacgcggcggctttgaa

SEQ ID NO: 1988 - DNA, 703 bp, Nannochloropsis_gaditana
cctatgccaggcgcgaggatggcacgtcctccgcctggacggctcagtctcaatctctcagcgacatgggcttgtggaagctttcaataggggcgccggttgcccggcgcgggagaaggaggatccattcgtgtttctacgtacgtgtcactgggtgggaggggcaagacggctacggacttgaagagagaagaggaagaggaaaacgacgcgattaagggcgtgccacagcccaccacatttccatgtggtcgctggccttcgggttaggtttggggtctcgtttactaattttctccttattcgcatattttccccccgtcatcaagtgagcacgcgcgctggtggccaggggctgaacctaggtgagtttgtacccttttaacgtgcatgattatttttcattgaacggattaagctccagcgtgtcgaaacgataaagctctttagaagggagctaaaaatgaatgtagcgcttaattacaacacttcaaatgcccgcttaacttaactcgagggactttggacagagcataatccatatacatcccttctgctccataatccagttggcggcaatcgtctcatcctcttcgactcttgcttcaacccctccgcggatctgcaagcgcaagcacgagtctggcgcgacggtcagaggaaaccttgcgtgctttaccgtctcctgagtgcgggtaccatg

SEQ ID NO: 1989 - DNA, 703 bp, Nannochloropsis_gaditana
gtgtctctatacatgtatatccctgcagctaaggggggggggaggagagcccatcctgtcgccccccatgtttcataaccctgccactacacatgcaagtacgtcgattgcggcagcaacaacaaaatgatataattagcgcaataaaatacacacagagcgataaatcgacgaacaaaaaatagaaatcgtgaacgatggatcgatatatcgatcggaaaatgcgacgaaacgattgctccaggactcaacatttgcttggctatgaccgataatgtgaccgatttatgcgatatgcttcactattcacgcttagatgtgatcggtgcttttgatagccccgaagtatgatctgttgaaatgttgttgagctcaatttccttagccatgattgctttatttatgctctcagcccttcgcgttcttgagctcaatttcctcaaccatgatcgtccggtcatgatatctgtccttgcgttgttgagctcattttccaagactgctacattgattttgaaagcgctgaagtggtagtaacggaaattttgttgcgattcatgtacggtcaatttgagcaatcgacaacttgttgaccacctcaacccgaacgctcaatcagccgttgggacggcctctgtacgtgctctccttttccctttcgcacctttgcaaggtatcaacaggcatcgatctacacacaatg

SEQ ID NO: 1990 - DNA, 703 bp, Nannochloropsis_gaditana
gcgaagcttcgaatgaaacctcagtttctacctcccgtaattgtagttgattatttttactcactggcttcaagactggcgtctcgctgacattcgatgcctccctttcccgcgattcgaccggtctcgcccaagactgatgccatcgacgaaaacccaaaacgcacttacagagcgctcggacagagtcagcctccttcttatcatccattattccttctttatgggaagtacattaggcacaggatccttggcaaattttgattttcttgccgctctcgaattctcagccatccacgagctttcgtcgtcctcccttgctttagtgacaacacgtttgtgtagagcggggcgcggtctttgtcgacggatgaacctacacatcaacagacgcagctatgcagatacacggatgtatcgtcttcacattcttctacaattaacgttgcttgtggtagtcacggcggcgtttaccagcttgtccggaggatcgctttcgacttgcaggcgcggtccaagcaccggctgtagcacacctcgcaccctagatgttgaaaggggcggcatccgccgcgttggagtcaccagtggtcggataagcggtcattcgctagcattacagcggaagtacctttgttcgaccatgccactcactcctttatctgcatcgagcgggggaacaagcgagccttcccacaacatg

SEQ ID NO: 1991 - DNA, 703 bp, Nannochloropsis_gaditana
ggcctgctgccgagaagccctccttcaaggataagacgaccacgtttccgacacactacgacaccagccccgaaatcacgaaatgcacacaccgctgtgtccaacgtcccacggacgaaggaacaaagaaggagaccttgaacccctggggtagtttctccaaattatgagcgacgtgtcccaaaaattggctgcccgcgcctgcgccacaggatcggcgccgacggcttctgtacgtcggcgcaactgggtgcaaaaacaccagcaatggcacaaaaagatcggtatcgcattatatgccagtaaatttttcgttaaaacatatgttttttccgcctttctgccttcgcaatgcatcaattttgtgaaaaagaatcattttttcgaacgttgcctctgaaagtgatctgcctgctcttgcctctctttcagaaagtgtacgtatcacatagtcgtccaaaatggcggcgggggctagtgatgacagacaggaacttcttaatttgatcaaagacggctggtttgaggagagacagagcttttggacaggtactgtgatctttttttctagcctttccttctttccttctactccacggcttgatgcgcgccctatcgtatctatgcatacataaagtgcctccaagaaatattaccaagtgtttttggaatgtaccgagtctttggcttgcgaaacacaaca

SEQ ID NO: 1992 - DNA, 703 bp, Nannochloropsis_gaditana
caccacaattgttctattttcgacgtcagtctctgagtggtggtggcattttttcactgtctacgcttgtactggtgcgtacatttggtatttcatctgagagcataaattactcaatctgtatgcatcggggaaggatttcaactctgcgtgcatcactttttttgctcgaacaaagcgcaggaagcaacgaaggctgcttctttctttttcctcttgcgatatttcttgcaaggagtctgtaagaaagcgacttgcttgcgagagcaacgttgtaggtaacatatactctctcgtgttgtactgtttattgacgtgcggtcagttctgtagggtttttggtgcagacaaggattttctcatgccgttgtgtgagtgtgtgggtggggcagggtgcactgtttttgacaccaaataaaaacaacccttgacacgaggaggccagtaatattttcccatgtcgatgaagatatgtctgcccaggccttcgtcgtaatgttggaggtagtcattggatgtggaatgatgggcgggttaaatacgaaaacatcttcgcccctatggaaggggaagggtggggggcaaatgaactcccgtcctattcccatgcccggccttcattgagatacttactctgtttcctctatgtatacagaacagcctacacagattctttcggagtaagctaagagaagcaaccatg

SEQ ID NO: 1993 - DNA, 703 bp, Nannochloropsis_gaditana
cgctttcccatcgctcgcaatttctccagcacagatggcactttgtcgatcaacgagtctcctcgccatatcacgccatcacaatcgaatataaacacgtcggtgttcttcagcagctcctcttccggggatgtgagacgcttgaccgatgcagctccaggcgttgccaccgtggccatcatagatgagcttccgcgccgagcagcggcagcattggccatagctatcgggcttgatgatgcacgtagtaaacgaggcacggtgaaagcagaacaggagccgacacaaaaagcaagcatccccaagccgaacgtgttacgcatgatttgatgcctggtaaatccaaatgatgatcggaaaaagaaggattattttacgagctgtaatactcgcaagaggtgatctcaggactcaagcttacgtaagaaaagagatcatgaagcgcttggcataattttcctgcgcccacgagaaggcgtacaacagacttcatcacacaacaatacgagtagcgtaccacggtctgcacggggcctaaaaagacaaggagtcggaagagggcatgcatttgtgttagttcaaatccgatgacgttggcgtcgctgaggcctcgccggcattttctcgatacggaaatcgtctcctcaccgccccggcggaaaatgaccaattacatcactcggacagggacagcgtgatcatg

SEQ ID NO: 1994 - DNA, 703 bp, Nannochloropsis_gaditana
tctacgagaaaccgtcgcagccagtgagcatggtaccacgcaatttgggagcaaccctgcagcatctgaggactcacgggagcgacgagtcttggcgatcgcctagttttcttttcttcgccgaaactgctttccttcacgggtgtgtgggcgaggccggagatcaggttttccctctttaccttggacgaccgccccgaggtcgttgtgcgcaccgtacactggtgaaggcgtcaggaagtccacttgggcacactttacccaggcctacagtgttagattgggtactaagcgacatggggaaagaaataacccctaggtgttctaaatcaacctccgattgtagtgtctcagctctgccgttacatggaggcattataaacaatatacgcatcattctgtttttcatcctggcccgaacaacggggttctctgatgagaactttatgaccactgtgctacctcgttggtgatgcttggctaaagttcgtcttacgatgaacacgcttggtcaggtttttaagtatttcacacccgtgtgtcctgtcattgtctactacgaaatgggagtgtgattatgtggacgtgacgacattctcgtttctttttccattatcccacagctctatgaaagtatatcaatactgcaatcgattgaaaaaggcaacatagtggcgtcttagttgccctagtccataaaatg

SEQ ID NO: 1995 - DNA, 703 bp, Nannochloropsis_gaditana
tggagaactgaagagaatgcgattcacttggagggctcatgaaatgtttgctgtttatatatccatctctttcattcacaatgaggttgtcgattctataagatgggtacaaatgatcgcctcgaggccttcccaatgggaagccgcatcacgggcagtacggccgacggcatcgtctcgatctcctcaaaaataaccacgataatgaccatacattctctggctttgctcgtatcgtgggaaagggaggtgattccacgcgagaccgcgactttctggtgtccatggaatttttttccgccttcgagccattgagtgcttcggggtcgggaatactggtacagccgcggaaggggtcacagcataggcagggagaggccgtcagaccaaaagggatggcttcaattttgtcgagcttgaacgaacgcaaatatttttgcttcagcacattcgcattggtcagagccgccatctgcgatgtagccgtcccgcatttttcttcctaggcctaatgcgccgtagtgggtggtaagatgcaggaatttcaacgggcggtctatgcagttgtcgtattgggcctgattttcccgccttgactttcgtttgcgtcgcattcttcggactcgttggtacaggcgtcgcactttgtgctcagtcctagcttttggagccgttgcttaagcaaaatgtggctttcgtggaa

SEQ ID NO: 1996 - DNA, 703 bp, Nannochloropsis_gaditana
gtatagtctttccctcggggaagaaggtgttgtcatagctttacctatttggtatttctctgagccttcctttccaatgtgggtactgtcagtccatatggttattgccatatctatgggacggattggcagaagagagtgggactcctaccaacgggtctgtgtgacccggatctgcttgtaaaacacgcgcacgcacgaaggaatcatgaacctagagacattctgtacagctcttgtctttgtgtctctgagcttataatgtgagctcacccggaattgtcacattacttccccgaggtcgttccctcaccctcgtagagctcgctgctaactttgctcttaggggccacccgaccgctttgtacatgtgttcctcaaccctcatgtcgagcagcaactttgctttgaaacctcaactacatcctgtgccacccttcagaccgtatgcgagttttagcgtggacaaacgctgccttgaacgttgcactttcggtcgagcttcgctcaggctcgtctccatcaagaatttttcccacgggcgctcttggttacgtcacacgacccagctgcttggagggtctggtcatgtctacggaaggtggctcaagcggtaccaatgatgatgggcgaagaagagcgagtttttcttccgcagaacatttacctgcatcatcaatcactacaagtgctcatggcatgg

SEQ ID NO: 1997 - DNA, 703 bp, Nannochloropsis_gaditana
tttttatcttccatcactcgggcggctggctttccatctttcttgagtaacgtgatttttcaaagaaagcaacgatagcgttttgggggaggaaaaaccaattcatcagactcgatgacgcctatatcagtgtcgatgatctcgttcaggtgttttctctatctgctttctgcaagtccatcgcctggagccccaaccgggtggcttccatccttgcaacgacttcctaatgcaccggaaaagatcgaaaaggtggggcccaagccccgttcggccatcccagtaagcatgcttcagcaaaaacaataaaatatttttcttcaataacatgtctggctacctatgaagcaatttattattctttagattgtaaaaacatgctcaatccttaaccgcaagttaaatttggattttcaaatttaccgttgaggccagttgacgcttctctgagaagtagctcctcgtttccgcgtttattggctggaggcatttctgtgtccaaccatccactctttttattcatacatcctcttcgctttcctggtcaaatattataactaatcataggagagcgcttacccggcggcctctgcactcctgttttttcttcagagaggtatctcatgctctctgcgacatatcggggcgtcctggtctaatcagagattaaaataattgaaaaagagcaaccttaccgaaaatg

SEQ ID NO: 1998 - DNA, 703 bp, Nannochloropsis_gaditana
tttcttgtgttattggcactgaattctacctctcatgcaagtttaattgtatggatactgcttatacgatgacatcgacacttgtcgtatcggaaacagagcctgtgcacgctcgaagaggcggggataactcttgaaagtggagtttcacatgattcaatcggcttttgtgctaataattatgactttaatatactacaagcgaatacggataaggggagaaaaatcatcagggcggcttactgcatgtactctgaagtcactcttcgtgtgtgcgggctaggatctgccgaagtacggtggataagtatcattgtacatccccaaaaactcctcctttatgtttgtttcctcatgacatatgtgctcatacaaaaaggtacaggggccttatataaggttttattcgaataacaagatccctggcagtcgtacacattcaacgaggaatcattccgttcctcgattgatcagccattttatgcggccaacggcgccaccacgcaagcatgggttaattgctagtgttttcatcctagttttgggtttaggtgcgacgcaggctcaggcggtagccggctatgcgctccgcataagtggtaaaaaatgggacgacacagcaaaggccatggcggtggacaaagtggggaatgcctacgtagtgggagattttcatgcggaatctattcaaattggtaatatg

SEQ ID NO: 1999 - DNA, 703 bp, Nannochloropsis_gaditana
atccgtgattaagctttatcgtgatcaagtacactcgtgtcaatgcagtttttgatacttacatgccgatttaagaaacgtatcgcaggcaaatttcccctcaaaaaaaaagaaataaggataatacgaggaacaaatagacttacccagagtaccggcaaacgtgatgagtattgcgtaccccagcagcacgtagcgaccggcctctgcatcgtaatacgcggaccccatggctttattgtctgtgcacgcaatgatggggtgtaagaggtccataattacgcgaggggatgataaaggagttggaaatgtcgctgagccgcccgcggccatggccttgtggaagacctcgctgaacgcgccgcggaagtatgtgttgtagctgacatcgatttaattcacacaactccccccccgtcttcgcaaggcagcatttccgtgggctttccttcaaatgatggctttgtctgtgtctcacagcgctgggatgttaaatgcatagtaagaatacgtgcatgcgcttagcacggacggttttgagggaaatgccatgatacctttccattgcttttgagaggcgttatcacaaaatgtttgcctggtatttcttttctacgtaattgctcagttagtgggtgcgctctgacacgatatcttccctcacagtgctttcattaaactacagcttggtacaagagccatg

SEQ ID NO: 2000 - DNA, 703 bp, Nannochloropsis_gaditana
cagcggcggagaaagaaacggttgactacggcggaaatgacaggcgggcaggtcaatgtccttttgatggactcaatttccacgggattggatagcgccgctacttttgacatatgcaagacgctgtccggctgcacccgggcgttacaggccaacattgtcgtctgcctacttcagcccccgcccgaagtcttcgacctcttcgacgacgttatcctgatggatgcagggcacattgtgtaccaaggcccgcgggagctcattcttgaccacttcgagaacttgggtttccgccggcccctccgtaaggacgtcgccgatttcttggtggaggtgacgacgtctgcgggggcagaattcatcattccggccgcgcaacgctacgcagctggaattcctgaccctcccaccagcacagaagaatttgtgcgggccttccaagagacggaaatttacgaacacatgatcgataatttggaacgtcctccctccttcgcgccctggcttcggcggcagcgctgcgagttcagcaacggatggttccgaagtacgtggttgtgtctccagcgtcaggctcgaatcacattgcgagaccgtgtcttcctgcgcgggcggatcatgcaagttctcctcatgggggcgatcggccggaaccctcttctaccaattggatgcgcatgattggtcggacaaggtctgcatg

SEQ ID NO: 2001 - DNA, 703 bp, Nannochloropsis_gaditana
gtagacaccaagcatgatgcacccaaatgatcgcatgcgagtgtttggagcgtcccctgcgtgccttgtatattgtgcctgacatcgccgtctgttgctttcctcctctccttttcccgtccacgtttttccgcacgtgcccggctatccatgacttgacactttgccatgtcccacgcctccctcttgaccctcatatggctacaggtggggcggccgtatggattggaaattaccgccggcgcttggggcacatgctgggagcggaggaaacgccggggtggaaatgggtttagaggcaccttcgccgtctttctcccttgcagcaactagtcagggcactggaatggtcgcacaccctgggagcagcaatggtgacgccggcgatagagctatgaatctcactcttgggtcctcttttgaagccgctgcgtcgatggcacgtgccggacttaaacccggctatggagagggagcttactaccctcaggcccctttggcgacggcctggtccccggacgcccacccactctgccacgcgctcctaatgacaccctccgggatgacgggtcgtgttgaagcccatcgacgccgtcaagtaggacggggggagggaaatgagtggggctcgtcccccggggtgacggatgagtttttgattggattgtctgatgggagccagggagtattgccggaatcgatg

SEQ ID NO: 2002 - DNA, 703 bp, Nannochloropsis_gaditana; identical to SEQ ID NO: 1662

SEQ ID NO: 2003 - DNA, 703 bp, Nannochloropsis_gaditana; identical to SEQ ID NO: 1663

SEQ ID NO: 2004 - DNA, 703 bp, Nannochloropsis_gaditana; identical to SEQ ID NO: 1664

SEQ ID NO: 2005 - DNA, 703 bp, Nannochloropsis_gaditana
atgtagccatgtccttgagcaaagcctgcctttcgatatcaaagcacgcctcagcgtcccggtaagttaagagcgtggcactcgaagaggtaggagctttgccgctgcttctgtcattgcatttcctcagagctgagacagggccctttgcggtgtcaaaaataccagagctgcgagtagtattattccaactagcacgaaaggagcctctcgcgtccgccctcctaccctcagtcgtgcctgtaggggcagggtgcgaggcggacagcattgtgaaatgcttcttaagcaatcgtacccctccccttcctgttcgtggatgcaaggtaccattgaaagacgtgaaaattgtggttctttccgtaaaatgcatgtcgaagtgccaaagggggcactgggcgatttgatgctcgctgcgttcctgcggcattcgtttatacgcaggcaaaaccaacctcgtaaatatgtaaaaggcaataatacagtgactccaatcgtacgatagacgttgtcaagcctgctttgcagcaagcagaagcgaccatctcgtatgcgcgttgtactctatggaattgcttgctgcgggttatttgtttttcgcgccctcctcttcactctgaccgtcgacccctcctttcacgattggccagtatctaacgttgccatacccgccgcaccatgcacagatctctcgcacgccatg

SEQ ID NO: 2006 - DNA, 703 bp, Nannochloropsis_gaditana
tcaatgcgaggccccgtttgctttccagttgcgtcctgaaattggacgaccatggaccctggtagtgttggtagcttttttgcctttttcgtgacatgaagttcggaggccggggggggcaaagcctcactcgtcatgcttggtgtacgcaacaatgtgacaggggaggtagtttccaaaaagcgccgcgtcctctgcaatgttaggtaaaaaaagtaaaagaaacccatgattcaaaagaatccatgctaaaatcacgctgcacgtacctaacaagcacaccactggcccggtcccattgcgccccaaaacgctggcaacggccctcgccattacttagcgggctgagtccttgtcgaccgtcaagatacttgggctcgcgattctccgaggatcggttattccaagtcgaaggcccatcccctgggtgcaacacacaccaaggcacgtgcatttttcagccacgtcgagacgcgatggcgtatcttacttgtaggggaagtttgcgacgaaatccatcttcgagccccaaattaccaaagaagccgaggtatcggggaaaattccgatgcagataaaggagaaggcatccacttcgcaaaggaaattctatcatttgatacggacacaacttgacccaaattaagtgactcaatcaattattatgccacgaactataggggtacattctcatctttcgatg

SEQ ID NO: 2007 - DNA, 703 bp, Nannochloropsis_gaditana
cccagcaccgcacccaccaatattccacatgagagcgcgtttaaaactacaacgtgagaaggagcaagcttcaagcggcgggtgctgagaaacactgcgagtgttaacgccgccaagaccaggttcaggaccacgaaaccaccgcgaccactggtagccccggctgccattccgttctcatatcctgctggatgaatcgaaagatgtgaaactgcgtacgagaaagccgagagtccctctttttcggggtcccaaaggggttgctcctgtccgtctccgccgagagcaaggagcgaggaaagccagcctgtggctgcgagaccttcgagaccgcggggaaaagacctccctgtcctcgtcgtggacacacctttcgcattcaaggcggcagagcgacggccatttcgctcgattgggggccggggtgctggtggctgttgtccattttccatatccggcggtcatcattggcctactagtattctaccttcatgacccgattttcctgcgttcgactacatttaccatgttcctgatgaattttactcatcccattcatacccacactgaataccgtgcacaggatagacgaaattcgaggtacacgtgttaatttcatcgagctcctccttggcctcgtttcttcttccagcttgcctttcgtgtccgctggtcttgagcctgtcctttcgcacacggcatg

SEQ ID NO: 2008 - DNA, 703 bp, Nannochloropsis_gaditana
tagtctgggctttgaatcagatgcatatgtgtcgctagagggtcgtattttatccctcgcatccatttgagtcttcaacggaccttctccaggcgttccttggctatcttctcaaaatgctcgaggtcccaggtccgacgctccacgttcaatgctcccgtggggatttttttcttcttctgttcatcgtcagccatcgtgtctgggcacctgcatgtgcgtagcgatgggatgggagcattggatgagcacacaacagacaagctggaggaggtaaatcctaacacgctaccaggcagggcacaaagagtaaaaaaaggccttcattttcataagcacaactaaaacatagctagtttcctgctcatttccagtgaagaagagcgccttggcaggaatgtgcaagagtcggcgacggaggccgttgtctcacgtttatacctttacctcgcgtttttcacggcggcttgaagttttgcggtcgagcatttcacttgtgcatttttttcttttcccgacctcaccatctacctcatttaacacccaccacgcgcaccacaggcattgctgtacatttaagcaaagctgattctcctgtacgcggacagaagggtggcagcgttggcatccgtcgtgcgcaaagataacgttttgtgtgcgtccgagacgtcctacgcagacgcctctagacaccgcagtaatg

SEQ ID NO: 2009 - DNA, 703 bp, Nannochloropsis_gaditana
agggacgaacgagatcatgcagataattatagcgaggaagctgttacagcaagattaggtcctattgaaaacaggggggtagtggttggggaggttatgatacacgaatggatgtgcggcgagtgtaccgatcttacgaataacgatgtccgaagttagcctgctctaatacagtgtaaagtgatagggaaatatgtacattgttgatacacccgtgctgccttccagccatcgtattgtgttcttgttcagggctctccaagagtcataattagcgagcaacttccgtctcgggcgaatcccataaatttgaagtttgaatatgctcctaggcaccttggaagaaaaaagaatggacaagcacgcgtcaagagcaagttttacagctatcataccgctatcacatccattgcaacttattccgcggtctatctcacacgcaggcctttttcgcattcttgtcaggttccctgtatgctcgcacgccctttctgtactctaccgtttgtgttgcccatcttgtcctcctgtacgccgacaagtgccattgtcctcggtcggtaagacgtgacttcatcagtttatctgtcagcgtagtgttaccttttcctcgtcagataaatgcccaaacccgctgttttccttccccgacagatctgtcgctaccactacctcaacaccatctatcctacgcgacggaatg

SEQ ID NO: 2010 - DNA, 703 bp, Nannochloropsis_gaditana
aatgcgtcctgtgggtgaccgacttggggcccagacgttggcttcctcgtgggagctttcaccacgaaatataccgcgaatccgtggaggcgtcacctcgaacactgtcatacagttctataggataaactatgggggggattccaaaaataaggagataattgtcaggagtgcgtcaaagtaagctctcggaaagggcttaactcttgaacgggacaccgtcgacgttaaacatgcggtttggttcccagggagatacggcaagaacacatctgcctgatgccgcatacatagcacataaactttcaacattggcgtacagccgagccctccccgtgacgagcaccggggtttttgatgattggggtggtgagttgcgctgtcctcgactcaatcgctatcatatgatcccgaatttagcgactggaacactcgacactccatgatacgggtgtgacgccctccggtcagtgattgatcgtgcaattaacctgccctccccccactgtccagcgtctcacatatagacgtagtactggcgctaaatggatctctggctttataaatatcaccggtaagcaagcagagagctcatgatgccacagacctcctacttgtagtcaaccgaccgacgtttaagtggaacaggagtcgttctgacggcattgtttccgggcgcactgaccaggcagtgcacaatatg

SEQ ID NO: 2011 - DNA, 703 bp, Nannochloropsis_gaditana
gcgaggatgaggagacgcaaaaagcatcaataactgagcgggagggagtgagatatcttccgacggcactccttcctggaatgctgtttgtatttcaagccacctcacaacgtggctccatgcatgccgacatagcaggtttctacgttgctgctcattattcgactggcagcgtcataccgtttcatagtagccgagaccgcaagtcagggtgtcgagaggaggatggggtaaaacccctcagcagtgagcatctaaatttgcatggccagcacctcgcatttcgatcacacccacgacacatggcgacatttcacgcacgatgtctatcttgtcggtacaaataaaggcggctcaccttccaggggcataccgcatggtggaagcacttcgtaagtcgccaaataagagcgattatcgcgtacactttgaccggtgccgggaatgtttttcctttgcacacaacgcattctccacggtcaccctgaaatttcggactacgtggccttgaaagagatagcctcgaaatgtcggtgcggatgctgcaaccagccggatgtgtctgtgcgattttccttcttaccgccgcgcatgcctgtacgtgcccggaggagatttaagcaaggacagatttctagggcccacacttctccaaccattaatatatcctatttcttacaggatcctgtgtgccgtcaggatg

SEQ ID NO: 2012 - DNA, 703 bp, Nannochloropsis_gaditana
gaaaaccacgctatgtcttggaggaggctaacaccacgagcctcatcgagtcttacactcggcgcacgacatacccggattacacgcagaagttcgcccttagaggatgcagcatacgccaagcggcgagtcaagataagttcttcttccatgtcactgttggcattgggcccaccatcaccgttctcgattgctgcggtccggtcctgcaaagccattggtcctcccggcgtccggagtagccgcttttacggattacctacggatgcagtgcaaggcacaatgaaataacgtgtgtcaaccctgatgtgatcgcgttatcacccacaaaacatgcactgtctcttgctcgtggtacgtaaagacgcacagtcgcaggcaatggaaaaacgtcgcatacgatactctctggttgcggaactcgccaaattcttgccgtgcaggcgtgcgcttgctctcttgtttttttccccagccgcccaccctgtttcacatgtacatcccgcccggctgcttgtttcccctgtgcatgttttgaaagatagaccgcggatttgatctttgtttcttgttctcgaatgtatagtacaggcggccagtcttcgagctgtcgggtgcttgccctctcctggtggttgcttcattcaagccgagcaactctcgaacctattgcacgacctgcacgagttcgatctcaaacatg

SEQ ID NO: 2013 - DNA, 703 bp, Nannochloropsis_gaditana
ttcttgcgataggcaggcctgtacaggagggaaggggagggggtgttggcaagcaaatatcaggggcatgtccgagatatgcaattcaagggtagcaggaaagagaaagggagagacggtacgatagcttatttctccgcctgattgcttggttgacgctccaatatagccacccaaacgctaggaaaaataatcaggaagttcatgaacttacgaaactaattctcttcccccctgctctcgatcttttcatcccgtcctctttgggaagatgtcagctattttctcccattacccgacgtaccttgtgtctttggggccagaaatgcttgcgctacaaatgtcgtgagtacgaatgctagtgctaatgctgtgtgcgaggatcgtcgcgctgctccggccatcatgtttgtgcacacagacggacggtggaaatcaggtggggagggggcgtacaaggacgtaccgaggcaactttatcaaccacctgaaaaaacaagggaaggtacgaagtcagcacaatccgcacacctctctgtatcacagagatagtgagtgacgggatcagaccgagaatggaggattgtcctcccagttaacgcgtggatcttgctttgtttttgctgccccccaggcgacaggacgcagtgtgagctccatcgatgttccaacacgatctgcaggagcccctttttctcgaatg

SEQ ID NO: 2014 - DNA, 703 bp, Nannochloropsis_gaditana
ggcgtgaggattgcgggcgtgaggaatttgcttggacgctggagctgatataggcacccatgtgtacgaacacggctgcttggtgagacctgtgaagccactactgaggcggatagaacaatgcatgagtgaagttgcctatacaggaagaatttgcgaacgagatccgtacagaacatacgtccgtccccggtgtgaccatggtggtgtctatttagctgtgcaacgactaaaaagtaaggctgttcacatcctgtttgcgggcaagatgacatgtccctgatttacaatggccggcacggaattttaaatcgcggccttgaacgtcacatatcctcgatgtcataggttggtgaatatgaccagccatgttcaccaaatctgcacatcaaatgaagcacactgaagcgtttgttgccgggtgccgttgggggctgagcaggaatttgatttgtgcgtccgtctggctcgacactttgctaaagggggtgaggaggttatcaacgtctcttatcttcattctcgactgaggccaagctacgtgggtgcggggcgtgatggcaagacacggaggggagaatactacaatatgtttttcatgtagagggatgaggtacattttgtggcgatgtctcggcgactcccgtcaggttgcctgcctcttgctctcttatacccccttccacctccttacggcagtaca

SEQ ID NO: 2015 - DNA, 703 bp, Nannochloropsis_gaditana
ggattgcgggcgtgaggaatttgcttggacgctggagctgatataggcacccatgtgtacgaacacggctgcttggtgagacctgtgaagccactactgaggcggatagaacaatgcatgagtgaagttgcctatacaggaagaatttgcgaacgagatccgtacagaacatacgtccgtccccggtgtgaccatggtggtgtctatttagctgtgcaacgactaaaaagtaaggctgttcacatcctgtttgcgggcaagatgacatgtccctgatttacaatggccggcacggaattttaaatcgcggccttgaacgtcacatatcctcgatgtcataggttggtgaatatgaccagccatgttcaccaaatctgcacatcaaatgaagcacactgaagcgtttgttgccgggtgccgttgggggctgagcaggaatttgatttgtgcgtccgtctggctcgacactttgctaaagggggtgaggaggttatcaacgtctcttatcttcattctcgactgaggccaagctacgtgggtgcggggcgtgatggcaagacacggaggggagaatactacaatatgtttttcatgtagagggatgaggtacattttgtggcgatgtctcggcgactcccgtcaggttgcctgcctcttgctctcttatacccccttccacctccttacggcagtacaggacatg

SEQ ID NO: 2016 - DNA, 703 bp, Nannochloropsis_gaditana
gatttcttttgcagcaccttgaatttctggtttataggctttccacccttgcgtccattactgagccgtgagcaacgattcaactttttgagacaggttggcaatattcgtggatggaattgaggacatcaaacgtgcatgaaaaggagagggaaaaaacaaattagtttcgcctgatcggtatcagcgcatttgttcttccacgtgtttgccctcatacatcacatttacgaaaccttttactttctatataataaacaaaccagagaaccccactttagatacaaatacatgtcagtgtcatcttatctgtagcaaggcaagattgtctctacttgttggaacgtttttccgtagttggggggtaagcgcaagcgcaagctcgaaagtcctagcaattcataatgcatcacaacaaccccccgattgtcgaaaacgtgtacaacaagtctattcccatattcccacaaatttttgcctttggcctcacgcacgccccctcgcggtccgtctcctcccaaatctttggcacgtataaagcctctccgccctctgccagagccagccccaacggcctctcagcacgcgccgcgtcaacggaagcgcgactgctcgcagtgcaaaccacgaactctgagcctatgtcccgacccttgttttcaagcgtacattaacgtcatgtgttggtgcacaagggagcatg

SEQ ID NO: 2017 - DNA, 703 bp, Nannochloropsis_gaditana
ccccggacggtcgcgccggtgaaggaggatacagtaacctttgaggatagagcattggataagagccgtggcagggcgccccccgtggcgcagcgcatcgggtgctctttgtgaggaagaggtacgcttcggtacccaaaattggagggcaaaaccttttctgaagtcatgaaggacggtatagacctgaagcggacgtgtattgtgatgtcaatgtttgtctagacaaatacaagtgatgaaacagaaattggaatcgatttgaaagcgacctaaggacattgttataaacgtggaacagagggcggagctatctcaaagactccgacgagcccgctctttgtcccggtgaggcgctttttggacctttcaagcccccctctgtgcccctttccattcctctcttccgtagggcatagaaagttaggaggccgtggcacaagggatggacgagttgatgacaggcagcaaaagacgacggcatgcttcttcagcgcgacatcagcaacttaatcatctagcggatgggacagagggaggggcgggcccccaccaatacaggggggcttccgagaacgcctctgtgacgtccgaaagcagcaaagcgaagaagcgcttcgtgtggcctgacgacttgcaccgggacttcgtagccgccatcttcgacgtgggcctgaaatgtgcttctcccaagacgatcatg

SEQ ID NO: 2018 - DNA, 703 bp, Nannochloropsis_gaditana
aagtttttataaaagtgatggtatattacggtgtcagtcgcggggcaaattgtagcgtgtattctatcgaacgattttgctcgaggctattatcacgggcaaagaaaggcaagcgcgggctccgcgagcaaagaagcggcagtcttgtttttcaaattagcggaaatggttcgcacgctcctgtcctaggattgcgatgactcgatgcataaacaaatttgttcaaaaataactcacctcttttgatccgagcacaaactgatccgcctggccattcatttgtctcgctgtgtgaggcagcaaggccacaggacgcaccatgcagcaatagaaagtatagtttgatccgatgttcctctgttgaaagcaaaaaaaagttaatgcattcaagaagtctcgagcacatcttagaaccggcatttgcttgggaatataacgatcgtatccctacttgaagacaagtcggcgatcgtcatcgaaatggaagttgcgtttggctcttgtggctgcacgacgattagtaccaagcgtgagcccatctccgctcttgttaacaacactgacgataggaaaatgtttggacatgattcaaccaactgaagcggagaccactggaccgaaagcccagagaaaatcggactcaggctactcgagttaccggctggactggtcactgcgagagcatcccaagacaaaggaaatg

SEQ ID NO: 2019 - DNA, 703 bp, Nannochloropsis_gaditana
gaggcagcaaggccacaggacgcaccatgcagcaatagaaagtatagtttgatccgatgttcctctgttgaaagcaaaaaaaagttaatgcattcaagaagtctcgagcacatcttagaaccggcatttgcttgggaatataacgatcgtatccctacttgaagacaagtcggcgatcgtcatcgaaatggaagttgcgtttggctcttgtggctgcacgacgattagtaccaagcgtgagcccatctccgctcttgttaacaacactgacgataggaaaatgtttggacatgattcaaccaactgaagcggagaccactggaccgaaagcccagagaaaatcggactcaggctactcgagttaccggctggactggtcactgcgagagcatcccaagacaaaggaaatgctgcaaatgagggtcaagattgcacacgtaatccacgcccttgaaaacctacggtatgtgctattgtaatttacgcttgtctccttgttcgccttccttaaagaggaaccacgacatcgataagttgtcaacaagatttcatttcggaacgatcatttttcaggcttgagtacctgtattcatctctcggtggcctacctttaccaaccgcccatcaacttgaagccgttgtgcgtcttcgtcccagttcgttgaacgcctgcccaggcggagtaatacctacttggtcacag

SEQ ID NO: 2020 - DNA, 703 bp, Nannochloropsis_gaditana
acgaccccatggacgtaggcttgttgtagacattactggcatggacgggagagggaggccgtcctgtcaggaggtatgtacgtgtattcaaccaatttcttagattgcggacgcccgcaaagtggacgaattttcctcaaggtcgcagttggttggaagaactaggtcttgtaatacgtaaactcgtatcccgtcagccgcgcatggctttgatctggtacaaaatgcgacaaccacaagtgcgaaatcgataggatgctcacgcaacacatttttcaacatttttcccgtgatgattttctcgcacaggacgaatattttgttcatcagttgactctccgactcgaaatcaatttcacctatctcacttcgtccttggcctcgtacgttccatatggacacaaattgtccctgtgcctgcgtagcggacgttgaagaatcttccaatcatcgtgcagccagcagagaaaaaaactctgccccaatagcggccttaccgccaacactacccgagcaagcacaagcatcaacgtccacctccgctcgcccccccttcaagcgtgcagactctgtggattccccgtctgtggcaaccagtaatcccgctgacgctgggtttgaggtttcttctgcatggtctgtggcaggtattggcacatgcatccaactccgtcatcgggcgttcgggctgcacatcgccatg

SEQ ID NO: 2021 - DNA, 703 bp, Nannochloropsis_gaditana
ccacgtagtctctcccacggagaagagccaatatcaagtacctataggcagtctccacctcaggaagcgcccactcatcaatttggttgaaaggatcagccagtggagagcgaaactctggtcctggcacccccagcgcacgcagcatgtagcgaggcagccgcttatgatttatgatgagccgaaccgcggcgctctggcgggcataaagctcggtcggttgtgtggcctctggaagatattcgcgcactttctcctcttccgatacaggcaatcgccaggccgtgggatgaaaaccgtcgagcttctgttgcagctctgctacttctggtgtgttcacgctgtatgcccgaccaaaaagtggctccaagctgttgattagggtgaaaaaatcggctttgaaagcagcgtaggacggtcgatgatccaaggcgtcaagccacctgctcaacgctggcagatctgggtgctggcgcagagtcagtcctttccaatagaggcaggaggcaatcacgcgctcgacttttggcgcgaaaatgatgtccaccagagacggctcagtgccgggcaaaaaccacgggctttcggcgtatttcgccagagcactctccacctgccggagcacggtccaaaattcatcgtggccatgagactcgggcttctcaaacagatagacaaaccagtcccggaacaagtcccgctc

SEQ ID NO: 2022 - DNA, 703 bp, Nannochloropsis_gaditana
cgtctgcctcttaaactataatcatcattataatggtacgcatggcgaaatttagtgatcacaaatgagaaaatctctgtagcggcccatgctcgactcagctcaactttctgctttatcattcccaaactcgtttaaaatgcgagttccaactccttgactaaattgtatttttttcgatatttcccatgtgctttgacatggcgcgtgcgtgtcttcatgctgtactttcttgcaccgagagcgtgagccgggatctcgctggcatcctccgctgtgatgaagcaccacacgcgaaaaagcagagaccgtggaataaaatcaacgatccggtttaatagaatttcgtcaagaagaaaaaacccatcagatatatccacagagagacatgtgcagcaaagcccagctttatgtcgcatcgcctctttcgccggctactgattcgagcgactcacccgtaaagatgcagaatgatatcaacgaagagaactgccataggcgtcaagaccaggcgttctccaaagcaattaccaccatcacgatattaacacttccccgtctttctcctctcgtcactcgcactattcaggcaggaaaagacatctcgccacgtgttccagtgcgtgcatgccaggggaaacggcggacgccagtttttgggtctaggcgtgtagccgcgtgaacatttccaagtcgagccatg

SEQ ID NO: 2023 - DNA, 703 bp, Nannochloropsis_gaditana
ttcagggtagcgacaagttatttttctgtgtatcctgttaagaaaccgtgcgggctttactgattgcgcactcatttccgaaagcattccatatcacactctccgtcttgtatagggaacagttaaaggaagagggacactcatttgttcacaccctcgattccttttggtaaagggaaggctaagaagacgtctaacaagtaagtatataccggtcagccatgaacggtggcagatgataaaagggcacctagttcgggcaatgctttcactcgacagggctatcgcgtggcagtgttgagtaacgacgggcctgtcgcctcacagcaattactgcagctgaattgtgtcgcttaaaagcgtggtacctcgtttgacctttgtatgtgtgatcgatcacattgcggctatcatatccttttttcggaaaagggaaactgaaattgtgatgataatagtggcagttctgtgtagcgcttgattttagttgttcagtgccacaagagctggcgagaggtgtgaggcaaaaaatctgaaaaaaatatttctgtcgatcatgtgtgtaatagaaatcgtaccttggctgtcatgccgtgtgtgctgaagctcgaaatgtgaatgcgccctgattccgctcctcttctcgtgttgcctgtactttctgacgcatggagcctcactttcttcctaggcctcagccatg

SEQ ID NO: 2024 - DNA, 703 bp, Nannochloropsis_gaditana
agcaatccccgagtgatatgaccgacaacagaaggcccttgagacggaattaagcattgcaaatcctcgggcgtctcctcctcatgggcaaccgcttccacggcattgtacaagtacgcatacgcgtcgcgacaccggtggctcccgtgatctcttatcccctccccttggccctcccccgtacctcccaacaggtccttcaaacatgccgccacactgggccacggcgggggacgaggacaatctggccgcgctttcatcgcgtccatcccctgtaaacacgtgtgcgtcgtggaagtgattattttcagcatcctgagggctcaagcggcgggcgtatggcttctaattggccgataaatatggtaaggacggctgcaggcgatgacgctttctccgagtgtctttggcgagacatggatcaaataatgcgcagcaagcctcaccacccgccctctttcactcagagggggattcttcttttagtggagaattagaggaattgctgcgaagatttgatgtgttggagattgcttgctaagagatcgcatcgaccggtcattgacttctccgcggcgcacgttttgtgtcccatcatcagtaagcaccatcacgggcacaaccaccacaggtgctactcgatacgccgacgggaataaagtgatgttggaaagcatacaacataatcgagagcaaaaaaatg

SEQ ID NO: 2025 - DNA, 703 bp, Nannochloropsis_gaditana
ttatgcctctaaaaggcaggccgagccgatgaagtggtgcacaaatgatttccgtccatgattcaatcaaatgaaataacctttcgtgactctttgctcgtcttactgagaatttatcctccatgaaggtctttcgtaccgcaatgtcgtcagtcgtcggacatgacggagccctactcttaggaccccctgtcaggtcttttactgacacatccattttcacctcttatcaataataaaagcagatatgccgtatttaaaaagcaactggtcatccatgccacccttggaagaatttgggcgttttgcttttggtgagatttttaccatccctgagatgaccttgacacagacggaccctacggcacgggcgtgctacttgcacgtggccttagaacatcaggcccgcgttcaggaattagatcttatctgtgcagcaccaacaatagttgtaaaccttatgaggggaaaatccacgacgggaatgagctatacatacctgaccactctcaagggccaaacttcggaggagtatcctggcctctttgcctttcgcatagatgcatcgctcctttcccatgtcgaggtatggcaacttcaaattaaatttttattcccacgtgttggggaaaaatcgttattgatcaaaaaggtgagcgttattgtggaggatcaggcgaagaaacggggagagctgaacatg

SEQ ID NO: 2026 - DNA, 703 bp, Nannochloropsis_gaditana
gcaccaccaaagcacgttgtgtccagtcccgcatccctctttttgggctcctcgtgaagattggggtcccatactgttctttgctacagtgttacaatcccagcaatgtgccttgcggagacattttgcccactgctgtcgtccctatggtgtaattttcagatgagaaaaatcaaaaagtgagcagggaaaggggccacgagataagtgatgcaatcgccgcacgatcttaagcacagaaagccagactctgtgcctacggacatgcaggatctctcttgcacatgtcagtctccttcaggatcgtgaagagcgccagtagagccacggctacctgtgcacgcggtcgggtgggacttatgcgaagactctgacaaggaaggcggcggaatcgatcattcccgcagatgcaatgtcgcgcattaccggacctagcgacacaaaaacgcgggctgcgggaagaacctgcttgtttcgcaccgctcgcggggttgacattgacgttcattcggaaggggatgtggtggaaatgttttgtagggcgactgtgccttggtcatgatgttacgaatgctcgcgtgcttcggaaagggcaggctgcccggcggacgcgcccctccctcatctcgatgcgacctctcatctggtagaccgtacttatactcgcgtaccccaacatctttaccatccccattagataatg

SEQ ID NO: 2027 - DNA, 703 bp, Nannochloropsis_gaditana
tgtgggttttttgttttccttcagttcttggcgagccccgaagaggagcgagcgagaaacataaggcgagcgacaccactcgttggcgtgccatcgtaggcggcattcgaagggtacacaacagcgtgcaggaccacaatttgcgttaaatgtgggctagatgcgattcaaggcgtgtggatggttatatttgagcggtcaagtgctcgtgtgtagcgggaagctaggacttgtgcgtcctcgcctgcgaatacactttcaggcgtgagaaaatgcggtgcccgcgggccagcaaccaagcttttgtttttgacgagcgatttcaccctccttagtgctcgttcataccttgtgcgagatttatgtgctccttgttgtgtctggctttgaaaaggggaaaagggatgggtcaggcatgtgggcccagccatgtcggttgcgagcaaggtcgtggaacctgctgaaggaggtggtgacgaatggcggtcgagttgatgcctcccttctctttctcagtgatgtccgtacatatggtcgcaatgacgtggaattcccttctcctgttgttgttattggtatacccggtctattcatcatacgtgccccgcatggcgctgcatcgctttcccccttattgattctttaccatatatacacccctcttgcacaatattgttacagacttttaaaagacattgctatg

SEQ ID NO: 2028 - DNA, 703 bp, Nannochloropsis_gaditana
ggataaatggtggctatcgagtgcttatttgaagaccaatcaaaggcggaggttgacggacgggcgcaaaacagaggacgccgggtactgaaggagacgattcgtcgggaaaggatggcgcacagcaggaggggacgcagtaagactcgcagcgggcaaccaccagacattacgaattatagacagggttgaatcacagcagaatgctgtggggggtggcggaggtcgtacaagtgagtgtgaaggaataacgggaatcgcatatgaagcgaaagggcgagggaagcaagtggaaaaaggaagcaatttaggtgctgcacaatgcaagcaaccatcctatttctggcctcgagtcaccacttgtcacgtgtttctccaggaaaaaaaacacgtgattttttgtgtggtgtaagcatccccgaacaactcgccgcctcaccgcattcgtcagcctgggggcgagacggcagcgagcgccgctttccacacaataaaagtcaccggtaattgcctgcgtccgagtaacacgaactttatataatcctgccgacatattaaagctgttacacagtcacttgcttggtgaactataggactgctggatgctgtctacagctgatcatatctcaggcgcgcaccggagctgtacgccagcatatcaagaggggaagctgcctgtctgagtccaatactcgaaagtatg

SEQ ID NO: 2029 - DNA, 703 bp, Nannochloropsis_gaditana
gcgcgggcataaggcaaaagtacattgcgttgcttggttgattccaagccgttttctcgtctcgggtgctgcggacggtcaagtccgtgtttggagcataaatgaggacggatcaagttggacatgctcgcaggtcctgtacccggacacggaggaaggagaggcatgcgtcaaccgtcttgcggtcctcgacggggagctcatcgctgcagccaccactctctcggtgactctctggcactgtagtatcaagtcaggaccgggtgggcgttggacgcaggtgttctcgacggccatgccccccgcccagatcccctgcgcggtggccttggcgcccttggtgaggagacgaggagacgctccgcacgcagagctggcattactgatcggaggggtggacggtaagattcacgtgtggaacggcacggggctgagaagaggacaggaagggtgtgaggaggagggacaggagagcgcggggagctggtcgtggaggagcgccggggctctgaccgggcatcaggcgtgggtgcggtgtctggcgtggagatcgctgcgagaggagggagaaggggagggagaaggggtcatggtggcctccgggtcgcaggacggcaagattcggctttggcgggtcggggccatggagggcgccgaggggataagaccgggtcgaggggaggaggaggcggaggaggcgggg

SEQ ID NO: 2030 - DNA, 703 bp, Nannochloropsis_gaditana
atctgtgcggcaggaaagtgctgtccacgtggcgaccttgtcatccgttgtcctcacgcctctttcgctgtgattatctcaggactcgaacccggaagatcttcaggcatttttgtcttctgcggacttcgcagatctgtctgcacaccaacaagacatcaatgacgtgcgcacgcaagctttgcggctggccacagaggcgtacgataaaattgatgacagcatacgggccctagactgggacattggcatgctggaaccacagatggcagcagcggcagctgaggactacagtactctggacccgcaaatacttgcaatcaagcgaaaggagcaaagaaaggtaggttttggccaacagcgaaaggcgccatttaaggagagaatatcgtgccatgaacgccatcgtactgactgatgtacctttgttctcccccatcacccccttcttcactattttttattcaacgtgcaaaacccctccaatattccggtttctgaccaggcacaacgtcagggaaagcgacgcgctagggagcttgccgtccagaagaaaaagaggctgggtaagagaggcctgccagaggaccttgggctggttgcctccgttgggcctggacaaggcacgactgagggagatgatgacgtcgatcccaacgaaccggtgtactgcacttgtcagcgtgtatcatacggccagatg

SEQ ID NO: 2031 - DNA, 703 bp, Nannochloropsis_gaditana
gtgaggaggagggacaggagagcgcggggagctggtcgtggaggagcgccggggctctgaccgggcatcaggcgtgggtgcggtgtctggcgtggagatcgctgcgagaggagggagaaggggagggagaaggggtcatggtggcctccgggtcgcaggacggcaagattcggctttggcgggtcggggccatggagggcgccgaggggataagaccgggtcgaggggaggaggaggcggaggaggcgggggagggggagggtcggctcagggtggaggaggaggaggatgaccacgaggtccgcttggtgatggagggggccgggtgcaggtacggcatccgcctcgatgccctgctggtgggccatgaggattggatcacgggcctcgcgtggcgtccccacggatacccggatgttggaaagaagaggcagtccctcgctttgctctcgtgctccatggacaggagcctgatcatctggaggcctgagggggcgcggggggcgtggaccccgcgcgtgcggctcggggacctgggcgccgatttgggtggggcggtgggaggcaatttactgggctttctgggctgtgtcttcagtgagacgggcgacagggttctcgcgcatggcttcggcgggtctttccacgcctacgagtgtgacaggagggcggagggggggggcggggcggaggaagaagagga

SEQ ID NO: 2032 - DNA, 703 bp, Nannochloropsis_gaditana
gagtgtgacaggagggcggagggggggggcggggcggaggaagaagaggagggggaggaaagggagtcacgatgggtccctatgcctttcgccacgggccacttcgaagaggtgagcgatgtgcaatgggagcggcctggaggaggcgttggcggaggacgatacctggtgagtgtgagcaaggatcagaccacgcgcctgtgggccgtggcctcccagacgcgccggctccacgagatgtcgcgggtccaggttcatggctacgacttgagctgttgcgacatgctcccgccgcgacggcagggacccggcgacgaggaggtctggcaagagcaccgcttggtctcgggggcggacgagaagacgctgcgggtcttcgacgccccccggaaagtgctcggcctcttggcggccctggcggggatccaatccgcccagcctgcccgcattgagacggcctacatccccgccttggccctgtcgagcaaggcggtgggcgtcactgcatcctcttcctcgaccgtggcccatgtgcagggtgtggaggcgggggcggggagggaagaggcctggaaggcaggatcggccgtcggggggggggctgggaaaggaggacgccgaggcggaagccaaggctcgagcccgtgtctcgtgggagggccggggcgccaacccgtccttgctggagggcgagctcgtggac

SEQ ID NO: 2033 - DNA, 703 bp, Nannochloropsis_gaditana
ccgctgcattaagctcctcatctgcgaagaaattctcggcacgattgcaggatattcgaacttccgcctccaaagtccagccactaaccaatgcgcagaaacgtggtttttatttcaaggctgaaatgctctggcaggctgtccaggatgggttacctgtcgatgatccagatcacgactctttgcttgcagctatcgattctttcgagagtgaaatgctttctctcaatcccgtgcggctcgcctcctccttcctcccacgtattcttcaacgtgtcgacatgctagtgcggatggtcacctgttgcgtcttcttctgcctgatgggcgtcctgacctttctcccgatgataactatcgcacccattctcgactcgctcctcaagctcgtgggctggccgcaccagtacctgacaaacgcactttttcagaaggccgtcggacgagggttcctctacctcgctggagtcttctacacggaggagggaaaggctaaaggcggctaccgcacacctctggtagttttgtttcagcacggctcgaatctggatggctttttgttcctggactcgttcccgcaattttttaaatccattggcaaggacgatatatatctcatgccttacgtaggctggctggcctatgtgatagcgacattgcccatcgacaggaggcatcgcaacgaagccatcaaacagcttgg

SEQ ID NO: 2034 - DNA, 703 bp, Nannochloropsis_gaditana
cttgctggccacggcctccagagacggggtggtaaaaatttggggatggcagggggaggggggagtcatgtggcgcgaccaggtcttaccggtgcttggaccggaggccctggccagcttcaagcccagcacgagcgaaacggacgcggtcacggccgtggccttcgcaccccgcttggtccagggggccgacgtggccggctatctgctcgcgctgggcacagagagtggtaacgtggagttgtggaccggtaccaaggataagggcaagtcctggcgctgcctccttgcgttcgacggaagcctgccccacgctggagcggtgcgccggctccgctggaaacctctctcgtccgcgcaggatggtgatgagaagacctcgttgatcttagccagctgtgggaccgaccatgccgtgaaaatagccaggatccggcacctgtgatgtcgcgcgtcgaggcgttcttgggaacacattagagcaaagaatgacactgatacctgtaatgaggaagccctggagcttaaacaggcattcgtgattggaaaagcgttcatttgaatcatccccctcctagacaatgttatgaggacacactcaacattcaaattctccttccattaccccgcacagacgcggcttcgatgcgcaggctctgtttctcctatccaagtgccagcataattatagtcgccctggccc

SEQ ID NO: 2035 - DNA, 703 bp, Nannochloropsis_gaditana
ggccttcccagcagcgaccgcattgcatcgcgcttctggtaccatcctgctcctcgccacgactgaggacaaggcctccgtgaacatgctccaagctctccttgccagaggaggctgggaagagaccacacccgtggacgcatcttcccgcgtgtggcaccgtccggacgggccccaaaatgtctttatgtggcaaataacgcaaggtttcttgcgggcggactggctggataaggcttggctcaccgcccacccctcacagcggatccaagaaatgatatttctgagccggcacgccgccgccagtggacggccctcgctcactatccatcccataggaaatcctggccagccctttgcgccacaggaaggagctcggggagcgcatggcggcatccctggacggtgtgtccctccttctccacgcatggccccgctttttagacagttgcatagggccgttcaagacgcaggactggcgggaacttttgaagtgacgttggaggccacccatcacgggccatggcatatgcatccaacaatgtttgtggaaattggttctaaggaggaagattggggccgggaggatgctgcacatgtgtgggcggatgttctcgataagaatttgggcttgagtgcgactgaagcgaatggagtgagaatccctgctgtggaggagtccaagctagtgatagtcggcgcg

SEQ ID NO: 2036 - DNA, 703 bp, Nannochloropsis_gaditana
gcgccgacgggtgacgcggcggcaccgtggggaccagcgggcgggccagcagggcgtggaagcctccccccgaatgttcttttggcggcacgagcggttctggttccacccgagagaatctcaagggcagagcaggggcgccggaccatggcttcggcgggcgtttgacttgagccggtcctatcgagagatgcaccgaataagcgcggagcggttggaggagagccttgtcgatgacgtggccctagatgccgcctttgcccgtctgctcacctacggcgagaaccagctggacgtgaatatcccgccctttccttccttgatcttgcaggaacttctcaaaccttttttcgcctttcagcttttctccatcatcatctggatcttgcaggagtattacatctacatgtacgtggtggtcgccctctcggtcatctccattatccaaagtgcctacgccgagtaccagaacctgaaagccttggagcgcctggccaaagcggacgggatcatcaataagatccgactctatgcctctgggcgcgggatgcacgcttctcgccgcagcgacgaggacttgctgcccagtaggagcccgtgtgcggcccatgccggcgggaaacttttcgcctgcctgacggcagaccctgtggccacctcttctttgcagccgggagacgtcgtgcacatatccacgaacatg

SEQ ID NO: 2037 - DNA, 703 bp, Nannochloropsis_gaditana
ggaggctgaggtcgagacggttctggaggtcgctcctcttggaatgtcagacaagggattgttacacttttaccccgttgtctacactcatgcgctgctgcaactgtgcataaacccacatgcgtccatatgaacgaggcatgccacccatgtgaaccttaacgggggtgaggacaccgcgcatgcgcccagtttttccaatttgcggtcggcagcggcgggcctgcgaggtgagggaagtatctctctccatcgccctattcgcttaaaggaaccaagaagaaagcacgaacacttcggggtggccccttgccttgcccgcttggggtggtgcacggagattcagcacggtgttcacagacgcggtggccgcgggaaggcgtcacgtgctgtgtttaggtcttttcgtgtcggttacggcatgtgccgtgagggaggaggaattccagcacttcgagagggagataccctcgctccgccgccgcaatgcccgaaccgaccataaaacccaaacttgcacggctcaccgctcgcgatcgttgaatgtgaccgcagagatgatgtttaaaggtcgacctggaccctttttgcgtgtcaatgtgcccactttgtccccgtaatcaaggcttctcttgcaacagactttctccgcctccgtattcaacagactcgcagcagcacgcagcaaacaacggtcaccatg

SEQ ID NO: 2038 - DNA, 703 bp, Nannochloropsis_gaditana
ccagaccgacgacgcgacggcccttgtcttgcgtctaaacagtgagatcatcggagatccatcctccttgcccgaacgccgacaggcactggagagaatactggaggagcgcggcctcttgtcgaccgtggaggaactcgtgctcgatccagaccatgacgaaagtatcctgatcaaggtggaggtggaggaggagcaggaggacggtcacgaggaagagggaggggtagcaagcggtcatcgccgcggtctgggacgaggctcttcctcaggcggtggtgtcagcggaagcggtgcaggcagcagcggtcgaccttatcatccggtgaatgaagagaaagaggaggagccgttgctcgaccttcccatcgcggcgtacagcgacaacgtctccgacaagacccagcatctggtgggagactctttggaaattttgtgttttcaagaatctggctggagatattgtgtgcgcccatcggagcctccgaatctctcggagctacttcgcacgatgggaccaggggcgctgaagcggcttttccgggacggggcatttgatgatttcaatatttggcggcacccccgcctggccagctatgtggatacggttctccttcctccgaaaagtctcaaacaaacgcgtcattcctccgctctggccatggtacgacgcttcgatttcgactcggaccttcgccgaatg

SEQ ID NO: 2039 - DNA, 703 bp, Nannochloropsis_gaditana
ggaacatttgtcggaggcggagttgttgagaggcacacgtgaggaacttgagaaaaacctgaccttcgtcggcctgcttgtcatggagaatgccttgaaagaggagaccacgggatatctgcgcgattacgcccgggccgggctgcgtcagatcatggtgactggtgacaaccccttgaccgccttagctgtatccaagatggcgggtagtgcatttttgtgtgcctggcgccacccactgctggtagacctgggctcgggagcagggacacgggatccgctattggcagtagtggacgttcttgaccccaccctccaatgggaccttcaggaatatttgcaggcatatcttggctcggccctcctaactctaaatgcaaccaaggcggcagaaattggaaaagggatgatcgatgacagggatagcggaggaagctctcgggacagtagtagccaaggggacgatcgtccgaggaatagcaaggatagaattccctcgacgacaccagcgttggccttggcgggtaacggggggaggaagccaccaccagccctcgctgccgtggaccttgtttgtacgggacgggcatttgccgcgttgctcgcgcagcacgcacctttgcgggaggaaagagactgtgacggggaagcctggactcctctagaggttgtgcttctcaagtgcaacgtcttcgcccgcatg

SEQ ID NO: 2040 - DNA, 703 bp, Nannochloropsis_gaditana
tatcgtgaccgtcgttaccgccactcaaaatgcatatgattgagagttgtcagtttgttccggtgcctgatctgtcgggtcggagatatttagggcttgtgttggagcttggtgggtaaaatactgcaatgggcccgcagctgtatgcgtgaagcagccaggatgtaatttctcttcttccacgcggcagcgggatacaggcaccgcgtcgtctcacctgttaaaaaagaaacaatgaacttaaaaccaatcatagcgtggcagtgcgtagcgtgggcgtactgtcctgcacaggggcgcgcggtaggccgagagcagggcgtgatgcagggcaatcaggaggagaggctcgcctcctcgccctccgagccttctccctcgacgtcactcctgttccatgttgaggacgctgccttgccaagtcttggcacgagcccgtgcactatgctgacccacacgggccaggggttgtcattgtggaagtcagaattgtctcttgacgagtgcggggggaggggggaatctggggtccccctggtaccgtatccattctcgatcatcacgctcttgagttttctcgacccgactcagcaccacgccacctttttgcctttgcaatgttctgtgattttcgtttgcgcatgggtagatttgtgcgaagaaagagggctcaccgacttattatactacttgcactgaaagg

SEQ ID NO: 2041 - DNA, 703 bp, Nannochloropsis_gaditana
gggagttgtggtcgacgaggggcaggaagcgaaggaaaattttggggcgggattttgggttgaggatgatgatggtaaggacggagataacaacggaacttgaaaagttgttgacaagtctatgaattgtagaggggttaaatcgtacaagagggatgtgagacgcatttttttgccagggtgaccacatttgtatttttatttggcacccttttccatattcattacgtactttggtctggatcactcatatttaagcctgtaggttgtcaaggctagaggccgcacaaagttcctccggggttatgcgatggctctgtatcaaatatgtttaccgctggcagcgcgtggttaaagcatgtggactattttaatttgaaaaggcaatttgtgcgaaaaggccagctaaaggaatgctcatgttggaatgaaaggggcgaaaatggttcgaccgctcacatgtcggttgttaaaattcctgcggcaggcaagtggaacgttcgcggtaggaatgacgtcattgcttttataagagatgacgtcattgatatccgccttcatgcccctaccccagtaagggcttgcgttgcttggccacaggcatgacattttatgtcccctacctcatcttctgctgtttatatcgcttacagacggacgcctagacgtcttgggctcaattgtgttgttagtgccattcatg

SEQ ID NO: 2042 - DNA, 703 bp, Nannochloropsis_gaditana
gctgaagaaaaatcaactgagaatgacgaatccatccacccaacttgtgtccgcttcagcccacttcagggtcaggaaattgtttcaattatgctgaagccgattcaagtgcacgtagagtctctagcatggctggttgaagaacaaaataataaatcgagttgatacctgcgggagacagctacgtatgcgcgagcactccgccatgggcccaaatatatgcgcccgccccggttgtatcgtatttcaacagtttttctcctctttcactctacaaatacccatctagagcttgaagcgtgctatggtacgtccactctccctttcagaacccaatgtggaggataatgaggcccccctttcgcatccgctgtcacccgctcaagcgtcaccgccacctccttctgcggccggttcacccttgacaaatgactctatgttcactccctctgcgctactcgccaaagctttgctatgcgacgacgaagatgataattgcagccaaggcaatgtgtccgcagaagagaggatggagcgcggaaaaaataagggacgccgttcgaagcagcatccgaagctgggggggcagtcgtctctaggcggttccccttcggcacaaccatctcttcaaaccatcctacgccaagttcagccaccttcaacacgaactggtcaatttcacagacaacaggaggtgaaaatg

SEQ ID NO: 2043 - DNA, 703 bp, Nannochloropsis_gaditana
aatgttctagacatggggacattctcacatttcattgtttattacatatcacggaaaggtgccgggaggtcgacaagagcgatactggcgagacaaaaggccaagaatggtaaaaaatctgaaaatttggtaagtattttaaagtgcgtgactaccgatggcgggaaggatgatttggtattttctgaagcactgggggcatactagattgtcacgcccctctgccctttttgtgcctctgggatgcttcctagctggcggtcgccgtttttttactagccacgactgttccatgatgatacgccccaggctctttcaacagtctctgcaatttttaaggtgatgacccctttgatggcgaaaatcttcttgttataaattgtgcggacagagtcgatgggacctcgtgctttaattgcacatgatgatcatgctacatgatgttacaagggaggggggggcgccaagagcttttccgccatgtcagcacgtgcctttcttccatgctctcccagagcacaaacatcacgttaccgcgcatcccagcaatgaattataccttatttctcgcatgaaatttcatcaacacagaaacacgcccgagggcttgttcagcaaggggaagtaagacaggattgggaagcagaagtatctacttatcctccgggccttcacttggatctcgcctcagtctgaaagcatg

SEQ ID NO: 2044 - DNA, 703 bp, Nannochloropsis_gaditana
cgatctcgtcagtagccggtctgacgggcctcaatgaatgatccttctcacgatcttcattcccgccgatcactgcctgataccagtcagcgtctttcttcaatgcctccgcccgagctgccgccaacaatttcttatcgggcaccacattcaagttccaacactccaaagggtccgatcttgcctcctcttcggtgggagagcgggtggcatgctggggggttgaggacgcgcgagaagccggagccgggacgaggaaggtggtctgtagtccgaaagccgagcatactccgttgttggctaccgtcgatactcctatcatcatccagagtatctgtcgccacatgacgcactatcctgtaaaggtttggatgcagatgaatggaaaaggtcgaggtgaagtcttggtgatagtaggggggggtatcgggcgatgtggagaccgctgcttgcggatattattttccttctaacctccttttttcccacgccaaacacataggtagatgacaaaatggtaataaaggtactttggattctctctatgccgcgccccggtcggcgttgtctttccagcattgcgttatctttcaagggagttgaagcacggtatgacaggaggtctgccatcgcgtcctgtgtaccagccgggaaatcgaacattttcggttgtggaaggttgacaggagatatggaacggatg

SEQ ID NO: 2045 - DNA, 703 bp, Nannochloropsis_gaditana
gcacattattttggcattttaagtgacttccggcgtgaccaacttgctgcaacgcgcgacagctgacgtgttgtcgagaccccccgctcctccccactcatgtggccgcggtcctatatttctgatcggaggctttcaatgcaccttgaaagcaatatttgcaagctgatacgggatgtgcggaggtattggaggcaaatgcacggagggatagcctttatgggctccgaaagttcctgcgtaaacttgcattccttaccttaagttccgcgaccaagccccaactcacgtttgaccacgcacatttatcatgaaacccgcagggaggcggcccactgcacgtaaaagtgatcttccttcccttggctacctatggccacggccagtgctcgtgtcgcggtcagtatagccgctgcggataaggaaaatgtggcgccagcaatcccgatgggcaaaggaggggtggcacgacggaaaggtctgtccacgatcacgctgggtgcggggcacttggcgaatgtccttcgagaaggtgggggtaatgcagacgctgatgcgagcaggaaaacccccttaacactcgtgcgaggagcatgctttaccacgacttctactcttcgcggagagggcagacgaggtgttcatgctgggggagggcttgccagaaagcgaggccagacgagagctagctcaagcagtgatg

SEQ ID NO: 2046 - DNA, 703 bp, Nannochloropsis_gaditana
actgagcgagagtatagtccatgtcgaacccaatggcccggatctgctgcatattgatttcccggttacaaaaaacttctgtctcaccgtcaagcaagtacttgtcatccctgggcggactgccagctgacattcgtattgaacctactgagaaagtaggaggagacggtagctgcaccgacctcctccccagcaactgtgaggcgcggcatggagccgtgaaggcttgtacggtcagtgatgcaatgctggacaacaccatcaccagagtgaactgccatgacgcttttgcggggaagagagccatacctttccggctcattaccctttgaggcctgtcgggcagatcgagagagtggaggaatcgcaagtgaggggcccgggcgtgtgatatgctcgatctaagcgtagttcgtcccgttgggagcagacgaccctcgaagacataggtagccacactttctcgtccatcgacccgtgtgacagtggccttcgaaagcgggtcagcacagaagggctaatcgtaagagggagattcaagactcaagagagcgtcgcttccccttcgtgcctatcgcccgcccccttcagatgctcgccattttcttcacttccatcctacggacgttctgaccattccatccccacgctacttgtacccacataattgaaattagaattcagacgccgcgtcacaaagatg

SEQ ID NO: 2047 - DNA, 703 bp, Nannochloropsis_gaditana
aagcaagttgaagaatcataccgcttccttgcaggagtactgcgcttggatagagtgatcgagaaggaaaaaccagtgcttactaccgcacaaagtataaccagagaggccatgattctttctagaggggccgcaggggtgcatcccatcttttgtgacaacgtgtatcgctgtcttcttgccatcctcctcctccgtcccggctgctgccagcggcgatcaagcttggaaaagcggccgacgaagcagtcctgaatgtattcaagattgtaagcaggacgttaattacacgccaggtgaagcccgttcgatcccgcccggcccctgaaaagccatgggccaagcccgcccgagttggggtgcgcggcgatgcgtgacgaaaactggcgccaagggcgaaaaagcgaagaggccagccaggcctatcacgctacgaccttgatgcacgtaccacacgcgggcagaggtcccggcaaccgtgcaactatttgtcgtcaaaatttaccagttctagcgtcgcatggttgatttattcacagaccctctttctcttgcccctatccacaggtttgccccgttaggaacggccaagccctcgtcgaaagtgttgtctcgctcgtttcgtccttcttgtcgcttcgcggatcatcgtgcctgacaatttgatctacccgcccggtcgtgaaacatctctctgaaaatg

SEQ ID NO: 2048 - DNA, 703 bp, Nannochloropsis_gaditana
tagggaaagacacggagtcaccggaattggccttaaatttcattcacacagcacaccatcacgcccagttctgcctcactagtcctgtccatacgctggaaagcgcgactcatggacgatccttgtgcatgctttcgagctttccttccgctttaggtgatccggtcattggggagggcgatatgacagtggaacaaggataaaacccgaggcggttgtcttccaagccacaaaaaaatccccttttcctccacatttatagccacgctgccctttcccgcccaccaagacaccgaggtatacgtgacaagagagacaatgcgtggtgggcatgccacttgttcgaagcccgggatttgtggcagtggctattgcttatgcgacgatacgcggtctgtaggcaaaagcaacagcaggtgccttgcttcgttgggcagtgaatgacacattttgtgttcatgcccccatgacgagggcaaagaagtatagcacgtggttcattaagaatcattgcttcccatggaaatagtgcttttgcgttcttgcatgttcagggttggaagttaggggccataaaatgatcatgatcatgcaaagagctgcggttctttccgcacctcttgattatagcttcgcaaccgagcccaagcacctttaaaacaaccacataattacacaggctacaacgtgtcgaggcactatg

SEQ ID NO: 2049 - DNA, 703 bp, Nannochloropsis_gaditana
gtgtatgcgacgcggacgacctgtggacgcgtacacagggtgccatagccttgcttatgctttgggtggtgtggcttgctggttccttctgtgccttctggtggccttatctggtcttcaaagggtatcacaaagctgccatagcgacggcattaattatggcatatccatacgtggtgaaagtcaagcaatcaccagctttcatacgctttatattgtcgggtgctggttggttcaagggtggcacttgcctttacctcgaggagtcgatgaaaaatgtcgaaacaagccaggtgcgtgttagaatgcgtcgtgaagatatctgcgattcctcttcatatttggggtcacactttgaagaataaaggaaatcgaaggcagcatctggcctttggctgctggaggaggtctctattttgcaagcttccgtgctcacactcgtcattgtcctttcccctcaaaaccacgccagtccatcctcctttgccagcacccgcacggtctcttcacatacggattcatccaaaacggctctgcggctcggatcgacgcccgccgcccggaaatttacgtccccacggccttccggcacatgaaaccgaacgcagtggccttggtggagccccttcttttcaaaatcccactcattcgacatttcatcaccgcctttggctgtgcacggcccgcaacaaagcatgaaatg

SEQ ID NO: 2050 - DNA, 703 bp, Nannochloropsis_gaditana
ccaaggcccgggaggttaaaggcggaagaaaagcaagagcacactgccgacctacatcatatgggaggacgtaaattaggcggcttcgcacagatttttttaaaaattgagtatgccactccacgtagcacacatacatacctgacaactgcaacgtgaatgcttcccatctacctgatgtcgcaggtcgccccgctcgcaagaaaaagctggtaccgctttccatccatagccaccagacaaacagcaatcggtgtgaaaacagacccatgatattttgactgtataattaagtaattgaatgatgcgtatgcgtgaatgtgtgaaaaacatcgagagttcaggcaagaaatagggggatagaacagaggagtggttgaatgcgcgagagggccgatgagcagcctgagccttcggaagctttacccgcttttttgggcacgaaatgcgaccatagagcctccgatgtctcatacagtctaccctatgtatcatgcggccgaggtggacatatccctatgcaccaagtgtaaaattttgtgcttctcgacggggggagtttcccagcgtcatcaaggctctgggatcgtcatcggactagccctccggcgtcttttgaccctcgctcatcattgccacccgttccttcctacgcgctacagtttgttcccgtagcagtagaggtgatttcttgcctgccatg

SEQ ID NO: 2051 - DNA, 703 bp, Nannochloropsis_gaditana
cgtccatctttccaggcagcacataagagtttaaagaataaggcgtatgttacagagtcaaactcatcggcaaagtctcgcaattcattgcttgcctgcagactcaagagctggttgaaagagagggactaaatggttggggaagggtgtgtgtgaaaaattattaatacaaaacaatgtcatgatgaaggtttccaaacttcggtttcatactgttgggaagtcatgatattagaggtcccgtccgatatttgtattctgtggcttagagttcctacctcaaagccgagggtcatatcacaggaatcacatgaaagaatacggcgcaatagggtctgtggactagccacctcatcttcttcctcctcttccatgtcccgcgacccatccgcgttcatagtccacaagagggaagttgaggcgacctcccgcgcaggcggggaggaggtcgggtgcatgaccatttctcatgtagctggaaggtcctctctcgcagcttggcggaaacttctcctttcgactcctgtgataatgataaagcacgactcaaaaataaataagtattgcttgcataactctatgtatcctggaaaataatgagaaacggagaactacccattcgccgtcgggaagccaacctcctggcaatcttcactttcggggcttttggatgtaaagtcacgactcttacatactcaacatg

SEQ ID NO: 2052 - DNA, 703 bp, Nannochloropsis_gaditana
cttgtcagtcctgtgagggttaacatgactatttaatatatttgattcactatcgcatatccacaatacttgtggattcttaacaaagcatggcaactagtataaaacgttgtgcaaggaatgcacacaaacgactgcggacaatcagttcgctttccgcagtctcgctttcccccgggaagtcttgccttcgacaatgctcctcaagtctaataagtatgcgtcgctcatccgtacgcccatcgccttcccagttccacggcgcgcaaggtagaaaagtactttcatcccttgcattcatcgaaaaaggactatcctctttccggtcgagctgctctttcccctgagaagcaagttctgcggcggccaaacgcgctgcgtccccaaagcgacacgacgcaaaggcttcgaacgccccatcgtccatgcccggcagccacgctctcagacgttaagattcgtgtgactgtaaataaaatgtattctcgattaggaagaggtggcgatacacggttctcgatcctgcgtttgacgtatcatcgcttgttgtgttgaacatggctgagtgctggggggtttcctagctatcaagttaaaaatttaccaactccaacaaattgaagccttacctttcattttttttgcacaatgttctctccagaattgagaaactattcacgccgtaactattcaggtagctatg

SEQ ID NO: 2053 - DNA, 703 bp, Nannochloropsis_gaditana
gtacaaagttgacgggcacacgtcgtctgatgccgggcccggagcaggatgacgatcgttgtcatgattgaaatcctcatcaacgtcctgcgggtctgcataccgggttttaccgcgcacaaagctaatcattggaatggctcggtgcggttgaaaggaggtatatttagatgtctgtggtccataatggccgcactcggacgcgcaattctggtcccacacctcctcttcttgggcgccaattctccctgtaccacctttacagtagccttccgacaaccagtctctttcaagttccattttcatgcgtcatttacctgatgtaaggaaagcaggtaagatacagtgtttgtaaaaatgtaaggccgcaatagggaatggaaggaggtaatgaaaattgcgcgaacacgtcttgcaacgtgcgtggctcgaggttttcaggcccatttactggactctttcatatccttttcagtagttgacgtcccgaaggggcgttcgatcactcccagttccaaattaagtaattgtgacggataagctttatcacaggaatggtgtgttacgtttataggaatgccttaaacactgctcgggatatgttccctcgagtctgcacgcagggacttcgttcgtcgatgcaaagcatgccttactccttgtgtctcacttattttatccttcgatcccttccgaagaaatg

SEQ ID NO: 2054 - DNA, 703 bp, Nannochloropsis_gaditana
aggttccttggtcatgcggacgtagggattgtcccccagacacgtctcgcataccaaagggaagtcactcgattcccatccttccttattcaaatccgcctttatttgcatgcctcgttcccccatggtcgcccgcctgtctcgtcaaagggatgcacgccggggtgaggtagtcctgatactgctcctatgaatgaagacagcaattccctcgcaaggtctcgagcgacaccgcgccggcatcctcgagcacatcacaaccatatcaatccaacgcccgtgacgtggcctacaggccccaatggtcataacgtggcgcgggcggaggcaggagagcacacggaaggcggctgccatccgtcgcgcctcgccgtcaagttgatatttccctagcggagcttgtttcgagaaagccctgcgaggcgcacgcgcttgatgttataaccaaggataatagggagatcttcgcttgattgacttccctgacttgccaactcttccacatttacgtgcattttttgacagatttagagttttgctccataatgcgtcggattccgaaagccgcaacagcagtatcgtgctgcctagtagccttgtggtcctacccgaccatggcttggacttatcttgcaccgcgctctacaatcggttccagctgtgcttccaatgatgccatgtgcagagccttctcccaggggac

SEQ ID NO: 2055 - DNA, 703 bp, Nannochloropsis_gaditana
atcaatggatccgatgaccgagaaatacgcatctactctacatagcctttacaggggcagatatttggcgaccacggggggaggagggccgctgttgttgcatcggactcccacccccgggacgaggtgggacggatggcttgttcctttttaagcccagcccagatatcaggaatgactcgtgataaacatcgacctttgtcttccccgtgctgcctcggatgtttgttccggctcgaaacccgcaaaaagcgatctctcagccgttgtgataccacgggggcaactctctactctcgccaagcgacaggcaagacccactaaacgaatcttgccctcatcggtccttctcgacctgaatacgtgctttatatattttgtagaggtggaaagggcctgcgtcccattatttattggatttaatagaagggcaggcatcataagcgagaacatgcacaggcgtccctgcttgttctcgctggacaagtgaggcgacactggatagaagtacgtgctcgaataaacatgtgctttggagcggcaatacctgcgagctggaaaaaatcgatatctcgaaaacgacaagacaatcctatgagtgcctgagattcatgcttaattgacgtatattcatttgatactggtaggctcggcgacctcccctcaggaaaggtaacataaaagaatctcactgcacatcatg

SEQ ID NO: 2056 - DNA, 703 bp, Nannochloropsis_gaditana
cgcgtggctcatactttggcaagtcaccactcgtggacactactggaggcttctctccaccatgcttcactgaagtcgccgtgttagcacgacagcagtctgtcgctacaacagcagcatgaacatcgggacatcttggtgacaaaagcccctttcgcttaatcgtcatacttgtcgtaagtgcccgtctgatatataggtaatttcacgagcgtcagactgaggaaagaagtcgtcaatcggcaataagcagacaccacagaaggctctacgcggctacacatattcttgtatggcaagccaagttttgtttttttcggggggctccgggagcttcggaaaataggggtaactcgtttgatcgaccgtcaatacttgctccgcaaacgagaagcacagggttggtggataccgtcattactatccaataccctgcagaacactcacaaagaccaggccccattcacgcaaaaatgagagagggctgaggtgtacacaaaacacttgggtaaccaagtttgggacccagtgcccggagcgcgaccccggcgcctctggagcgagtcctgtcagctggcgcgcatctctcgtcgattcttcctagtcgctttcctatatcactcataccatataccacgcgagtcctctcatgattcttgaccgttgattatgctctcaccatactggtcaacagtttcccatg

SEQ ID NO: 2057 - DNA, 703 bp, Nannochloropsis_gaditana
aaccagctgccgccgtttgctcgcatcgcgacatggctcaccgacgagggaggcgcaaaaaatgctgaccaagagtgcgaatagaccatagtaggagaggacggcggaggtctgtccgggacgtggtggtgctcgcatgagtagaggtgacataaacatctgtgacgggcggggcagggacaagtgcctgcctcgccgaagcttcaagccgccgggagtcgacgcaaggcggagacgctattagccaaatggtattaggcatggcaggcacaaggccgtccatcccgttcacttgccgcttcatgacccatgctccttctattctttgtgcgtggtgatgcctcgtggatgtcgccccatccttcgaccgactcgtatgctcgtagctacttttttgctgccggcatcattgtcagcaaactgaatcgctcataacccttccccttgtctgagcagagcctccgagatgcgaggccttagctcttctcacgttttcctgctgctggtgatcagcgcggcagttttggggaagggcaccgtcgcgtttttacctgttcctggaatcaaatcatcacgggaaagggcattgataagacctctgcgtgcatccttgaatcaagagagcagcagtggcaaaaatgacgtgggaagcagtcgagacgagttcctccgagggttccttgccgctgccacgggggcaatg

SEQ ID NO: 2058 - DNA, 703 bp, Nannochloropsis_gaditana
actttcgaccctgctccatccttatcgttgcatactttggagggatgagggcgcttgtacttgaaacacaacttccatcccgccgacccaattcccaccacgtcactgaaacggtcttcacacgaatacgtggtcgtcttacatctcagtcagggagagtatgcgattctacctctttaaaagatgtaacatgttcgaaaagaggctttatttgctcgagaggtcaagatcaaactttaagccaagttggatgcacccagctcgggaagatcaaacctttaaggccactttcatacattcatccggaacacaaaacagtgaaactaaaacaggaagctcttaagaagtccaactcaaagcagacctaatttccttcgcttataagataaaaatttctaggggcaccaagctttgtccatccgtccaggtcgagaaacaccagagagagacgatcgctcgctcgcccccgcctcaacgtgtgaccgttacttgtaaatcctgcgtgccattccatcctcctgctgacaggtggacggagaatgcgcaagggtcgtgtccccttgtatttttgatcgcgagtgaggatcagacattgaatcatttaatcaggaaactggaattcctcaaattcgctcccattaccaagccagggacctccgacgagacaggaaattgaaacgcaggaaggaaaagaatatacatg

SEQ ID NO: 2059 - DNA, 703 bp, Nannochloropsis_gaditana
tcgactgtaaacaaggaaggcttgtcgaacttttgcggttcatccgggtctttccaggttcctatgcacaagatcatcaatcacaacatacactgagcaaagtttcggtacaagcccgcgctcacgtggcgtatgttctcctgtgtcgatttatctctcccccgttacttcaactgcaggtcgcacagggcgtggtgcatccacctgcccgaccggcacgtaccccgtaccacacgacgcgagcgactgagaacctcgtggagcgagagctgtgggtagtacgcacgacgtctggatagggtgcctactcggagtcataagcaggtgacgtccccttgtacatctttgttgcacgtaacgccaatactgagatcggaagaattgcaaaggagccactccaagcgacttgttacgggaaggacccttaattgcatcgatctgaggtataagcatttttgaaacgatagcagaaataagggttgggaagggaaggctctcgggaccttggtgtgcatggtgtggttgaatatccacccaattcgtgtacggtccatcctaaattgccgactcatggtgaactgattccatcccagggcccagcctgtcattcgtatccataaatttatatagacatcttgtattatctgacgatccctcgcttcctttctgcacatatttccacattcagcaggtggcagccatg

SEQ ID NO: 2060 - DNA, 703 bp, Nannochloropsis_gaditana
gttcatccgcaaacctaactttctttatcggaaccgtagcggctgctggacgaggaggcggtgccacttgtgaacgagatggagtcggatgtacttgtgcggaggaagggacaggactcatatggcctccttaatggaatcactgatgtaattatggaatactttaatgagcaacatgaaaagtacgatagttaatctcaggtggcaaaagcaaattttcagtgtctatttcgtgcaccccgtttcgaaagtactcacgcgtaatttctatatatcctatcgcctcacaaactccaactacgaccgtttagaatttcctatcacgtttgtcgtataaaaatccccccacccgcatttgggttgaatttcggccacgatgccaccgcccaaaaagcgccctagtacccagcccggctgctgacgcttgaagtttggcatcggcgagaaagagagccttgcggccgaatgactcacccgtgtcaaaccctgaagatgccacaaggcgccggcccgggcggtgggcaggtgcatatttattgaaacgtctgttcaagtcgattggtatccttccaatgtcacaggactgtgtgcagcatccttgccacgcgggtgggtgtaagcatcgtcagcagcgaggaaggtcgaagaagaacaaatcaattgatgcacttgctgtccaccgcaatatccgaaagatagaatg

SEQ ID NO: 2061 - DNA, 703 bp, Nannochloropsis_gaditana
tatgggcgtgtggccccccctcgccgcaaaacgtcaagaaaaagtttgaatcactcctcgccctttttcctcaaaacgactttcttggacttcggcgccatgaaaccccaccgatgcactgcaaactagacgaacaacgaaatgtcctcagcatctgcacgacttcggtgcacgcggggtttttccatcaccctgtgtggtgctttggaaaggggcggtcggaaagggcttatttgtctctcgcttcctctcgctttttccccatatatccagtaaatactttggatggccaagatccccgaagatactattgcgcgaggccctttgacatcatgtgcacattctgctgctgatttctcttccttcgtcatcaatccacccgatttttcttgatcttctggtttgtgcatccaactatggtcacagcatttattcgccacacacagctttttggatcaggtgggacattcggccccctgtatctcggctacgcctccagccctgaaccgcctgcttccacgcagcaatcgcttcacgtcaagttgatatcaggatgctcacattcctcatcgcccggtgacattccttcctagttgaggaactccctccattctgctagtcatctgtttttcttgaagattttatacattcagaggaccctttcaggtccgaggaggtccggcagtggctctgggagaccatg

SEQ ID NO: 2062 - DNA, 703 bp, Nannochloropsis_gaditana
ccttcctctgccggcctcccgagagccaccccccgcactcttttgccttgcccacgccctccctttctcgtcttcccggcctgagcagcagccccccatcccttctctttcctgcccagaaagacgagcagttccatccgcacagtccccttcccccgcttctggtcacttccctcaaccacggcaccgtcctgcacgacgcctccacccctccctcgccctccccccctgctcccccccgtccgacccgccgcatcctcccaccctatcccctgccctccctcggacccttccactccggcgcgtccacgtccaagcctgccacgacgccaacgtgtacctgctgggaccgatcgagagcgcgcatatcgccgcgtgcacggatagcaccatcgtccttggggcggtggcgggcctggtccgggtgagcaactgcgaacgcctgaccttggtgtgcgctgcgcgtcgattggtggtctgcaactgtttggactccaccttccccgtctacctcctccgtcccgccgtcctggttggggataaccgcggctgccgccttgccccctacaatacttgctacccgtccctccccctcgacttgcggacggcgggcttcggggagctgggctcgacacagccccggaaccagtgggattcacccatcgatttgacggcggagggccacaatggggcggggggcggc

SEQ ID NO: 2063 - DNA, 703 bp, Nannochloropsis_gaditana
gaggaaaccgcgcctcagtctaccatggtatttgtgtcgtaattgcaagcacctacctccagagatgtactgatggtatgtatactttgtgccagggcttccccatcgtccagcacggcgatgctcatcttgccttctaattataccagaagaaggagtggagcaatccctcttatggcgaccctaagtatgcctcctaagcaattgcaagccgcaaagcaaaaacaaatgtggatgccaccttctggctgccccctgttgaggaacttaagtattgagcatgtctatcactgtgaaaggatcactgaaggcttttatgtacgggtgaaacaaaaaaagcggagaggcctaggcccatatgcgtactggctgagaatggtagcaggtaaaggcccgatacaaagcaaccacgagcaggaccgcgaagtttcaccggcccgtacatctcccaaggagtgtgcacctgtctttacgactctatacgcacagatatacgccacttcgggaaattgatgccggcattttaacaaagtaattgaggaggattgaaagggtcatccgcctattgaagcgagctcttcaagtagcagaagtgacttccttcatcgtcttgcccacacaaccacagatccttgtacacgagcaccttcacttcatgttaccaaccagtcagggatcgaatcaagcgggagatatttagatg

SEQ ID NO: 2064 - DNA, 703 bp, Nannochloropsis_gaditana
ccggacgtgccagagaaccacttatacggcttcatgctgccactcatgatcaaaactacggaggtgctttgtgtccacgcacaactgttgccgtctcgcctgtcaaaaaccacaacgagtgcacctggtcttgttgcctacaccgtacacctacactgtacagtttacgaggtgtgaagttgtgaacgggttgggtttcgcacagtgcacatcgtctctgaggatcgcctctgtctccacaccctcggcggtgcatctggttaaaaaaaaatcaggcaccactgtcatagtcttaacaccgcgtgtgccgacaaatgaaacagcactataccgacactttccgtcctttcatgcctccgcacggctgtaagctttgccgggcacgggcgtggcttgctgctgctgtcacacatctggagccagacggacgaatatgtccgttgctggtttttggggggggacagcctccccacgccttttcagcttactccatttatcgaggaagaacatggagtgcttgtcgagtatttgctacaaaatcgaagagtaatattataaaatcatttgtagacgttagatagttgagggaaatttgtcacgtacatgttttttagcatatcaaagcgcaatgacttctgaggctgaatttgttccataggcctgtaacacaaatttatatttttgcatggaaacagtcgtcatg

SEQ ID NO: 2065 - DNA, 703 bp, Nannochloropsis_gaditana
aatggtccgcctcgtgatggaaagtgcttgctttccatttttagacaaagacaaacgcggagaattcaaactttgtgaagaccttcagtttttgggagcgatggggcaccctggtggcggcaagaacgacataccaaaccggttgaaacgcaattttttcatgttcaatcttgtcctacctacgataacatccatcaatgatatctacggtcagatgttatcgatgtatttcggtaacaggggggcaggtggaacaccatttgacgaagacgttttacaagtggtgccagagctgacgaaagggacgatttctttgtggaaatctatgaaggacaaaatgctacctacacctgccaaattccattatagctttaacatgcgcgaattgagccgtgtgtttcagggcttgctgctaactccgaagacgacattcttaaaagccggaaatatgcagacctctcgactatcaatgactccagcccagagtttggtaggagtatggagacatgaatgcgagcgagttttctgcgacaaattgaccaacaatcaagataaggaggcatatgtctcttcaatggaatacgtttcaaaccaaacattccctcggcattgcctccccccctcgttagctcctggaaagcgacatgcagagacgtcatcttcgtctcctataacaaagccggatgataccaacacattcatg

SEQ ID NO: 2066 - DNA, 703 bp, Nannochloropsis_gaditana
acgcgcacgacaaagatgagacgagagcgccccaacgcctggcgtgtctcccacgtaccgcgctcgtgtagtagatgatgatgaggacagggatagaaatgacgcgcagcaacgttaggatattaggcagattccataaagagggctcgttgccccgattggaggcggcgtttccaccccccgccatgcgcgcaagccgtgaccaggagacctcccccccgttgctttctgttacgactgcggtgcgtccctgccaggcctttctatccgccaggtaggccaaatgtgagaagggtcgagtggaagcagtgaacgactgaggcaccactagacctagcaacgcagaggggctgcgggaggggagtccaggtgtctggaaagcgagggccgcgctgtgcatgtcggaggggtcaggtcagacagagagccatcaatccacagaaactgacttaactgtgccatacatacctggaactgcctgctgccgcgcccgtagaagcgaaataaaaagctagtgtacaagtaaaaagcgctccttcaaccctcattcgggtcttcctgctggtgggcacgtcctgtacacacgggcgaagaaatgctttgcataaagaaattaagcctgcgcaacaaatttggtaagtaagcttcgaagtgcttggataggcgaccgtccggttcattcacgcggtttcaagcaagtcgc

SEQ ID NO: 2067 - DNA, 703 bp, Nannochloropsis_gaditana
tgtctttatgggagttgtaataggtgtgggggccactatcatcttctttccccttctcctacggtttcccccaattctgcggaaacttcgtacacttcataccacgcctttatcggacgtgcccggctgcccagagcactacgacgaagccttcacttcagctctttttacccttccggacccaaacaactacctctctgtgtacagctatcttccccttgacgagggcatccgtttccgacatccaaggatgcccgtttgtcgctacttctcgctctctctgtacgctggcctcttcgaccccgtgcaagaccaggtcccgcccagcctctgcgacatggacctcgtctacaatctggatgggagcttcgatgtagccatttgtgatgaggaagagaggccggcagacatctccccggcgaactggctgccgcgacacggagtccgcgacgccttgctggtggtgaggaggtacgggactctgcctggacagcgcctcgacatgccctccttccactctatgggccctggcacgcccaaagagcttaaacccgcccaccacagcttttctgggcctcattacgcggagaaagcgccctcgcaccgcttccagcggcttctgcgcctcctcgcctacctcggggccgtggcttgtgccttactcctggcgggcaggtggtcggcggcggagataaccgcgatg

SEQ ID NO: 2068 - DNA, 703 bp, Nannochloropsis_gaditana
acagatatcaaagttgattggttcgcaagcgctttatctttgccaagagcacaagactggagggtgagagagctggagccgcgtaggagaccctgcaatagcagaaggtaaaagaggggtcgagttagaggcttaggatacacgaaggtccttggcggttcgacagcctctttcccgcgcctggtgatgtttcaataaccatgaaaatgcgtgcaggttggttgattttcgagataatcgaggttgtggttttcactcgttcatgcatctggccacgcccttcttgacgcgaaggcgatagagcgcacgggaggcacaacgcactgaaataagaatgttccaccgatgttttggccaaggccaagagatttctcgctttccttgcactgcaaatctcagctttgacaaagcacaactcactagttggagagtggctatcggttccgctttcgcattctttcctccccatgtgcgggttgcctttccttgttccacaaagctgagacaagtcagagtaatctgacaagtcatcacggccacctctttgatctgcgaacgcatacatttttcgcatgccgctccctggtctcattttaaatttatttacattccaaagacgcagagctctctcagaccaatgttttgtaaaagcagatagcagtgaattgttgtcgccctctgcttcatcccagcgaccgtgatg

SEQ ID NO: 2069 - DNA, 703 bp, Nannochloropsis_gaditana
ggacgagacggggctggagacggggcggttggacgcggcgggtgtggccaatgttcagtgcctgaagggcctgatcgagagccagaagacctcctgcaacttcggctactacaaactggacttcgaggccgactgccccatgctcgtcgtctccaagagccgatccatcttccacgggggagccctctgtgaggtcccgctcgcgcctgcgtccgctcctgtggctgcggggaccagtcactccatctctgctgctgctgtctccctccccatgggcggtggcgaggaagggcgtgaggaacgggcagaggaaatgtcgcccgaggccctcgcgtccctgcgtcggtacctggcggctctggctggcttcccggtggagatcggggaagacctcgcccgccatgcggaagaggaatacgtgactttgcgggggcgggaggcaggaaaagacctgcggcccgaggatttgagccgatggctgacgttgactcgcctgctcagcgcgagcgaggggagcgagcgggcgtgcaagagaaggcactgggaccgaatgagggagatggagagggagcgtgtgggtcgactgcgagggctggaggcgggaagtgtggcacagtaggtcgaaggagcgggaaagagagtttggacagacaagcgcaaatgaaaggaagaagggagggagggacatctcttgtaaaagcac

SEQ ID NO: 2070 - DNA, 703 bp, Nannochloropsis_gaditana
aggttgtgtagcacagcgtaagccaaaaaggtataaaaagggccggtcgtgtgtttttccctccccgcctttcctctcgttgccagatcgagccccgtcgttgctctctccccgagcctgcttgcgtgggcgtgccctgtcctcagccgagtcgcactttcgtgcaagcacaatccattgccacacctaaagaaatcagacgaagcttcgcttgcgttgggcataagatacgtggatgctttccctggggggtctttgattcttttcgcgctatccttgctctccctcgacccggcgccgcgtcattccgcgcacccgggccgcttccccgcaaagtgttgcgcatcacttgcccctgtacattcaatcacacgcagggtgctatgacttcgaccattcctaaattcatgaagttgttgcctctgtacatttaagtgtgtgcaagttgttagggtcttgtttggctgcgtcgtggtggctgaatgaaagaaaatctagaaccatttgctcaatcacattccctcacctatgaagacaggctattgtcagtcagtctcacgctccaccttagagcacttgtggagcgtattctgagtgcttgcgtcgggcaggtactttgtcgcagacacctcttttaccgaggtcctactctgtttctcagttgggtgttgctcagaaagtgcgctaaagcatcgcttctatg

SEQ ID NO: 2071 - DNA, 703 bp, Nannochloropsis_gaditana
cgcaagcagtcgattctgtgggtgttaagggcctagtgagaccgtccatggcctggtactgccccttctttccttcctcagcctccgaaccttccaggaaacttggcccgtctctggccatcggaaattttaaggccgtgacaaggcctgccggtcgacgacggcagccgcaggctgagcaccgactaacgtctgaggacccaaacacagggctcgcgagggccaggcgccgccgatcctttttcagagtcctgcagaatgagtgttgtgatggcgggttgggggggtaagggggtaaggaggtttggccacgcgaccaaacacgcgtgagttagatttcttttacttactccactgcaaaggcatgattcagatcctgatgctgagacatgcatgtgcgagaaagaacggcgctactctcctggcaggggcgtcgcattgatggggggaaggggcagcgaggcctctgttacctcggcccatgaccttgagcttcacaatgtcagcacagccaaaaagacaccacgatactacagggcagtgaattactcccctgcgtgggggtcggtctcattcacagctcatttcgtgggttcgaggtcttcgggccgggtgtatttggagcaggctaacgaccttctcgccttctttctctcaacccttcctctctgatcccttccccgtcgtcctatacacaaggatg

SEQ ID NO: 2072 - DNA, 703 bp, Nannochloropsis_gaditana
ccagcctaagtgatgttcgggctcaagctatcatgctttctctcccattgcaaccgaaacctgcatgtaacgttgtaatgtccggcccgcgagctcccggaggcgtgctgatgccgtgaaattcgcgcttgccgagtatgggtagccctcagaagtcgtttctcgccgctcgccaaaactcggcccaccctgcgaggcctctgtcccgtgcactccaagcctcggggccccaacaatgactctgcctggtgtgctgggggaacgccggggcataggttcgctgtcgtgtccttgctggtcatgtaatctttcgtagaccatgtactcgtcgatgtgcccatttatctcataccgtcaggggatcggaacaaagaaaggataacgcaggcatgcgcggaagtggagcatccacgtgccatgtatacatttctttacatgcgtttttaacataaattatcctgttctcaacgcctctaagcttatgagagagccccgccgcttccgctcctcctctgcggctaactcggccggagttttcttctgtataatttcagtcaccacgtctgtagtccggtagctctcacagtcaacaatctcaaaaagcgcggccttccctcgctcttctccattgtatccacccaagcgcaaatcgtaagccagcgtttgtcccagtctctcatcctttttggggaacgccatcaag

SEQ ID NO: 2073 - DNA, 703 bp, Nannochloropsis_gaditana
ggtcctagcactcttctcaatgacgtagcggttggagtccacaacggcctcggagcggtccaaggcctcctgttgacccgccacggccgtgagggtctcgcgccctatggccacagactcatgcgcgactcgcaaataagcgtccagctcgtcttttgatttgaactggtgacgttcctgtgccccattcggtgggcagcagtcagctaggtcaaggacgagatgtctgatcagggactgaaagaagcttaccttttgttgccccattcctgcccggtggctgcccctcggatctccaggcgcttctcttggctccatctgagacacttaaatgtaaatattcgcaacgagaaggtcagagtgggttcagatagtgcttgttccgtaattaagcacgcaggggcggatccgagccccccgccttcggtctgccgggctcgcccttttgtcgtgccgccgccccaagcccatcgcctacttgaggtgttgtgcgataggcgagcatgacagttcacattggtgtaatttatgtgacttttgaatggatgttcggtgcccgcgtaaccgcagtaatttgacttgatgactgctgtcagtccctggtggagcatgatgagtccgggtgtctttgtcccatgttttccttcgcacgtcgaattgtaacgcaatcgaaacagagggtaattcgacaggagcagtcatg

SEQ ID NO: 2074 - DNA, 703 bp, Nannochloropsis_gaditana
gaaggagggggaagaggaaagcagagcaggatggcggcgcctgcgtacgtcttctaccgaatcccatggtacttttacgggttgcgcgcgattttcaccagcactgcgtacgagtaattactgtggcatagatgtgggtggcaaaataatgcgtgcattgcggagcgtgcgggagaagaagaaagcgaaagagaaggaagaaagtcagagaggagacaagcgggcgttctgccgacgagtcagcacgacagggccttgacatgcatccggcagatatatgcccggtgcccaccgcgaagtcgtccttcgcactccaacaatactggtacgggacagccgagcctttgagtcagcgccgcgggggcgggacgatggcttgtgtcgggacgaggtctgaaggagctcgctctcagcgaagcttccgcatggggccgccgacaagaacctaggaaagacaagcgcgggtggtccggagaccaatacccgagcaccaggattccttgttccttgtcgtctctttttcctgcacgtgtgtcttcgtcctggtcgtgggaatgatgctggcctcgtctaggggcgcctcaggattgcgcccctcgccctccgcgcctcaagagcccatctcgcccgtgctcaccctcacaaggtggtgcacccgtctcacccatcgcacctccctcttaccagcaagttatacagcatg

SEQ ID NO: 2075 - DNA, 703 bp, Nannochloropsis_gaditana
ggacagcatcagccaacagctgagggtggctgtgcagcacccttttgtcgatcgcgtggagtcgtggctccccgcgctggccgtccgcctgaagtcctcggccctgcaggacgtgtccgactggctggtggccattcggggcaagtcgaccagcatcggcaagggcgtgttgcgcaagtgcgtgggctacctgaccggccaggccgcatgcgcaggaaccggcttggggggctttctgggggccccagccctcggggcgttggatgcgcggtcactggccccgacgccggccgagctgctgctgcggcaaacgaatcacgtcacgagcttctccgcctgggtgcaggacgagctactacaggcgctgccctactttcggcaggcccccgcaggagacgagcagcatgccctctcctccctcgccgagagcctgggtccgctgcaccgagcccttcacatccacgcccatctgggggccctggatgagctccaactcttctacgtcaataaccgcctgccgcaagcctcgctgccctcgggaggctccctccctgccccatcctcctcggccgaagccaccgagcgggcacccagcccgggggccgggagggaggggccggacgagcgggccgcccaactgcaggaggccatggcttactacgccggcttcttcgtcaccgagcacgcggccattcggtccaca

SEQ ID NO: 2076 - DNA, 703 bp, Nannochloropsis_gaditana
tggggtctaagggagaatgagaggcgggaggcggccacggcgggtgagagggcgggagagagggtagtgatggttcagggcgcggtgcaggcggccaagtatgtcttggaggaggccggtcgccgcgagcgagccaatggggaggagggatggagggaagaatggaacggggccgttgtcgctctggttgctgtcttggagagagtgctggaggtggcgttgggggttgtgggcacggcgcaggagggtctcccggagtctctgctctttgaccaaggtgacgcgagggatgccgagaaggcccatgactacacagaggaggcggccttgcacacggcggggcctggtttggtcgtcgattgtcgagggcacctgattcggaggggcggggcggcagggaaaggcagggaggtggaagggcttctgggaaggacggctgagggcgaggccgatggggaggaggaggaggacgacgctcgacagcgattgatcgtgggcgggtggatgatggtgaaggaggcgggggcctgtctggcggaggtggtgcagcaagcgaccttctcgtgctcgtcggtctggagcggaggcgggaggatgacgagggggcagcccgcgcacggaccatccggggggggggtccaggagaggagggaggttgagtcacaggcgccggccctcttggcggccctgggtggcagcgcca

SEQ ID NO: 2077 - DNA, 703 bp, Nannochloropsis_gaditana
gttgaatgttccgcagcagcggagtgttatgttcttcaacaggcggtcaagatacacaagtcagagcgctagttttctcagtctgcgacggttgttggcccttcgtctaaagcatgaggtgtgtgggctatgatttagcctgttggtagacgtgggcgttttttacggtcacgggggagggcgcagtgtctgggttgttgacgcccgcatcctattcctgtcgaatatccctcttgttccacaagatgcatcggctgctccccctgaacggactcgtttcacagcccgtccactccctatcctccggatcttggaagcaatcccgcataatgcactgatattttgggacacgcccgagcgatgctagatggatgcctaatgtcgtgattgactctttaccttgggcttgaggcgctcctagctaggggaatccgaaggggatcctcctgtgccgctcaaccagtcgtagaagacaacctttctagtctctagtgtggtcattcacacacgcatggatcctgagagtgctttcatgtgcggccctttagattggcctgtgaggattgcaattttgtggctttgtgacgcatggcacatacctcgccctctttcgtccgtctgaccctctcacgcgtgtagatacctctcaacgaccattttcacagcgcttcttctcttctaaaagctactcactccaaaaatg

SEQ ID NO: 2078 - DNA, 703 bp, Nannochloropsis_gaditana
caacggggacctgtgtagtctgttttgcgtacctgcctctcattttctcccggcgatgaccatgtgtccgtcatcgctctcacacgcgtccacagagtggggatactcaaaccgcctggtggacctgatcgtgcacatgagtacggtggacagcaagtgaggtgcctacgaggtccttcttgaagaacagggccatagggagacgcaccggccccggccctgtgctctcacgggggctttccttggggaggggccctgaggatgacgagggggagggtggaactagtagagtcacgccacacacggcgccttaggacttgtcttgtccggaggtggcttttacaggcactatgatgcacgcagtgaaggaagagttcaaattttttccatacatatattgcggggaaggacggttagatgaattgcgaggtattgcggtcggaagttttgccagtgaacggatacggatatgatgatttttgcatcccatgcctgaggtcaggagcatgaattgcacagaacggagattgaaaaaagaagatatcacgttacgggacacatcacgaagccgcaggagtagctttggggtagacgagcgccacgcccttggcgatggctttctctcccctggctgtccatcagaaatctttcattttcttcgtgcgtctgctcttcgatatcagacgttttctcatccttccac

SEQ ID NO: 2079 - DNA, 703 bp, Nannochloropsis_gaditana
aattaattagagagaagccgttacgccctctcctctgcttcgtgaccgccgtggcccatgcccaacggaagcaggtgcatttgtcatttgttcatttatttgcgctgtactctgccggtagaaaaggtgcctttgtttaagtctcgcatgtaagatctcatcatagccaggataagtttactcttaccgcgtaagacccagttgagatgggttagtgctaggattcaaaattcccagaggaagctaacggacaagtgcatgggcccccattcgcgacgccctcagcatatgccacctgattctgtcctttctcatctcgttatcacgtacacaacgctaacacagcattgcctcttctttgactggcctgaattccctgtgccgtcttctaggggcaatcgacttcgcctcctctacgcctcgagtaagtacggttgatgccagctctaccgttatgttaggtttttttcacacacaaagcctgtggggctctctgtctagcaaggacaaacatatgcgacataattttgaacagattgctgtcgatgtacacatacttacatgggtaaatgcgcttgctccaccgacgtattctgctgacgccactaattctgtttcactgttgtcccctttcctagccgaccactttgagcaccggctgccaatatctcactcatatttcttgttgatacacatagatatg

SEQ ID NO: 2080 - DNA, 703 bp, Nannochloropsis_gaditana
ctcacattgcttgaagccggcttgttaacctcccccctcgccaaagcgaactgaattcttgttcctgtgtcgatagtggctaagagtctaacatattatccaagacatttttagccatgacgacaagtggtgaggtggtactctcctctgcagactcccccggccagttttatctgggaaccgcaggatatacgtatcctcattggcgacgatgcttttacccccccggtgagttggtcagtatcgaaatgcattgttgattgtatttgatccttcgtatgcaagttgtactttgatccaaaataccttacatttatatgttgtgatgtcatttgggcctatttggacgtgcgggaaacgaacaggccttccccacgccaaggagctaagattttacgcccaaacgttgaacacatgcgaggtcaacaccaccttctacggtaagactacaaaggcatccaagatttgttgtatattgagttcatggagataattgatcagagtgtccttgggaactaaatatgaggggggaaaaggggaatagaagtatagccatccacgtcaactagcactggataaagtcttttgatcaggctccctcacatgccacaaatgcgaaatggcaacaatcgtgagtggataactgaatgtgaccttttcgacggtgcccttcacgacaggcatacccagcgaagccacaatg

SEQ ID NO: 2081 - DNA, 703 bp, Nannochloropsis_gaditana
tttttggtttaatcgcaagttcttcaaaaggatttcgccgctccacactcccactttcaagttctcttccgtcaaaccctccactaagtcgccaaaagctgcggttagagtattcagaaggagttgccgagccatgatggtggatgtgcacttttggtggttgcgaaaatgcggttcacaggtggcggaagaatggaatcacccgggcaggaggcaaaaacacgcccttccctccgctatgcagcagtgcgggggagtgctgagaagtccacgggctttgcggtagattgcaatgcagtttccttcggaacaaggggatgttgggcgtacgtgagggttattcaagacatgaaccctccaatttaaggtacttgcagtagagcgtgggccgatgctcagcgaggtcctgcccacagacgtctcttgagtccttcacaagcatacactctacccagcataaacacatatacggaaataaccataaaatatgtatgataccgcgctgactcgcgctttcccccaagggcgtgaatcagcagaatttcccccccgagacagaacccaccctgcttttgatcgctcgtagtgatgagcgatctctttcgtgcatgtgatgtcgtgctcgaggatgcggtattacgtgcgatttaagggaaatcactcatgccgacatccaaattaccgatcgcagggggaaaggatg

SEQ ID NO: 2082 - DNA, 703 bp, Nannochloropsis_gaditana
ttcagggcgggtaatcttggcagccttggcctcttcctcatccccttcctctcggtcttcagctactacctgcaagcaacacaaggaacggcagcgaaatttgaacggtgagattaggtatgaagccatgagaaatccaacaaaggaaatgttgagacctgttccttaaaaacctgagataaatatgtgaacacaacagctccaggggaccctccccgcgctatcctatcatgcgtacctcctcatcatctgagtccagcgtcaggacaaggccatcttcggtgtactttaccatacttagtggttgtcctgtcttgaaatgactggttaatttttttggaagggttataagcgtgtattcgagcggaagtgcttgagtggcgacggcgacgatagagggtgaggaggtaagccgcatgaaaattgtctaaacttccatgtgcagccgcagaggtctttacaagcttccactcatgcatttcgaggaaactctggtgcacatcttggcttaataattccttcacgaagcatataggcatggtgggaagtgtgggccatggatacttctgcgatgcatcctcgtttcatgttcccattgttccgtccctcatccgggacagcctccttgtgtggtaaatccactcttaggtttcatgatcaaaagtatccctcctaacgaatatctctttgctattttaggctt

SEQ ID NO: 2083 - DNA, 703 bp, Nannochloropsis_gaditana
gctgatgttgatatggccgcgcacgtacaacggcttcgagccaagtttcgagcggttacttccatgttgggtgtctccgtcaaattttctttgcataaatcaggccggatatcggatggggaaactgcgggcggggtgggagcactgtccttttgaaacataattatacagatgaaaagcaagactaggtgggaatacatgagactgcgctggtgtacattacatggtcggtagaaaagtgcagtcatagatgaatatgattggaaaatctttacacgagacgactagatgcagaatttccataaacaaattcgagaagatcgcattatttctttcggctcttcttttcagatttgaactttttgctttgcctgtcttgtgaatgtttacacgccgcaaacgcaatcagctccagtatcaaaagtaaagtgctgaatttggttgttttcaatgcactgtaagcttaatgagctcttcaggtgatacgttgttgcttctgaacatctccaaagctttgaacttttaaacggtcttgccgttaacatttcaaaggattcttggagactcttccactctccttgcgatttgtgcggctggtcaagctggccaaggatgtgtcaatttcaaaagtggtcgaactctcttctatcgattttcctcatccaatttcgcattcctcggacgcacacagattcaggccatg

SEQ ID NO: 2084 - DNA, 703 bp, Nannochloropsis_gaditana
ggcagaacatcacgtggcttccgagtcgacattcggcggcctgaggatgcaaatccatcttaaagacatttggtacacggtaagtgcacaaatgtgcttcgaagcataaatatatcacaagggtgaaaattttgtcagcaaactttttttcttccaaaatgaatgaatctggataagtacgaacaagaaattccgaatggggaacacaagtcggtaggtttgcctttcttttcggatctcgagccaaaaggcatcttgaattgagaaattttcgcgccatatggaagagtacacatggccagtacaattctcgtcaaaaatagacaatgatgctgtcaggcaggagaaaaatccgacggttgaagggtggggggggcggagctgccggcgttacggaaacggtcgggagcgcgcgcgccgctgcccctgccccccaaaatcttagataaaataaaaaaacattgacttattgacattcatggcttcgcatgctgcatttctgttgttaaatctcattaccatgcacactcttctatctttgtgcacgcatatgcatgtcaggtctggtctcggagacagaagacagcttattaacttgggaaagcccatatgacggataccgaccctaccggctgtcgcacaacgcggagcacacgttcctgcacatcagcaagtatagcagagaggacacaagaagaagatg

SEQ ID NO: 2085 - DNA, 703 bp, Nannochloropsis_gaditana
aggagtaagagaagaatggcgatggtaaaggggaaatcatgcgaggagggtgtagaatcaaagtactaatctttaaataatcctcgaggagcaggaacagaaatatggcaagatcaggcatggaaagcgagtgtttgctgataataaatgcgtattctttgtatcaggaaatcaggaaagagccggaaaatccagccatcattgcggcaagtacgtacggaaaatagaaagaataacacattgtgaggtaacgcaccatggaagaagcactgcgcatgtttttcgaaaaaggatatagctggggcgcctgaaagggtctcctactagtagcctgaagcttttcccagtcccttacacggtgatacattgtctaagcagcgtaagcacctaacttcctccttcccataaatgccaaaatttatccacaagcccgcattcaatgccggccgacatttccgtccttgtcgacacgaaaagtgccctgtcccctctccctgcgggccgagcgagaggaattgtgtcggagacaacccacaccaagcctggactcgtacaaaaccataccgacacgatttgtgccctatgacttctcatctctcactctcgttcactttaaatttctcgcacagccgaccgcagtcgctatggacgcgcatttggcaaatcaaggctcacatcgaggataggaaatcacaccatcatg

SEQ ID NO: 2086 - DNA, 703 bp, Nannochloropsis_gaditana
ccacaatactgcggcatatgaaaggtagaagaggagaataaagtcgaggaaccatgaatttcaagccaccccccatgccaaaagagacacgcccgaagggtaaagaagtccacgcaccttgcagccacgatgcgccacggcaaattggcttctttagcagcagcttcgtgccttgacaactgcgccgcgcgcgactgcaagtatgctgccgttgatgaaggccgtttccctttcttttttttgggtttgaggcctcctttttttcctttgccagacgatgaaggtggagttggggaggatggggctgtatcggcttcagatgtccttattgcggatgttctaaagcttctttttgatgccacacattctggtagtgtcctttttgtagttcttgctggtggtgctggaacggctgatgttcctgtggtgagggtggcaaccgctctcacacccagaaataatgccctctggtcccctagtccctgtctcagccaacatagaagcatcctagaccagtaggaagacattaaagggaattttgagcattcttgagtgaacacgtgcctgtcgcacggtcgacaggaggaggggcaagatatgtgacggtggtaagcccttcgcctgcgtcgcttttcctggacgtgccccgccaaacctcccccccccctcctcacgcgcacgccctacgagcacaggtggcatg

SEQ ID NO: 2087 - DNA, 703 bp, Nannochloropsis_gaditana
tctggggtattgcccccccgccatcggggagaagggaaagcactggtgcccgtggcaatgatgacacagtctacgtcgcttaaggggccatacaaggagtcgatatcacgggagtccgcttcggcaaattcaagtttggggctctcgcctcccaagacctcgcgtagcttcgcctcactgcgtccaactgccttcacttgatacctcccctcgtcgaccaatcgagccgtgataagttgcccgcaaccacctgttgagcctataacacagacacggtcattcaccttcagctccaccgccatcattgtaaaaggactcgtgcttttccttcccgcatagctcgcgctggcatgtcgcgggccgcggctgcgtgggcgagccgcgagaagggcgtcaggaagtagcggagaggaaaaaccccacgcggtccaggcccagaataagacaaccaagggaagtggccgccacataactggggctcgtctcccactgtgcgaatgggcgtgggaattgggtgtgggggatgcggcaatgggctgaaagttccgaggggtcgtcgctttttcttgctcacctcgctccttctcctgcgtcccctgaagacttgacttaccggccaccttttctaatatttgccagcgtgaccaaagccaataaggactacacagctctttgacgcacaatcgtacatcaggaacccatg

SEQ ID NO: 2088 - DNA, 703 bp, Nannochloropsis_gaditana
cgcaccgaaaattcgtctggatggggtgattccggcaaatcaagaagagctagcgcctctttctcattcatgtgaacgttgtgtacgcttgctggtgagcaaccctctgacccgtcctcgctaattggtgcttcaaatgaaccgagcctcgctgtccaaaatgaccacaagctgtccggaaaagatagggaaaaagggcgtcaagacatggctaagcctgtctccacgtgtatagacacgtcaaatgccgtgcacagcgcttgacgcgcgcgtgagggcgggacgtggacgctgtgggaaggacccatggcagccccgcggcccgtcagcgagagcaagcgacgcgtacgttgctcaacaccgcagtgctccaggctctgcctgacctaaaaataaccttaatgaggacgcgggaacggggcacagatttgtgaagacgtgttggactactgtgaggtgagattttggtttgtattgtacatcaaggcatgatgtgtgtcgaactggcgtgttattaggagatgctgggtttcaatgctgaagtcctgcgtgaccgaagggcccgcgtcctcgggtggtgtgtcgggcaagaccgcagccaccacgacattttctctgatacaatttactgtttttgaagttcaaaggccatttttatgtgtcattgatgcgcacaggctttgtgcctcgaaaaggtaccatg

SEQ ID NO: 2089 - DNA, 703 bp, Nannochloropsis_gaditana
agtccattcggcagggcattggtcgtgacagtgctggtgaacaaaagcagggacgggatcgtagcgatcaccgatggaagcacgcccgtcggtccggatagttttcgacgcaccattaccgcctatgtgcgaacatgcattattatgaaggtaatgatgcagtggtgttttgtgtcgcaacgacaatatttgaaaaaaacgggcaacaaagaggcaaaagaaatgccagaaaaacgtaaaaagtacgctccggcttgtcaaacagacctcaaggcaataagcggacttttcggaccaagcacctctgacaaggactttttctatccgtcgacatgcgcaccgtcgatacacgaaggtttgtgatggaaaccacccttcgagggctgtaaaccctctcaagtcgctcgtaagggcacggtaaggccgtccatatatgttaagtccatgagcatgtgttccctcgacggaattccgaagaagctcgctttctggttcgaggcccgagcatggtccccccttttgagcggagtctcagcaagcggtagcgcaatatgcacacacgccttgggagccttgcgcatttcatatcagtttatgatagagggctggtccataagacgctgggactcatttttgtccatctgtttctaacagctgtccgttgcttctactgcttctaggcgggtagactagtgcgagcatg

SEQ ID NO: 2090 - DNA, 703 bp, Nannochloropsis_gaditana
tttcaggagacagagtcccatgacttacaagggtagaggcgtatcagcggggagatgtacaacaattgtgtacgttccaaagcgtagtgctcataatggaaaaagaccagcgtgacggagcgagggatgagtcaaattaaaaggcccattgtagattgcttttcctttccgtagccattgatgccacgtcccaggcagggtccttacatgacaagccaaggcttgacaccttctgaaactgaaagtctcaattaaatgccgggcatgaggaaaaaacaaatttgatatcagagtgataaacatcagggccaggccgggtgatcgtgatcgtggcggcctttcatttgcaggcttgggcgataaataaagaggttttttttcatcgcggcgagaaggctaggtcgtccgaatttgaacggcaaggtctaaaatatcaattctaagcatcacctcggctttgctacaagtcttactgcttgactgaaggaggcgcatgtcagggtcaaatctgaccacgcagctagcttgtggtcgtgatagcaatcaagtaaagacctcgtggagagtaccgtccgaggagaacacgtacgcgtctcattaatccgcacaattcgaagccaccattctcaccgaatacacgtaaataatttcaatgcacacacctcattaattcgaagcttacatcgttcaggaggacgccatg

SEQ ID NO: 2091 - DNA, 703 bp, Nannochloropsis_gaditana; identical to SEQ ID NO: 2088

SEQ ID NO: 2092 - DNA, 703 bp, Nannochloropsis_gaditana
ttgccagatatcacaacatctttaatcaaaaccaatggcatcacgtaccttgttacaccccatagccaaggtcgaggcgtcactttagtggccaatccgcctgaaatcgagggaacgtaggccggcggaggccgacgcgtgctccccttcagggtgacgcaaggcttacgtgcctcgcttgattgcctcgcgtaggtggtttggcgacattgaatgctcagttctcgcatggacacgtgcccacaccttgatggacggcttgttgagcaatattcataagctgcgtctgatgagaagtatcgttggattgctttgtgccatgttagcgtgggtgtctcctcacatcgtccatcttcccgcccgatcaacccctttccaccaggcacggggcaggcaccgtcaggaagatgaagcgccggccaatagtctccgatagaattttcaggcatttattgctgaccttggttctccttgcctcccttttacccggcgtcgccttttccttcaaattgggcatcatcccttcgggccctaggtacgcgaaaagcatctgaatcagtctcgacatacgccatcattttatatcattttgattggagtgtcaatcttctttttgcctcttgatgcgctttccaacagtatagggatattgacaaatctgtctgtcgatcaaccagttttctaccttagtaagacacacatg

SEQ ID NO: 2093 - DNA, 703 bp, Nannochloropsis_gaditana
ttctccttgcctcccttttacccggcgtcgccttttccttcaaattgggcatcatcccttcgggccctaggtacgcgaaaagcatctgaatcagtctcgacatacgccatcattttatatcattttgattggagtgtcaatcttctttttgcctcttgatgcgctttccaacagtatagggatattgacaaatctgtctgtcgatcaaccagttttctaccttagtaagacacacatgctcttccttctcgaagccttcccactttacccttccagtaacctctctcttgatgcgccatcgcgtgatgctttggcgtctcggattccaagtccttcgcgtttggaacctcgaacatccttgacgcacttctcctccccaattgtccgtaaaatcagttccccccaccctatcagtgtaacgcggtccccgcgaaccgccgtggcctcgaccaccgccagcacagacactggcaccctcaccagcaatagtcatgttcaaacgaaaaagagacgtcgtgagaaggccacccggctcggcaagatcaggcctgttttacatgcactgcaacagacggcctcacgagcggccccgcccggctccacgcgtcgcagtctcgtcaaaaagtttgcccgaggggtacttttcctccccccgctttttttaggcggtgctctcaacatcgctgctccttctggtgcgatg

SEQ ID NO: 2094 - DNA, 703 bp, Nannochloropsis_gaditana
gccgctagcactggacaataacgtcaaggaggacgcgcttggtgccatggatgctcgccggcggggagcgccaccaagagcgggacgaaaacttgcgtggtccatgccagtgggtagataaagcagttatctatcaaaacgtgtgaaaaaagaagtgtcagagcataatttgtggaatcggggtgtataggggttctggtgaccgccttaaggtgggtgaggaggattccaccttgcgtggactttacacttaaaaacaaagaaattcgccctcgacaaggcacagccccctctctgggctcataacccacccagtcgaagcaagagactggaacgcagaggaatacggcgcaatcagggccatggtggccccccggcaaccgggcgtaggagctttccctccttgcgttaacggccaggaatttaaatcatcttttcccgcccggccccgggagtcacaggcttgggttttgggaccgagagaaggacgcaatgccacgggcacacggggttggaacgccggttcacgttttctttttaagttttcctggaatgtgctggcattcaaatgttgatgtgctggtactgttgttgcaggtttgtttcctctataacttttggtcgcagtaggcttactactacctcccccccaaaggaaagactccgggacaatatttgctgggtacatctgtccaccacgatg

SEQ ID NO: 2095 - DNA, 703 bp, Nannochloropsis_gaditana
ggatggattactcgttgttatggcgagacataaatagaatatggagtagaattttggtgaagtgtagatgtgtaccataagggtgggatgcggagaacgatatcggaataaggatggaaggggaggttgagccccgtgtgcataaacgttgtggtagaatttatctcccgtacgacgcaaaacaaacttcggcgcgaggctaccccacacaccattttcatcccagtttttgttgacctctatcggtattcctttgttttcagtttcacgcggcacttggagtataatagtagaacacggagtgtccaacgccactttctacacggctgaaagagcaatgggctgtccgagaacaagctgcgcacaaggcgatgcacggactagacatatacacggttagatatcaagtaaagaatgcatgtaactagagaaagcctaagcctcggggctgcagctgtgtaaactcaggtggcgactagcgacccctcggcgagggacttcaaagacataaaaacgcgctcacacccctctctttcccatccataccttactccacggaaattgcagagctcctgtagctatatcggaacgtgtacaaaccctttggaagcctggcatctcatcctggcctgagctcacctttcgatagcttcccccccactgccctccctcacccgtcgcgagcctcgaagcatttctgatg

SEQ ID NO: 2096 - DNA, 703 bp, Nannochloropsis_gaditana
tggactgctgaagcgagcaattgcgcccgtttttaaaaaccttcaagcttcctccaacattttcgccgcagtttagatagctagggtccccaaaatcagcatcagaatgccgaccacgggctccgcccgcagtaggctcatgcgaagagtcctgcctttagtcctccttctccttctcccgactgctgccgtcttcggcctgaaattctacaccaccacacacaatcctttcgtcgctccaccaccaggaggaccacaattgatcgctaccaatcgtttgatgatgaaaaatagcggggtactcattcctcggagcgcgaccgcagcagccgcggcaacatcagcagctgccagcgtttcttcttcctccgtgccattggccagcgttttaaacggcgttagtgccttgtaccaccacagcagcagcagcagtagtgggggcagacggagtgggaatgtccgcatgctggtctgcaacgcggcctccacgacgggtatcgagggacaagaccaaggaagggccttttggggatggcgaggcctattctcggcgtttcgtcggggagggatcagctccaggacaacaagcccggctcctggagaaacggcagctcccagcttgccgggagggcctgcatcctcctcgaacacgtatagaatcttgtcgtccacctacgctgcctggtcctcgggcgagacgatg

SEQ ID NO: 2097 - DNA, 703 bp, Nannochloropsis_gaditana
  misc_feature (1)..(395): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcatgctggtcgtgcctgcggcttcctcccccacccctaccgggctctcgtcctcccccccgtcctccctctcgggggttgagaaaggcggagtgggaggcaggataagcacgccgtccatcaatccaagcttggacaaccccaaccaaaatcctggcttgaaccctctccaaacgcatcaccgccgtgttggcactcggcaaggagggggggacggacggcgtgctctccacacctctgtgccggggccttggatgagggaaaaatgcggaggggtgaccggggataccccacaaacattcagtatg

SEQ ID NO: 2098 - DNA, 703 bp, Nannochloropsis_gaditana
aaaggcgtctacaacggtacggaaagaacatgaacgcagccctggccacggtacaaggagatgactcccctttccgaagtacaacccccccaccgtccgaaggtcccaactggctcggcacgcgtcagctgacgcgcctgttcgtcatcatctgggcggttgccagcgaggcacgtcccgtggccgtctaggcaggagttgggtccgtcttacacttgcgacggcgctccatcccgccgtccatggtgggcaaaaaggcggaaagtctcacgtgggggcggttcgtggtggatttcttgggccggtgcgtgcatgtgttcacgttgagcaaccagaagaaaaccagagccagacgctttcatgttccccgtcagcccgccctgctcatcgccgcacccgtaccttgtgttatgcaacacgtctaacaaggagctggccttgtaggtcttgccatacgtgtatttgacgtatgtaaggaaattgtgacttcattaatctgttgatgacgtttagattacttcttgggtggttggaattcatgagccacgtaagcggaacatttttatagatcgcctccacccgaggagtaaaatgaagcgagatggattcattgcccctgaccttgtatcctgacccgtatcaacgaccacaaccctacaatgtatctttagacaggttttccaactcacctttctctagaatg

SEQ ID NO: 2099 - DNA, 703 bp, Nannochloropsis_gaditana
tgcataactgaacgatgtggacacgagagaggaagaggagacaagtacaacataccttggattgacaacgatgaaagttgattgatatttagaagtggggagatgagaacgaggacatgccctcagaaattctacagtaaaactagctctaggaaaaaagaaactggaaagaagcttccgtccttgttttctcatgtacatcttttttcatggtttgcttaaacgggcaggtagttgacaaagtccttctcaggcagttcaccgaggctgagccagcttcgtctcccatcaaagaatttgaaatcaattcgcgatgttttgcgtagttttatgtaacagaaaggccggcaatgctttgtacgtaaggtttgcagggtttaggcgggcggctcgggaataagacggaggaacggtcaggagcctcacccggccatcctgttcattgcaacgtcgtcaggccctcattccagatataatttgtattttgagactttgcttgagagatgtaaagtatttatcgatgcgatccgtattcaagtcgctcacgcaatctttgcacgcacttacagccttctacacctctcctccggcggctaactttcgggtataacctgaaggaaaagagtgcggctgtgagtggaaagccaaaagccaagaaagagctagccctaggttcaaaatacaaacgtgtgagccagccatg

SEQ ID NO: 2100 - DNA, 703 bp, Nannochloropsis_gaditana
aaagttattaacataagcggctgtacttgatataatacttattttctttaattttatacatcgttattgaaatataacataaatctatggtattccttcatgcttggacaaacagcgcgcagaaagaatcacagcttaaataacatcgaagagttcctgtgtatgcctgccagcaaacaatctcgcaggtcgtaagaaagttgaagtaaagcttacagcaatgtgatctccagcatatcttgtcagtaaaaaaggttttgctttatatctctggcgcaattcaaaattaaacggttagcaacgggggggggggatcagccgtttccgtttctgttcaaaaactgaatgtagaaagaaagatcgcttccataaaaccctctttacacgtttcattggagtgcagggatcagtgatacagtcaaaagcagccgatattcttatggctgtggtttacttctcatacttcgccgggtgtttcgccccatattcgaacagtctatgcaaggcgatgtccagctaaatgcgctctgttgaactttccgacccattacattccacccaggcccttgttatatatttaacttagctatacctcaatcttagaggtcacaaaagtgtcgaactcaaatttctctcatgtaacaatattgtgtctcaggtctagtgtgcaagacgtgatccacgatagtattcatcgagtatg

SEQ ID NO: 2101 - DNA, 703 bp, Nannochloropsis_gaditana
  misc_feature (1)..(609): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattgcccagcacatagtcacgtataagcaggatgggccgtttgtcacttgcttgctgtgtctcggcccttctggccttgacaacatatgcgatg

SEQ ID NO: 2102 - DNA, 703 bp, Nannochloropsis_gaditana
gaccagaccgcggccacggcctgactgccagacccgcccccttgaaggcccgcatgcgttgctatggacagactgcgccattgataccataccatggccatggtcagactgtgcctgtgtcggacatgcggagggcgattggaaagcgcgacataattgagaagagagatgtctagtaactgtgaattccatacatgtagaatgcccatagacatcagtaagtgtgaaaattgacatgtcatcggcacaatatgtgcaggttgctccatttggctctaacttttcttgcaagagctcggatttaacgtcaaaagtggtgcgggagatggcgtcaacagacagcgacaacatgcaaagcagtctacaatcacagaatccggccgcatatttactctctatcaacaaaattgcagtcaaaaattacgaattaccatcccctctgggagagtacgacgtacgtattgcaataaaggccgtcggcatttgtgcctcagacgttcactaccttcgaagaggtcgtattgccgactttattgtaaaggagcccatggtaataggccacgagagcgcaggagaggtagtggctgtgggaaagaaagtcacaaaccttgttgtaggtgaccgggtggcaattgagccaggcatcgcttgccaaaggtgcccgcagtgcaaaacgggcgcttacaatttatgccctgacatg

SEQ ID NO: 2103 - DNA, 703 bp, Nannochloropsis_gaditana
ggaagttggcttgactctgctgatagctcggcgatcttcttcttgaaccacggcatgaggacgaaaatggccgcgatccatgaaactcgagacccaacacggtagtacaaaagcgttgatatttcctagctgaaaaaaaaggaacgaaataagccccaaggcaaaggacggcattacggagaccggtctgcatgagtagcacgcttgcctcctcccacgctgcttagccacaacctggacgtcgacggcctcccccgctaacataacttcaagcaccttagaagaaatgcgaatccatgaagctatatgtcggtgtgcatgtgtatggaatgcctagattgcaagaaaagagccgagaggatgaggggccttggaacaggaagagacgacgtagctacgtgtggctcgcggtctgacacccgagccctcattctggagtaccagttttgagtttcgggctagagagactcacaaaaccgtcatcatacaacgtctacattgcaagcacctgttgcgggatcctgtcagatctatgaatttgtcggcggcaaacggaactgcttgcactcgccggcatcgcacctcctgaggccgccttctgtgtaaatcttctcgttccatggaaagtttggcatttctgacaggcaaaactcattgatactcaatacgacagggcacaactcgatattcttgccaactgatg

SEQ ID NO: 2104 - DNA, 703 bp, Nannochloropsis_gaditana
ataggtgacctgaaaatgaaatactacatattttccgatgtgatggcgggagtttatagtcttaattttttttaaatataagcaaaagtggctcctttgactactcgcgaatcaaattggtggtcacgatcgagactcacgtatttcgatgtcggctgcgctcgtggagcggaatggcggagaggggattttaaattcaaattttcgaatcgctttcgatttgtggccatcgtactggagggacggcgattggaaagtgtaaagtcatctcattatccttgctcgaattgtgcacataattaagagcctagttgaatctcctttttaacaaatattctaccacttcatgctaatttgcacggtatgccattgcagaagcaggatgcacacaaatcccctctccagcaaaagcgttgctccttccttctccgcagtgtcttacacctaacaccgaaaatgccttaaatgcgtcttttaattttaattgtcctcgtagttccttcgcgtggtattcattctagccattaaatgcctgaaaggcttggcttcgagggaatacttggttgaaggtagaaaacgacaagacagacgtcatgcgtgtcattttaaggacgatgagaactattccgtaaagccacctagattcagtttgtctcgttcctttttatagcgtttctacaggggcaatccgtgcgaaaggatg

SEQ ID NO: 2105 - DNA, 703 bp, Nannochloropsis_gaditana
gagccagagtgccttcaccttcatgcatccgtccaacttcaatgtagtatttcgtagacaaaaaggttgtcgtcactcgatgatagtagggtaggtcttattcggactcctcatatcagattgcttcgtctccaggatgaagatgatgcgccaataggtaggtctgacgtgctgagtcacgactaaatcactcgaaagcgccgcatgctgagagcagcgctaaatggttgcagcagcggggtgtctggcaaatctcctcccccctttctgcaacagacctcgctgtcttaagccgctcagcgtgccactcccagtgggcgaggcaccctagtagcacgtggcctggtcgcatttcttggacaacgctttctagtcagcaggctatcacccacagcctcttattgaaataaagtgaagatttcctccttctcacaatcaaacacctcacacaagtctgatttcatagggacgcgcgcgggctgaagggacaagcgggacatcgaagagccggatcttctcgtctcagggctcttgaattgtatacgctagcaatcacgtgggtgaaggctccgttacaccactacggccctcgctggtcgaaagtttctcatcactcgatccgggtttgccacgcggcatcgcacggagactgaggaatcggttctcgagcttcactcccgcgaagacctgatcaccagccatg

SEQ ID NO: 2106 - DNA, 703 bp, Nannochloropsis_gaditana
cggacaaaaactggtttctaagcatcaaaaataaagaacatcgatctttagtaataattgacagtcttatggacacttcacacgtttgttgctgcaaaaagacaccgccctgtgttggcccgcatcgaacaaacgcttgcttgagcttgaacttcacttaccgatgcatatggtctgaaacaggatggccatgtaacccgcgatgtacccaacggcagcaagaacataccccatatttctgtagcagcaaaggaggataaatgtgtgcgaaggctgtctgtgcgtgaaagcaatgagtcccggaagaaagatacagcgtgaaacgtgctgggagcagtcgtaacgtctcgggtttaggggttgcccagcgtccagcaaagcgcggtccaacagttgcagtcaagtagaagtgcgccactacttggccaaattcattgcggtcaaaatctatgggtcgaaggacgagagggcatcggcccgatcttattaactgctccgtgcgacgttcttgaccaagagttagcccggggcatctcttctcgttgggggtgaaacgactcacgagagaaccacgcaccttccacccgcgttgcaaactgcgtaaactggataccacggtcacactcacttcctcttcttgccaactttcaaggtatatatgggtcgggtgagaagatacaagaaattgaaggcttgtgaccca

SEQ ID NO: 2107 - DNA, 703 bp, Nannochloropsis_gaditana
agaaattggagcacgcctgggagcaaagagtagatcacgagaaacaggtcaaaagagaaggtggtattgtagctgtgtaaaggtatttcctttgttatttaaagcgaaaaacgatggtgacatgatagtataggtagataaagaaaatgctgtacattcgagtgagcagaaaagaagcgcttaacggacggagtgatctccttttttttttaaatgttaaacccttgataacgtttcataggtctgtaggcgcaaggattacatttcatagatttgtaggcgcaaatgaatcatgtcatacaatgctcgcttttccctttcgacaagacagagaggttcctctcgagtgcttcaaaatatgacctgggaggttggacccgcattgaccgtcttgccgacgttctcgatcccggcccacgatgcattcaatgctccgcactcatttgcttgtcctttcattttttgaactggcgcgagatgctcgggttgaggtgatgtagcaaatggctgcgatgggaggggtccgaagggacgcgaaaagtctttaaagagcaccgtcatgctaattaggcccgtgactgcccccccctgactgctgtctgcgacgctacatgaaaggcttacaagataattgctgtcacttgcgcggctatgcacaagacactcactaccctcgctcgcttctctctgtctcctgggcaca

SEQ ID NO: 2108 - DNA, 703 bp, Nannochloropsis_gaditana; identical to SEQ ID NO: 2102

SEQ ID NO: 2109 - DNA, 703 bp, Nannochloropsis_gaditana
caaagttacgcgtgctccgttatccgcatcatttttcttaatcgcatgaggtacgtcttggaaaggggaagagggcatccgtgaatttgacacaaaaaccctcaaaaggccagaccgcggaggtgaccaagcaagggctggaccccctcgttctttcaaaggtcgcatcctgcctgcgtcgccgcactcttgcctgtaagggtatggcccacagccgccacattcgtacaaaagaagcgtttctcggcaacgtctccccgtggtacacggctgataggagagagctcttcataggtagaggacagggcagaatgatgacggggagcacggagccccaggctcgagaacaagaagcggaaggcttccagggaaaatctttgccacaacacacgcctcaaggacatcgatcgtcccccgaaacacgtcgtcgggcacgcacatacctttgacagaaattcgtgtttcctcaagcaaggtgccagtccgcactaccaccacatggcacgtctctctggacgggctggtatccagcctctgaccacgcctccctccccccggcggctcgcgccgagccccaacatcgctaattcccgattacttgactcacttaaaaaggcgcatacatacagcagagtgggacactggggcagggccatgcgtgatggcgtttaattcgttgaatgtgtgtgatggagaggaaatg

SEQ ID NO: 2110 - DNA, 703 bp, Nannochloropsis_gaditana
cagttcggggccgattcagtcaaaggagtacatcaaacatcatgcgttcttcgattcattaaggggtgaggatctacaaagagttgtgtgcaccagtcacgagccatttgattatctttcataagcctatgcttaccatgtttaccggggaccgatgtctcacaggaaacagaggcggcgaatagcgagagaccctcctcgacgactccgccgagacaaagcgagggacggtgttcctctgtgatcgaaaaaggagaagaaaatcgtgaatggttcgtttgaatggtcttgtagcttctgcctccgttgtatctggctaggaatgacatggtgtagtccgggtgctagggtaggaatgcgtacacagattgcgtggagatagcaggcggaggagcaggataaggaaatgcggcaggggaaggcgaggccgagccatgcagagatgcttgacgcggaagagatagggtttaaaaagagtctgagaatgatggcgttgatggtttgtcctgaacgttgttctcgcgccgcacaagcgcgtcacacggggcaggcaccggcttctctctcgccccccttccgctcacgctcattggtatcagcgttctcgcttctcaccgcagacgcaatttagtccgggcacgcggacgacgcgccttcatcagtctagaaaaatccacgaacatcttcgaccagtcaagtgatg

SEQ ID NO: 2111 - DNA, 703 bp, Nannochloropsis_gaditana
gacataagagggcgtgagacgtacaaggttactactactttgtgcatgtgtgtgacataagaggacgtgagacgcacaagcttactactactttgtccatttttggctccgcgataggcgtgaagtgatccctgccaaaactaaagaacaagatcaatcattcatacaaagtaagccttcttgtaataatgggtagtgtgtcaacgatgcgtcgtctttaggctacgttcctaagccgttcggcgagaggagggatcacccctagtagacgatgggaagtctccctgtctaatggactgagtgacacgtatgcggtgatctcatctcaaaagaaaacccgacaaggagcagtgatgtccagtttgctcccccgagtgtcgccactgtccgggggaccctgatgaagacggcgtgaaagcagggggacggagccgaggcagctgcctcgctgacacggtggacataaatggcccgttccacgttgtactctttcctggaatgcgtgtcgcaagaattgaataaggcgcatctcccttcatcacgaatctttccataccgtgatcctgacggatctcacatttcacacacctcaggaaagtccgccacaattattgccgccattttcgccaggaagtgctgaaactcaaagacgcgtcattcgctcccgtgggccttataaccctttgtggcacgctaaataatg

SEQ ID NO: 2112 - DNA, 703 bp, Nannochloropsis_gaditana
gggggggcggggcgatacgcacgtgggggccgacgccgtgagtcccttccctttgcccgcggcttcctcctcgtccaaggcgggctctggaagctcaggagccggcgccaccgccccccctccctcaggaccgagtactgccccctcggaggccgtgggcaggcaaggagaaggagcgggcggagagggtccggctgctgcagtggtggtggcggtgggccctcgggtcgagctcgtggacgggcagatcgtcattaaccagaaatccctggaggtggtggctcggccggaggacgggggggagggcgcgatggaggaagtgaccgaagacccccagcaggcggccacctacaacagtttcacgagtcggacccgggctacgcggtggacggacgcggagacccgccttttctaccaggccttgcgccagtgcggaaccgactttaccaccatggcttcgctcctgttcgcagggcggcgggaccgggcgcagctcaagaacaagttcaagaaggaggagaagcaacacggggtcctcgtctacaagtacctggacagcacccagccgttgccggtattggaggcaggggtgcatgacgggcgaggggagggatcgggggagggggatgattgaggagacaagaatgagaaggcgcccgccaacgcaggcggtggggccgcggatggttcttttgggtatggg

SEQ ID NO: 2113 - DNA, 703 bp, Nannochloropsis_gaditana
aggaaacaaaatcggctgtgcttctttcgatatcacattttctttagacaaaatttgaggaagcagggggggccaccgagtcacggcccgccttttttctctcacaggtaacactctccttttcggaggtagattggctgttgctttcccagcgaatcttctgatgcatgcaacccatccgcagaaaaagccgggcatgtaaccagggatggggcttcccctcggaaggggacaggaggttattcgtccgaaacttcaactcgcgtagactcgagtatggggcacacccattgccgtaaagcaagagacatgccttcttacaaggttgagaaggcctttcgtaagcgtagtggcctccatgtcgtacgaaaaggatttcgactctcaaattctcatcccgttttacgattgaccaggaagtccatgagctacaacgccgataggggaagcagtgctggcggcagcagaggcaaaaattctggcaatctaccaatacctaaagaggtagctcactcatgtgctggtgttaaatagttaggccttgttgtagagttgttttgtattttttccatgaatgggttttctccgagagttgccaagctgaagagagtttctctgttctattgaaaatcttcgcattcactatttaactttgccttatcacacatacaaggcggtttactgctatggattcaatcaggat

SEQ ID NO: 2114 - DNA, 703 bp, Nannochloropsis_gaditana
atgattacataagttgaaataataaaaatcatcttagcggcgaccttgcgcttccggcttcttcatcgtcttcctcgtcttgccagccacgcacaagcacgttgtccatggctgctggggtgagagtatgtccaaaggatgtacgttcgtcaatttttgcaatttttgcaattgatggaccatgatttgacatttaaagtggtggcagaaaggggacgtaggaccgcttaccctttactagaatatagtatatgggccagcatttcacggctcggtcatctggcactattcgaaggaaaagggtgcaaagcaaggaaaacaggcatggaacccaaatacagctttagttcactcgaccctggaaatttcaaaccgacggatagtttttggaggtttctcgtgctcagagggtctatttgtgttcaaagggtctggtacacgactccggctggttttcggacggtctagttgtgttcggaggatctataaagcgacgcgcctccatagaaggcgatcaaatcgacgtaattcaaaattcagagggacaatttcgtccgccaaattaatccacgcgttgctgacttttcgtgtatttgtacgacttacatacaaggagtcgtattttgccgtggcaccttgtattttgccgaaactcaactcattacgatgcctccctcataccacagaaaccaaagccacgatg

SEQ ID NO: 2115 - DNA, 703 bp, Nannochloropsis_gaditana
gaagggccatatgctggcggagggcctagtttgaatgtgctgccccgggcggtgtggctttgacgcgttaagcaatgggttcactgacccattttgctgatatgcggcttgtgttgttagaactcaacagcattgtcacagcctttgactttttggagccagtggccccttgcctttttgccgaaatgctccgcgctttgaatgggagcgagcccgcgtgctttcatcttttcgactgaaaacgatttttataattcaacttacgtcgtctctaccctcacgtttctaccaaataaaattaaaaattgaaacagcaacaccagtgaagtagggtgaagagcaagccagggatgcatgcgcaggtttctagtgtcctagtgcggcgagggagcaggcatgcttgggcaagcacagtgatcaagatgacgtcctccttttccggtaacttcgcccaaaaaaactcgtccagacaacgatacccacaacaaaatgtggtaggaaggtatgccagcagggcagcctacatgagccccggtagctcctcctcctcttcctcctcttcctcgttcatgcggtggggcgtggggtcgtggcagcggctactgctgccctaggtgcactctcagagcggcaagactcgcccacagaagcttgtgggattgttggtgtaatcggagaggacgacgctcgttccattctaatg

SEQ ID NO: 2116 - DNA, 703 bp, Nannochloropsis_gaditana
aagtggggacgagagatgtgaaagtgatggattcacaacgatttggttcatacccataacttaatttttcaagtctgcgataatttgtgaatggatcccgtgaacgtgctattatgaaggcttttagcctagaactcgactgaattgagctttcaccctatcctcacgggtttgcgccttccggtttaagaaaatttcagtacatatttgaaaaacacaaatagaacatcgcaagaacgtactcgtcgcagcctcagccacagcgtacatggacttgattaaagtcctatcattcgttgtcaagagttctgtcaactgccgcctagagatgtccagcttttgtcctgtgtccaaacgatcgaggccaaggaagtccttcaagggtgaccaaagaggctcagcaccccctctcgcagtgcctttgtcgctggcatagcgtattgtgactgacagtggtcgttggcggcccaaggcgcgagggcaggcgcatgtccaaaagtgtcgggctcgaaggatctgtttggtatggaaacctaggcagctgccacagaccgaaagcaccgccacgtttgcaggaaaataatgcagtgttcggggtagaagcatgccgttgcctggcgtgagtgattgttgcatgtgtgagaatgcgaaagtgactttgaagacctggttcagttcttcctgacaaagttgaagcagaagg

SEQ ID NO: 2117 - DNA, 703 bp, Nannochloropsis_gaditana
gcagcctgtttgtgccgatgagtctgaaggtgctacaaaagtaggccgagtgtataagaaatatactgctcaaacgtagtatgcctttgtgcatataaggccccctgtagtcgggtatatataagctatgactatatggcccttaaaatcagagcgacagtaattaggtcgccctttacgtgtcatctcagaccatctcaccatgcatgagctgcgcaatcaaaaacaagtttcaagtctgtcatatctcatgatgttaccaaagaaagcaggaactacctcaagaaaaatctgggagctcgcgtcgggaccacatcttagggaacgttcgtcttcgaggccagcagttaattaccccgcctcaggaaaatattcggtcttattccgtcgtaaggatccctgacaacggacagactcagatcagaatccgcggggacccttgaagaacggaaagggtgttttttttccacatatatcatcgggtcatttgttgtgtgaaggattgtatgcgcttttttggtgatgtgcgattctcatcgtggacaaaatatttgcgccgacgagggcctcaagttaggagtccccgggtagtgttggggtagagagctcgctttgtaagatgcttcttgaaatggggatccatgaaagaataatattactctcaagcttgacatatcctatgctgatataacataggactatg

SEQ ID NO: 2118 - DNA, 703 bp, Nannochloropsis_gaditana
aacatatgcggcacgtggcgcgcgcaggaatggaagggtgtgcacacaaggtaggcacgaaggcccccgcggcccgggcggcttccaataaggtcgagtacgctggaacggcaatactccgtccattgacttccacgttcacaagctcctcgtgcgcctctggaattgaatttgagatggcattttttggggtgggtgcgtggtcggaaaaagcagagcttccgctgcttgcggtgggacgggcgcgtaaaaatgacagtctgggccgcgccaggttgacaggagcgaatgcagacgatgtgccggttccacggtgcgcaataacccgcttcgggagacgcaggccgcgcatagccccctaaatctgcatttgtgtccgtaggatgtgttggtgacggaatatttgtcagaatatagccttgaaaaaagaagaaagtagaacattcaagcgagggtcctggaaacgagcgatgcacgacatccttttgaacctgctggcttcgtttaaacttcctttcccacgacccttcctttcccacgacccgtgccacccccgccggcaatacaggcaatgcccgcacggccacgggccatgccaacgcagcgcaaaggctttgaaagacatttgttaatacaggcatcgcggtcagaacaagccctttggcgctgagttgaagctcagaacgtcacgaaagaaagaatg

SEQ ID NO: 2119 - DNA, 703 bp, Nannochloropsis_gaditana
catgctcgtcttcaacttgaagaaggagagagaggaagaggtggctcgggagggaaggacgagtcttggggggggggggaggaacgggcgggtgaggcaggcgctagctctccttgggtgagggaactgattaattccatcgaagaatgtattcggagggatatcaagggacaaaaatcgtactcgttaagaggagaagagggaggaggagggggacaaggcgggggacaaggtaggagggggaggccgatcggcccgtccacggccagtgcaagcgccccggtcagaaggaacctccctttcttcacgacagatggcgagcaggagggctcccatttcgtcctcctcccttccttcacggcggacttcacagcccccggcgcgggaaaggccctggccttacacctccttcactccctccgcccgtcctcccgccctgcctccgccccctccttgcccaccgaggaccccgaacctcccctcctccccctccaataccatcacgacaaaatcgtcctcctcaacatacccatggacgccgagacccccctcacccgcctcctgcggcctcaggccctcctccaagccttctgcctccaccactacatcccaacgatcgcccaccggatgaacctgagcaaagcccggtccttccctccttcctcgccctccccctccgtctcctccatgcaatcaccctacg

SEQ ID NO: 2120 - DNA, 703 bp, Nannochloropsis_gaditana
cctccaacacagcttccaccattgcctcctcgactccgtcaagtcgattaaggacatgtaaagcttctcccgtccgggtcgcacgtagaaaatatattctgcctccagaggaggatgaggaacggaaggatatctcgcacgagatgattcccgatgatgaaggcttgtggtgatgaccattttttgagaattgggataattttcgcatttcgaaatctgtactccaagatggccggtgcgccgtcctcctgccatgctgctacatgacatattctgacgataaaatcaattttggctgaagacatctgacccaactcgtaaccacatatcgtaaactttcagcagataaaaaaaagttgtttctttaatttctattgttggcaaaccctctcgttgtcttatgctcgatctatgcttcgagccatatcgtggggtggggaggttgtcagccgctggaagttgaacaagatgcatgatgctggaaaagattgacttgcatactagccacagcacgcatttgtatggggtctaaatatcttgtagggctgtagatcgaacctcaaacgactttcctgcgttacatcggggcatgcgcgtcagcaaaaaggttgctactcgctccaggtggctcattgcgagggtctttggcctcacgtccttcctactgacacacttcacgcaaacagggttctgggcgacgatg

SEQ ID NO: 2121 - DNA, 703 bp, Nannochloropsis_gaditana
ctcgtcgtcatcataatatgctttcgtgcactcaggccaccatcatatcgacttcgaacgcctgactccaacacacttcttctttcatgaaacatattcatttacacagggcctggctggttcgcagctgtccgcgttccaatttatgcgaagaccacctccctcggggggagcagtgcacagacatgccaccaccgctctgctggcactgttgctttcttgcgccaggccctcgctgtcctctccattctttcccagtcccgctcctccatattcgccatcaagtagaccatgtcgcctgaacatgcacatgccggggacaacggcccagcccttcggcaaacgtggagcgtcactcccaagcgccttcgggggaatgcttcctcggagcaaccgatcacctcgtgcctcctattgctcggctgtgccacggtcatctgcttcccatccgtccatttcttcctatccggggcctgtctccgtgagcaaccccgaggaagcggggtcggcacctcccgcctggatggcagctcttctgaagagccgcctgcacgcacgcggcgggatggaaagatgggggggaataagccgggccttgtcgcgtttccgggcatggatctcggtgcaatcaccccgcgaatctctcatccggagggaaggagcatgggcctcgcacggcttggaagaggacgggagggaggga

SEQ ID NO: 2122 - DNA, 703 bp, Nannochloropsis_gaditana
cttggtgggggaagagggaagagggcagcgtagggcgagtcggagaagaagcaagaaaaatttgagcgatgtgcgtgaagatgaactttttcttctccaaaccctcagaaacttgacgagactgaccaacgccatgccccttgcggtttcacgactcacattgtatttcatgcccggtcgtctatttatcagagtgctgcgagaaggagtcgtgtgggagcaggcaatggtgcggtttctggcgggcttcggaggtacctcgccccccctcgccttgctgctgtcctacctgtccttcctgttttcaccccaagtagatggattttcgaagcctcctcagcagctttggtgcgctacgcactcttggacgcgatctaagagggcatatgttgcgaaaagacccaaattgctggtagcacaggcagagagcgaagggagcaaggagggctggtggaagcctcggccggagtggcgagatgacgatccaatagacgtcccaggcctagcggcatcggagctacccgacagttttgacgacgcccttaatattgctgtggagtcggcacagcaggccttcgctgcgggcaggaaccgcgtgcgcatcgatttcgatactaccgccggggacctcacctacacgacgctcaaaaattccatccccctcgcgctggccctcgcgcaatatctaggcaaggaggtgatg

SEQ ID NO: 2123 - DNA, 703 bp, Nannochloropsis_gaditana
tatctcttccacgcctgagttgcggggaggccggacgcggacatgagtggcctcctggaccgtcgagacctgggtgtaagagacggcggcattgcaggctacggaccaatgcgtggacagatgcgtcagcaggtgggtgatgaggacaaagggccatgcaacaaggatccacaaaggaatattgcgctcggatgtgctggatgtggtgaccgattcatttcggtcctctactattgtaaaaggagcgactgccacagcgagcaacacaacgtaggtgacaaggaagggcccaaaatctagtcgactgcttccgggtcgtgccttgtagaggccagcccaggcgacggtcttatccttcatcaacctgtgaaacgaatgagtccgaagccaggtgaatacgggggaggggggcacaaaaacggcgaccttgggcgtgggaggcgaaagcgaggggaagggggcgcaacgaggggcggaggggagagcaaggggtacattgagtgctctagacggcagctctgcggtggaatcatccacgatttcattagtttggttatcaggatgtctgtcatttaaccaaaattctctaaaggacatgacaattgaacttgtcgtgcgatgccttgtattgttatttgctatgatcctaccctcatgcctcagacctcccctccatacaaccacaatgtcaagctccacaatg

SEQ ID NO: 2124 - DNA, 703 bp, Nannochloropsis_gaditana
gcttaagcccagacaagccggaggatttacctttcaaacggccctcggcctggggccctaacgggcggcgacaagccgttgcgctttctcccagaaagcacgctacggcctccaggtctgacgcgttggagaggctggaaccaagcgcggatggcggggcttgtgtttctcggtggtacccatgtctgaaggctagcctctcgtttgtacctcgagacttgagagggtgctgctgagaaaatggtgacgagttcgttccccttgcagaaccattagctggaggggaacgagcggagagcgggagaaaccgacaaagtcgcctagacaaatacggcctcgttcaggaatcgcaaaaactaagcggcacctcagcagttaaaaaatacatgcgcaccattgttccattgatgtgggacgggaaaaaaagctttctattgtgctccaagaagccatcctctctgcgtccatcccacatcgtatattacccatcgttccaagccatctccttttgtgtgtcactcctctgtgacataggtcaagtacgctaggtgcaatacatgcaccttcattttatgaaatttggcgaacgactggttgtctttttcctgtttgattttgataggcgttgcccgatcagatgttcatgtctttcgtctccggctcctcactgatcaaccatctttccccacttcactcaggaatg

SEQ ID NO: 2125 - DNA, 703 bp, Nannochloropsis_gaditana
tcagaaattgctgagctcttgccccgcacctggccccgcacgccttttcaagtcgctttggagcgccacttgaaggtgcatgcctcccgcgtggaggtcctgacctggctgggcgagcccaaagtctacgaggcggcccgggccctgatccagggctgtgtggagagtgccagggtccgggaggctggctctttggcgcgcgtgctagtgcaacggaagcacttgctgacggaggagcatgggcgggagctgcatgagtacgcgctctcccatgctgtcaacgaggatgactactcctcagcgatcaagtcgtgtatcgtgtctctttctgcgctacccacttcgatcgagcgcggcaacgctctcaaccgcctggtcagaaaggccacccgggcagacgcgaaccgcgccgtgattcgccgcatggcgcacaagacaccggagtccctccctctcgctctcctgtcggggaacgccttcgccctttcccgcaactaccagatggccctcgacaaattccttggcgcgtaccgcatggcgccgtccgagcccctggtcacccttgcggcagcagccttattgatgcgagtcttgtcgcaccggaagcttgtggaccggcacggatgcctggtcaagtgtttggccttcctcgagcagtacgccaggttgcggctagtgcagggggtggaagaagacgtgttga

SEQ ID NO: 2126 - DNA, 703 bp, Nannochloropsis_gaditana
gacacagccaagcgtagtcgtctcaaacagcattcgatcatcaatggggagtacagcctggagcgtctcctcctggttgtcctcctttaataacggtggtaggggccatgacccggctgtttcaccttccaggacgcctcctcgaggtgtgggcaagggccgggcccctccgtgtcgtccgcatcactcgcaccatttgccgtcaaagtgctgtgaaagaggtggctgtggaaagcgcagcaacggatgtaaatattctagcccaagcaggccgcggccaggccccaaattgctgtgtcgttacggtatgggctgtacacacgtgtcggaccctgtccacgccgagcaattttggcacccgccggttccaggtgagccagtatgtatgactttggaggacaggaatggaggctacgctgcagaggccaaaggtggagagaacctcttcagtgagtcctccttcgctgtcacacgttcatatccctgccatgaatgtggcctttgcttccgggacctttctgttttgcggctgcacttgcaacgcaaaacggcctggtccaaccaatctctagtcggttgtcgcgtcagctgtttggtggatcatcgggaatggcaggagggcctggtggtggagtatcgggaagccgcggggaagcacaggattgtcttagagcacgtgggagagtcgcggtggctgtcgatg

SEQ ID NO: 2127 - DNA, 703 bp, Nannochloropsis_gaditana
agagatggtgagactcgccttttgcggttgacggaatgtctggagcccgaaggcgatgcgcaagacctcaacaatccgcgcatcaagttcattgtcaggtgaacctttcactgatgtggaatccgctatcatttcggtgccagacgtcctgtaacgtggtgagcgggtcgaaggtcagagcggcgaaattaagacacggtaaaggaggcattctagtacgacgggcaagagattgccggatgaatagttttcaaggatggtacgagtctcaacgcttcaccatggttgaacgcctgaagggcaaactgattgacttttttgggttttctcatggctcgaccaacggcgtcaaagcgcagagacgggcgcacatcagtgacaagtgctcgctgagtgaagtattgtgagcgaggcgatgatatcatcccctccttcccgagtgccaataggaaggaagcaggcctccgccacaatctgcgtgcggtactcttccgtccctcttctaatatgtgtcaagaggagatctgtctttgcgtgcattcagtcctcctcattaattgtgcaggtggtgcacaaacctagcccaagaaggaaggattggcagaccgccacattgctatctacccccccccgaaccgcaacatctttcgctttctcagccgactccgacacaatttgcaatatctgctcgaaatgatcccag

SEQ ID NO: 2128 - DNA, 703 bp, Nannochloropsis_gaditana
tcttgttgatgtcgtctactaaagccttctcaaagttgcttgaagcagcatgaaaatctttttcgtcattaatggaaaagagtggtgtgccggaaggaaggctcgaaaatggaaatgtagacattgattttcttgatcggtgttgtgagatatcatgaagaagcgtaatcgaacttgactttgagagcaggaacaacatatgtttctgggaggaccgccaatgccgctgtccgaacaggctagcgtggaagccgtgtatttgtagtggcctcgataaggtcaaaaagagaggtaatagcacccccagaagctgatatcgctgctgtttttttgacgttgaggtctcttgtttgcagctaaggcttttggatccaggccgcgaccaggcaaaagagcccgacatgacggacgtgagcgtcgcgaggagcagtttgaatatgtctccatattttctcaacagtcgattcttttgccgccttttatatgcgtcagacttagaagacatatttattactcattgcctgtgcttgtatggcgtcgatgagggcgttaaccttcacgggaaagtcggctgaccagcgcagagtgctaacctccccaccccacgtgctcgcgcgtgcgtcatcgccaatttaacggttcgagcagactttgatgaccattgagacactgcccaccctctgccaggaaattggaggtcatg

SEQ ID NO: 2129 - DNA, 703 bp, Nannochloropsis_gaditana
aagctagcgaagaggcggtggcactttgacacttccgcccccgacgctgacacgttctgcgtatagtgacacgtaaatatggccgtctttcaggaagcatagtccaggagggggtggcctcagaacgcgtggggtgtattaaacgggcctcagtgatcgactttgcgtcgcgtggcgcctagatggccacgtcagcaaacatagacgtgataccaaagggttggatattttatgtcacgtggctgtggaaaggcgccttcaagcgacctcgcactcttactttgtgagccttggtccccgcagtggatagcacgcatgtgtcttttgccttcttccgtagcccaattcgtacaaaggggctgaaattgtgggccattctggataggggttcttgggaggatgacctcccaccctactgcttgtactgaaggtgagacatcccttcccaccatcaattgtcagcatgttaggcttatttgtacggtcatggcacgatgcacggcatcgatacatgcatatgacgatttatcccttttgtgtcgcggatacaccgcatacgtcgatgtaccctccacttgaccttcacctcacgatgtctacactcccacaagctgtcccgctctcataaatactcgctttgctcccctatcacctccaccgacaaaacaacgggtctgcctgcctattattacactcgtgcagc

SEQ ID NO: 2130 - DNA, 703 bp, Nannochloropsis_gaditana
tgcacaagcaccgccgagcacttttttcgcgcaattgttcttccccccgtctccactactgggggcgtgcctgcctgaagctcatgcctgtcgacgcttgtttatattcaggtctggaccggggttgataatggaagagtatgcgtagaaagaagagaataagacatagtctctgccacgggtgtgtaattcacatttttccggcattgccttgaggtgctcgtatcaggacataacacagattagtgtgtctctgaatgacaagtcatttctttctcttgcaattttcttcaattgtacagatacgcatccggaacctttctctgagcaagcaattggctttgaaaggaaccacccggttgaaggagggtggtggtagcggcaagtcggcaacgagaccggacagggctgcagcatggggtccgtcgtaggcaagagtgtcccgaacactccagcatttaccagtcctttggtgagtctcagaagggaatagtgtcctgtgaccttcaagccgttccattcctgtcctccattcgaaatttacgcattttggccgatattcgttttttttatccttgacctggctcctcctacccacatccacagatatattccttgatcagtaccacgcgccatgtggtatgtacagctaaggaagcgcaattgatcgcgagtataggagttgtaagtcctgttgataatg

SEQ ID NO: 2131 - DNA, 703 bp, Nannochloropsis_gaditana
cttctaatctcagatattgaaacctggaatcatttctagcgcaatctcttgctgccttgtccgtaaaagacgctcactccgtgaaatcccttcctttgcgagactttaatccaacatacttttggaggatcaatgtaaaagaaagctaagactagagacagaatcgtgtccgagcgaatgaatataaacattataggcagcaataattgcacagagaaaaaagaagaattgtttgctggcaaaaatgagaagcttcatgcaagttatttgaagctagtaaccacctagccatgccgtgacttacatgatgggtgggtgtcgttgacgactgatgaaagtgcgcagaaagatcgcaggagcaatgggcatctcatttgaataaatggattgacaaagcagcatactgcacaccgtcgaggctttttccgtattaccgtttgcggactgggttccgacaagtccggaaaagaaattcgagtaaccgttgaaaatttaacgagacgcttgctgccgttgccgttggaggagattggcgcaaagagtgaaaggcctctcatagatgggcatggatgctgcactgtagtcacttccactgatgatatgtgtgattttattattaagcactgtgttgtacgctgaacgtctgcccaaccaacttcttcaggagtcttctgaaaacacccctttttcctcaccccagatg

SEQ ID NO: 2132 - DNA, 703 bp, Nannochloropsis_gaditana
attgtggctccatgaaaaacttaccactttgtcttcgacatgctcttttctatgtcttatcaccagaataggtggcaagaacttgtgaaagctgcacagaattgtctgcgtcatgcaaccagccagagctgcacgagccgacgtttgacaacagaaaaacggaaaggggaaggaagactgggggggaaaacggtgaagtaagtatgttactgaattttttgcaagaagtaacgggaagtctgcttgtgcttcaacttcttcattttaccacgatatgcacgctatacatcgcagaagcagcgaccaagcagcacgagggatccattaaaaaggcgaagaaaacgccatttattgcagcatcagtgcatgcaagatgtatggcctcaataaggcgtgcgaggactcagttctcgcggcggcgtgtcacgagacactagaaatggaggatctggaggctctcgcgacttgcgcaaaaagcacctattcgggagatgtcggaggggatacatggattcagagcaagcgtccctcgcgaagttctttttacttaaagacaggcctctttctgccgccagatgtgacattgcataacatgaaacactacgggcggcggcatttcctgaaaatgcgcgagtcggagatgcacatatatgcctgtgatccttgctacgaagaacggcaaatcgaactccgcccagacatg

SEQ ID NO: 2133 - DNA, 703 bp, Nannochloropsis_gaditana
tacccagtagaaaacagattgacacttggttctgcagggagcagacgcatattttggaaagcagccagcatgtgttctcatcgcaggaaacttgaaaactgattccaagactgaaaattaggcttgctagaaagtatccttccgacaggggcaattcgtgaaaaataattgaaaagagctatctgaactgtggaatccagtagcttctataacaatttgaaaagtcagccgtgaaatgatcatatcgtctggaaatgctgcgagtgaattctttcacgctggttttactctatctcactgaaatgtcggttcgatcaccgagtggaaaacatttcacaacagcatactgacatctgattctgaccggcgcatcgtttgggagagacgtttttagctgaaagacggaaagggtggtataaaggggggccgggaggttaatcaacagttgaacgcgtggctccccaccgtccccgacgacgagagcgatcagccaccgtcctgcaaagctgacataagtttactttggtctcggtaggagtaattcattgcagtaacacctatatccttatgatgcagttaagaggtatagcgtggcgaaagcacgcggtggctaagcaagtaataaaaactgcttgaacgaacggcaaggatacatacaccatccttctcgtcctgtaccacaacatgacacaggaaagagatg

SEQ ID NO: 2134 - DNA, 703 bp, Nannochloropsis_gaditana
gagggattgggctgacgaaacgagtcttgagcccagtcgtccggagccacaagctcctcaatgtcatcaaccgggggcgggggaaccggggctttgacagaccggcgcttggaccggtgatgtcgatgcttgccgttgctgtcagatttttgaggatctggcgtagggctgatcgagcattgtgatgtgtcgcccccggatggcatcctggtgaaggcctcgttggtccggggcgaagaaatagtctgtaccagggtggacttccagtttgcccggatcacagcatgtgagtacgcatgagtttcgctggatccactcaatcaaatcttgcagttgtttaaaagggtaaagatcaaacgagggcggattatcgaaggggaaacacaggcgtccaggaaatggcgacggacaggagcaagggcttcggaggatactaggatgccatggaccggggacgaacataagacagaacggagacccgcatgcatttcgcattcattttgcttgttcaagacgtttttgacgcgccgcagggtcccgatggatttgtgtgggtcgttcacagtgcgtctgtgtcggctttctgctttaacccccttcagctacttgcttgccgcgcgacttcccgtcccccggcattgagagcctgtttcatttcaacatacgttctaaatcgtccgtcatttcaaacatactctgccag

SEQ ID NO: 2135 - DNA, 703 bp, Nannochloropsis_gaditana
gagacggccgtggcggcgaccacgacgctcttgcgggagggctggaccatgggccgacgcctgtatgcctcggtgcaattccggttgttgatgggggggaagagaaaccttttggaggccctggtgcgggaggcggagaaagagatgccttccgtgtcggcggcggctgtagaatacggtgccattacgctttccagggatcaggggaccaaagggaaagcggccgtccgccttgtgcctttccctccctccaccggtccccccatcccttccttcccgtatcacgacacgaacagctgcaacttgttactcacggagctggccaagcaccgccgcttggatttagcctacatattcctctccctcatgaatgaactggggttgggtcctgccgatgcggtcagctacaacatcttgatggacttagccctcaaggtcaagcggcctgggaaattgcgcgaactgttcgccgaaatgcaacaacggggcattcgccccgaggtgatcacgtacaacatcctcctgtctgcctgcgccaccgtggcggaagaccggacccaagcccttggtctgtgggccgatttcaaagccagcggcctcttggcggatcggatcttgtacctgtccttaatgcgcgctttgcgaccggacacggcggaccgacgcaccgtgttgaccctgttggacgaagcctccagcgccg

SEQ ID NO: 2136 - DNA, 703 bp, Nannochloropsis_gaditana
tgccagtgaatcttcgcggacctggcaggggaccaaaagtccccgcccaggcgaagacatcttacccatcgcagggctgacctcgccctcgccctctccctctccccccacccaagaatcgccccgacacgtgaccgtctcacgcgcaataaccatccttgagcagagcattgagtggggtttggtggggcgccgtgcgatttttcgtcgcgtcttgcgcatggtgcaagctgagcgaggtcggcaggagatggtggcttacgtggatacgctctttaaatcaggacggtttcgacgctttcctgaggaaggccgactactgatggtggaggccctatgtgacgtcggacttttccggcatgccttgcacattcttcgggaagcggcgcctgcggacgtcggggaacggaaacgtttgtatggcctcgtcatggcggcggcggcggcaggagcggatcacgacttggtcttccagctgcacgatgaaatgatggcgcacatgggccccggtccagccgcaaaccgtgacgtgtatcacgcggtcttgctctctttgcgggcggtcggtgtggatacagggcccggcctggctgccaaggccactgccgatgaacgctcccccgaagcccgatggcaacggttggcgatggagatgctgggggcatgcacgggggaggtggggggagaaggtgtggcgggacgg

SEQ ID NO: 2137 - DNA, 703 bp, Nannochloropsis_gaditana
ttgcgcgattccggctttggaggcagcgagagaagcgtgcttgaatttgagaatgacctatttggaaagtttcgaacatttaaatggcaaaaaggctccctttttttgcttaatgatatgttagtctcgagaaagcattcaaaagctcaatattgaggaggggattcacacatcggaaaaaggtaaagcctgcgttctttggcaggaggttaaatcataacatgcttgattttttttttctaatttacatctagattgggcttcatcagccgaagagtattccgattggtttttgggggcttgccacacttctttttaattgcctacgtgcgccgcagacccgtgagaagcatatgacagtcggtatgctgccaacttttcgtacgattgctcttggcgagtcgctcacggcaaggcacgcacagaggaggagggcaacgccatggctgcgtccatgttgtcccggatagccaaagaaaagggacctttcgatcaataattggtttcactttgtccgtggtgcagaaagccgggctatggttgggtcttagatagcatcgaggctgcgcctgaaactggcatggcttccctagacggtggctgggtcgttgatctgctccctttctctgttccgagtcccgttccacgtgagctcatatcgacacacacatggaatctaggtgtcaaatattggaggggtatg

SEQ ID NO: 2138 - DNA, 703 bp, Nannochloropsis_gaditana
gttagcaggaggagtccttcttgttgatatggccaatgcctgtttctcccaaaaccttggccatcggtggtctgttgtaattattcctgcgccaaagtcattctccacatcgcacttacttgcctcgaagcaccacgcactggcctacgcttcaattgaactctcttcagacagtccccaggtcaagggagaggagccctgccgcccatcatcccccgggcctcacgctcaaaaaatgactggtgcaattattcccgaaagtgtctctttctcgtatgtgtccaaccgctgcacaatcatacgcttgtgggagtcgtttggtgcgtgcaagcacacgtgggagggcagtggtaacatgtgcccgtggaaaccaggtgccgctgctacccgtcgcttaaatgagaagaattcttgagaagcgcggtccgccctcccttcaaactttaacccaaaccgaacaaccccgtgtgggaacctcgtaattggtgttggatagcatacgtgacactgggcatatcgtgcgggaggaagggcctggatggacctggatcctgtcggattttttgggttcacctgcccgctagttcgccagaatcggtatcagactgtaacccccttgctaccttccccaatacacaggtttgctatcggtaggagcacagcaccggcaggataggacccagctcttgcggagggagccatg

SEQ ID NO: 2139 - DNA, 703 bp, Nannochloropsis_gaditana
aaatgagccgatccaattcatgtctttgtaccctggttgcatttcttcgccgacccacacccctcaacggaagtaataagtgtatggcaccgattggacgcaagacaacaagagggaccacgatccatggaatatttgcatcgtccgctcaattatgtggaagagcccatgggaaaagcgagcttcaagcgcgagcaggaggtcactcccaggcacggagcatcaaataaaccacaaagacaccagaccagaacggtgtgaccctgttgtggcgtttactttgtgtagatttcagaggttctcctgagcccgacttggggttgaggtgcgtggcgtgggtgggggaagatggccacctgtgacgtccgagtctcctcacgtcaccgaagaagcaacagcctggcttctacatcagatcttacctattgtcattatcttgttatgtcgattggtcgcggatgcaatcacctgcagagcagaatttgtgatacttatcatcatggtgtatagcattgacagaaaaattgccagtaatcgcaaagtcctggctccttcatgtctgctcaagcaccaggcacgacaatatcttgaatgtcctcctctcacatgtccaccacgtatcacacagtacacagcaagcaaagcaacgtccagcatcatcaatcaagagcactaaatccaacaggagcacgaaataattatg

SEQ ID NO: 2140 - DNA, 703 bp, Nannochloropsis_gaditana
ataacaacggcgggatggggggcgggagagtggcgggcggcggggtccagaatggatggggtaatgggatgggcaataatggcatggggagggcggggaataatggatggttgtaaatcgtcttcttgtcatcaaatccatcttgccacgatacgaggagaggaatttaaaacaaaacaaagtattttcataggacacaaaagagacaaggtaaaaagatgacagaatgatgtgagatcgcggcgcagacgcaaattgtcaggctgcatgcatgaaaaggacgaaagaaaacagtggtgcagagctttaaataagtctcaatgttgcgttggttgctgtctcccgaaattcttctttcgtactagagccggcgcttgagttgcacgcgtagctgctcctagtcttgttctctgtgtgaccatttacagagaacgagaccacccagacaagctacctagcacgaccacctatcctggagagcgtgttgtgtggtcttcttgctattaaaagcgctatgctccctcgtactcatggtcaaatgtgtccttagtgtgagattgcgcgatggctttccttctccccaaggattgttccgtctccatcacgcaatgaatggattccccgtctttctcacgccacccacacacaggcgttcgacctgggggacttctaacacgtccatccatttgtgtccttttttaca

SEQ ID NO: 2141 - DNA, 703 bp, Nannochloropsis_gaditana
gtggatgagacagcgtacatgaatgtgggcaattattgaaatgacgggtcgccatgtcctgagagcgcctcttcaggcttcctcacttggcatgtcttccctccgtcacctacctccacatgtctcttctttctgtgtctgcagcaaaaattaaatgacggcaaatatagaagacaaaaatgggcaagctgaacatggccaaggtgtaaatgaagagcttgcgacctacttccttattttggggctccataagtctgtaaggacgtgggaagagggcaacaacgttgcatatcggtcacatctgagtataggtagctttttaaaggcttaaggatgagaacttacaggctaattagctgaaacggcatggtttactcttgtggcggcacgtgctgcgaagtacgggagagccgaggcgagaagaaatgttcgcgtggacgtgagggaaagttaagtcgcacaatttgaaagtagggctgtagtactggatcgagtctgtctttctgtagccgaggtagagcgtgagaggatggcagtgagggtctaggcacgcggacgtgaagtaattgttccgctcttgtcccgtcgctaagggcctgtggcgaggctctacgagacttgctggggtgggaggtcgcgctgcccgtcgactcgtaacatttgttttgcccacgactttcgcaattttatcctcacaggcatg

SEQ ID NO: 2142 - DNA, 703 bp, Nannochloropsis_gaditana
cgaaactcgtcgcccagttgcggcgtcccatggttttctcagccacgcacgaggatccgctgtacaaccccaggaaagttgcgaggaggaatgaatgcttacatgcgcccactgtgtgatgacggggataagctcagtcaatctacccatcttactgacgacacgtaagctccatctccgacctatgtcactccagcctccctctcacgcacctgcccgagttcgaaatattcgcagcataatctgtcctcgtgaggccttcgtcggtaatggaactgtatcatagcggtgaaagaatgccccccacagggcccccacgtaaagcccgcgaatgcaccctgcttgcagcggacgggagatgaagaactgagctgcgaagagttaaaaaaaaatgacggaaaaccttaccttccgcgagccgtgcgtcacaagaagggctatacacgctatttattggggggaccaccgccatcaaaatcacctgtcctgaagaacgttgcgataagtgtccgtgaggtggcgaggttaaagactacagagacgagacgtcaaggcatcgctgaggagactggtttgcggagattaactgtgatccctgccccaaaggctaacaactcagcgaacacacactttgttattgtgaattagagaaggcggagcacacattgggaggataaaccacctacaatcaccctcaggtcac

SEQ ID NO: 2143 - DNA, 703 bp, Nannochloropsis_gaditana
cgttctagaatgcggctacatctcctggctcttccgtgccctttcattccaaacctgcttaccgaaatggaatggagggtcaagcccgccgcttaggttacgtgcgaatgttttagtcacacgtcctcgcgatggccttcccccggtcacccccatcggggccccggaggggcagcggcttgccgccaagaaagcttgtgcctctggcagccgccaccagcaaccgaccaaagcgatggaaaggcctactgtcagccttcgccgtcgtttgactgggttggtggaaagcgtcatggtataggagacccctaagtatgtcaacgggaaggatgacgggctttgtcagtatgcatggagcgtggcgcggcaaatcgactgcccccatcatgggtcataaaaccaatccgactccccgctccaatccgggtcaacagaacgtagaggggtgcagcatgagcggagtccaggtggggcgcagacgagagtctgacaaattctagatggcgtgtgtaagtgacctcgcgacatgacatatgaaggaggacttccaggggtcgccaattcgctaagttccagtacactgacgcggtccgaaaatggccttttacgtactcccaccacaataacacaggctgcaggaatgctttcgtcgaaggccggcagacttttgtggcttggtgctgccggtggaagcagcagcatg

SEQ ID NO: 2144 - DNA, 703 bp, Nannochloropsis_gaditana
cctgctcaccgtctacgtagcgtcgagtttatcctactcacacgctacatgaaggcgggcaaagcctttggggcgtacgaaagatgaaccacgcacgcgaggcatctctcccgtgctaccgccagcgcccgtaacgcaactctcacttccagacggcgacatataagcgagccgtcgccagatcccctcctatctccgttttgacaaggggatccacatccctggtgtctttgggactggggtgcagcaaggcggtctgttattggtcgactggaaggaaaagaaagaattgcctgcgctggttgctcccaaaggcgcggttttttttttgcacgggctgagagaccgaagtcgtctcattgctctcaggcttcccattcgtcccctcgactcccgtgatcgacgcccttcgtggagctgcggcatcacaggcagtcatgttgcacgctttctgacccggaggaagaggacgttatattcgattggtacctccccgttcccgcgcagcaccctatgcactccctcacagctttttctattcaccgtctcacagctcaaaacgaccaatcgagtggagttgtgtcgtcagacttttttgatcgttataatcgggacccttgggtggcggctttccgtggtacagtcctagctcgggaaaacccaggttttccgctcatcgcttcttggcagggcaaaagtcatg

SEQ ID NO: 2145 - DNA, 703 bp, Nannochloropsis_gaditana
cagcctttacatttacagtatctgtgatcattttagtgaagcatatgtattataatgatatctcattgatcacagatctataaagaggagtatcccactcgtcaacaagcttcagaaatgggcgtgtatgccagcgggctaaaactaagcaaagctcgatgctggcgccggggcgataagaacatacctcgacttgtcttgtgtattttattgatgttgtgcacgcatttcgtgctcaatcgtgtgaagctactggaaaaggacgatatacaaccattacaagctcaaaatttaaaattagaaaaatgtcagagatggaccgcagcacaaagaaatgagctcctgcaggaagtgaaagcctacgagaaggatcagagattcgccagaaaaattgctgaggcgaaaggcgaaatcaagctagatgcccgcttcccagcttgtctggctttcttgaaggcaaaagtactgacatccgggcagtcagtgttagatcttggatctgctgcaggtgctttgttgcgggttgttggtgaagtgcttgatacggatggtggtagggggcgaatggtcggtgttgagctagttggaggatgggtccaagctgcaaaagaaattttgggagacaagatagagttctatcattcagacatcacggaatttgatgaggtcgactttaaatttgatgtcattacgctccttgatg

SEQ ID NO: 2146 - DNA, 703 bp, Nannochloropsis_gaditana
ctcccccagactgctcctattacgccatcgctccctcactccctccctccactcaccgttacggagccatatgtctgcgcgcgtcccgagcacatcagcacaaacagagattttgtaccctgttcgcccgcccgggacaggcacgtattggcaaatacgtgtcggcggcaaaggcacttccgccatcttattcgctcccgccttggtccggatgtgcagcgtcgctgtcgttgcagtcgtgctgctgttaaatgcagtcacaatatcactttcgctatatggcattgcgtctgttgcgtgaaaggcaagataatgagttacaaattaatgccagcatcggccatcgtgatggccacccacagatctcaaacgcacacagccgtcgctcaagatcgcttcaagatggcgtgcacgggaaaggcttcgcgtctttatgcgccttcaagatacaagagcgatgagtgaggaaaatattagtatcaagcaaggaaaagacaagataaaacaaaaaaagccacttcggctgcatggcaaaacacaatgtaaacacattcacgatacatggcaacttcggctgttcaaacgtaccagacggaggatgtgaacataaggcgacccggatgtgcggggcgaccagaagtgcagggcctaagttgttgacccgatcagagggtctattttctcaagaatcttggacttaatg

SEQ ID NO: 2147 - DNA, 703 bp, Nannochloropsis_gaditana
gatctgtttccccagtcttgtgccacatggccgggcacggtggtgagcttcaggcaggagagtcgcttccgcccgcagagtcctctctcttaccctcccatcccccctcctccctcccctttcaggttgtcattgcctacgaacccgtgtgggcgattggcacgggcttgaccgccacgcctgagcaggcccaggaggtacatgccgccctccgtggctggttcacccagcacgtctccgcccctgtggcacaggccttgaggatcatctacggcggatcggtcacggcgaagaacgccaacggtgggaaggggaagggtgtgggagggagggagggagggagggagggatggatggaaggagggaaggaggaaggacaataaacgatattgccgggggtaaagcgcttggccacgccgagatcacgtggtgccgacgcaattgctcctctcattcttccctccctccctccctccctccctgcttcccttcagagctggcaggcaaggcggacatcgacggctttctggtggggggcgcctccctcaagccggagttcatccacatcgtcaacgcttcggacgccgccgcccgtacgaccggccccattcgggtcgggatcaatggcttcgggcggatcggacggctcgtgacccgggcggcgcaagggaaggccctcacccacattaaagccatcaacgac

SEQ ID NO: 2148 - DNA, 703 bp, Nannochloropsis_gaditana
gatgaatactgtcctccggcgttgaccgtcatccccgcagcattggcttgccgatcctcgaaataattgagaagagcttgacagacatcctcgggtttgtggatctggatctcagttaatgccatcatgagcaccgcgttgacttgttggtccaaaaaatcgcgggtctgattgagggacgcagagtgctgaggaacatcgtttgacccggtcaaggagatagcaggatcagtttccggctcttctcttgccatcctatgaaactttaatgtgtattttcatatatgtatttttatgtattagtatagatgaaagtccatggaaggcgcactgctgggcaccattagtaatcttttttaagaaataaaatttgccaaattttgcgaccattactaacggccacggtgcaacgtaacggtcgaaacccgtcgacaaaggtgttgaatcagttgataatccatgcatacggttccctaaccttgcccttgtcatcgtcacctttacaaatcatcacactttcaagattatgcgaagggtatttgatagtgcacttcatttgggtcggtatactcgtcatcagcctgtggcacggtgtgtcacctcatcaggtcctcaagtctccactggttgcatttcgtcaaacctcgtcttaattcctttacccaagctcgctccgcatatgaagtctggtagaataaactgg

SEQ ID NO: 2149 - DNA, 703 bp, Nannochloropsis_gaditana
aaaaagcatgaagtccaactgatggccacatcctggcctcttcgttacaattaataaacagagaagggaaggaggaaagaaaagaatggtccgcgtagatcgtgaagatcggaactacttctccgattgcggtcttacagtcacaaaaaataccgaggggaagaaagccgctcatgacatgctttgatcagcaggtgcgcctacaaagtggttgcacaccagatctttgaaatgtgattgaatggaaagtggctacggctttggtgtttttggaacagacaacttttactcgtgatccttttcaggaatcgagattccgtctatcgcttttaacgcaatcggcgcgccccagtatgactcgaagagctttggtgcgcaagaaatcccgtcaagaatgagcaaacaggtacattgacgtaccgatcatgtggcatacggttcaatctctctccggtcaagatgattgagctctctctgtggaaattaaaggggtgggccggacaaccctgcgtgcgtgtcgcgttgcgacctctcaattcggtgttctcgatcggtagtatgcgttccaagaaggacttattggctttcatttttcgttcgattttaccgcgttgcgtcgtgaaatagaaacatggactttctcgaaatctaccttttcttacgccggcgcactcctcaaagtttcatacattttcgcaggatg

SEQ ID NO: 2150 - DNA, 703 bp, Nannochloropsis_gaditana
gcgtaccgcgggttctcgccgcgcctccctcgacctctcccacccgcccacatccctctcccttcaacctccccactacgccagcgcaccgcccatccggcaatgcatgcataggcctgcatccacattcccaatatgtgcactggaatgagtgcatgattattttttgatgtccatgtttgggctcgtcgaaccccgttggcggtccaattgacagggggtcggcgcgacgcttcgcatccccttggtgccgcctgcgtttcctttcaattctctgatgaaattaaaattctacccattctccttcatcagagccccatgggtgatgcatcggagcctttggttgaaacatcctcaatatctcgagcggaaatcggtccacatcgaccaagctttgtgtctactctccaagttactcgtaccgctcgaaatgggctgcttagccctaggcagcgagccctggagcaagcaagcgaggacacagatctgctggacatgtcatcactatccctgaacacagtctcccccctcagggacgtgcacttggatctccccttcattcttgcctgcgaaaaaatctacaagcagtcagtggccaagggctgcccatgcagtgtggggagggccctgagcatgaaggacagggacgcaagcaacgagcaagacgctaatctcacctacggggaggtgcaattcaggtcca

SEQ ID NO: 2151 - DNA, 703 bp, Nannochloropsis_gaditana; identical to SEQ ID NO: 303

SEQ ID NO: 2152 - DNA, 703 bp, Nannochloropsis_gaditana
ctggttgtgaaattcgtggtgtttagaggggaatgaagagctgaggtcgaccgcaaagggggcggggctcgcggcgatggcgtatcttgtgatggaacacgtaccctcgccactcagtaacagcaacagcaacatccttctagacgaagagctgggggtcacccccaccacaccctgatgcccagcacgagaaatctcaaagtcgtatcattgtcatttctatgcaggttgttcattcttctggcttgctgacgaagctacttttaagatgatacagctccgagcacgtgttggtagcttgaatggtagaaagccggctgcgactgccgtgttgctgggtttattcctgaccaccggcacattggtgcatgccttcgtgccggcaacacacatttccaaaggtagaagtagccaatcgctttccgttagggcatggattttgccctttcagtcccaagcacggtttcatgtgccacttcttcagtcggccgccgccgcagatgacgacgccggtaaagacaagttggaagaggagctggagcatgaattgcctgaaggagagcacgaagaagcagataaaagcaccgcggcaccggcaacgaacgctgtggacgacgtatttaactctgtgccgtttcttcaaaagcggaaagaggccatggaaaaggagatggcctcaatcgacgagaatttagccatgatg

SEQ ID NO: 2153 - DNA, 703 bp, Nannochloropsis_gaditana
gaagaacatcctggagagctggactcagacttttaatgctggtcttagaaaagatcaaaatcatttaaaactcaagccaaatcagccagaaaccaccctgtgagtgtgcgataggaagagtccccagctttatatacggcccgaacgccaagacgccttatttatatatccacactcgggagtcatgccgttcactggagcctcgcaagccagtggagacatcacagcgaaggtcctcgacctcacttttttcaagacgtactctgaaagggggatgcaatgagctgcgggcacatcgcaggactatgtaaatattcggtagttttcctcttcgcggtaccgtatcctaggagaggcaggcaacgcacgtctcccacctccacttctataccgccttcccctccctctggtttcacatgacttagcgcacgatgcctctcttgcacatgcgtctgtccacctgtcttccaacctgcctcgcacacccgagggaggcagcgtctatggcccatttccagggcgtgacctgaagtcatttgagcgagacgagtaaagccaatgcggcgagagggaagaggcgctctcgtgcctgactgccgctctctgctgccacattcaccacggctcaaatgaccacaacgtcaatccacatattcacaaaaacgaaaagggcacaagttttggccttccgtggtgcgtcatg

SEQ ID NO: 2154 - DNA, 703 bp, Nannochloropsis_gaditana
taggcagcttgacgggactcaacattccctcccccttatttccacaattttcaaatccatactacagcatattcgcttaactacccaagctgctccggtcacgaacctggtccatgctttttcgaactccacattgtccactctaccgcatcagggcccctgtcgtcctattccagcctggtccacccaccgctccctccctatccgcgcactctccgcctccgcaagccaggatttcatcctgaatgtgccgagcatgggtgactcaattaccgagggcaccatcgtgaattggcagaagaaggtgggggactgggtggacgcggacgacgtgatcgtggttctggagacggacaaagtgagcgtcgacgtgcgggccccccgctctggcatcatcacggaggtgattggcgccgaagacgatacggtgggcgtgggcgtgcctctggccaagattgatacgacggcagccaagcccgagggggcggcacaatcctctgcccccccgcccaccccaccccctccccctcccaaggccgaagccgccgctgcgcctcctcctccttcttctcctccgccgccatcccccccttcaacccccccaaagccccccacgcctgcaccagcccccgtggcgccgggaggggccagcactggaggtccctcagctcctggcaaccgctcagaaactcgggtaaagatg

SEQ ID NO: 2155 - DNA, 703 bp, Nannochloropsis_gaditana
caaaaaaaacatggcccgaaggcttcgtgaagtgattcagcttccgttttgtttccacaataacgaagaactatgttcattttcattcatgaattctcacattaataagcaattcgttatggtcttgccgagtagagcaatcgccaaaaaattaggactccgggctaaggcgggccctgtcctccagttcgcaaccaagcccctgtgtcgatacgtgataattgcatgcgaaactcaatgcctctgtattatcgagcgtcattggggtaatttgtatcgtgtgcgatctgttccacacgttgcatcggcaggttttccactgggggccatcaacttgcccaaccctcactatggctgtcctcttttccttggtatatattttacgacacgagtcttagttgcttgtaccctcaactttgcaccaagggcaaagaaccagggtgttaaggtctcactttatggaagcatggattctagcaccgaaacgtgtgttctgaatgattgcatatgcatcagttcgagcaagcacagaattaaggagagagctcgtcgagacagcgcggcttcacacttcccgccggatatttcttctccattgttttataccaacacattatcattatcattatcaacgaacagtgaagagtcaactgtgccatcacaaggcgcggaggggctgacaaatggagaggtaagtacgatg

SEQ ID NO: 2156 - DNA, 703 bp, Nannochloropsis_gaditana
gggcagtgtcgtgcaaaggtgtctggttttgatttttgtagtcagacacgtacaagtcgtgaagtggagcaaggcgggaacagtaagcagaagagccgagtacaggggaggttgagttttgaaagaaggggcccaagggtttgctaatcgcacgagtattgcaatgcatcttcataccaaatataattcgatctttgccacttccatctacagaaaaaatgtagttatttcaattttgccccgttcttcatttgccttcggttggaccttttacgataaaatatgtcaccgcttgagttctccaacaatatttcaccatctaatttatcgcctttaagaaggtggcattatagcggtgattcagcatactgaacgctttaatgcacgttttctcaatgtgtctagtcttatttcctgttcgcctcctgggcccatgtgctcctgtaacggtcgccgccttcatcttcttccatttggtcataggggacatggtccgccacaggcacctggctttccattggatgatgcatcgggcttttggtgtttctcattatcgtttcactttgtcactatcagcctagtagcagaggaacgggtcttcaagcctgataacatcctcgtctttatcctgtgtcggacgcaggagcagtagccagcggtatatctccttcagccctttcatagcaccaccacctcaacaatg

SEQ ID NO: 2157 - DNA, 703 bp, Nannochloropsis_gaditana
tctcatttgtgctccccaaaaaaaacatggcccgaaggcttcgtgaagtgattcagcttccgttttgtttccacaataacgaagaactatgttcattttcattcatgaattctcacattaataagcaattcgttatggtcttgccgagtagagcaatcgccaaaaaaattaggactccgggctaaggcgggccctgtcctccagttcgcaaccaagcccctgtgtcgatacgtgataattgcatgcgaaactcaatgcctctgtattatcgagcgtcattggggtaatttgtatcgtgtgcgatctgttccacacgttgcatcggcaggttttccactgggggccatcaacttgcccaaccctcactatggctgtcctcttttccttggtatatattttacgacacgagtcttagttgcttgtaccctcaactttgcaccaagggcaaagaaccagggtgttaaggtctcactttatggaagcatggattctagcaccgaaacgtgtgttctgaatgattgcatatgcatcagttcgagcaagcacagaattaaggagagagctcgtcgagacagcgcggcttcacacttcccgccggatatttcttctccattgttttataccaacacattatcattatcattatcaacgaacagtgaagagtcaactgtgccatcacaaggcgcggaggggctgacaaatg

SEQ ID NO: 2158 - DNA, 703 bp, Nannochloropsis_gaditana
  misc_feature (414)..(569): n is a, c, g, or t
attctcccgcttctctctcgcctcacaaccgcctgttccatcagtccaggctgcactgaaaaaaggccatcgaatcctcttgcggtttcaccaacgagatggtgatgtgcagattctgcgcctcctggccaaggcccccgatccccaccttgggcagggcccgcctcgtcaatcgcagcattttcgagtcctccttctcctcttcccccccgctcggctggttaagcatgcgggcaacggccgcaaaggtgtcctgcagctcttccggagccaccaggttgaagaacgtcaagcgccccagttccgccttggtgtatcctgtggccatctcaaagcgcacattcgcgtcgatgaatcgcccctccaccgacgccacggccaagggggtgcttacctgcttgaaaagggagtggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtcgtcacggtacaagccccccttcaacccccccaaagccccccacgcctgcaccagcccccgtggcgccgggaggggccagcactggaggtccctcagctcctggcaaccgctcagaaactcgggtaaagatg

SEQ ID NO: 2159 - DNA, 703 bp, Nannochloropsis_gaditana
ggcagtgtcgtgcaaaggtgtctggttttgatttttgtagtcagacacgtacaagtcgtgaagtggagcaaggcgggaacagtaagcagaagagccgagtacagggggaggttgagttttgaaagaaggggcccaagggtttgctaatcgcacgagtattgcaatgcatcttcataccaaatataattcgatctttgccacttccatctacagaaaaaatgtagttatttcaattttgccccgttcttcatttgccttcggttggaccttttacgataaaatatgtcaccgcttgagttctccaacaatatttcaccatctaatttatcgcctttaagaaggtggcattatagcggtgattcagcatactgaacgctttaatgcacgttttctcaatgtgtctagtcttatttcctgttcgcctcctgggcccatgtgctcctgtaacggtcgccgccttcatcttcttccatttggtcataggggacatggtccgccacaggcacctggctttccattggatgatgcatcgggcttttggtgtttctcattatcgtttcactttgtcactatcagcctagtagcagaggaacgggtcttcaagcctgataacatcctcgtctttatcctgtgtcggacgcaggagcagtagccagcggtatatctccttcagccctttcatagcaccaccacctcaacaatg

SEQ ID NO: 2160 - DNA, 703 bp, Nannochloropsis_gaditana
cgtgttgtgtggaaatttaaggcgtgggcttccagggccaggacgtggtggagctacaggcgatgcccgaggctgaaaggcagggggcgagggaaatcgagaggggtaggaagggggcctgttccgtgcacggaagtgcccaaaattatatttgagagtttgaagaaaagagaaatgtcgcggagacaatccgatgctcttatcgctgcggaaatggtggtctggtagttttagcgtcagtatctgatgcaggtggtcgcgtgaagatatgaggaaagatggtatgtcgagacagctggtaagagggttcttggcagtgaggtactaaggaagtaatccttagtacctcactgtcactatccgagggagcagaagagacagcgttaggcgagttcgggatgggttgccgaaagggaaggatgacggaggttcaggatgagtggacggacgagttgctagggaatcgcctgacatcggtcgtctttgcgcaggatgcacgcaatggccgtgctcggattcgaaatgtgaaaggagcggtgtgaatggattctttgccaagagagacgaggcttggaattcgcctgtatgttgtgccagcttaccacggagggaaaaaagcgacccgccccgacgtggaaatgaaaactcggtggaaaatggttgaggagcaagcgtggttgcacatggcacgcttcccggctct

SEQ ID NO: 2161 - DNA, 703 bp, Nannochloropsis_gaditana
atctaaaagatgtgtactcccacgagtggccttcgacctgaggaagctctgcacacgatgcccaggaaaaccgtccaggtcttttaaaacctcgttatccctcgataccggccgcttaccttattcacaaccataatggaaagggaagccatcccgtacatgagcgccgagccacctttttgccatggcgaggcgcccacattgggggccatgacttttgaaaatggaaagaggaagtatggatcgctgcaccagttttaggaaacacgacagtacggatcaccgcagaaatgctcgaacctgctcaaaattcatgcatgaatatgtgtaaggcgccatgataaaaaggataacgacgccgtaagagattcgcagagccggcatgggcctgcgacctggcgcatagcaaaaagtggactggaggcaggaaaaatattgggggccaaggaggaggatttgcaaagaaccaatcctataggcaagctgagatgatgttgtgggaggagcatttttgtggtcacgcgtgtggagagagaaatggcggcacgttcacctggagctcccaggcgatggccctcccctcgctctagggggccgccagcgaacaagaacaaagcggaggcggccgaccacgctggtttctctcttgaacgcccctttcacacccatcatatcatccgttacagctttgtgactcgacatg

SEQ ID NO: 2162 - DNA, 703 bp, Nannochloropsis_gaditana
tgctgaaataaagactgaattaagcgctttgaagagtcaagtcggtgaaattgtcggctctaggttatccggtcttgggagcgccttcacggaaaaagcgggagatgtgctcataccttaccaaccgtttcttgaacaaactaagcgtcaacttggtgataaattctctgtggtgtcgcaatttgcagagcaggcaacacaagagctgagtaaggatgctgaaacactttcaccagctttgcgggcgctgaaaacggttggaactccccgaaatttgtttaacgcagaaaacattgttatattgcctttttgggctagcgtaattctggctccttcaaacacttttgttaagacccttgtgtcatcgtaccttcctgtattggtagcagcgcttgcctatacttggagcgcgtatttggcttttcaggaccctgcggcactggaaggttttgcttcgatctcggacttgagcgcactcagcaaaggactaggtactgaagctgggaccgctacagcctgggcacactttatcgcgcaagacttatttgtgggtcgatggatttttctggacggcatccgtaacggtgtatggacagctcattccctcacattagcttttctttttggacccactgggatcctctcgcaccttctgacccgctcttttgtcaaaatttttcgatgggatattgctgatattatg

SEQ ID NO: 2163 - DNA, 703 bp, Nannochloropsis_gaditana
ggcatcagctccttcactcttggcctggcgagctgcggcacgtgctattgcggcgaatccatttacttgagcctgaatttgagagcgctcaccttccgctcgtcgctccacctcgacaatttccttctgcaattttataagttcgtttgattgagtatctaagcgctcgcgtatttgttgtggggtgattcctcccagtatgcgacgagggtcctccggctcgaaaaagtcgctatcaggtccaaagttacgattccatgaatcaataatttgtgaatcggaatgatgtgagttttttttcacacaaaattgacaggaagagggtagtgatgcgaaagacgatatatatgccgcgtcgatgtctccatgcaggcctttactacgcggtcccctcgtatacatggcctgcattgtgggttaggctagttggtaagcacgaggaaagatacaacgacagccatgcttaagccaggcaggtttgtccacgatcaggttgcttcacactaagactgggatggtagatcacccgaacgctggatgtggtgacatctcaaggcccgcgcggcccaccttaaagcaacgggacggcttcgtggaacggctcccggaccgttgaatcggcgataacgaccggcaacttgtgctgcccgtgaaatccttccacaagacactgatttacaataccatctaggttggtgcgatg

SEQ ID NO: 2164 - DNA, 703 bp, Nannochloropsis_gaditana
tgaactcaaaagtgggtgagccaatgtcattcctgagtattgaaagcgatgatattagactagagatagatgtccggtcaaaggggcgatgcacacgaagatcaatggtttatagaatgataaaatacacaaactttaaggtcatatcttatatagtatacgacccaaaaagaggacgacttatggcgaatcgtcattttacacatccatcgctgctcatgttcctttcacgcagtaaggagacgaattgctatgcgtcgaggttcatgctgtcttattttttttctacaaaggagtaaaatgggccaagggtcttcgtatatcgaaaccggcaagcccatcaggccgaccaattcagtccaaggcggtgagtctgacatttcaggctcttcacacaacctaaccctgtctttctggtgcattgatgaccataggtctcgctgccaccgtctgcctgcgagcagtcatagcaatccatcgcctgttgaagagcaacctcccccccgatcgtagatgataggccagtcaccgccatcctggcctgcctctgattattttccagcttcaaccacaagggtcacagtgcccccaacgtcctatttaatgggaggttgagaagagaattgaaagcacactgaaatggtctccaccacttcaacgacatgcctcacatttttgtcgtgttgcatatcctccgcatatg

SEQ ID NO: 2165 - DNA, 703 bp, Nannochloropsis_gaditana
tataaatagagcttgcaacatcatactttttgacgttgaatggagtctttatttttgaaatcttcttcctaaaactactttctaaacattactcactttcgactttcatagatatagattcaacatcacttaggaagttcaaggccttcatacctctcagaagtgaccttaatttcggtgtgaggttgctttttatacgtaacagtgcacgcaacgctcgcgtgacctccctcgatttgaagaaggggggaaacaatgatcacaccaccagttctgacaggacagaattttgaacgacccaacttacttaagtcgcattatgtgcggccacttcatggtaaaatacaatgtcgagtagggtggggagaagggagtaatggtggcgtacactccggagacgtgagatgagcatgggcggctgatacccggaggacttcttgacgggcttgacgggggacggcatcaggcggcttgctcggagcatcagtgggacatggcttcactcactacatcagccagcgctttgtatgtactcaccccgaaatagttaggtcgtcctttcacctagtgcgaatacgagataaaatgtgcattgaagcaacacgcggcgttgatcttatatcgagaactctccaataataaccaaatctatcaaccgcaggcctggggcataatttgcccacttctgacaacaaacgacatg

SEQ ID NO: 2166 - DNA, 703 bp, Nannochloropsis_gaditana
gacggtcccagaggaaaaagtaaccaaaatttctccgccatgacacacatgcatcaaacatcattaattatttttttgttgaaccacaatgtgagctgacgtttgcccggcttttgacgaccgctttagtggctggctatttgtttatatagctagccttgagcacgttcaagatcgagcttgctcggacccgaataaaacaggagcttgctaagcgaccaccacaactactacgcctgaggaaaatcgaatgagtctagctgtgcgagattccaacttcagtattttcgttttgttttgttgaggccaatgccctcacgtgtgggttgccatggtacatcgccgactcttttgttccgcgagcgtgatatctcaccgtcggggggacgtgatatctctacgccgcagcaggcccagtgtctcaataggctgtgtccagcccgggaatgataccacgcttacatcaaatctcttccttcgggaagtcgctccggattcatactatgtagactcgtcatgcgccttcacgacgattctattcaactggaagaatcgcttgccgctactttccggactgtcgtgatagcaatgcaattcgtagattccttcgttgcaatgccctccttaagataatacaaatcttctttcagaaactttcaggtttaagcttgtagcgtggttcgtctattcagtggtaatcatg

SEQ ID NO: 2167 - DNA, 703 bp, Nannochloropsis_gaditana
caaaaaagcggaatgaccgtgccgaacgtggggtatgatgtgctggacaccagcggcacggctccccacaagaattctaggaattcaacgccgtaaaagaaggcgtcaaatgagaatgcacacaagcggaaaccttcatacagccgtacaggcaccgtgtcttgctcacacacagaggactgcctcgcactcgtgccgtcatgccgagaaaggatcgcgtcccctccctgtctgtagctagccaccaccagtctcacctgcacctcgtcctcgcagccaacgatgtctcactgcatgacccaattaagggacgaaacgaggttcaacgcctgcttaagaggagagctaggagggcgaggggagggtgatgcatggagccaaaggcaggcggtgaccggcgtcgcaatggaggcatgggtctcgaggacataagtgccaggactcgcccgccggcctcgctggatgcgcgcatggcaagatggcgaccccccttgtgtgcctggacgttttttgcgctcgtcatcccctcacatccgcacacaaaaaacacaggaagtaaaggacaacacactgtatatacgatagtaatttgtcgcgtcttcgtggcagctcacacgcccctgaactgcgccgcactccggcgtcgaaacggcccacacgacattccctcgaaaacccagccattcctactgacacaaacatg

SEQ ID NO: 2168 - DNA, 703 bp, Nannochloropsis_gaditana
tccgagcacgaccttgacaaactttcacttcatccgtcaatacgaccttattttttttcgaccaactcaatgcataatttctatcataagagtgatctttgagcttgaaagaaagtaagaggcaaggacataaaaaacgaacttgtaaagtgcaccgccgagcccagtccagtgatattttataactgtcaattgcttgcatcggcatgcaggctgtgataaagctatttcgaaaagcataccattcgtgtccgtttttgttttgtgccatcgtccgggtaaataaggtgacgtgcgaagccgtttgacaggggtggcgagaagcagggcgttccgccatcgattttgccctgcagcaattagacccttaagataagaattcttatacttgtgcttctgcccagtgcaggaccaaattctctcttggtacttgcctagccataggacggtttgaagggggattccagtggcactcgtgccgaaggtaatcaagatacccggatcactctggccccgagcaggatgaacaagtctaccattttcttttcagaatagcttatgcaattagccgacctgtttctcacacagtctacgaaacggaacaaaattaaggaaatactcatcaatccggaatcttggcccttgacagcacagactaacgtctttatcctctttacggcactgcaaacatccctctccgcag

SEQ ID NO: 2169 - DNA, 703 bp, Nannochloropsis_gaditana
ggcgagaatcacacgagggatgcacgctgaagcggggccgataagccacacacaaatcaaaccaatacactacatcgaaacattcaaagaagtaaagcgaaaagtcacacacattggctaggagtaagtatacgtgcttgacaggggtttcggtgccgggtaaacatgagatgagaagccgggcgtggacacgtactactcgtcgtttatccctcaggatgtgaaggccgggggattgcttgtggtgggagtgaggacaagtacgcgaatataacacttgtgatgccgtcgcccagaaaagctgtgatgtgatgaaaactgccgtggattttttggacgtgtgcaaaggtggaaagcaatttggcaggtcagcggcggtatttcgaggggcgggcgccgtaataggagagagtacgggcgcgagcggcagtgggtggtcgagcgatggcgaggcgagggggttcgtgtggatggacagagcaacaagcaaacgcatatcgttcccgagctcttgtgcatctcagctcgaaatacatagatcacacacgttgaatgtttgcggaaagtagatataggggggaggggggggttgttttgatagtgtcatccatccccgccgctactccaagctttcttcatgtttgtatcccatcaaatcctagactgatcagccacttctcttcacacagttttttccaggatg

SEQ ID NO: 2170 - DNA, 703 bp, Nannochloropsis_gaditana
tgatgcgatattacaaaaacaattttatcgatgccacgcgtcaagacgccttggacctgatgctcggccgcttcaggcccgacccagccctgccttccccttttctctacccgcctgcgacccaaggaaagctatcgtcttttatgaccaaagtgtttgtcattttggtggccgttttctcaatcgccatggtcctgaaacctgaggaggaggtgctgccccagttattcctcggctccctgctcatcacgttcctagtcctcatcctcatggcgcgacaccttgtaaccaaaggtggaaagattggcaaggaactcgtcgccaaacccagacttgtcccagagccctacatctacagcttttattcagcctgagcctgattgtgcgttcggggcaaaggggcagtaggaagcccttgagggaaaaaaggaggggaggttacagtccaagcaaggaagggatgacgaaaagcaagcgatgaaactgttttaagtgaaacatgtattttgaaagaaccaaggggaaaatgccgaaaaaagggtcgaaagtcttgaattggtctgcgtgtgatatgcattccttgttgtggccgccatgggtcgaggtagcggagagtgacctgtgatgtcttgtcgttcaaccccgcacccccccatctttccaattgctacccagccatgagagcgttactacagcagagatg

SEQ ID NO: 2171 - DNA, 703 bp, Nannochloropsis_gaditana
gacaaggagctagcaagatcttgtgtaccagcgggttgtctggcgtgagttacgtaagtatttcgtgtccaggtgacccagcttactggctcgccgagaaacatgccaaggcccgggggcttggcgaggggcggcggtgcttggcattttaaatgcgctacttttctgctcgcttttatcacattctgcgagggagacgccggtgcgtatccgagcccgtccccgccaactcactgagcccagcctccgccaatgttgtccgcccgtcgtgattgtgcacctgcgtcggattaccacagcttgaagcttttcatgtcatggactgtgtgtacctcggtgcatgacgcgggcgcgccgggtcgggaaaggagcaggctcctcctcctccgtagtgcgtcagcctcgagcctgctgcaatttctgtcttgcggggctcgaagggcttgttcccttcccttttcgtgtcggcgcccatggagagattgccttgctttgtctaaagagttgtacgcggtatctatgtgctgcattcgtaggctgtgccacccaattctatctatgctcacagctgtcatatttggaagaagagaagaaccacgatgactcggtcgcaatgcgcgcacgtgcgccccatcacgcaactccacacgcacgcctctaatgaactcgatatatccttaccgcacaacttgttacagatatg

SEQ ID NO: 2172 - DNA, 703 bp, Nannochloropsis_gaditana
ttgtctgcatggtcatgaatcgttttcgccccatattgtttctatttacatacctctctttttctccaatcacccaaaatgcagatgtggtgggtgaagagcatcaaaatccagaaggctcgctggaccgccagctggcatgtgacggtggcgggccgtgcggtggcgttccctggcaaaaaccggatatttcggatctctgcgactcagtgccagcgttttttcaatccgcattacatggacatatatctcatcatttactcatcaccgtgtgcgccgcgcgaaagttagtcgcgttccaccgtgtagacctccgggatcacgagctctcctccaagcccgggccggcagggcccaggaggcgaaattccgagacagcggacggactctgcctgctggcggagtgacgtctcccttgcttctgaaacgcggacaacatgatgaacgccccgcgtcaaaatttcaacctttttgcgctcttgagacgccaacattcaaattttaaacaatacttacgatatgttgcatgtatcttaccctctttatactcccacaggactcaattatctattttggactttaagagactcctctccagccgcgatcgacggaagttgcgaacagaaggcttgcaagtcgccggctgcctgcacctgtttgatcaatttgacgcacttccacccatcaatttctcaatagaatg

SEQ ID NO: 2173 - DNA, 703 bp, Nannochloropsis_gaditana
gttttcatttaaatcagtggtcgcctcgtatggcattgtttactaccaataaatctaaaaaaaaaagcacagtatgatccgtgaataactatggcaggaagtcgatgacatttgcgtgggtcatggagtgtgatcattacatgcaacttgcactcacgtgcagggactgcgtcagacgaagtgagaacaaacgtatcataaaagaggaagcattgagaccttttaacagcgtcattctgtcgaacttattcactccttatagaatatttgcttcaacactggacgacttgcctatcaatattaacggatccctcacggcctgggcgcgatagcaccacagagggggagcatttgagagcaaaaacaacaaaatctgtactattatgtctatattatccatatcatccatatcttatccatatcatccatatcaatcatattattcatacgaaaaagcacaaagaatgaagcttgatggctgtcaacgtgaggccgctttatccaaaagcgccgccttcgacctcccgacgttgccctgtcttggcgagagcgcgtttgaaagtgccgtctagacgaatgaggtcacgcagtctttccgttccaaaggacttccgctcacgctcttcatttacactggaatgctgcgtggaatggtttgatgctaatatcggcttctaactgccgcattcgccaacacttcaca

SEQ ID NO: 2174 - DNA, 703 bp, Nannochloropsis_gaditana
agtagccatgcaactcgctcaggcagtcaatcgtgctttcggctaagcaggtttgccctcccatatcagacatcaacatgcgtcggctaaactatttatcctccttcagaggtgacccaaacgctgcctcgctccgtctgatagctttttcaagtttctcaatctaccattcggttagagctcggcaagttttggcccctaagtttgcttgccgcttgcatttaaagtacttttatagtactgctccgacttcgagcaagccaacatttcaggatatgctgcggcactgagtgactccctcactttgcaatgataacttcgatgccaatgttatatgaagttgtaccaactcaaatgcgagaatgaattgttgccaggctgccatgaccttctgatgagattttcatattttcccactcatctgtaacaggcagccatatgtgtcaattgtcaggcaaggcccagcactgatacgtggtgcttaaaaaccgagggcatgcacgtaccgctgctccatggcaaacgagatggggcggaagttgccactaacctttacaatagaatcgatgagaaagtcgaccacagtgacactcaagaaggcgctgactgcattaatgctcaagtgccacgtcaaaacgatcgcggccttcgtatgctccaaaaggcgtcaagagaggttgtagcctttcttgtgctaatcatg

SEQ ID NO: 2175 - DNA, 703 bp, Nannochloropsis_gaditana
ccgttgcagcaattgaaattgccgattgaatcatccccagtctttccgggaggacgttactgaaaatataccttacactcgctcagcatgttatcggtcccatgaaaaccacccatcagccaatgaagatgatgactttctgaggccttggggtggacatgatgcagcaaggatcgccgagtggcgatctccggccgcggggaaagccgacaagccacgtttgcgtggaaagtacaccactaagatctttggatgtctgcaacgactattcccacttgtgcgctttgagcgaaatttcaatattcctcttgggcagctacatttctttccgtctttgtcagcgaaggggcaggttggtgcggtggtctgatttggatcggacagattggacacgagtgtctgaccagacctccccaccctacgctctgacacaagcccgtgtcgacccctgcaaggactctcatgcatggggtaaaggcaaaaagactgtgagcaattgatgaggcactgattcttggtcctcataaggaacttatcttaggtgttatttttatcaaaagcgaaaaattcataagtaaaatgcacgcagtaagtatgtgcttcgactgaaggatgcttgctcacttgatgattcatttatatatcacagacagaagtcaatcaaacttgtctgtgaacgatggacttcgtgaatcatccaatg

SEQ ID NO: 2176 - DNA, 703 bp, Nannochloropsis_gaditana
acaaagagctccgtaacgagggctacgccacgctttcaaatatattaggatggatttattttttggcctggacagtttcattttacccgcaaatttttctcaattggaggcaacggaatacagaaggactgtctcttggctttgagcttctcaacctcctagggtttctcttttacagcgtatatgcgctttctttcttcttgctcccacagattcaagaagcatacagaaaacgacataacggacacgagaacaaggtgacaattcaagacgtggtcttcgcatgtcatgctacaattcttactgctttgacagtcgcccaaatgcttcactatgatggcataagaatctatcggcgactctcgtggcctatcttaatggtcctgacaggattgctggtcattacttgtgtagctttagtggtagtaagtgcgagaggagatgggccctctgattggctgctttatttatataccatatccttcatgaagctatttgtaagtgtcatcaaaggcgtgccccaggcctttttaaattatcggcgtaagtccactgtaggatggtcgattcacaatgtactttgcgactttacaggtacgcaggaaattatggcgggttgaaaagttgacgtcaatcgtcgtcttcttgtaaagctttacaccgctcgtgatgacagcctatcccgttttgatgtattagtttg

SEQ ID NO: 2177 - DNA, 703 bp, Nannochloropsis_gaditana
gaaaatgtgaccatgcgaagagattacaatcattgtgggattccccacgagaatccgccagcccgggcatcaccgtgtcgctcttcgtctttcgagacctcgtccaggtggatcttacgcccgccgcccgccgtcgaagcctgtctttcacgaggtcttggaagctacgacccccctctaccccgaactccaggactcgaaggacaatgaaacgtgatttgcaccgagggcagacaagctcctcgtcaagaggtaatgctgcctgctgcgttatcgaggtggcagggcagggaccggaagacgctcgccaagcgggagcaatattgaggctgctttgcggtctttttgggtcccagtggaaactggtccatcgtctataagcgtgccaacctttcacgtacatttcgggtcggtcaatgtcactgactcttgtcctgtaccgcaccgtcgcggatgcaacagaccacctttgaccacctttccctagtgatgcaccatcacaaataggtgggacttcacttttactgatttctgccgcgcacaaatgctctggtccttaatcactcatatatttcatacacgaacagacttgccgcagatgatatgtctgttttgggagaggcagtgagggtgaacgattatttttttgtagtgggtatcgacacagactcgttgcccccgttgccctccgaagcccaagatg

SEQ ID NO: 2178 - DNA, 703 bp, Nannochloropsis_gaditana
tttttctcgccttcgaaacgctataccaacacccgatgagagtgaaaacgcggccaataattgccggacttcacattgcagtccttccggacagtggcatgtcagagtatgtaggcacagtacttgtaacagacagcaaacaaggaaggagatgcgcagggggcaacaatttgagagcgaggcggcagtaggaagaaacggcgcacttcactctcgtctggtcgtgcttgcaagttcgcgagctcttcacaaacacccgcttcacaaacgtccatgaaaacccgaagttgctctaaggcacaggggacctgcgctggacttgactttggggcggccaggaggtcgtccgagtctcgcgtgcgtgcgcgttctccctggtggccggatttagcatgtcgccgcctcgctctttcttcccagccctcccaaaccccaccgtgccccgtccttaatctcctcccggtctcaagcggatgttgtccggagctatcgatgcgtaccgatcataacttttacactccctgcccgtcatcgcaccttctgccctttatttcttcctaccaaaccagttcaattctatttttggggtgaatcccccttatccgctttcctcttgtccttttaatgccctgtctttgatcatcttagtcatattccaccctccgatcgcgcacatgctacagccgcttgtaaggaagatatg

SEQ ID NO: 2179 - DNA, 703 bp, Nannochloropsis_gaditana
cgccaggaagctcccaggcctcgctcgcccccgccactgacgcttcaacctttgggaagaacgcccgcgcggcgccttcgcggcctttccgcggagtgggtggcttttccatactcggcttaatcttacgccaatggttgcattgtagctgaaaggcttgcgctccgccatctttcgggcgaagtggcccgtgcacgtgaggcctgtcaccttgctcgtcacgcggaacctcggagcgggcatttgtgcgcttcatgttaataaaaatcaattaaaataaccggattccgtctctactatgtatggtcttgatctctttgatgagaaaggctctcgtagatcgacttgtgatatcatgacctaccatgatgtccaggcttcgactcccatgtcttatgaccatgccatcaacctcccgtgtgagagttattctggatgctatgtaaatagatttgccagggtcttcctttgaaagattaccatttctgacaccacttagtatggtctttgaagaagatagttcatgcagaagtagatagttttaggctctgtgacggatctacttgaggacgtgtggtagctttctccgtcctgtcctggctggaaatggttctgtgtcccttccgtggaggcaacaatcaaacaaaagagtaaccgggtcctccttccgtatttcattgctcaattataatagctcatcatg

SEQ ID NO: 2180 - DNA, 703 bp, Nannochloropsis_gaditana
gttcttacgcagcacatgagctacgtcaccaaactgaatgggggtaccaggctcccctctcttcatgattggcagcttccaaacgaaatcccaaactgccttgccgaaggggttcccctcgaagacctccatacgagtagtccccgcacctcgcctgctcctcgtaccgggcaaagtagatggcctgaaaggagatcgagttgcgccgccgatgaaggcttgttccactttcattccactgccacatgcgctgatagtctttgtagcctgaagaagtacaagcgtagctatttgtcccaggcataggcggcgcatggctagagcatatacatgtgttggactgaacgtgagaaaggaccttcgttggatgtgacacagggactttaaaatgtcgaattttggacaagaagtgtgccattcacaagtaaaggcaacaaaatcgaggtcctgcagggagtaattctcagtcggagacgagccccacggcgccgccttatcctaggcgcttcaactagctatcattcctccaccgtccaacccgccctcccatccgtcaactccgccatttgcgaacgccagatgccaagcccgcgcaagctttcttttctcacgagaaactgatgcatttcttccccatgcgtactcgcatagcagtatctcccaccttacagccctcgaccgacttgcactgctttgaatcatg

SEQ ID NO: 2181 - DNA, 703 bp, Nannochloropsis_gaditana
cactgtcagccgaagcagcgtcacaaaaaaggccacgaagccgagatacagccaccaaaagtgtgggtatcgtagccattctacatttttgttgtatagggatgctggccggtctccgtcaaagtacattcccgagtataaaccgttgccactgtcgcggacacccctagggagccgagcaaaaaaagaaagatatcgcaccataagtctcgcttccagcatggccgcacaagtaatgcatataatatacattcatgtatgacagccgcaatagcacaacggatccttagtcctagccgttctcatgacaacttcttcctctctcttaatactcacattttaacgattacaagcctaggactgcggccgtgaaaatggctgcgagcgagttttccgccaacaaacggccctgtttgttgatttcgaaacgaacgacatcgtacgggagggtgttgtgaagagcgagggtcgcgtgcgagggggggcgatggaaagttccggctgagggatggaagcgctgcagcgtctccgagagggttccgacccgccggggcctcgagctcctcagagcaagccacatccttctcacccgcctgtatcgccacacttttcttccgtattcccgcataccttctccatagaaaatggataacattaaagcggtcccggtttgattgaatgctgggctggtagtgcataaatg

SEQ ID NO: 2182 - DNA, 703 bp, Nannochloropsis_gaditana
  misc_feature (1)..(668): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaccagggaggtaaattgccaggcactttacatg

SEQ ID NO: 2183 - DNA, 703 bp, Nannochloropsis_gaditana
cacaattctcggtcttacgttgtcacatccgaactttcgatcctttccattggtcacaattgcgaggttgtagttgttgtatgttccagtgaagcagtgaaagggtgctgcgtgtccaaaataattggactgctgggtcaaacctaatttcgtgatgagcggcatggcctcgcctgtgtttccgaatgtgatgaacaaaatgaaattgaatgctaatgcgcaacacttactgaagaccgtattgtctacgcaagctatgaaaaaaataaatagatgttgatcgaaaaacttgggcatagcgcgtgtaggagttttgcaaacacgacctcccccccccttaatggctgacggataccggcctccggcttcactttaccttccatggcaatggttatgacgattgacttgatacctttcataattacttgcggagatggtgacgcgctccggaaaggggacgacgagtcctgtgtgcgtgtggagtacctgagtgccatgtacctgcgctcgctgagccttctagcgaggaagacaggcgtgcgagggttggcggcactcccaatgccacatgttcgtgacgatagcggcggtgcataagcgttcaaagtctttgtgaggtagagcgagcacacttatgtgtaatgcacatccaagcacaggtgcagtggccgggttgagagccgctctatcggtacgctccatg

SEQ ID NO: 2184 - DNA, 703 bp, Nannochloropsis_gaditana
attgtcgggcgcgggaggtaccatgtgacgacaaagctgctccatgagttgaacgacttccacgtcccggtttcccgatggggtcggtacgacatgcgtggaagacggcggaggtgaattcgtttgatgtccgttcgatttcacgaaagaggaagtcgtcgtcgcggcggaagaggaagaggacacgtccatcatagcgcctcggttcgatggcaggagtctccacggacgacgaatgacacgctaccctagcccaccgtcgtcagatgaccaaaatacacagtcctgtaacaggtaaagggaaaagagggcaggatggggtgtaagtagggagttggaaaacggagacttggcgaagaggaagaacatggtgcctcacgttctccctttcgcttgaaccggctgtgccgccctagtcctcaaattccgccccctgtgcgccattctcgtggaaatcaggtgccttggagtatattaggcataatacatgatgatgcatgcatggcatgcctcatttgtattgttggtgctgagcgtgcggcattggcggccttgcttagtacctccctctgctggtttcaatcaacagactgcagctctttctggcagcattttttccccactatctgtgctgccgctcattgaatatcagctcactcaaatcaattacataataggcttcttaaatcgttggcgtgtcatg

SEQ ID NO: 2185 - DNA, 703 bp, Nannochloropsis_gaditana
accgtggaactacccattccacaacctgtacaaccacgtcatctccggcctctttgccggcaacgccgtcgtgtccaaggtctcagaatacacgtcctggtcctcgtccgggtacttctccgacataatccgttccgccctggtacaatgcgggcattcgcctgatctggtggcggtcgtgaccggattgggggaggcgggcgcggccctggtggcctgccccgacgtggacaaaatcatcttcacaggcagccccgggatagggaagaaggtaatggagggggcggcgcctcacttgaagcccgtgatcttggaactgggcgggaaggaccccatggtcgtgatggaagacgcggacattgagggcctggtgcccatggccatgaagggggccttttttaattgcggtcagaattgttgcggggtggagaggttttacgtgtacgaatccgtgcacgaccgcttcgtggccgaggtggtgaaacgcgtggctgccctacgacagggacctcccttgtcgggggcagaaagggtggattgcggcgcgctggtcatgccccgacaagtcgagatcatccagggcctggtcgatcaggccgcggacgagggggcgaaggtcgtggtgggggggaaaccccacccggggttcccgaaagggaatttcttccaacccactgtgctcgtgaacgtgacgaacgagatg

SEQ ID NO: 2186 - DNA, 703 bp, Nannochloropsis_gaditana
tcctaagagtttggagctcatcaagatgtgaaatgaaacctcgctgcctgagcagacaatctacggcaacatggattgctgtttcttcttcttgaaaaaccgaccgttgcatcttgaaaagtggcaaggcgtattgccaagggctgcagggaaactaatggcagggggggaggaggttgttggctcgacaaaagaggtggctaggcaacaagaagtatcaccccctcttcccaaaaacaaccaaaaaagcccggaaaatattcattctttcaacctatccgattgacaaaaccatgctacgggaagcgcggtgttgcgtatgcccgggggccgtagcccgtgtgcccgatttaacgctccgacttccgcgatctgcccgtcattgccctaaaggatgacggctgcttaagtgggctcgcggcaggcccacctagagccaaaaatggacatgcagccggcattggggacccattagggcatgggatggaagaagggggagataaggcggcaggagggttgtcacggcgtgttgatttcgtttttgaagtggcgcgatggaggcaatttgaagacagtgctgccatcatcgggagtagggtatcttgatggcttgatcggtccaaatgcgtgcggcacccgagtcattcaccacgtacacgcgtatggacacaggcgattctgcaatcacagtaagatcacgatg

SEQ ID NO: 2187 - DNA, 703 bp, Nannochloropsis_gaditana
ttagggtaaaggataaaattgctgggggtggcacgagagcagagaagcggaaggatcacatgataaagttcaatgttcggacaacaatttaagaagagggtggagtcgcaacgtagcatgtcaccgcgtcaatcttaccagtttgggcagaatttcatggtttttggacgctccggaggaaagcccctgcccgcctcgcacctgacagcccgcgggacctgaaagcaaacagcgtgtagggtgatcgcggggatgagaaaagctttcgctgtgatcgtgtagatggtaacacgtggtttggcatgaacatgtaggagcatggccggagacgatggtacgggaggaaataaggggaaaacattggggtagagccaggctcggagagactgtagaggggaggtaaatgggatgggctgcagcgcgcccgaacgccatgcttgcgttctgtcgacccttttctcacgtgggaccgacgcgcgtaggttagaatgtttttatttgcaaatggacggccactggctttgtaaaggctatggtttagcaaggctgccagacctggctttgagcatgtagtttactgcctcctcccctctgccatcttgtcacccaatcgggatggcatttaccgtctgatttaaaccatttaaattttattttctcctttaaaccaccactagagtaattttcgacgtgtacaagcatg

SEQ ID NO: 2188 - DNA, 703 bp, Nannochloropsis_gaditana
tttgcgcgcctgggggtgaccggcccggcagaccctcaaccgttacgccgctttctgcgtttctttccatgtcccccgcgcccgctgttcagcgcgcccgtgtccgggcattgtgcaccggcaacgaccgtctcacgtatttgaaagtcgtcgtggtttgaaatgggtgtgaatgagtgtcttcgtgagtgattttgggtccgaatggcgtcgtggctcgcgctagtcgtggaagagggtttaaacccagtgggcccgccatgacatgctcgacgcacccatgatcctcaacatcgcatggccattcctccggatctctttttgtcgagacttggaccatgcaacatgctttcatgtatttttttacgggaagtgcctttgcggagttctacttttcagcggttcttaatgacttaactcagcctggggccatcaggaggagggtagatgaaatacatgcaacttccatactgaagctgttgtgcttcacatgctcagcgcaattcgacaaagctttttcgccctttattgcacgatttggtcgtttgtggcagctcttttttccttccgtcctattcgcatgtcaagctggggaacagaccgtttctctcccttcatcgtccctcactcaactcctttctttcttttgcgcacacacgtcatagagcctgtcagctgaaatctttgttgtcctgttgttatg

SEQ ID NO: 2189 - DNA, 703 bp, Nannochloropsis_gaditana
tcacgcgaggtccgccgtgcctccaggaagatgtcaggcgccaggactcggcaggtcgtacacccggtgcagctgtccaggatggccacgctcccaaaatgttgcgtgtctgacacgagtggcattgcaacgatgtcctccacatcgcgtacaacagctggacaaggtgaaggtggaagggaacccctcatgacttcaggcttaggcaggaggttgcgaaaggatgtctactaagccataggacgcgcaaataaccctgcgaaaaccacgagtgcggttttcggaggaaaatgagtaagagacaccatgtccacaagccaaacaagcagggatccaaccttctagtacccaatgtggtgttccggggagggaggcaatcactccccgcccccccgcctctacagcgaccgtcggggcatttaatgtcaccgaatgtttgagagagcccccacatagacacatcctgcccactccctttttccggggtcgtgtccggaccacgcttcccatgcgtgtcggatcatgtcgatagtgcaattagacgcgtcagtggtgcgtgtgaacggtgggattttggtcagggtgtgtagcgggtctgtttcacatgaaactcgggcgtgcctcatgaccaagcgaaaagcgcgctccctccatttccatatattcactcacatgcaccgtacaacccgctccaggggcgatg

SEQ ID NO: 2190 - DNA, 703 bp, Nannochloropsis_gaditana
gggggagggagtgggaggagggatgggggagggttccgagggtagtggaggggagtgggagggttccagggggcgtgcacgatgacggagcgcggtcgcagcacctctacgggggcctcaatggaaagtcgaaggtcgtacgcttgagcgcgtccaaatttcctgacgcaaaggccaagtttgtttggtttatcgagttctactctgtcaactgcccgcactgccagaacgcggttcccgccgtggaggcggtggccgggaagctcgaggggatcgtcaaggtcgggggcgtgagctgcgacgcggacaattcgctctgcgccaagcacggggtccagagcctgccctctttcaagctcatcctggagggcaaagcgatcgactacgaggggtccgtggagacgaagtccatgctcgacttcgtcacagagaactacccggcgcccatcgcgaacattcggcggacggcggccgcctcggatttcttcaaggctgtggtggctgggaagaaggcaggggccatggtcctgttcacggacgagtacgaaacgcctctcctctacaaagggctcgcttaccagctgagggacaagctcgcctttggggaggtgcgggcttccaacttgcaggtctcggaccacttcggcgtcggcaagtaccccacgctgctctttttctgcggaggagaggaggcaagcgcggt

SEQ ID NO: 2191 - DNA, 703 bp, Nannochloropsis_gaditana
ttgaaatcaaccccaatggtggactgctgatggtcgtcgaacgcgtcatcggtaaatctcagcaaaatgcttgggtgtgagtattataaaaaatgagacagacagaagatttttctgaaaagatacatgctgcattggaatagatgctgagacgcttttgcctccttgacctgtaggggcgcacatcgaacactgccagtcatgggattccgctgcctaccttgatttccccacgcccgcgtctcctatcagcaagagcttgaagaggtgatcatacggctcaggctcacgcaccgccatgcttttcagataacgacgactgcttgatttttggttgtactcgaattggagcaaaggtgacgaggcgaagagatgcacgttctcgtaggatgaaaagaaccgcacaacctttcatataaaacatggcgattggttaggaagggcctacaatccctacattttggcaaataacacacatctcgggcaacgaatacggggctttgacagcggtgggatcgcacatacgaggaagggagtcaatacaactattctgagagggccgtcacccgaggggttgctttccatcacacgctgcgcccccaagttcgtagttaggtgccccatctcatgccgtcccgtcgcactctcacctgcagcacacgcccccacgcacagggagacgtcctgcgctactgagtaaatg

SEQ ID NO: 2192 - DNA, 703 bp, Nannochloropsis_gaditana
gaagcggagctctgcgcagccggggacggaggaatcgtatacacagcaggcggcggcacagaggaggttgcattgatgcttgtgttaccactcggaccgcccgccgctaacacattcgccttggtaggcggtactaggacaggcggtgttccagcggtagtgggtttgtgcatttgtgcagacaaactgctacgaggcggctggatctcctggatctatccacgacgtccagacctggtccgtgctgcactggaatacgaatgaagaccggcgcagtcaacctgttcgttacaattcatggaaaagtcaccactcgtgggtcaaggacgtggtaccacaattgcgtcaggcatgtcctgtaagcgcgatagagcaatataatcgccttcttccgccgccgccggcgcagggcccgatgccctcgcaagtagggaaaatgcttttattccaacctcgttcccaggaagagattgtgggcaaagcatgtatgggctacattgagaaccatagcatgcgcttaaagggcgcgggagctggcatgtctgtgaaccatgtctagatggggcgaagcctcctaccccacccgtcctctctcatgctctcgcacccctcctccaggctcttgagtatcatgactacctctttagcggacatgattctcggtaacaggaagcgtacctgcgacctatacacagcagaaatg

SEQ ID NO: 2193 - DNA, 703 bp, Nannochloropsis_gaditana
agcttctgtgccacaattggggtgcactgtacctgacacgctcgcttttcatagtcgaggatgacaagggtgcacttgcatcaatctgctccgcaggtcttgagcatggatggcttcttatcccactacatgactcctcctcttgcgacccttctgcaaagcaatcttggcttctcgacacctgagccttcgcagctcgcgaggagaatccatcgtgattgaccgaggacgtgggtatcgaaggctcgtccatgaggggttcatgttcattcttccagcattaataagcacccatgctcgcccagtagaactgaagaggtgatgcggtcgaagacatgaggcttccctcgctcggatggagcacaaagtaagtcctgagtctaccgggagggattttatgtgtgcagacacgttcgtggtagagtagggagcaacgttgtcgtcgaagcggtgcgatgtgtgtctgtgataggtttagggcttgggtcacttgtgcctcaaaggaaggtaacatatgatcgccaagcatgaagagggcgagctcctgctggcatgtaaaaaaacaaaacaaaacaacttcccaatcagaaggaagacactcactttacaacaatttgcattgctacagtccgatttaattgtgcatctcgtaaagagaagaactgaattcttgaggagcgccagaagagacaaacgaaccatg

SEQ ID NO: 2194 - DNA, 703 bp, Nannochloropsis_gaditana
gccaccggatacgctcccatggtggagtacaggtcctcgtccagccaatcgacgcacttagcgtgacgaatgttaaagatataccattacagtttatcatcggtaaactatcacgcattgtatccactacgaagtaggctggtgcgctttacaagcatttttcgagacagccaactttttgaggagggagaagacacctcaaaattgagctcagtatatttcttcaaaatacaagctttagccaaaaacaggtatagagtcgtctttcatagcgccacactctacgtgagtagaaaattcatttaaaactggccaataaaagtagatctggctaaaaatcggatcaatattgatgtggacgaagaaaaactccgcgaaagagccaaagagctcggttgaaaggcgtccgagctttgctcgcgtaaccttttgcacggacaatgcgcaccacgctcgacaaaccacaaatttgtcctttgcagcgcgtggaatattaaagaacttgttgtctgcaggcgaatgaaaatataaagacgctatcaggctttttgcatgctgttagggtgatgagcctcatgaacttggcgtcccgtgagggacagggaatcggatacatttcttgtatgaaatgtcctgtggcgaagaaggctcgtacctcacgtatacatagctcacatcacctctttaattttaacttggtcag

SEQ ID NO: 2195 - DNA, 703 bp, Nannochloropsis_gaditana
tgttgaggagcttttgcgactggctagtggcgtagatgagaagtgggtggggggaagaacagaggaggaccagcggagaggaagggcaagcgacaatgaaggacgaagggtcagacatgagagcgaacgggataccgacatggatgagggggaggcgcgaaaggaaagagtagatgcgaggagagaaggcacaatgtttcctgaaagccgcgaggccttcgaagaagaaagagagggacttgaagcgagcaacatttggggttatgactcaggaggcgccgtcgaagcgtccgatcaagagagccagccttgccagcggaaggccaaagaggcccttgcgctcttatggatgcaaaccgggactcgaagtcacagagccaaccacgtcttgcggcagctcggcttcacccaccgcttggcctcccgcgtcctggcctaccctccctctcaatcgctagaggcctcagatcccgcccccctctctccttccgctggcagctttctccgcgtatacgaccatgtactgcctcccgctgccttgctagcaatgcagcgactcttcggcccacgcgcccctttctgggaggagcacggctactttcggcgcgacagagggtacttttcctacctcctccccttgtccttgaagagtgtgggcgacccgacgtcatcctcatcgtcctcccctctgcccccgagtatg

SEQ ID NO: 2196 - DNA, 703 bp, Nannochloropsis_gaditana
ttctttccatttgacagacaagaatacttggttcatccacgctcaagcactaaaaattgcttggtagcttctcttttccctgctttgcgcttgtcgaaatgctgcacttacagcctggcttcaagtagtctggaaacccacatgtgaagcatgccatccatatcaaggattcagaggggcttgtatcagaaccgaaatctcgccccccactgaaaggtgtccgtgaaaagctctttcttatgcgttcgagcacccaagcgccaacagggaggaggtcctctctgcctcgcttgtcgctgccggcgatgccgaccagaaaaccactccaccaccctaccacacctatcacagacggacacccgccgtgtgctcgtgctcgtcagcatccctgtgaatggcaggtttggatggtagtcggcatgattttttctggggttctcccacaatggggtcttcagcccctcttgagctgtaaagtatcctccagtcccccggaccatacctcctatgttttctgcacgcgttcgtccactgtttttaaaaaggctttcgaggacaaggtcattcgcatggcaagccttcgcgatgaatcttctctgcctctccaatcatttgaatgtaccgctgcgctattgaagaagcataaggattttacccgagtcttcctttccttctatactccgtcacgatatgtccagttatg

SEQ ID NO: 2197 - DNA, 703 bp, Nannochloropsis_gaditana
aggaaaaagaaaatcctgctagggcacggagcttgctgtgtggctgtgagagtagaggggtcagtaggagacccagactgtgcaattgctggtacgcgttggcccgagaccagacctcatggggggaggccgtagtcgatgcaggagggatctgtgccttttcgagctctttcaagcgagatgcaagcccatgggcgccgtatgcctatgttcgtgttgttcaggtacaaaaggagccgtcaggttgacgacggaagtacaaaattgaacttcccgtttgtcacaacctcccctccctcaaacctatttctgggataaaatgccgttccgatgcatcgatacccacacactctcaagtacaccatgcacagccccccatctcacccctaggcccacagatgtggccatcgaaatccctcctagagcctgaaagaccatgtgtcccacctatgtgtgtgtctgaggcatttcaggttgggctgggagtcgtcagctgggctcgctgggagtcgtgagggtacacctccgagaactttgttccgcgccgagatttacttatgttccactgccccacgattagtcgtttcgtcttcatatttcaaaaggttgtgctacgattgcgccctccaagccctcttttcgcgcacatcctcttcccacggctgggcgccttctcggcctagccatcatcctggttgtcatg

SEQ ID NO: 2198 - DNA, 703 bp, Nannochloropsis_gaditana
agggaaatgaaagccccattggcgcctcacctgaagatctggacgatcggaacgacgtcaagagaaaagactccagtctgacagagacggcggctcctcaacctctgtatgtgagcaccggcgatgaattatgtacctccaaggagttcaccgaccgcatcaaggtagatcctcaaaacctccgtcctaggccatctttcaatgcaaaaagcgctctttttccacccccttcattggccataaacgcatctattccctccgcttgcacgagcaagatgcgacgccacaacaagcaggcaatgtctgcccctgtgcaatcaaatttcacacgtggtcgccttgccttttcgccgctccaacctgccatccaattgcccttccagcctactgcgacattcggaaatcttgcagtgaaaagtgatcagcaggacggtttgaaaccccgtgaatctggagaagatgcgggtatatcctcgccgactacctttaagattgaagacaggcaaatcaaacttcctcccggttcacccatttctaagactctaacctccccctccaccgatgtcctacatttcatggccagttctggacatgtcagagatcggaaattgccggctgtggggtcgcaggtacgcatggctcttaatgagaacgcagcgcaagccgcctcgcaaacatgcccatacatcgtatcattctacga

SEQ ID NO: 2199 - DNA, 703 bp, Nannochloropsis_gaditana
ttgcggacgcgttaaacgctcgggatcattgcatcatttgcgtacagggacgcactgtaaggtgagctgtgaccgccctgtggagatttgttgcacaaagataaactattgttgccaaggtctagaatgaggtgcgaggctcccagccatcgcaactcgctgagcagcccggaaacggcacgtgacgagagacttgaagcccggcgacctctctgtaatgcgctcttttttgggacgcttttctaatatctttccgcaccctatccgactccaccatcccacagcgtctgacacccacctggaaccaccaagcaaagcgaccggggttccctggttgatgccacctcctccttttcttcgacctcctacctttttaccggcgctgtctcattccacaaaacggggggtttcccttcgattcttgcctctcgctattacagcctttacgacgttttttggttctatgtcgtgtaaaagcggtagcagcggacgtggcgctgcattatctgatgggcggggccaaggtgtcgcggccgctagcattcataacgcagccagttattctcagtcggatgccggtggaagctcctctcctatcgcgcccggtagagctttgtgcctcaatcactctgccggatctgacataggcactatcaagcgtttgattcccgcgcttacgcacacagctcggaaaggacagatg

SEQ ID NO: 2200 - DNA, 703 bp, Nannochloropsis_gaditana
ttgagtcggtggtaatacttaatggaagttcttaatggggagagcacagataatgcaacatgtgaattttaaagtttcgtaatcgcagataaggtgtgacctcataggttcatgcctcagcaatctgatgactttctttaagcctttgcagagaggtcgttattttttaacgcttgttctttgaatcttccttatactttattgatatccaaaaattgaggacctcgaccttgacaggaggggttatgttgcttatcactttggtgaccaggccagcaacggccaggaagcggtttctcaatttgaattcaaatgtgaacggacgcttcaaaaccatctctttcgaaaagcaaagatcgcgaagtgcctcccgctccaaggtcggtttttggaacttttctcaccagaaaatgaagaaaaatttgttccgtcaccaagaatttgtgttctcagggtttgcataactgtttgtcgatgagtaagccatgatgtcactggtgtcacagcagcgtttctttttgtacgtcttccacacgattttgggtgacgctgtatcaactcgacatcatgatgtctttttaatgcattgatatatctatatgtgcataagcatgctatgtgtatctgcaagatatttttaccttaataggagcaccccacatctcgaaactagaccacggtcatcaagaaacttagaaatatg

SEQ ID NO: 2201 - DNA, 703 bp, Nannochloropsis_gaditana
tttgcgtccttcgtgacctctgaggttccggtcgtcggccgcagggcgggtgtttgtgtccggcgtttccaagcgttcgagctgccacacggccagacctgcatggggtgaggaatgggagaaaataccacgggactggaccgtcggaatgcttgcacgcaccccgtgccttgtccatatgcacagagatctgctgcttgtgaacgcgtgagatgccctacaatcttctcggaggaaattcgcacgtttctaccataagcaaaggagtgcatggggacttatgatggctgctatggcgctcttgttttccttggtcaaagtattcggcgcgacgcgagccaaatcagaccaggcccaactagcttatattgccaagatcatttgcaataaaatatgctaatttgagacccctcaaaacgaccagcaggtctcaacaacgcatcgtttttaacaaacagggcatgatcaaggcctccgacccggcagtcaccacgggctaatttacccactgcttacctgaagacctgtgtgggaacgatgcagcggggtcatccctcgggcggcgggccaggtggtgttggggactttattggggctgggggacccggcggtctggacactgacgtgtacagacaactgatgcaagagatgcacggagatggaagtcggcagcagctgcagccgcagcggcagtatcagcatg

SEQ ID NO: 2202 - DNA, 703 bp, Nannochloropsis_gaditana
ttccactctctttccctctggcttgtacttgtgaagcgtagacgcagttcggtggtgtaaattctataattgtgtgtcatcaaccatagaaagtggttgtgtttcatggactgcaaagaaggcgtcttggcgttggccctacctttcacgattttcaccttatctcttcaatttccaaccctggacataatcaatttagatgctttcgtcctgcacgtgggcgagtgacgttggctatgtacaggtttcatgtgaaagcaagaaagagtacatgcatggacgtgcgcgtaagacgcgcgtccgagcgcttggacggcgtgatgcgccccaatacgagacagctttgcgcctgctccttgcggtagctcaacccgcctacgccacgtcgtcacacgcgctaaactcgctctcttcatcgtgtccgatcatgaccaacctcccctactcggatactgtccaaaattgtgaaagtacggcggcatggttggaaggccgtcctgggcttgatccagcggaagggcacctatgcaatcaagaacgcgctcgcaggaagcgacagcaagtcgcgaacttggtacaagcatgtcatacgtatataaaatatctcctggcaacgtgggaacgaaactcaaccggcaagccaataagggtcatcgaattttgttgcggcagcggccatgtggcgcttcctttggctgccatg

SEQ ID NO: 2203 - DNA, 703 bp, Nannochloropsis_gaditana
ctcggcacgacgaaatgaatggacatgaagtagtgatgggagggggggggggatgattgcagcgagcgggggaggtccccgaaaaggaggtcttttaggaatgggagatagggataaagttcattagtgtaaagcgcgtaaaacggatgcaggacaaccgcgtgtaaacctttaagcatgattgtacaggaaatgcaagcaaattgacaaccaaatatttgtagcaggggagagtaatacatgggccggtgggcctggcgatgtctggttttccttgacatccggttctgcagcctttatgctaagcaacggatgtcttcaaaaacgccgtcgtcgtaattgtaccatttgcttgccaaggtgtatcatcgtcgctgtcgaggagcattctcgcgatatgatagggcgcacaagggaagtcttgtctccccatgcatgtcgctcgcccatgcttagtaaggccgaccccactctgaataccacgacattcactccttcatacattgcctttcaaatgccaaacttctccatgccgtctctcactttcccacttgcattgtcattacaggtctgcggcttgtccgcgggtgggaagcgcttcgactcgccccgtgtggtctttcccgagccctccgagacaggtctaaggagtgcccttccttccagttcaattgcaaacaaccgtccagaccagccgtcattc

SEQ ID NO: 2204 - DNA, 703 bp, Nannochloropsis_gaditana
acctgagggaaggacgtggcggtgggggtaggaggcgcgaatgtcaccccaggggagaggccgaccccgtggagggcctcggaccaccactcgtacgcaggtagggcttggtgcggtatgcctggcgctgcattcacgagaagggagatctggtgacgagtgccaagcggagatagatgatcaagcgaaaaatcacaataaacgtgcttgaattcttttccctgtgtagccctttcaaatgaaatatatgtacaagtccagccctcctcaccttttcctcctgcgtcaggcgagcgagtaggtcttccacgcgctcgtctattgacaaggacatattgcagtaggcggcgtcggcaaatgaaccagcagagtcgcagacgtgggctcggtcgatagaattaaaggggcggaacattggatcagaggtcacctcgcgagcctttgcgggacttatgacggcaaggacgcagtggaagagaagcaagcgaccgccgcaacgcagccgttggcgccgttcatccatggccggcatccctgcagtgacggtggtgcatatgttcaagtgaacttggaaaccggaagtcaacttgtccagagagggggagtgggcgacacagcagcgagtcatcgggttccacccacgatcccctcctcacgcgcagtcacacattcgacacgttttaaccttcctcacagcatcatg

SEQ ID NO: 2205 - DNA, 703 bp, Nannochloropsis_gaditana
agagagcaaagttgttgtctttgtatcctgcataccccaagcatgatttaaagacacttccaatagaaggaaggttacaattgcacgatatgccatctatgtaagtttacggtcgagccacttttatatgtccctgcttcgacgcgcacgatgtgcttcctcggatcagagcctgtaaatcaggtcaagaaagtggatgttacccaattcgttgacacagtcggtcaagttagggacggcgaagatgtaggacaaaatgtctgtacaatctttcgtttacttgaagaataccgccttacgcgccttccatgagggaagacaaccataaatgcataacgaaccgacacgtcgcgggggggacgaaacggctggaagcagagcaacgacaacttgagtttttgaactcggaaattccgcgaagctccgaggtctgaagggaaaaggtgcttgttccccacgcccgtgttgaccgcccctcttttcaaatcttcacgcagcaaaatgctaagctttctaataggcataagaccgtatatgagcagaagggacttcacggtcatcgccttcacctttgcatgtgtgactgttttgctcgattctcatgagctccaaagcgcaacagaggcatcgagggccaaactcaacattgcccaacaagtggaccatgatacaccaccaaatattatatatatacttgcagatg

SEQ ID NO: 2206 - DNA, 703 bp, Nannochloropsis_gaditana
gcctttcgcgccttggcttttccttcttttctttgatcctttgcagcttgaatcgccatcttcttctttacagcatcagacaaggcaacaaaatccgcgctgttggtctggaatgtctcaggagggctgttagaggaaccattaatagcgccttcagccccgcttttacggtcttctgcatcattgctacccttctttacgccctttactggctttgctaggcgggaatcaacttctttcttttgtccagttttttctttccccccccctgcatccaatgaggtgtcctttggcttttttgctttgagggccatgtctgtttacgtgttgacaagatactcaatgagtggttggcaaaaagaaccgccacagcgggcaagtcgccacgacagcctctttgctacaaggcaccgcatcgtaaaagaacgtagcactcttgtaaaacaaaacaacgcacgattcaaaggaccgagggctacctctctacccggctccgccacccatctttgccccgaggcgacgagctcgctgcgagggacttccagggggcaggaggttatctcatctaatttcctagtctttcctttatggagacagggtctctccatggtgacgctagttggcctcattattactacgtagctatacacctgggaggaggcaattttacacgctcttcatttgcccattgcgtggtatcatg

SEQ ID NO: 2207 - DNA, 703 bp, Nannochloropsis_gaditana
ttggaaaggttgaacttttccttgtagttcttgttggcctctgcccgccgtttgttcacctcttggaagtatgctttctgtttgtctgggttctggcgagcccgcaaaatttcttgttgcttctgatacgcctcctccttttcactatccgacagaaatagaccgtcgaagagccctgctgtcacaacaccgcgaattcggcgtaattgtgagacctgataagctggacggacaacaaaagcaagagcagtgcttgcgcatgtcagcaacaaagccaaaaataagccggaaaatctcatgcttgtgtgtccaagcgggctacccctctgtattttaatcgtaaaggggataagggagggaagaaaagaagtatcatggcggaaatgagcgctcgtcgaaccgtcatgttttataacttccttaggaagacacgaacgctagaggtccatcgacatgtagtgtgccatagtagacgtggttctagcggggcgaatagacgaggggagtgtcatgtatttccacacggagccgtcacaagaaatggcgagctccgcgagtcgagcgacgatgacatgaccaagtccgctgtgctcttgctggtttttgcctccctcgagcagacatgcacgtcgtggaaatattcaacccagccctctgacaagattttcatgccattcctaggtgcgcgcggtttatagtcatg

SEQ ID NO: 2208 - DNA, 703 bp, Nannochloropsis_gaditana
acatgcacgtcgtggaaatattcaacccagccctctgacaagattttcatgccattcctaggtgcgcgcggtttatagtcatgcagggcgaggagctgtcctgcctatagtgtgcttgtgaagcgagggcaagagcaaaatgcatgtaagcaaaattttatttctccgatgcaaagtcaagcgtaccaagagaaagggagggtcaacagcagctgtgggtgccgtccttcgtcgtgcatgtgcatgacagcaagggacgggacgtcgtgggggccctctgagagtctttttcggatcccccagcttgccctagtgcctgtccacctccaaaagtgaaggcgacatcatagtgcatgcaggtggcacagcccttatggccagcatacccctgtgagtctccatttagtcgcaaaattcgtggtccttgtcctcagacaacgacagcttgggcgtgcattcgcagtgtaatttggcttgctccccctgagtgccgtgtgagcatgcctgtgcaaatgaagtcgaggtgaagtggcggtatctcaacccgacactttggtcctattccctgtatattcttcttgtgatgtcagtgagagtgatggcgaatggaccctcctaccacgaaacccagcgtcggctctgttgcggaacccacaccctcaataacctctaccaacaccattggatcgacacggccacgatg

SEQ ID NO: 2209 - DNA, 703 bp, Nannochloropsis_gaditana
aggatatgagccagtagagagaccaatgctcggcgctctgggactcgtcgaatacgtcgggcacgtcggcatgggccgcggcgcttgactcgggaatgctggcccgtggccccgggaattctgacaccgttcgacatgaggcaattatggggtatacatacagtataccgaccctgtttcgtgatgagcaagtgggaccgacaggtgaaggaatttttgccaggtgcccacgatcaggtttgccatgaaaatctgaggaagaaaaatcgaggcgggcaactcctttacctaccgaagacattgatatatcatctccactcccgtgcgcaaaaatgaatgtcaccacatggagaccttctgtcttcgaaatccctgcagaggcacgtgcacggggtggtaaaggtgcgcaggttggagtaaatggcataggacgatcacatatagggggcacatcgattgcctggaaagagcgggctgtgtaagcgagcggctcaaggtggagatgatgggttgggcgttggaaaaatacgtaccaccgccgggcgcacagcgcgacttggccaaatacagcgtgcatgtccatgatggtgcatagattggcattcattttggttttcctggcatgttatctctcatttaggccacgggtgggcagggccctttcagcttgcctctgatgcttgcggcttttccaggagcgatg

SEQ ID NO: 2210 - DNA, 703 bp, Nannochloropsis_gaditana
cgactcagacaaaccctgacaagtgactaaagggacgtgcatagatgcacaaagcctccatttcgaattcacaactcggttattgtccacctatcctgttaaagttgcggcacaaccatggccgggttgatgttgccgacaccgcgtgctcgacccgccctgttttcttcctttcctgtttttgcctttttgctaatattttcttccttgtcccccgatttgtgtcgtattattatttcagtcgatatattgcaagaaatctaggaaggaattacaaatttacccccgccctgaatcttggtcgaagggttggtcgcactgcgtatcttggcttgcttgttcttaacatttcaggtcaccatcatttttggcaaactcgctcgaccgctcgccttcggtcatcaagaccgtgatgtccacggccacaccacaagaatggatgtatgagaaagaggtgtcacaaagttgacccctcgacatcgcattgtggagtgtgatattacgcggtaggctggccgacttccatacgagggggcggcgcggagtagatggactgagggcgcgtgacatgtccgcttatcttatttacggacaattaagtagtcaattgcacatgccacgtgtcaaatgctgtcctcagattttgtcaagaactatggctgtctgtcttcatactcatggcatggactcgggcgtttttagt

SEQ ID NO: 2211 - DNA, 703 bp, Nannochloropsis_gaditana
tggcacgtcggtctcgacactttctgtactcgaagtggctttaggacctcgtggttggattgccggcctatcccactctctgttcggacgtcgcacaggccccgctgcttcgagtgcctgggcggatgttcaaggtggaagtgttctacacgccggaacccgaacgagactacgtgcaggcagcgattcgaacggcacttcaggtgaggggggaagagggagggagggagggagggaaggaggggaaagggaggggcgacgacacgatttccacaacaacactctttccgtggtggccttccatctcgggacatgcaccggcggctcaagttgtgggcatactagtttgcttctcttccgtggacccttccttcctctggctagtttggaggttggggggggcatgggagggaaagctagggggagtacaaccaccgggcgcagtggcctacgcggcgcttggcatatctgttccccacatgcaactcacgattccttcgactacttcgctcgacgatcctcccgtctggttctccgccggttcccttcccttccatcgtcttcaccacgcccctacatcctgccttcctccccgccctccaccccgcgctcccacagattcatctctgcgaagagcccggcgacattctggtctttctaacgggcgaggaagagatcgaggacgcctgtcggaagatccgcg

SEQ ID NO: 2212 - DNA, 703 bp, Nannochloropsis_gaditana
ttcaaggccgtgctgggggcgaggcggacgggcgggcccatgcctgtcctgaggggcgtccgacgaagcttggaggaggaggagggaggcaagggggaggccgtggcgggaggggaggaaaaggaagacaggaccgccctcttcatgggggtctcgggcgaggactgcttggtgccttccatcccgtcctccccctcgtcctcgaattcgtcctcccggtcccccgaggcaccttcctcgcccccgcgcccctccctttcctcgtcttcaaagtcaccccccagacccgtccctcgcaccgcccgcccttccccgcagccctctgtccgtagtcctttgcccacactgctcccactcccgctgttatgaaagtcttccgcctttttctgcttgaccctgtctgcgtaccggagggtgttgagggtatgatcggcggaggaggcgttgggggacacggtggcgatcatgacggtgcgtgctttttccttcgtgaagcaatccttcaagaccaacgtaagcttgctcgcgcggtaaggaacgtgggtgccaccgcccgcatccaatgcccgaatgcactctttgagcgccaagagcgatttgttgatctccgcactttccaagcgccgctgccggcagtggctcttcgtgtccgccccccgttccgagccggccaagtcgaccagggagagtttcccccacagct

SEQ ID NO: 2213 - DNA, 703 bp, Nannochloropsis_gaditana
cccccagacccgtccctcgcaccgcccgcccttccccgcagccctctgtccgtagtcctttgcccacactgctcccactcccgctgttatgaaagtcttccgcctttttctgcttgaccctgtctgcgtaccggagggtgttgagggtatgatcggcggaggaggcgttgggggacacggtggcgatcatgacggtgcgtgctttttccttcgtgaagcaatccttcaagaccaacgtaagcttgctcgcgcggtaaggaacgtgggtgccaccgcccgcatccaatgcccgaatgcactctttgagcgccaagagcgatttgttgatctccgcactttccaagcgccgctgccggcagtggctcttcgtgtccgccccccgttccgagccggccaagtcgaccagggagagtttcccccacagcttccccgaatctcggtcccggaggaggacttggcatatggcgtgggagcgggaggagacatcgttcacctcggtcgcgtgggtggtccggttccggttcccttcctcgatcaggcgccataactcctcctccgagctggcctctttttcgctcagctctccgatcaccacgtctcccttcccgtcctcccgcaccagcagcttgtgccggtggttgagcaggtcctgacaccgcccgccgtagatctcgaagtagctcacatagacgcccaacccccc

SEQ ID NO: 2214 - DNA, 703 bp, Nannochloropsis_gaditana
attcggggtgcgcggcgtgctgaccgtgctcacgttggaggaagaggacgcaaggcggcttggtgtgccttggaatcgggacggggtgggcatgctatctgacaaaggccgtagccttcagaaaagctatttcgggagccgaacaattgatgtacgggcttcctccaggtactgtgcgtgacggtgaagacgacaattctgctttaccagctcccacgcaataccaagccctccaaattgcagccactgtgcagtcacctgtcaaatgatgaagaaatcaaaacaaagaccttgaaagccggaattcgtgcctgtgggcacgggaagtttggcctctagggcaaggaacgaccacatcgaaaagcggcaacgtcaaaaatttggcgaggcgtgcccggccccgtatccacacaggccccggtgccctttttatgggggctcttgggccatttggggaggggccggcccgggagggctttccaggacggtgatttatgaagggagatcggtggtagtgcactgctatgtagggtggaggctcattttgtgcccatgttttttctttttacagggggcttccttggcagggggcaagtttactcttgcgtgggtgaagtaattcttgcgttttttccccttttcccggggggagtggcctagaaagcatctctaacgtctacagacgaaccagacaagtggaatg

SEQ ID NO: 2215 - DNA, 703 bp, Nannochloropsis_gaditana
ttaagacgaaaaaatgggtggcaatcagccgcaagtgcctccttctgtaagtactccgtggttttgaccaagctgctggtatctcgatcttgatcacctcccgacccccgttgtggcttgttgaggaagctgacgctctctgtgttgcgctgaccacacaaaggctgctggaaggaaagtcccggcctcggacccgcacggctctttccattttgcctgtgaatgccctggtcacgggtgagtggacgatggacgtgtgaatgtgcctggatcgccacgcaagacctctcgggggggggtctatgggcgctctccaaaggaactcagcgaggagtttcgtcgtctgtctggacacatatcccacgcccgagaattcccacgctgtctcccaggactgtggatgcctctctgcacctgacagtgttgaaaatgaggctgtctgggaaatcgatttccttggtatgcaccacatgtggccgtttttcctcgggatgatttaacttgatgagggtaagggggtgctcatcgtgcataagcctgtctcacttcgctcatacccctaccttattctacgtcgggcattctggatatcacaggattttccttcacggtactgggacacacctacaaactgggctgatcgccttgcctcgtccgtgggcgtttcctgctttcgagtctctagcatctcctgcgcatcatg

SEQ ID NO: 2216 - DNA, 703 bp, Nannochloropsis_gaditana
acggctgcggccgaagcttcaattcggcttgccgaccaagccattcaaagtaggtaggcccagaccgttctgcattaagagcggtacaatggtagtcaccacggatggagaagggagagtggatcatcgggagcgcggcttcccggatggatgagcaggaggagaattgggatacgaaagcggatgcgagggcgggggaagttaaccataaaaatagacccgcgaggtaggtgtactgctgggacagctttccaacatcgcttttatttcttgtgccacttttcaggtgacggccacggaaaacaggcatgtatattaaggctgccaagcgccacacgaggtccgacctcacgctggctttcagcactccggagactcctatataggggatccgtggccgcaaatctgggcggaaaaaccaaaaatccgacacacgtagaacaaaacctgtttcatagtgtgtcgtttagttttcaccaagatgcattgaattttgcgcacaaagaagacgtcaaggcctcgggcagtctgacctcctcagtcgccatcgccctctaccaacgtcgaggtttcccccacaaatcaccttagcgcggtcacccctacttttggggaaaaagcatcttcgcctcacctgtattttacattcgtatggacaaccagatcgagcacagtagatacattgggtgcctgtgaagccatg

SEQ ID NO: 2217 - DNA, 703 bp, Nannochloropsis_gaditana; identical to SEQ ID NO: 1583

SEQ ID NO: 2218 - DNA, 703 bp, Nannochloropsis_gaditana
ggacccccaagagcaaagccacgggcctcagaaaggatgctgggcgactcatgatgcgtttttatttgcctaagagggcacaaataacaaaagggcacgaataagacacttaagactttcgtacgtcaacttcttcccgcgggcgtcgtgtttcagctcataaagtggcctgacaagtgcctgcagctcgagcaacagcaccagcggcccgggttcaaggatactacgtccctgcctcttctttgaggccataaccatgaccaatactgccaaagttgccggacacgccattgatgacacgtcctaggaggttcatgctaccctgcgaccacccttccaagcctccagggcctgccgtggcatggtttgacgcctcgcagagtttcgggcactgctcccgtgtaggttgacggtgggaggcgggaaagtcgtatatcatttgcttcgccaagccttctttctaggcgataatttcacttccagcttggctcctgccttgcgtgtgcattcccccaaggtgtgcgtcctgttctaaggctcggaggaggtcttaagtgtggcgtctgataatgtggcgtagacgagtgtcaccaaaagagtaaggaaatggatggtaatctctctcctccccccccctcctagggtacagaaatcggaaggacgcacaccagctttcttgcctacacctaccaccagcacgatg

SEQ ID NO: 2219 - DNA, 703 bp, Nannochloropsis_gaditana
gaacgtcacaccaaagccagcttgagggctcaacaacccacggtacagggagctaattccaccctcgcgcaccatcgaacgtatcacatcgatagggcctttatagtggggatatgcctgtagtcggacttttgcagtatccagaggaaagatcaaagtgatgcctacgacgcctcctactgttcctggggtgttcaatattaacggattaatatgttaataaattatggacaacaattaattgatgaattgtgaccctaataagagcatcgtgtcacttcttcagggaattaaaacatgttgaggatgtacatgagaacgctatcgtctacatgtcgatcttttcgtaggagggcggaagtatgctatcgataataaaagcattgtaagtacctgccaagagctcatgtacaaatttattttccgctaccataaacagtctgtcttgtttgctattgctcttgtcgcctaggagtcagtgaggtgttatgtgagagtagatgtcttaatgggacgtgcttcacccagcgggctcggtcagcggcgagcgtttgcttcttgtgccatcaaattccgcgtggtttgtgtccacatcagccgcctttaatccgataatacgaccttcataacggcagtttgagaaattgatgacatactccacgtctggctctgctcgagagcttccattaatggcgcagcagat

SEQ ID NO: 2220 - DNA, 703 bp, Nannochloropsis_gaditana
cccatgccccagtaatggcgtcatcgccacggtgtcttacgacaggatcttgtgacaactgtccagccttgaaggtacgagataggagaaagctggaattttcactacatttcattccgggtatgctcatcacgcccagacggctccttttcaacgcagaaatcgtaaaagcgtgacaattaacacgaatgggaccatgcgttggccagtgacccgaagacaccccgatgccggttacctgaccaactcgtttacacagattcaaaacttttttcaggagagaacctagacgtccaaggagaggagtgctgattagatgcacttgcaaattgctttgtcgttggtctttttgtttttgttgtttggtcttttatgtggcttaaaggataaagcttggtgttttgatcggtgggaacgtctacttgacgacttgctaacatcgtaacgggggccaggacgtagacatgggccggacctcgaagagacactgaacgctcaccgcgtgtcgagcagttttaccggtcaatggcatgctcgaagttctgtttatactctaaaatgctataagctgcaacaagttccatattgatcatgacaaacatttttagatagtgcgaatgggccgtgtccatgagggtaaatctttgtataagttttagctcacaaacaaccaaaatatcaattaagcagttgacatcccatg

SEQ ID NO: 2221 - DNA, 703 bp, Nannochloropsis_gaditana
tggagagcctcaaaggcaagcgcgtcaggaaatagacagccctctcccatcgaccctcggtacgagaagtacttagatgtgatataccctgtacataagagagttccttgatgtcatcaggagggagagataggatgaatgatgggttgtccgatttgtatatctcgcctttgaattcgccgaggaaaccacgcagcctctacagtgtttggctgtcatacttttctgtgttacctggcgattgctgttatgtgcgataatgtacgcatgcactggcatccattttcaatctaagatgtattctcatttccattttttcctcgatgggctcaatctgagcatacgacctctctttaatcttctgtcttcccattcccccttctttttattagtcatacccagcttctcgagccctctgacggagtcctgcattgaatcgaacgactctttattcgctgatgtctctccgcaggcgcaaagaggaggtggaaggaaagtgaaaggtggagagaagggggaggaggaaagctgcctccctgtttcagggcgcctgacgagcgagctagtgaaggctccagaccctcagcacgagtgcttattcgccccccagtgggcgtccgactcaacgggtccaccagccaagaagccgccctcttacctgcctgctagctctcctgggacggtacgggaaacgtggtggatg

SEQ ID NO: 2222 - DNA, 703 bp, Nannochloropsis_gaditana
tcggttgatgacgccttgactgccgcggatactggatgtctgaaaggagaaaggaagaccaaagcagacgcagtcgtggcgacacgaacgagggaatcacgacgggaggagattccacgggccgcagcggacggagcgatgtcagaggaggtagacgaagacatgaacactaacgcggacacccgcttcgacggcaatcgctcaaccatcgggcagaaggcaccaataggaaagagcgtacaagagacaatggcgagagcaagcacgagcttcgatgtagctcccatacttgctgctgaatcaaacacgcgttgcctccccgtattgcctcaggtccgacccaaaaattgctgtcctacttcttgatgcaataagggtgcttgtggtaagtttaaagatatgcgagatgcagcacgatcactcagcggagagatatggatgcatctcaatgcgctgcgtgcttctcaagccaaggcttcccgtgtcgctgtcatctcagggtttatgacccgaacgaggtacgtcacgccagccgttgccccaacgtcttgaaatcgatccgctgcttcctccctttccacccgacttgcattgacgcgaagcaagtcagtggcactcgctcatcatcatttaatgcaatttatcccataacataggtcgatatcgaattttagcgctgtacctttgggatggaacccagtaa

SEQ ID NO: 2223 - DNA, 703 bp, Nannochloropsis_gaditana
cgccgcttcttcgccaagcccatgcttcttttcaagcccggtttgtcagaaacccccttggaacagcacgcaatttgacgactgtgtatttatgccaagtgatccgccgccagccagtttccatagggctcactatgcctgagtgtgatgagaaaagtattgccgtccctttgtgtgtcgttcctcgcaatttgtcagccggtacagggatcaggaagcctacctctccctcattcctttcccgatctcccttttaacagcataacacctgctttacgaggcttccccagtctcgttttcgtctcctgcaattcgaggctcgtcgatctcatctatacgagcaaagagcaagaggaccatagacaaaatcgcagactcggataggcgcgataccagcagcgggaaaaattggtagggagagcttgtccatctcgctgaagggtaaggggctatgtgtgagagtctctgggtcatcttcctcgcgcttgctacagtagatatagatagctgactttccgttccgaaatcgtcttccgcgacacgttggctcacgaatcatgtgttcctcgagcgctgtcctcgagggaatcttaccctgcctccactgtactgtctctcagtctcacgcattcctcttttgtgacctgtgagcagtgacttggagagtggaagctgcactcagcgtgcgtcagacacagagatg

SEQ ID NO: 2224 - DNA, 703 bp, Nannochloropsis_gaditana
gctgactttccgttccgaaatcgtcttccgcgacacgttggctcacgaatcatgtgttcctcgagcgctgtcctcgagggaatcttaccctgcctccactgtactgtctctcagtctcacgcattcctcttttgtgacctgtgagcagtgacttggagagtggaagctgcactcagcgtgcgtcagacacagagatggatttacgtctccgccgtagcgggcaggtggaggaggagacggaggcggggatgggtcggtccactcccccgcctccttctacgcttcgtaccgcaactcgggcgaggaggaagacgacgcacgaccactcttggaccggagaagcagcagcactgcgtacttccagcaccaaaacctgatgtccccgggcgctgaccgcgtctttgcctaccaggcctcgagggcgggggacgaagagggagacccgcgccggagggcagacgatgacaggaacggcctcgatcctgcaagcatgccctccccgtcagacatcttgcgcaagcccatgcggttcggtgccggggtccgccaagatccggatagccccctccaccaccctccctttcccgccccgccctcccctccgaggctcggcggccaagcgcacccgcaccgaagctcgcacccgggccggagggagtcgagcatcatcggcggcagcctgcacctggcccctggggacatg

SEQ ID NO: 2225 - DNA, 703 bp, Nannochloropsis_gaditana
ggaaagctcgcaacatactagttaagagtgtgtttcaaggtaaatttgaaagatttgaatgcacaatttcatcttcctgcttcaaagggacgtaatttgttttatctcaatggtatgctgcttgtcatgagtggtgacgtccgccgcccgtctgcgctcgagtctgggttgttggcagggtgctggtcgggctaccgatggcgaggttgatcccgactgtcccatgaaccgaccacggcattgtccccttctccctagttatcgtcctcgttttcgtcctctttctcgccctcgttctcgtctccgctccccccctagcaagccaggcagggcccgagcactcgcatgccgtcgtcgagaacgcagaaacagagcaccgcgaaaaggaacaacacagtattatcacctgcaaactgtgcaaaccacgccaaccagaactgagacgtttgtggttataatgcatagtcaacattgggattccttccttagtgaagcatgctcacgttttccgtagcgtcatcatcacaaaaaccgcgctctggtggacgacttgttgaccgtcctctgtaaatcaaactctcataccacagagcactgatttgcatcgttgtctggcaaacgaaaagacttgctgacttgtggacggcaaacagcaaagttttcttggagcggtccgtcattttcaagcaaagcactcagaatg

SEQ ID NO: 2226 - DNA, 703 bp, Nannochloropsis_gaditana
gcttttctgccgtgtcttccaaccaggtccttcggtcgcgtgacggaagggaatccgcatggtacgcgcatacaactgaatttttatggcccccaaagtggcgaattttaagccacgggacgtggtagtgcgctgtctgcggcgtggattgcttggatggagtgctcccagcagcgagcgagaggcggcgaggcgaggctgtgtacgacttgagaggcggtggtttgcattacttattgcctcgcttgagttggtgaagggttagattacggcaggacaaaattttcagagataatttatgctttcgcggcgattcgagtgcttttctggagctgccctctgtcctactggtcaaagccaaagcatgcgcaaggcgtcgcgcgtagccccattgcctcgtatcataccactccacaacattgcagacttttctgttcatcgtctttttattccttcatgcctgcgttttgtcgctgccgcttgctctgtgtgtagatgttatcaccacccgctcgtagtgcagcttatccgtcctcacacttaaacacagtcgttgagcgactagatttcatattgactcccttctggttaatttacgacaggttaccctgtaatctgttcggtttgtggcggaggggcttcattatcctctccctgtgactcctgttgaactgatacgtaaacgaaagagataagagatatg

SEQ ID NO: 2227 - DNA, 703 bp, Nannochloropsis_gaditana
tctcaccctcttgaactcacttttgggagaagttggcgtctcatcgtccgagtctccggcctgcacagcgctcgaagcgagtttctgtgccagctcatcccgcgaaggaaatagcgtgtacgcattgatattgatgtgttgctccatctcatcgatccgaaagatttgaccggtgtccttgtccacgacctggaaccgcatctgctcaatgttcatgggctcatcaggagcgccctttccattcattaccccaacttcttaaccgcagacgtctcccagactcttcctagaagtcaactactcgacctgtgaaagagcgtgatgtcagattgggacagaagtttgtttgtgacggggccctggcgccaggaggagaaagggcagacagtgaccggagaagaaaaatgattgagaaagatcgatgaattgttgaattcaaatgccctcgcagattctaacattgtggttaagtgagcaagtccatatgcacgccttccgccaggacccgaggccttggccgcgcgacggcctccgaaacagggcctgtaacgtacgttctccttactgagtagtacttgttctgcccctcgctccaaccagccgcggcgatgccggatcccgcccgtacactttttcataaattttcaaatcttctgccgataacctattcatctgaacgcaggtcttgcatcattcgttcatg

SEQ ID NO: 2228 - DNA, 703 bp, Nannochloropsis_gaditana
ttgccactttatgctgctgggctgcttcagatatctccaagctgtctgatgactgcatccacacagggaaggcaggttgttctccatatcttctttggcgtgtcctgtgcgcacaggggcttggcagggaggaggtcgaggcgtctcgagcagaggggcgggaaaacgcaagggaagcttgtagggcgccacatggctgtaaagcaaggtgtggggatcccttcacagtacacaaaatagccaagagtatcaaggccgaccgtgtgtgttttggtaggcggtcgttcatgagttgctgaatggaagcgggaacgccgccggacactctcttagccgccttctgtccgagaatccttccgctgtttgaagaatattgagcccctgcaaatacatagtgggatcatacatgagcttatcgccacactttcgttggcctcaccgatcactaatgctttcggcaacaagagatctttgagcagtcgtcgaggctctcaattgcttacagaagcggtcgctgttgtatcgcccttaaaaagaggacatggaaatgttccgtcatgtctcatcttggaagaactcatcttagcgcctttgcgtcaccacgacaccgccgtccatcgcaatacagtccgcaaacggtgaaagttgagttggtcgctggacggcctagacacgaccgctctacacgcaggagtgagagatg

SEQ ID NO: 2229 - DNA, 703 bp, Nannochloropsis_gaditana
ggaagtggtctgtcaagactcaaggggacgagaaacacccgccatccaaggcacgtactagtagaaggaggagtgtggcagtcgaccggcgtcattttttgcccctatcgatcttttttttaacaagcactgaggttcgtttggccgcaaatctcaccatcacagagagggctctctggatactgtacctgcacatgctccgcctggccttgcgacccggcgacgcggacacatttatgaataggatcgtcggatgtggcctaatgatgctcacgattgtccaggggtacaacctaggtggcaagagcactatcaataggctaggatcccgtcagatgcaacggcagaatattttcacatcatattcggcgtcatcgaataacttttacagcagctcttttcaacgtaagtcttcatgacctattcctaccgtgttgccttcccactcaaaagggtgaccgttttgatactcatggaccaaaaaatgtcttcatgtgattaaaggaatatgggcagtacttgtgtaagcaatatttgtttgtcatcgaagagtcatacgatatatcggcttaagccatacgtctagatgccatgtcgttgataatggcacggctcagaattacgagagtgaacaaattgttaggtgagcccagcctgtttggaaggaatcacaaccaagcacttcaaatcctccgcgcaaatg

SEQ ID NO: 2230 - DNA, 703 bp, Nannochloropsis_gaditana
cagtcgatggtccacacttgtgcaaaataggcgaggcaggatgtgctctgtaggaggtaggtaggatgaagaatacccttggcacacgcaaaggtactgctgtcgatgtgcacatccagcgttaagtcttgcgtacctgtgaaatacttatttgcgacaagatattttttaaaaaaatgacttcagaaaggctccccggggttaagtcacagcaactagcactcgcactagtagtactgcgagtagctcatcgccaatgttgcaccgcccacagcggtcacgttcacgtcgacacccttttttgtgcctgtcatctgcagcgtcctgcacccacggtgccatggaaggggctggcaaacccaaagacaggaagccaagcgctctctccagtcccgcgcaggggcccgcgggaagtcttccaactatactgtctgcgtcgtgctcgctgaggtgaccgactggctcgagccttcttggctctccgcctccctcgaccccgcataaacacaggcacaaataatacaaagatgtttactggtgtgcctctgtgacacttaatcgtccgaattattttctggaaagcagaaagtgtccccctgaaatcgtgcaataattactttgcacattccatattacagaggattggaaaagtaccgaagcacaaaaaacagggctggggggtccacccttgacgctccccatg

SEQ ID NO: 2231 - DNA, 703 bp, Nannochloropsis_gaditana
ttttcgtgtcgtgcgagcctcttaatccgctgtgggtcggcgcgggaggccggggcagcctgtgggcaagggaggcgtgccagcgatcggtcggtccccgcgtagcctgcccggcctctgcatcatgtgtcttgcgctggtttgcgacgggacacggcttgtcgtctgccgccagtgcggcattgatactgcgattacagctggaaggggagactgccataggcagctctcgtcgtctagatcgttccatggccggcctaagacgacatctcgccgggatgcccgctactccgcaggtcctccttgcggcctcttctgccattcccccgccccgtgtcttcccgtttctcattcacaatgcaccccttcctgtttttccttccctacacaaggttgtagtggctaacagacttctttaggatcgagaatataaaataaataccttatttctccgctaagaagcatggccaagcacatacagagcaccgccatctcagcaccatcaaaggaaatactaacgcagcttgccaatccgagcaacctggaggcccttctgttgcaattgacagcacccgatacgcaaattatccagcaagctgaagctgttataaaaaaatatgtgaaaagtcctgtgtgtgtggcggggctcgtgcagcaactccaaggctcgacgtatttgcaggtcagacagctgtcagccatg

SEQ ID NO: 2232 - DNA, 703 bp, Nannochloropsis_gaditana
acgtagcgtacaagacgaggtattagcaaacgatgtgctcccagggttacgattgcttttccagaaccccacgtacaacgagcaagcctctcttgggctgcaaagctttgcgcccgaggctcgcgccgtcatcgcccggcatttgcagcaatagcatgtgtcaggaaggaaaagtacactgccaacgactcgagatcttgttgcgaagaagctgtcctttctttctttgcatgttgactcattgaaatgcatctcgctttatcccgtaagggttcgtctttccggaagagttcgtttgggcggacgcggtcgccgaccaaatttcttgctcgagggcagccgaggtactctttatggcaccgcagtaacaggccaccaagctacactcgttaaaactcaatggtgaaaggtcgtgagcgttgaacgagtattctgtatattatgagcaactcgtcgagcaagagtcgcattttacgtccccttccctctcaagcttggcgcatatcttattcaatcgaccagggagtagcgggttcgcaacaaggcaatgagtggggggccaccatttcgtgcattggttggtggaattaacggtctagctacaacgcatgacaatgaagtagccagctgcggaaaggggttagagataagcatgttgagtagtgaagcacgcgagatacaaggcggaggaaaaactgcaatg

SEQ ID NO: 2233 - DNA, 703 bp, Nannochloropsis_gaditana
ggagggagggcgggaggcatttgatggagaagacgactcgtgcttatcgcccttcccctccctcttccccccttcttccctcccaatttcccgccctccccttgctcctatgtctcccagcggccttcgctttccttcgcgtgcattgggggccatgcggaggcgaagcggaggctccggcaggccgttctctaccccttcctctacccctccctcatgcgctccttcaatctcatcggacaaggtggaatcttgctgtgtgggcccccggggagcgggaagacttgtctaggtaacatagagggaggccgagtgggataggggaaggaggaagggagggagggagggagggagggaggcaggtagagagggcaaaaggatggagaagagttcgaaaagggaatttatatcaagcatctgacgttgggtatatctctgcagtcaaagccgccgcagcctcggtgccaggtctctcttttctgtcttatgcggcaagtgatatatacagtatgtacttaggggaagcggaggcagcagtgcggggggccttcgccctggcccgccaggtgggaaggagggaaagaaggagggagggaaggagggagggaaggagggagagggagatgggaagaagtggaaggacggaagagataagggaatggatggtgaggtggtagcacggccacagacgttgtcggcgcga

SEQ ID NO: 2234 - DNA, 703 bp, Nannochloropsis_gaditana
tctggtcgattagtcatatcaaacgccttgaatgtactcataccccatcccaaacctcctattcaattggcctcgatctgtatttcctgatgaaagcctttgccacgccccgaagtccgctcttcattctctgtcctccaaaggcaacgtctgcaaacgcctgctcaagttcccgctgtgctggcgggcaagcgcgtgcaggtaagcaccaagagggaaccagagtacttgaggtacaggagttgaagggggttctagtctctttcagaaattcacgaggagggtttcagaaattcacgaggagggtagtatgcttttcaaaaggaggaggctcgtaccaacaaaggctcacatacgttgttcctctgccattacgttactcgtccgtcccgtctgtgtgatactgcctccgccttcccctttgtcaggtggttcccaaagaggccttgggcgcggtggcggatcatgaacgaatcgaagagctctttcctcgcacgtatggaaagccgcgcgtggagctagccacaatagaagaggactccgagggcaggtatgtggtgtcaggagcaatgaaaataggaccaagtggtgtctgtaaggctccgaaaggattctatctaatgtcctgcggtgagtgccatcgttacgctttcccctgttactcattccacccggttccgcctgctccttccttgcctgcgac

SEQ ID NO: 2235 - DNA, 703 bp, Nannochloropsis_gaditana
cccggaattgtacctgcaccattgtcttctttgagaggacgattgcaacggccatcgtgcgtctcacgtttttttgaacgtggcactcgccgctcttctctccacctggctctttcctgtccccacaggcgtgtatgactacatcaaatcggtgcatccggactcggaacttctggggttcgccaacggcccgaagggcgtctttaccggcaaatactacgtcgtcgatgcagctttcatggacgcttacagggtgcgtaatcccagtttctcttgttccttattccagccttttcccttttcattacgtgtgtcatggacactgccacggtccttctctttctcgcatgcctctctcatatgaagaagtcctacaaatctcccacttggctcatgcaccacttcctttgaaattttatcccgcccgtcgcgatgtcgtctttcgcccaatgttcctcccacgcttcctttgtccctcagaacaccggtgggttcgatgccctgggctctggccgcaataaaatcgaatcccctgaagagttcgcggtatggacagcagaagggggggggagagtaaaaggggggtattttatatacaccaccgttgaagatgtcatgcccttttgttcataaacgggtttttatttcatcatttatcctctttctctccgcaaccttcgacctcacgtcctcgattcagggc

SEQ ID NO: 2236 - DNA, 703 bp, Nannochloropsis_gaditana
ttggcctcttgccacaaaatgggggcgagtaggacaaggtgttaactgaagcttacggtctgctatagacaaataatatggcaaaaggaagactagtatcgcaagtaatgatttaattgttgtaatagcttgccgcagcttacaaaaattgccatgtatcccttcggtcgcgtaaacaaagtttcctgtccctgcagaaagctccgctcgcgacagtgttactttcataactgcgttggctttataataagaactttcattctttcgacggactgcacattggttcactgtaggggacgctataagagacatttcatcaatatgagccttccagggcgctagtttcggcacgtacagtgttcagcatataaacgaattcgacttttggcactgttcatcacatctccactaaacctctgcacaagcctggcgaaaatgatatttgaggtgcattcgatgacgcgtgagttgattgctcgggacgaggagtgtttggtggtcatttactttgtgttccaatcggtgtgtttaccacccaacactatccgccccctcaagcttcaagcagctagcctccttcctccaagccatctccctctttttatgccataacttgaaaaaattgtcgtatctcaaccacacagggttatcaaaggtgatgcatcgccttgtacaggattctttgcactgcctgcgtcagccg

SEQ ID NO: 2237 - DNA, 703 bp, Nannochloropsis_gaditana
gtggtgcaggggggagaaaaggagggaggaacgtggatggagagaggtacagcacgagccgtggtcagggccgcagagaaagaaggcgtgttcagtacggtcacggcgctgggatcgctgcgactggacgcggaggagatgaaaaaaggaagaggacaacgaaggagaagggaagaggaagatgtaggtagaagtgcaagccccgaaaacggtggaaagggttggggtaaggagggcgagcataagggaagtttgctggactctctggcttcctggttgtcgagaggggctcgcacagggccaggacggatgtgaaaaggcggacgagaatgtaattatgcaaaagggaaagatttagtcccgaaagtggatcaggcagattaaacgaggagttagttcacaggattgtgcttcagaaaagggtcaatgacatcctgtactctacttcaattttcgaatcgttattttttcaggtttttgaattgcccaacagtgctttatgtgggtaaaattcgactacaaggtggcgtcggtcagatgagctattcttatttcatttcgtacgcaaacctcctttcatagagttgactccgctgatttttttgagcgagcgggcagcttcctctcatcccctcgattgcgcctgaggcatctccttacctgccacaattaattacgccctactgtcacagaagcgaccatg

SEQ ID NO: 2238 - DNA, 703 bp, Nannochloropsis_gaditana
tcgctcagctatgtgttgaaaagccaaccgtgcaacgttcccctttttgtacctctgtcctcgaacttaccttggccgcaatgtcttcaccgaacgcattcgccggctggggaggcactgcaccaaaacataaggctgccgatggaaggacgactgctagtaaatgatgaaaaactgcacggaaataaggcttaaattgcgtgactttgggagtaggaggtgggggcgtgggaggaggcaggaaggcgaaagctgagctgaagagagctgcggcaacgatgaaggagagcgcggcgcagtagcttctaatgagcatgatgtgtcactggtggtacttcaatttatgcgaaaggatcgagtgcgggaatggtatatacggtgaaagggcaggtgtcgcatgacgggaggggggcagatacctctcagacgaggatgcattgactagtcaagtcgtgcgcaacagttttaccattattcaaaagactcgcgatgcagacacggctactgtctaaccaagccgcaagaatcttgtttcatgcccattatggcacaaacacgcccctcaccaatggccaaggcaatatcgtcccttttctcgtctcgtatcacactcgccgatgcaacttgagccctgttccgtgaattcacctctatgcccttatcacacaatcagaccggtactttcgaccaagacaaagcgatg

SEQ ID NO: 2239 - DNA, 703 bp, Nannochloropsis_gaditana
aatatccatggggacaagaaagcactaagggtctgctcgtgcaacacaaggagatcttcaaatccagattacgagctccagaaatggactggtgtccatacccgtacactttgataaggagtctcagatccaccactctttcatctcgtattcggtaaagatttttattgtcgtggattaaactcgcatgtccttgttgtatgcgcacgcctcaattttagacatttttacggcaaaagctgatatatcaggggaggttaaaaggttttgtgttagcgattaggttgccctttcctcaactcttttcaccggtacaacacattaaattgctcccataagcccgacaccgcgtacggatgttttacgtggtgggttttggcatgaccatttcacttcctaggatcatattgaggcacaacgaagcaatcagaattgatcggaacgagaaatctccagacggactgataattgccgcacacgataagtttcacttctttatacgttcttgcaaccattaaagacatatagggtagcgaaaagggggacacacgcctttaaggatggcaacgtgtcgcttgctagctggaggtacaagcagaggtgctattctcaacgccggtacagtgttgagagtgcggagtacaagaagtcttgcttatgtcttccaaatacagcgccactcatcggttacacatagtgcatg

SEQ ID NO: 2240 - DNA, 703 bp, Nannochloropsis_gaditana
tttagtcgttgaatgagtacctttgatggtaaagtgcttgaaagcttagctttaggttccctgtctcgtgaggaggagggaagagggacgcaacgctgaagaagagtcaagacctccgtggtcgggtgcacacaaaaggctgccttctgtatgatctcaatgaaaaattgagcaataatcacatccattttgtctacgtgattgtgcagcagttgagtggcatacaagaaaagtgtgcagctggtattaggaggaggttagctactcatatactcatattattcacgaatgataaggagggaaagaccaggcatctcgcccataggtgcacccttaggcgagaaagtattattttagtccaatagaatataaaaggacagcgaggacggaagggaagactagtaatccttgccaaagtggcccattgcgcatgcggtgcagaggctcaaaccatcgcgggatcgatttgagcgaacggggcgagggattgaagagaccagcaaaaaagactgctcatccattatttcaaaggaagtcatttctcttacaagggccggatactcaattaatgtattctcatatatctacattggacaaatatgtagtttcagaacctttacgcgtggaaatttaaaggccgtggatacacctttgcaaggaaggaccgatatacattcatcactactcttcaattgacaccatg

SEQ ID NO: 2241 - DNA, 703 bp, Nannochloropsis_gaditana
gtcatggaaaagagaatttggaagtttttcttcgttcgaatgactgcttagccaacacgtttgtgcaatgcgggagagaatagaaagcagctatgatgcatttggtaaaagcacacaaaaggacaagttgaaggaaagagaacagtacggaacatgagctctgattattcgatgtaatgtaatcatcgcgatacccatggcaacatgaggggaaactttgtatgctacgctgaagagccagcggcgtataatttcacgttatcttctttttttcctatttcgttcgtagaaaaactttttcaaaacatctaggacagcaggtaaagctttcaaagctctcaagtggtgtacataacgaggtacagggttttcagagtcacattcgtggtagatctctaacctccccacttctcaggctggagcgagcgagcacagagcccgcctctggtttatacaaagtcgcctttaaacacccgtacaccgcgtttatatacgctggcatatatgtatgacagtaatgcgtaggatgcaagccttaaaatgcacgtctagaaagccttcctccgcctagtcccgtgcatcgaacaccgcacaaagcgccatcttttccatcacaccgcatgcacagtcctgtctcaggtaacttagattacaatatgcacctaaccacagggcctgctcatgctatagtatcccagaaatg

SEQ ID NO: 2242 - DNA, 703 bp, Nannochloropsis_gaditana
gcttctcttcctcgcattacgctcatttcgtcctcgcctaccagcctccctttcttacttcactttctagtcccaaccgttgttcgcaggacctcacaatccacggatgaatgggaaaaagttgacttttgctgtgcattttggtgtcaaaacaacatgataggaaggaaatgtgtttattcgattgaatattttttttgctttctgacgtgcggggataatgaagcatttggattctatggcacaaattgagataaagattttttttcccccatcatatcctacatgtagatgtaaacaagtctaattcatcgatcaccacccgcattattcatgactgtcgttataaaaggcagctgtgtgttgctcgctgaaaggaaatcagcaaagcgaagcgagtcaacgcgtctgctgccccttccagagcggagaagacagcactcatgactctccgaagcacggtacaactgccatggcttatcaactgcattagtcactcaaaagcatgtgctacaagtcaatattcatgccgaatcgatagtcaactcttagaaccgctgagtgagtgcctagctcgaaattctggaaggatttttcggctccgtacctgctccgctctcaactccttcgacccagcctgataccatcacattgctcgtgttcaaacttctgtaccaattcctcactttcctaggtattaatg

SEQ ID NO: 2243 - DNA, 703 bp, Nannochloropsis_gaditana
tggtatgtcgaaagcgtgcggcgcctcaattgacctggttgcaggcgcgtggctccgctttcctcggcaatcatccccggaggagagacgatgactcaccccgacgccaactccgagcggcgtggggcactacagagcacacttaaccggaaatctggccaggcatgctgccagaggtcgggctgtgatgtatggagggacatttgaaattttggacgtggaccggcggcgttcgtagggatttggtctggcatgcccgcattctgacatcaggagcagaagtctcagcttcgatcctctttcttggccttggagtgcgccactggcgactcctacgtttgaacactgggtagggtgcaatagtgtatagtgatttatggagcttgcgtgatgcggggggccatgcagggtaatctgtgtgcgcctttctttttcagacgagcaggacttccacagggcagaagcaaggaggaagctcctgcaggctgctgtattctagatcggagacgcagctaatttttttaccacacattgaaccggaagctctagaaacaggcacatcgaaagaaacgtcgccagtttgacagtcgtgagcacgcgtgccgaggggttgacaacatttttcaagcttacagggacggtttgcttcaaatctacttagccgcttgccaggcaccagaatacctgaagctaaactccgatg

SEQ ID NO: 2244 - DNA, 703 bp, Nannochloropsis_gaditana
tgtaatgccgaccgagctcgcctacatgctcccggacctcgacaggcacgtcatcctcctccttgtcctccaccgtatgtggcgtagacatgagtcctacagcaaccaccgatggtagcaagcgctcctcttcgtcgacgcggcttgataccatcatcgcaggcctcacggtgcttgccgcaaatgcttctcctccctgacctggcgtgagatgtgactgattaaatgctgttggtatgcaacatgacgacgttgcatcgctaaaacctcctggccgcccaggttttcctcatccaaaattcatgcatcttttcctgttgtttttcgctcacatgacaattttgtcattgcatgaatagatttcctgggaaaatgcctcgggaagtcatcacgctgcaagtgggccaggcagggaaccagataggtcgacgcttttgggagcaggcccttgaagaacattgccaacccgacgaggacgatgaccacggtgaattgaaatttacggacagcatgtcttcattttttcatcttcacgacaacgatgatttgatatgtgggactgctaggaaagtccgggatcgtattgtcaaacctggcgctctaaaagcgcgggccgtattagtagacatggaggagggcccggtcacggagacccttcgaggacctttacgaggactttttgacagccatcaatcattaacag

SEQ ID NO: 2245 - DNA, 703 bp, Nannochloropsis_gaditana
gttggtatgcaacatgacgacgttgcatcgctaaaacctcctggccgcccaggttttcctcatccaaaattcatgcatcttttcctgttgtttttcgctcacatgacaattttgtcattgcatgaatagatttcctgggaaaatgcctcgggaagtcatcacgctgcaagtgggccaggcagggaaccagataggtcgacgcttttgggagcaggcccttgaagaacattgccaacccgacgaggacgatgaccacggtgaattgaaatttacggacagcatgtcttcattttttcatcttcacgacaacgatgatttgatatgtgggactgctaggaaagtccgggatcgtattgtcaaacctggcgctctaaaagcgcgggccgtattagtagacatggaggagggcccggtcacggagacccttcgaggacctttacgaggactttttgacagccatcaatcattaacagacgtctcaggggcgggaaataattttgcacacggccatcactgttatggaccgcaatatggggagagtgttttggaagctgttcgtcaggcggcagagctgtgcgactcactgcaatcctttttcctgatgcattctttgggaggaggaactggctctggcctcggcacatacatactgacattgttggaagacgactttccgcaagtccaccgtttcgtaacggctatt

SEQ ID NO: 2246 - DNA, 703 bp, Nannochloropsis_gaditana
tcattgcatgaatagatttcctgggaaaatgcctcgggaagtcatcacgctgcaagtgggccaggcagggaaccagataggtcgacgcttttgggagcaggcccttgaagaacattgccaacccgacgaggacgatgaccacggtgaattgaaatttacggacagcatgtcttcattttttcatcttcacgacaacgatgatttgatatgtgggactgctaggaaagtccgggatcgtattgtcaaacctggcgctctaaaagcgcgggccgtattagtagacatggaggagggcccggtcacggagacccttcgaggacctttacgaggactttttgacagccatcaatcattaacagacgtctcaggggcgggaaataattttgcacacggccatcactgttatggaccgcaatatggggagagtgttttggaagctgttcgtcaggcggcagagctgtgcgactcactgcaatcctttttcctgatgcattctttgggaggaggaactggctctggcctcggcacatacatactgacattgttggaagacgactttccgcaagtccaccgtttcgtaacggctatttttccttcggaggatgacgacgtggtcacctcgccctataacagcgtcttggctctgcagcaactaacggcgcacgcggactgtgttctccccgtggaaaatcagtccttgatg

SEQ ID NO: 2247 - DNA, 703 bp, Nannochloropsis_gaditana
aggggcggcaatggtgaacaggtggtttcgtagtcatcgacaggcgtgaatgtacgttgcaatcctcctggggaaggtggacggggcagaatatagtcgtcactaccgcctgggctaccgccacttcctcccccatcttccatttttagcggaccgtcgtcgtcgtccaggtccatcatcattgatgacatctgcgtcgcagtatgactggttgatagaaacgggcaaggggagatgagattccggggatcgagaacgagtgacaatactttttcgaaaagatagaggggcaatgagtgcgtcatgtcagtgtcaggtcttcatctggatctcatatgcaagagatctctcgtaaagtgcacgcatgccatgtcaaggctattgtgatgcttgagtattggtgcacgtgtccttgattttttgaacagggcttttgggcgggaagggggggcagggatggggctggcggccagcgtcagctgtcgctccgtccgtcgctaattatgatggaaaagataccctcgcccgtcatcttcaagtcgttccttaccggtggttttggggctcactcgcattaagagggcaagaaaatgcttcacgtaagtccctcacgacttattctttggattttgatacaggattgtcatttatttggcggatattttacgcttttgaggtcttctgttctgctcttccttcgatg

SEQ ID NO: 2248 - DNA, 703 bp, Nannochloropsis_gaditana
ttttgactgtactttgtacaacaaatctttcgtacacaggcatgtttgcatttgagaaagtactgcatcgagaaatttgtcgcagcaacatgcacccccgggaatagaacttatggtgtgtaagcgttgtatgcctgcgagcaccccatggaatcctatgccccttccactgtctcgtgggtaatctggcaattactggattcaaacttgcccaccgggggtttcgcgcattcgtatggccttgaagcagcgctgcaactgaagcatttcgatctccagagcgtcgatgaggaaatgcgtgtcactggcttgcttgcctttgcccgccagacaatggagcaacaggcctctcttctcttgcccatggtcagtgctgcacaccatgcagcgaaggacgcgacggcactcttaaagtgtacagatgccggttcatctgtgtccatggtatctcgttgggcaacactcgataaagaatgccatgcactgataaccacggaaggtggccgtagggcttcgactgctcaaggcctagcactgctccgattagcttgcgacaacatcccctctctctcttcccagcactgtcaatggctgcgtactgccagggatctgatccgagggcgggtaggatacagatacagggacgacgcggcgggcgaatcggagtctttgggagtttcacacgacatgtccatcctatcgg

SEQ ID NO: 2249 - DNA, 703 bp, Nannochloropsis_gaditana
caaaactgatagcagagaaacgtaccttccatgatgcggcgacaagacaggtgtaaggaacccccccgctgccaattttcgcaacgcgataaaccgctgcataccgttctaactgtaaaatacatgtgattgcgcaagtacgttgggaacgttgttcatttgggggaaatggcaatcaaatgtccacaagacagtatagacaagaggaaggccatggtaacgtgagaattcaaccgccttctttacatttttaaggacgaacaaacatctatcaccacccagatacaccagaacaacaccaaaaataatggcgatggacactgaatccgaggacaaatggctgcaatcaaacttctcggcactccaaattactgcttttcccaccgtaggatacgagcgcggagccgggcgagggaaagtcttctcgcccctctcgctggttaagttgatgataaattggacgtgacttttatgtctcagactcacctttgttcctttccccctctggaaatggacattcccgcgtggacacatgccataacagacagcgactgggtattggtggattgacattttaccatggctacctcatacgcaaacctccccgcctggcgcaaccaaatgactttcttgcccgggaacatgcaactgacgaagccagaagacatgccgaaggaaaagacttggcggtataagggacatg

SEQ ID NO: 2250 - DNA, 703 bp, Nannochloropsis_gaditana
catgaggctgtacgcagcgaggaagagggctcgggggcagctcagtcgcctctttcctctccccccgtggcccgcgagatgatgcgagtactggagggaaaccggcaggcgctgaacaccttaatcattgccgtcggtcggcacaaggctgatcgacattgtgcggtggagctggtggctgcgaagcaacgaaggagggctaaagggaggcagacggcggacatctccttggcaagtacggagattccggtggggacagacgtgggccagggagagggaggatgcgacggattcggccgcgggacgactgacggtgggatcgaggaggaggaagaggaagagccgccccctcccttacaggtgctgtggaccctgcagggggtcgtgggggtcgggttgcaagcctgggatgtcaaggcgggagggcgaggggaaaagctggggaggatcttggaggaggatccggtcgagccctgatacattgaggcttggaaaagaggggatctaggtaatggtcctggaggagggacattcggtgggaggaaggacttgctgcgccggaaatggacgggctcgccctgatcacgtggcatgggatacaagagagaataaatggcgggaaagggggaggtggtgcttaaaggagaagactggccgcagggagacgttggtcggacgcctgtagatggggcgttgacagatg

SEQ ID NO: 2251 - DNA, 703 bp, Nannochloropsis_gaditana
agaacatgtgatgacaacccattttctagcgccaagcggagccttggaagttgtgagtcaaatagaagtactactgtagtacgtcaggctgcgggctgcacatcatttatttgttctttttcctcgcgttacctctcttggaatagttgacctcctatcaatgccgacgacattgctgggacttgcccagatgacgccagtaaatgcgtccacaacgtcattgcggaaatgacaaacgatttagaagcatgaaggagtccatgccaacgtgaaatgctgattattattgctgactgcgtacggcttttttgaggagcgagcaggatacgggagagcgttccgtctcagcgatcagaaggttacagggtggcgtcgggggcttgaaggtcaaaaatataaccccaactttgttgaagtgtcgcgcgtttacgttcaattgcacaaaattttgacgtgtggaggtaaatgtaggcatcaggagcggtgttgtgccccgcctcagcttactagggaggcctgtcaaggaagagacgagcgacttcaacaagagggtggctcaaggagacagatgccagggtgaccatcttggggcaaataaacaccgtatgaaacctcatagacttactgaacactttcacagccctgcttataaccgtcagccctttaaggacgctccgcactgcggacgcttctttcaaccatg

SEQ ID NO: 2252 - DNA, 703 bp, Nannochloropsis_gaditana
cgaagacttcgtgtatctggaacgccagctcacgtgtcggggcgagcacaaccgcaaaaaggcgttgaggctttgccaacaaggcttgcagcaccggcaaagcaaacgcaccagtcttgcctgaacctgtctcagccagcccgatcacatcacggccctgtagagccgctgggatagcttgttgctggattcccgtgggtttcgtccatccgatcgctgcgcaggcctcacagagaggcttgaccacacccagcgcctcgaaggtctgcacgtcatcctcaacccctttggctgggtcagaatccagatcgacgtcaggatgtgtgtttttttccttcccatccttttttttgccgtttgtaaccatgcgtgaggcggaaatggagttggtaaacgccaagggggtagcccaagggagggaggaggttggttgctgggcctgcgcggatacgttgattacctcaagaaagtcagaccttactgaggcaatcaaggcctgaggtcaatggaacaaaggatggaatgagcgtgttacgtttcaattgtgcggtaggtgcttgtgctcctcaggttttagcgttaccgtgttcctggacggcagccggagggcaagtccatcgccgagacgaagaacgcgttggcactttgacgtcttcctacttaatagagctgaccaaccctaccattcatagactaggtcatg

SEQ ID NO: 2253 - DNA, 703 bp, Nannochloropsis_gaditana
tggaaagcaaacgaagcacttaggacgagcatcgatgccgaagcttaccgagatgtgccctgatttcaaaggagatggcgtagtactggaccatgaagggagtaatgagaaagactttacaactaggtcgcgtcctttgggtgggtttgaacagtttatgtataatgctcatcgtttgggatgtggcttaatctacatgattgctgaccttcgagaaggaagcccgtttctcaaggacaccagtctaatggaagaggcattgcgagcaacggtatctcatcatcctaatttgcatgcatctatttcgtcggatggaaagcaactgatgttccagcccgtcaacaaacttccgccttcttttttttccgtacctcttatctctggctcgtcggctgtggatgtaatacaagaggagctgttgaccactcctatcgcccgaggtgaacgtcacagtcctttttggcaattagtgctcgtacaaaatgcgaaagatgggaaagaaagtcagtcgttggtagcgctagcgcaccacagtattatggatggggagtccatggtgctcttcttgaacgagattattgtgcgaacaaatgagctgctgcgaacgagatcaggcgtgactactcatgttgcagacgaagcaaagtcgccactggaattgtcaaagttgagttttctcccatcgcaggacgagctctttgat

SEQ ID NO: 2254 - DNA, 703 bp, Nannochloropsis_gaditana
aaagggaggctcacgtggagtcgaaatacagttttaattcaatcgatccatgtcattcttcgatcgtcggttggcctcccgagaactattcatgttctgaaggtctcgtacaccctcatttctcgcgcgcgtgttcccttggtcaatttgttttctcgcggggtccgtagtcacggggtctaaaaagcgacaccccccaatacacacacacacataccaccctaataatggtgtccagtaaccaaaacacctcctcgctaacttcgcatttggcgagcaatgcgccccagctttgtcgctcgcatccagtcttgatccatacgccggagagactttgttggtcaagcgcagtccgtttcggcacttttctttttgtttgtgtgcactacatagagtgacagaaattgtcgtttgtatgtcatctttcttgtcatcaagaagtccgtaaggatgagcgcgcagaagtgtacgtgtcgacgacatcaggagcgctatagacattccatcgaaaaacctgttaaactagcctctttcagtaacttcagcatatggcgtcccacccttaatggccggacagtacgtggcccgaatttctgcccctcttcatgcctgtgaggaacaagtgtaggcatgtccctgtcatcctgacttcctcattgcgatcaggtagaggtggtctgtcaatgaagagatcttcaatatg

SEQ ID NO: 2255 - DNA, 703 bp, Nannochloropsis_gaditana
caatcgtagacagctgccacgtatcattgaatatctatgggattttctgaaaattgatgcacaaagcgcagtttttctcgaggttattatctagttttcagttgaagggtcgccccctagcagcttgatctgctcttcgatctcgctagcggagaaatccggcaaggccgtgccttcagatatcaccacttttttacgaagcactgcaagattgaatacacttacatgagaaattcgtgttttctgtggaggctttattttatcaacaagcatgctccaattttaaggagttgaacaacgtgaccacacgaaaaagcaagttcacccggcggtcggattgcccgctgtttcgacacgtactaccctacccattgctcaaaactcaatttgcgtatactggcgcgacaggatcaaaacaccatttcatcatcaaatcaagggtgaaagttcgcattatttttatcgtgtacgcggcttgggcagatctggtggtggttagcccgcagggctgagcggtctggcccatcgtaagtcacctcccgcccgtccacgggattggaccgccgtgttgagaagatttcactagcatgttgttcaagccccaaaaactgtttgaaaggggccatcactcttctcacttccatgaatcatcatatccgatcgtgtcacaggtttttgtgggcgtctccaagcaccgagtatg

SEQ ID NO: 2256 - DNA, 703 bp, Nannochloropsis_gaditana
ccagtgaccgagtctagaaaaccaccagcaacgcgaggccggcgggcacggctccccgaataagacatacctttgatcgcctgcagaaccggcattactgctcccacgataccattataatttggaaaaaaaaagtcgctatctattcaatgagatacggtcgccctggcccctaccattcggggggaaaagcagcagggtcgatttcttgggcctctgtgcgtgctccctcgagaccgatgacgcggttcgtatgatggaaaaggacccctcgattgcctggctcccgagcacccaaaccccaggtggcgccctggcagtggtggacaggaggacgggtgcacgcccttgtattcagtttgtttctctagtctgatagcctctccttgtgtgcgtgtgaaaatgaaatgcgattttttatcgcgtcgcgcgcttgtcttcgcaacatggttccgaaggccggaggcggaagtgtccccccggcaggagcccgttcgttccctttccatcatggtcctaaatattctctccctttttacacatcctgatcttccttgcatgcatcaggtcgcctgggtccaggtttccttctgtcttgtgcctgagctgtccgtcaacgcacagagctcgcacccttcaccatactttttcttctccggtacagcttgtctgctgttccgcgtcgtaggtcgcaggaaaaatg

SEQ ID NO: 2257 - DNA, 703 bp, Nannochloropsis_gaditana
ataactgtgcgcgttgttttgcagcccgcttcccggtacgcctgacgatagttccagcgcggattgacaggccaagaacctgtggttgtgcacgtttgagccatttcgagttaagtggcaacattttaacatgataatagcggtgacagcatgcagacaggcacaatagacttcaggtgtcacaggatgagtccgggcaagccccagtttgtcgcttcttccacgcgcgataaagcgagtcggatcacaaaatgcgtcaccacgacctcaataccccgggaattgtatgtccatatcttgcaataagaccaatgatgcggagtatggggttttgaagtggacgttttatgatagtgttgccaaggaggaggttggccagactgtacacgtgaacaccatttaggtgggtattgcctcgtctgctctgctccgacaggaagacttttacttatgtcaggaaaaagtgcctgtggttcccgctgtccatttcctgcttgagggacgtgttgtgatagtgactgctaaaagtcactagtaatgctcgtccctgcgtgaaatctaacgcaaggctgaatgaaaaaaacaattgttagcgtgaagcgttacacgcatgtaaatacgctgtcatggtcatgttcgacaacccgagcggtgtagttcacacctccttctaattatgtctttcgatacatgcaaacagatg

SEQ ID NO: 2258 - DNA, 703 bp, Nannochloropsis_gaditana
cgtttcttgttcgcgagccttttcacctgtctttcacctaactattgatgccctgtggctttgcttcgtatcccacctcttagatagtgaccaaactgcgaacaatgtgtcaatgacggcggcttggcatagcgtagcgttcacaaattgcgttgctgtggacgacacattgcagcattgcttagtttgtcctgactcaacctcactgactaataccccgtccttgcgtacttacacaccaatctacagtgttttaagagctcaccaaaccccgcttcatttaatcgaagcgcccggctccgcgcgtcacatctttctcgcgcacaagatttgcacctcctgtcaggcggaaagcaacctccacgcaagcactttatagaaacgaatctcttggctcccgttcacttacgggaactagtcgagggctttgttttgcacatcacctagcaccacgtctctcatcaccgccgcatcctcgtgctcgactcaccgcaccctaactgggtttttgcactctgcctctctcgtcgagctcgctgtcctagccagccacttcttgagccaagtgcaccttaccggccccaaggccgccttccatcacagtcaagtacacgggggtacaaccgtctaggttcggtactcgttccagaggcagcaaaagcagcaagccctttttaccttcttttcaagcgaccgaaatatg

SEQ ID NO: 2259 - DNA, 703 bp, Nannochloropsis_gaditana
acgcctgcgtattcgacaaagccatatcccatggacaaggcgggctggtcggcgttgctcttccctgtctctttgctcaccgcgcgggccgcacccacaggagccgttttcttagggattgccactgttcgcaccccctgggttttgctcttaaagtgcgccaatagcttttcctccgacgtagcgaaatttagatttttgacaaagagcgtaaaggaaccctccctctcttcctccccctcgtcctcccctacccttcctatctgaaacgacaatggagcgcccgcgtcggcagctgcagactcgccttctcctgtagtcgccagtccctcttcgtttgcattgtctcctcccctcttcttcggcatgaatgtatgcagcggcgcccactccaggtagaggggcacgtgcttgaagcgcttgtaggctagccccttgaaggctctcttcgcctctgcgccctcaaggaagtccaccaggcctagggaccgactgggcggcagaaggactttggccacggtcccgaagcgaccaaagagctgggtaagctcctcctccgtggtgctgtagggcaggtttttgaccaagatcgtggtcttgctccgggatattgttggcccgccccttgccccctgggacagctgcttccgtcggacttgctgcgcagccgcactctccaagaccgtcaggtccaccccctcct

SEQ ID NO: 2260 - DNA, 703 bp, Nannochloropsis_gaditana
tgccttgccccctcggtccctctcctcgtccccccccaggcgctgcccctcgaggccaggacccccgcgatggtcgccaatctctccgtccaaacccttcttcactttcgatcgtagatagccgagatcagaaagtccaacatcacatgatgaagacgcaaatttcttcttgtccttttcgtcctcctccccctcttcctcctcctcctcctcctcctcctcctcctcctccccattctcctcctcgctctccccctcgccgtcatccgtggcaacacccctgcctctcctttcgccgccggatggccgccgatgttcactcccctccctcccctctcccggcttccaccgtagtccctcacgccgctcgcctcgatccagcttctgcccctccgatgtgaggcccacgtcgtcgtttccccaaaacttggtttgagaacgcggcatcattgttgccagaaactcgtccttgctcacacgtcgctgcttctttgtcttggcgttgtcctcttccttcgtccccccgaccttctcctggcccccgaggtccgccaccaagtgagcttcttcgctctgctcgcgaagtcgcttagccgtacctccagcgtcctctccgtgtactgtgctatactttcgtttcgatgcctgatcgctgtcgctgctgctcttcccgccggcacctttcttctcgaagtgagagctc

SEQ ID NO: 2261 - DNA, 703 bp, Nannochloropsis_gaditana
cggggcagctcgctcgcccctcgaggcatagccgcctcaacgaccagccgtgatgtgtctaagaaagtcttattgaagaatgctagtgcagtacgagcctctgactcggtcttaaagcccaggaacgccattttccgggactcccccgttttggtacggaggagcttcgcatcggtcaccgtcccgtgctgtccgaagtgttccttgagtcgtcgctcgtccacgtgtttgggcacatttttgacacacaaacgggtgaatcccgcattggaagcgggtggatcaggcgccattgtgcttctgcagcatcggcaggggggcaggagatactacgcgtgaggccatcggaacgagaagcagaggagcacgaggccccctgaaagaaaccgcaagggaagcatactgtcgcatgcaaaggacatcatagtcccgaatttttatgaaaaattcacccatatgagaaatggaacacgcggacgctaccttgccacgtccaaaactgtgataaaatcattaccgtctccctggggggggggaggtcgctatctgagagcgtgccaaagcacatctagcatcaaacagcgaggacaggctgaagccgcctatgttcttgctgcaacaagactttttgtaccacgcgtcagagtcctgacttccacacaccgcacaggctcgaagagcgcgaggggtcaagtgcgccatg

SEQ ID NO: 2262 - DNA, 703 bp, Nannochloropsis_gaditana
cactccatcgacttccgccttgcccttcgaatgcttctcgctccccttggtaactccctcggacaccgtgatggctttgacaggtgtaaccgtcagcagacccgctcattggctgtggcggcggcccacgacggaaattcctgctctccccccctccttcctcctcctcgcttcctccttcataaagctcgtacatcggaggcgatgcaatgacaggagattgctgcatcgcaaactcttcactgcacgttgcgccttgctgcgcattcaactgctgggcaatccgacggaggtccttagcgctgtctgttttagcgtggacttttaggatgctctgcttagccccacacatcctgcaagcccacttggaatttttggtttcttggttgggggagaaaatgcgacattggtagcattgaagcaggacgaaggacggcatgaggatctcctgtatcacagtggcataaatgtaggcaaaattatagcaaacctagttgctgtattttgagcgagtctgcggcgaaagggaggcttgaaagtgtgcttgtggcggggagggaaagattaaatgcagcgagcacggcttgcagtgctcaaggcacatctaccataccccattctcaaaagagtacagaaagatcacggttcagtgcggtcgggcgggcgtgtcgattgagagaagaggagacgagtaaaacgcatg

SEQ ID NO: 2263 - DNA, 703 bp, Nannochloropsis_gaditana
atgccatcatgaagcccctcccgaccttcgcaaggtgcaagtggaggatgagggagacacagatgctacgtagtgccctcatttggaagcttgctgccacgtttcaacctctgtaattggcacaggtctgatttaatacgcagtggtttatctgttcgtgcgttaaagtgagttaaatgatcggtagagataaaataatgccgggccccctgagtgggccatgtgccttcaatctcaggaatgatatcatcgagcggtcgaggctgctgttgcctttttcctttctttaatccgcatgcgacgtatttcacttgttacctagacatgcgttctttttcacgtacttgcaggcatttcctcccaatggttcacgctcagtgcttgacttctaccaaagccatggctcccccgctaaagtagcctctcccccgtatgcttccttcgtacatgttttcaccctcacacccgcctttgttaattatcatcgttgaaaggccttcaggctatacacgacagagagcgaaaagcttaaggaatgggcgtgtatggcataggaagcagtacaagcaccgaaaagcctaaacgactaagaagacgaggccagcctgcgctcaagccctcctccgccgtgcttgtgctggcagtccttgtggcctctgccaccgtgcgcgctttcgtacctacccgtgcacctttcaagatg

SEQ ID NO: 2264 - DNA, 703 bp, Nannochloropsis_gaditana
tctgtcacaacacgaagccagaagttataactggagtcaagactatgactgtcaagatgtccattccatgcctcaagcacacataaacgaagactttcatcacagaagcgcgaaggcaagcgtgattgaagcgcgctgctatatgacgtatatgtagtgactttaaaaaaaaaagacattcgcttcgtaagtgctgctgttttgcttgatcaaaagtgcacatgaggactttgatgtcgtatctgatgcatgcgcatcgaaattccgggtgaacatgcttgctcgatgtacataacattgttttattcgctccagcaaggatctcatcaggagaactccggcatccgtattcgatgacctccccccttcacgcggtcgatgcttcgcatgacgctgcatgggatgtcacgtatggcaagcatgaatggacgaggcttgatggcggtaaggattcctttctgaaagcctggaaatagaggacatgtagcaattatccaatttggagccgaatcgaggctgcacgccttgagccctctttctctcatgcttgcagatcctttttgcttgccaatgatcgacgggcgggaaggagggcacgaaatcaaatgccacttggcgcacgagtggcgattgcatgggcatgaagtcatttgtacgcggggatgaaggggttgcatggtgaaaaaatgacaggtgatcgatg

SEQ ID NO: 2265 - DNA, 703 bp, Nannochloropsis_gaditana
tgccttcttttcatccctcgttcccgcggcacaacgtgaattctctcctcgttccctcaaaggtcatcccgacctattgcgcattatcattagccagccagatactcgcaccatcaaggtattttccatcatgatcccgtcaagatctcttgtaacatgtcctttgggacatggggaggtaagagcgctgccacagtgtgcgtatcaggcgcctcacaagcgaagagcggaggagtggtggccagcgactttctttccggggcccgccctggctgggtgatgggggttcacttgtcgtctataataacgtgtgatctctgggcatccgcacggtgtcttgcgccgtagtcattttggtggcaggggttgtgtgtcggaggatgtagggcggtgagagggaggcggcctggagaccacaagcatcgccagcctgtgtggctgctgccctcgagctctgacttttatcccaagcactctcacgtgtacggtgcgaagctgtcatgatgagcagttttgtcgatgcatcccgagaaatctctttcacggagagaaatagaatcgcggactgcacagaaaagctgcatatcgaccttcctaaggccatcgagggaggcaattttgctcgatgggaggcgtatcggtgtgccttcatctttcttttaatgctcataacctccctctatcttcaaattgtatagtcatg

SEQ ID NO: 2266 - DNA, 703 bp, Nannochloropsis_gaditana
aaaaaagggggcggggggggtctgaggaggcaccgtgagggcatcgcgatcaagcaattgcatggttgccacgcatgcaggtctggcttcgagcatcttacctgttccgcacgcttgctgaaacgcaatcgtccctcccttgagccatctctgtaatcagggtccgggacaatggtaggaggagtgcccgcgctcatgacgtatgtctgagagatgcggagaggttgctgtgagcattaaggctgaattatgagcagcacatgacgaagcccccgaaatatttgagttgttggtgagatatgcattgcatggcaatatgtgcattgagtcccacgccttcactgagggcgaccgtagcaaaaaggaggcgtttctagggtttcagccacctccactgccagacgggcactactctccctgtacccccccgcctcgtctgcctgcccccagaaccagcgtcaacaaatcttatttcaagcgcagtcctcattacaggcatcacaacagcctcgttcaccagcgctttggaggtgaacccttcggtgacaaattttggctgaaacccgacgcggcgggaggggttcccacacgcagggcttgcgggttcagatatatattgcggcgcacaagaaagcaggcatcattcgctctggtagcagctttgttggttgaggattgttgaatacacatcattacccacatg

SEQ ID NO: 2267 - DNA, 703 bp, Nannochloropsis_gaditana
tgccgcaagcacctccttcctgcgcacgtacctagacacacacaatgccctttgaccctcccctttatgccctgcttgagccacagcatactcacatgctgcgcagggtgtgggccaccctgcacaggctggaatgatcgcgtaggttggattgggcttcctgcctgaatgtatcttgggctggctcaatcgctcgcgtccgttcgcttcattcctatggcgtggcccggcgacagtctagccaacaaacaaggccaaagtaaaacgattcatcccgattgtatcaccatagtgtgggtggggtcagcgtgtcatgtcgatgttttttggggcagtgtcttgacttcatgttgccatactttacccttctggccctcatcgttggctgggctctacttgggatcaagccaggagcctccagcctcccctcaacccctctcttgctctgaccttgtgcgaaaaaaaacataaggcaacacagtacaccatggccagaagaagattacatggacctgcgctgcattcaagtgtcttcttgctgttttccctgcttcccacatctagcgcgttcctcaccccttgccgtccggccctccagtcccaacaccaactctcccaccccgcagcactttccacaccgtctcccttttgtggctgccaacatgatggacggctacctctttctctttctgcgactacgatg

SEQ ID NO: 2268 - DNA, 703 bp, Nannochloropsis_gaditana
gccttagaatgcctcaaaaaagaacttctcgtgcatttatgattacaggcacatcttcgggaggttcgccattttctaagttcacaaggttttgaagttgaggagaatatcttggttcgaggaaattgcttgatggaaacatttgaggagaaggtcggaaaagaccacggcttcgtagatttccataatgcgaaagctagcatgagaagtcaataacctgaaaaagatggagatactctggatttggattttacttccagaagaaaggggaggagaagtgaggatgattagatgctagcccttataagacaaaggaaccaattgttgaaataaagctttcgagcgctcaaatggccaatattacatgcaattcgacatccgatacacaaaagcgcggaaacaaaggacttttgtgatcctttggcgcgtctcaccaggcccataggagcgtgatgtcacggagagggaagcagtaagatcctcacgtgaccctcggctgccgcagacccagccatggtagctcctcctcattgtttcccagctttcttcatagccatcttccgtctgtacacataccttcttgatatgcaacggatacaggactggagaccgcctgttggagactgtatctcaggtgacttttcctagggctagttcagaaagaccctgaaagttgcgaaaacacaagccccttcctgacatg

SEQ ID NO: 2269 - DNA, 703 bp, Nannochloropsis_gaditana
aggagcgcaaggtggcggctttgaagtcgatatcggcgtgtcctgggtattcatgggagacgggttcctgtgttcttgtacagaaagcgattcgccgcgtctgcgagtataaggggaatcgggaattgacacgtcccggcacaggttaacaaaataaaggaaattactttgctcaagacttgcacacaagacctttgaagacgtcgcagcctgcaggaaaactattcgaaaacggtattacccccactgctttgagtcaagggttcaactccgatgcggggggtgcgtgtcactccaagtatccttgtccggcattggccagaacattctgttctcaatatgtgttaagcaagagctagagatggtcaacatgggacgttggcttgtatatattcatttcccgttctgttcgctgcatcaaattactcgagagacagggcggctggagttggcatttgccagttgtaactatcccaagtcgtgccacaggggcatgacaaccccccttccaaactgtacagcgacatgatcaattccatgacaccactcactttaagaatacatacatcacaggtaccctgttgggttgccagtgcgggggtcttgatctggaggacagatagagcacgagacagaacgagaagcagggcagtgtaaaaatctatatttcggctgcggaaacatagaaatcctccatatcatg

SEQ ID NO: 2270 - DNA, 703 bp, Nannochloropsis_gaditana
gctaggtcgaagattaacggctgatgcgccgtttcgctccaaaaccgtttcaaatttccgaaggcgacaccagcttcaaccgcccattgcctctcactcttccctctcatcgttcgtttcgttccttcccatgctttcctatctgtttgcttggtcaacatgaaatgttgcgtagaatcgtgtttgcttgcgtccttaaaaaaggcagtgtctacagtacgaaaacaaatgtagagcccatgagaactagagtctgtggccactgattagtagacgataccctcttatacagcaccgttgcgtgcacccggttgctttgaaattcttataagctttgtgtaagaatttcaagcactatgcctccatcgtctacactctctctacggattacagctcctctttcattactatgatttgggggttgattgtcatattttcttgtatctcacagcgcttgaaatcaagacaaaatcaattgttttgactttatgggccttgtatgcgataaaactgatatagagcgttctacctttggcgtaacatggaaatttttgagtagaaacatggaccaaatgttgacatgttcgtgctcatgtcgccgtagcaagcatttcctctaacgctaccttttgtatctgtctaatccttttgacactcaacaggaacgaactactacacatttatctgtacttgacgcaccatg

SEQ ID NO: 2271 - DNA, 703 bp, Nannochloropsis_gaditana
aggttctgttcatcaaccgagggaaagttcgtggacaaggcaccatgcaggagctcttggtaagcttggaatcaccttttgctttttgtcgcggaaggagtttgatcaaatctttcgtctctctaggtcagaggttttttccctgacgccatggtggagatgaacgccacagagagcactgtaaaattgacggagatggctactgaagcccaaccagaggcatcagatatagaagcgacggtaagacaatgagacacgtatgtataaatgttaaaatattttctcctctagatggacattggtagcctctagcgtagtttattcgccgaattgctcttccctttctcatattctgcctagttgtcgcccactttagcgctgaagaaacaagcaagtcaccttcacaagctccctcccttcttgcctacgcggacgatgagcaatatccaggaaagtggagacaatagcgacacggagtcccttgacacggaagaagaaggtaacaatgggaaaatcgtagagacttatatgggcatacattgaatttaaacttaatcggtacgcagacaaggtattgcaacagcaaatgtgctttgacccatgcgagacttaacttttgactgctttcgcacagatgttgaaatgcttcctccgaagattcccacactggtcaagcgcttctccgaaagtcttaaaaggatcc

SEQ ID NO: 2272 - DNA, 703 bp, Nannochloropsis_gaditana
agcaagagatgcactacaacgtcaacaatgatagccccacatgctcggctctcctcaactgacacacggcctcatcctgacaggtgtggataaatggatttttcgacggcatcagccccttctttgtattcctctacgcaccaatattatccttcgcctcgtcaaatgaagcctgcattcgactacctaccacattccccccccgtacctgcggcctcattgatgccatttccgtacacacgtcacctcgatggtttcctccaacataaggactgggcgaatgtgcaggtcagaaagacaagtcaactgacaatcctgtcaattcgtgagacttttcgggcgctgcgaccggtacgtttgttctacgtctaagcttttatcttcatacttctctaggacacagtgaaagacgcgctttttttttgcgcccgtgctttgcaagagcagcatgacgagataattgctcttcagaggcagctaatagatattcaggtgaggtggataaggtgagggatcgaggacaacatcacaacatccggtgccagactccagagccccgtgcgttctcatggagcgatgataatatgactgttgctttaaatactagtataaaaatcattgtttaatgacccgttccttcaatgcacagagaaaggaagtatcgaatattgtgccggaattagagaggaaggttgccgcaatg

SEQ ID NO: 2273 - DNA, 703 bp, Nannochloropsis_gaditana
tcaggtactcctcacgcacactgtatgggtagccaacgggtaaaaatgtggcactaatgccatgaatgattgaagatcctaaggcgcgtggagcaagaagggcgcgccagagtagcccatgccgggcatcatcgcgaacgagagttttcgcagacgatgaggcataataatgtgctgtgtgggcccgaggattgtgtatgtccgtctccgttgctatcgggtaggtttccatgctgttgatgtgtgcgcagtgggatcagacgtcaagaaacgtgcttgagtgacggggcaggctgtgactagattgaagaacgcaacactttgaagtttcggtgctttacatgggccgccatgcattctagccaaagtttctgcaggcatcgtcaaacgtcgcagagttcaatgtaaaagagggattcctttaatttttcgaaaattgtgtgtaattaggacgaggagtaaatccagttttctctacgttcatcctcttgaggccgttagacgtttcttctttgatagcatggctgctccgatcttctcttgggttcggttcattaacagattaccgccgcctttcaggcaccttggacaatgcgtatccgtacagacaaaccaattatatagatatgttacttcaataggcgaaatgagcgcaaatagcgacagcgcagcggcgcgagctttgcagcattatacttccatg

SEQ ID NO: 2274 - DNA, 703 bp, Nannochloropsis_gaditana
acgtcgatggctcctgatgcccgcagcttttgtcggacgtgggcctttatctcggggagggtggttgtaaagtgatgctgacactcctggcattcagggtatttttcattaccatcatcagccatgtgccgtgctgtcaagtctgaaaaggcgcggggaaaaaaagtgaaaaaagaaatcgcgttttctagcaaggccagacagcgacgagaaaaagtatttgttccatccgccggatttttgaacttttttcctagcagcgagaagaaggctatgcgccttccgcagtcaccaggagatactacttgtctcaccagctcatccgactcgcactgcattcggaggcttagaatcaaaagatcgtcgtgacacattgagagcatgtgctgcagggtgaaagggtagccgaatggagcggatttctagggcagaaaagcaactgagatgacaacgtcatctcgctcatgctgtcttccgccttactaacgttccccctcctttgagagccccaaaaagtacttaacgacgatatgaacacacatttctacccaggaatccattgaaagcgccctggtgaggcgttgcttggcttttcgcattccttcatcactttaaaggcacaggattcttatcaatattccccgtcggataatcgaggcaggtggacagagacggagtgaaggccattggaaacagaaccatg

SEQ ID NO: 2275 - DNA, 703 bp, Nannochloropsis_gaditana
gtgttgggttttcaatgaactaaaccgccttcgatttgctttgaggtcggtttatcacgatcatgttcctgcccactgataaatgcaaaccaagaatactcgtaccggaacaatgcttgaccgtgagcatcccattgctttactccgttcgcatccaaggaatgtacgtttgtgtgcgcccttagaacttcgtgtctcgctcaaaacaaaacgtcggtgtcgccattttttatccccctacccgaggagcggcgtttcggactaggagcgtcgaacgtaaatgctgttttttgcacgaccatttttggatttttgtccttttccataccgtgtgctccactcattccgtgcatatctggtctattcaacaccacagggcggactatggatgacggggacccgctctcgcatcctgccattcagctgcaagtgtctccccccccgtctgccgctaaggggagaagcagcagcaacagcagcaacagtagcagtggcagtggcagtagtttcagcagccatgccagcacagtcagcgtttggcgacgtcaacaacaacaacaaccgagacagcagcagcagcagcagcagcgtgtgacaccgtctcctgagtcgggtctcggggcggtggatcgaacagtggggggcggagaagcagatacgacaacagcccccacggcgatcaagacacagcacagtagcgatg

SEQ ID NO: 2276 - DNA, 703 bp, Nannochloropsis_gaditana
agagcttgatcgatgtacaatagggaaagataatcaagcccatgtatccgcggtactcatcacttgacagccgtatctttcattcatcctccaagcagacgggcggctccatacaaatcggtccttgatacatggcggagctaaatgttgcggcctcctcttcgctccccgtcaaggagaaagcccttcagctgttgcgagcaggccccctaccaaagctcattgtcttagatttggattacaccctctggcaggcttacgtcgattcaacaagcggtccaccttttgtctaccacaaacaggagcaagcagtccttgataagtaagtctctcgccgttttcacgtaatcctcgagtcagatttctgtctgttcagtcaggcccaacacattcctgattgccacactgctttaattcgttgtgatcttttggttgtcgtgacttgtcctctcggtttataagtgctcgtgttgttgccgattcgacagtgtagcaacatgttcgctcttgactgatgtgaactttttaacagacgaaaatgggagatcgaagcgtttgaacatactcgaccattgctacaagcacttatggaggcaaatacgcaggtggcctttgcatctcgcacagaagagccagcttgggcaaatgaagttataagcatatttgaaattgacgaacaaggacgatgcctaagcgactacgc

SEQ ID NO: 2277 - DNA, 703 bp, Nannochloropsis_gaditana
ccgcaatcgtgacggggctgctatcggatttctcgatcgccgcacgtttcgtttcaatcaaagttttttgcagcctttttgctgcgatgccagctttacgagccgtattgattgctacagttagctcatcttggaggtttgtcgttgtcatgcagagccacgggcgagaatttgtgcgggagggccgacgaatagagctaaaagccatggccacccgaccggacaaaaataagaacagggccaaaaaaatatgaggcgacgaaatcatagcctgtttttggggcaaatggaggcgttgcatttcgcgtcaataccaaaaggaaggatgagtttctacctcccacctcgccgttaggctcccccacgagcaacggactcgggacaaggagaaggcgaggctcgacctgaaacccagttcttgccaccatgttcaaacgctcgcaccattccttagtcacttcgaactcacggagaaggacatgaagcacacgttcgctaccccggtctcggatgccgacgagaatcgacgggcgccgagtgcgaggcgagggcatgccctcatgggccctgcgaggacctcgatctcgctgccctggctaggtgaaagtcggcttcgaatgaatagtctcactcccttcttgtcgcacgcacagacttgcaagggagaataggctttgacaggttggctgcacactcaagcatg

SEQ ID NO: 2278 - DNA, 703 bp, Nannochloropsis_gaditana
tgtcagtctagttgcgcctcgtggcacgtgcttcgaagttcaatattgataagttttctatcttcaaaaatctgacgtgccataatatttgattatagtcccccttttgccaaagaacgaatgacagaaaagtggcgtgtacgctctaatgctacgcaattatcttcctctcatcccttgcctcccctcctcccgctttctttgcagcagtgcatcttcagttgaaatcgagaatgtaaaatgaaacattgcataacatgtcacataggggcaatgatggctttccaggccgctttaaagacatctttccgggcttgactacgacggcgccacaaacggcaaggcagaccgtttttccaacggttttttcaaacgacagtttaaaaacacgagactagtcagggaatggaaggagtgggatacctccatgccactgcgcgtacttgttgttcaattaatctaaataggctaacagattgcaacgatgtttcttttaaaatgtatttaatgatgctgtactgtgcgccttagaaaatggagttataaagtggcgctcctgtgctccatttccgagaggctcaacgcacacagttcttttcgatccaccccgtcgcgtacttagttccctcatttggagctgctttgcgtctaacatatatttatccactccgcacaagaatttcaaaagggaatccatagtatg

SEQ ID NO: 2279 - DNA, 703 bp, Nannochloropsis_gaditana
ctatggcgcccagaactcgctcaccgtgtcctaccagacgcaaccctctcttcaaaataaaacaatcaacactttccgatgcctgtgtcccggtcacaacggttttcattgcgcggaaaagttaactttactcaagaaaacgtacgaaaggaaatattttggctggctggctgggtggcaaccctctcttcaacataaaacaatcaacactttccgatgcctgtatcccggtcacaacggttttcattgcgcggaaaagttaactttactcaagaaaacgtacgaaaggaaatattttggccctgggcccggactgaaggcggagcccggggccgccacggtgggagcaacagacgctaccccagcgctctctcttgcggcattatttctttctcagaccgtgttcaagagcacgattagttgaatttcacacattggtgcacatctgccaccacaaatatccctgcgataaggtgctcctctgtcgtgcacttcaactagtgtccttgattccctcactcgacgacctcgccaaccgcgctctcccgcgtgggcgacggtcctttgggtctgcgacacacagtagtctctccaggtacaacaacgcgtggacgctgtcctgttgtcccgtcccacctatccctttgacagcagctcacatacatcggcgcctttaaggcacagggagagatctaggatcatg

SEQ ID NO: 2280 - DNA, 703 bp, Nannochloropsis_gaditana
tgacgtccacgtacttcacaccattgggtgtctctcggattttgttggggttcaccttcctcactttgacaggggattcctccgccaggacctgtagcggccatgccaaggtcgttgccgtgctgcctcccgtggccagtgccaccgcccccagcatgcctgtaaatcctactgcttctcgccgtaccgcaacacccttttcttttgcatatctggcccaagacgtaggagttgttgtcatggagggtacaacgtaagctgtcgtgataaccaggagaagcaggttgctgcagaggtgcagaagccgtgaagcacccatgatggcgttctgtgggaagatcagataactcaaaaagtcatgtcaagtacatatttttagatgtcttggtgtcacaaaacgccattgcgcaggggctttcagtttccattccaaagtgtccttaaaaagtgagcgggtcatcgcccagcgagcaggcaagccagggctagggctgtaagttgactactggactgaagagctcagcaataaagacacataatcatttcgataaagccttaattctcaaattataccttataaaagacacacttggtcgcagcatagggcttcattacgttgtggatagtcagaaacctgtccgttaagttatcagttgcagtaaaattacctttataaagcacccattcctgtaccacgagaatg

SEQ ID NO: 2281 - DNA, 703 bp, Nannochloropsis_gaditana
caggtctgattgcaacatctttatctttggctgatatgctagttctcagtgagtgaagtaagacctgggctcccgggccgaaagaatccgtcgtaaggagggtgacgaaggcatgctccgcccgggaagatgggccaatgatttcgccgttcgcaatgcccttccttgcaacgggacgggacatctgataaagagtgagaaattttccaaaacatgagtggagggactgtcatggtcagagtccggaattacaagtcatttccaaaaaattgctactaccaccaagttgagggaggaggctgcggttaggaggttttacccggctttatcacgtccaggagtaacgtcaaactatgctcggtccttgctatagggttgtccacactcttacccaagtacaagcatcatgccattttcaagtgtttgggaggtgccgggcagctaacatcctaaactaaactactcggcgtcgcttacagcgagacgaagcggctctttgttcttcaacgccgagctccccgcccccggccttgctcctctcacactcaatcacgctcttaccacacagaggatgctcaaatggagtctttggatcgtatggctaccttttctagtcttgagccgcccaacctttttgcattccttttctaaagcgaattacatgtggtcaagcctgttaccattctcaaaatcaagagccatg

SEQ ID NO: 2282 - DNA, 703 bp, Nannochloropsis_gaditana
gtcggagactccccacccccgcggccccttcacatctggcagacggacggcaggcccatgagcggggacatcgggcgcggaaccaccttgagtgccgttaaattcgctcaagtcgtgctccgatcccaagccctgccatgggccagctccatggtgtcagaagatgagcactttcttcagttagcgggaggaacgaacgcctacacggcagaaaagctcgctgacgagggcctgctctctccggcatcggtggtgagaggtcagagtgacgcgactcaagagaaggatcgctccgcgtgggtgcatggtttggctttcgggggctttgcgcgtatggaagtagaccgcatcatgagccagtggggcctgggacccgaggcctctctgattgaagcacctcccgacgccttgctcgctgtgcttagggccgcttttggagtggtgcggccgatcaagaagaggtagcgttgggccttttctgtgcaaagcaagatattaaattcaagtgtagatattgtacaaagaatcagttcaagtcatgagagattacggacatttttttttcaaagtcgctgtgccgagaggaatggagaggaggttaatttaacaacgtgcttgaagttacctcaagcctttcttttccactttgtaaccctcagaagcttcaactgattctagataaaaccgatcacctccgctcaca

SEQ ID NO: 2283 - DNA, 703 bp, Nannochloropsis_gaditana
gtcgcctcggagactcttgagtcgagaagatctgaatgtttattattcgatgtgtgtcaacaatagtgccgtcgcgttttctgatccactcgtctcacgccatgcacgcaaaagtatagagtgtgggaccgaagagttttctgaaattgtggggaaattagtacgaccagcaagtagacaagtttgtccctgaccgtgtcgctcgctgtcagcattcagaagcgtaacagatctcaaatttcgacaggagcaagtcatgcccggggtcacccgaaggagaccagtcgctgccccaggattggccatagctattattgcgtgcagttggcatctgaatccttgtgatgcgtttcaagcttcatcgtcatcaagcagacagcggcagctgcagcatggaaggcagattcagcatcacacgacttccctgagaaaacagggggagggcttcgatgcttttaaatcaccagcgtcaagaaggacgcaagagacgtctacctcgacctcttcctcaactgccccatctcctgcacctccaaacgcgccctcaccttctgttgtccctatttcctctccctccttttcctcctcaaagcccctggaaggaactttattggagacccggtcatacttctctgtagaatttcttgcgcatcgcatgtcgtcttctgcaacactcgctgctacaggggtacccaggcgcatg

SEQ ID NO: 2284 - DNA, 703 bp, Nannochloropsis_gaditana
gaggtcagtgtcgttgtcctcatcataatcatcctcaaacgttaatttgaaatgcgcagtcggaggaggaggtggaagaggagaaggaagagatgcaggagaggaaagaagatgaggaggtagagaagagggaggagaaggagaagatggcggaggcaaacccgaaggatgttgggaagataacgagacagaggctgccgagaaagatttgcaatgttttggcgagatgggtggcctgaagccccacccaggtttgtaaggcataatgtcctaaagggtacgtgtagtcgcggggggtacgggaggagagtaatttcaattaattatttgatcgggaggagggagagcgaagacccaagaagggatgagagcgatgagtatgtatgtctctagggcccaggctgctccaatggacggcttctggctctgcgaatagaaataaagagggaagggggaggagggaggggtggggaggttgaggcggcgattccggccccctgcccctctccctccgagtcgcgggtcatgtcggtgcaggaagcgagtgggtgccgccttccaccctctctgcatccttggagctgggtgttccttggagtgcaagccatcatgcacgccgttgaagcagaatcactttcatcctctacgcgacactctctcagcttcctgaactcactgaaccatggcataatagggattcatg

SEQ ID NO: 2285 - DNA, 703 bp, Nannochloropsis_gaditana
ccccgcacacaggacataggcagtcggacaagtgtggatgtaggacttcatgagcggagaacaagtcgcgcaggcgaataaattttcgagacaacgcacgtgaatatgtttgattggtgggaaggtgacttaaggcctgtttccaaaggtaatcgaggcgtaagagcagggccggctcgacgttgtcagaggcgggcttgccccgctgagcggaaatcgacagcctcggagcaagtgcagacgaaggcactctgaagctctcgagaaggcgactaaatgcaccggaaatccttatcgtcgccggatccatgcgtctggcatagagatggcttcgtttccttagtccactgcaacgctatttaggggggtgacaaagctcactgcgctgacctggcgagagccacggcatgcgctcgtacgttccctgtcaggctgtgtgcaaagattgcagcgttgtcatggtttgttcatttgtttcccccattggttccgttcattctgtgtctcagtgggtcatttttagagcgagcacgtgaagcggcgcacgtcgctcgtcgctggaggtagtacactctgtctcatcgccccgccttcttcgtattttctgcggcgccgcacacacatctcttacctcctacgcacgctcaaacaggcaccacaaccgaccacagcacgaacagtacctttaagcggcaggcttatg

SEQ ID NO: 2286 - DNA, 703 bp, Nannochloropsis_gaditana
ctacgcacccggacctgacggcaacgggaggtgagaatgagggccagggcggagatggcgcccgagtgacccaatcgagcgacccgttggacatatttgaggcacctcctgctgcacgagtttgtgcactcggagacgcccaatctttaagcccggcggctttgaatgccttagagttggacgatgaccgcgacccgccagtgaagtgaccttacctcgaacatttggataagttacgaatacatatcagggatagcagagagacacgacacaagaaatgtatagatatttttgtaaaagataaggttggaatcataaatcaattatcagtcagtgaagacacctttaagggcgttgtattctgggggggtatggagtaaagtattccactcaagcaagacttatcaattacttgcgtgccattgtttgccagtagaaatacgggcctttgagtgcagtaatagcccattgctccccttcgattgcatctatttcttgtttgcccatctaaaccgtgtcccctactactactagtagtacgcctgcctccgagaacgcgagcagccgggtgcgattgagttgattaaatgcggactgtttctccagatgcacggggcacgtgacatccacgactcacatttggttttccatacatgtttcgctcgattacaaggtctgataaattcgcgctatcgtgtctatg

SEQ ID NO: 2287 - DNA, 703 bp, Nannochloropsis_gaditana
atgcattgctaacttcgtcgccccacagcctgcagagcccatcatgggaagcgccagaagacatggcggcctttatcatggaagtcccggtcccagctagaagctggttgtcagagatgggcccgcgccttaccgagagcgcgtgtactgtgtcaccgctctcctcgccctcgcagaccttcgatcccacggcctcggctctggggtccgccgtctcaggcatgcccctggactcggacgaagaggccacacaggtgtccctgagcgctctcccagctgcccaggctccggggggcggagtccctgcggggccagtcttctcgctgcgtacagcagccccagccagggagcgacttaagtcctcatcagttgaatgcattggcaacctctagggcctagggccactcggtctcaaagctagcttgagcgggctatctccatagcggccacggcgcgtgagcccctgccgcgcgagcagcgggattcctaccccccaaagcttgcttcagccaagcaaccgcgcccggccttcgatatccagattccgaccttgtcctccgccttgggttcgggccccagcagcgcacctgcggccggcataagtaaccggagctacttgttcgcggaaggcggcagtgaaggcgggcgtatccggggcagctttggtcagtggcaggaggctctcaaacttctcagcgagatg

SEQ ID NO: 2288 - DNA, 703 bp, Nannochloropsis_gaditana
agaccgggaaggcgccgagctgataccaaggccatcaaaaagcatgtagaattaaatgttgtacaatgaatttcaaaatatgtcgacttttatctcgagaagacttttgttaccacctcgaagacggggggactaacctcccccgtgccctctctctggccttgctgttgctttgcactacagttttcgccgcatgattgtaatgtccatagtcttaagcatgtcctaggattcttgacatggcttgtaactttcgccttttccgcacgccttaaaacccgcatatttgccctctattcgacgcccgcccctcgcccgccccactcgccggtgctcgtgaccgcatggccgtgagatcgccgcctcagatcatgccatttctgtcacacgagctttggaaggatttatgaccccgaaagccacttagttcttcggatcgtttgagggacattggatatcggtgtccaaaggcgtcggaaccctctttccctctggaggggtttagggtcgtaattcagtcttcttcactcccaaagaggacaacgttgaaaaacatccgtaccaggtgcagaaatttattccccccttcaacgtgatctcatcgcatcacgtatgaacaggaaatctttaagcgagggtttacggcttctcgacatattttgctcattcgcgggtgcgtcgttgctgtggtgagcgcggcatg

SEQ ID NO: 2289 - DNA, 703 bp, Nannochloropsis_gaditana
aggggcataaatctcgagaaatgttccttctaagttttgtgcgagagtcacctacataaaacgagaaaaggagactcactagctcgaactagatgtcagcagtaatcttcgcactaggtataaggtacttagagaggagaggaaatttctgtggggcaacgtcgccacagctgtgcacttcaagggatcacattgtaagaattacgtgcaacttaaaattgatgagttttctgaataaacagcgtgagaatgatccagatttgcagaaaagtgggtcaagtttacgagccgtgaagtttgataattgtgcggaacaaaggtcttaaacagtctctcctgtacaccaagaataagcaccaaaatattattttccggaggattatgggtatttgttcttccttcatcgtgcacaacacaaagaaagatataccatgttaccagctctatgtggcggggaggttaaatgtttatgggccaggatggttggtgatacagtaaaaaagacaagtgtgatacaaaagttttatgtttgtgtttatcgcgttgaaaaagacactaggtattttgaaaaatcaagattaactgaagttaaggggcgtgctttctcaccaggacgcactcaacaagatatgacaaccgcaccaactttctcctaggcgctttcgcaatgcgacggtcatgtatgcgaagcaacccacagtgt

SEQ ID NO: 2290 - DNA, 703 bp, Nannochloropsis_gaditana
cgatatatgtcacgatctgtgatgccttttctcacctcaacgagactgcgcagaaattgtatccaggtcgccgagagcgatgtctcacggtctgtgatgttgaatatcagagctgagggcagtattgacacggtggcatttaggcacacgcggtctgccggccctgcatcgtgccggacttaccgcaatgcacggcgttgagtgcatgccttttccgggaggttggcactggctatgtggtcaaattgccacgtatgttacactccgccgggcatatgcctaggtgaaggtcaacaagaaagatactgcagcaggcagcctctccctgcgcgtcaggaggcacagggggatggcatgttccgatgctggcttgacgcattacttgcacgcccttttctaaactttggtctttgggcagctttatgagcggcctgtacgaggctcccagttcgcgttgtaattgacagcatttttttgtagtacatcggttcgagcccgaagcctgctcagcggcagcacccgaagcagaaactctcatcgtacatagatgcatttcactaccttacaaatgagtgtttttgatgtagtagcttcttggaagacttgacgcgtgtatttgaccacaacaaaagatgaaagacctcttatttgccatcaacataaccacacaattgcctagcacttccgcttttcggaaatcatg

SEQ ID NO: 2291 - DNA, 703 bp, Nannochloropsis_gaditana
tcaatttttgcaaaaaagtctgtgtaatggggcatggcgacaggtcctcttggactctacgcttgctgctcgctgtcttcggctcggcgaggggcgaccaaggaggcccgaaaagggccacgtggacccaggtgcaggatataaaatcacgtggaccactcaagcacgtgatttagctgcgtgtggtttaaaaattttgagcttcagtgtgtgtcacacaggcgcggggccgaccacctccgtgcaagccgttatggttttccgtctcggcttgaggggtgcgtggccggctgcttcaagcctgagggggagacaaaaaaaggcacgtccctcccctgagtagaagggtcttgttcctgatggctactacctgccctcaagatatctagtttgatgtgcaacatgcaatgttctaaattgaagaggacctctgccttttaatatgtatcgcatgctctgcgggctgatttttatgtccctacaacttcaagtgttctgcttccagagcattccttttgacacatggtagcacgccaactaattctcggaaacatttggctactgctttatcttccgctctacattataagaatttctcaatgtgttctgcctgttgcgcccgtacactttcgcacgtaacatgctgtctttcgtctttattgtactaagtacagcgtatctacatccatcacaaacaactatg

SEQ ID NO: 2292 - DNA, 703 bp, Nannochloropsis_gaditana
gggcagctcctcgaccaatgttcggcataaatgcagtcgtacctccgatgccgccgcaggccatggtaatgacgaaaagcgtggtaagatgcatgcttcgctgtcggcacatggatttgagtgagagaatgaggcctttgtggagacaccgatcaatcttgcgaatgattcgcattgctattccccagggaaaaataagagaggtgaatattcctgcaaacccctcatgccgtgaatgaagtcgcaggcacagcgcgcacagtgggcaacgcagccgaagatctccggcgtccgacccgggcggcgatcctctggcatcatgccctactcattcgctgccgcccgccccagcccccgccccgcctgctgagggacgtgctgcctagacccgtgtgcctgtgctctgctcgatgcactcttgcatcctgtgtttcgggccccttgtatttatgaagtcgttcttttcctcccctgcgctctctcatttcaggcaaggggaaggcggctttagctgtggggagtctgaccccgggtctctcaagagatcaacatcagccaaatatttggcatgggtcaagatcaaagcatttcgaatcagcaatatccgtcttcatcctatcctggtgcaggtcgctcctcgggagggactaatggccctggtaatagaccaagacccactccacatgtgtccccatttcagcag

SEQ ID NO: 2293 - DNA, 703 bp, Nannochloropsis_gaditana
cggggggagagagcttgaggccttccacgagatcatgcaccagcttacgctgtcgaccgctcaggtcgagggggagggccaggcgccgggggagggcggggtcgaggcaaaagccgagggtctgggcgaccaggaggttgtcgggcacggggctggcgggacgggtggagggcgggggagaggcaggggcgaaagcgtcctccccctcgccgcccctgccctccttcgagccgcgctcggcgtcctgcccccccccgtggccggtgctccccgccttccccttgccgaccgtctccccccccaaccttcccacccctcccccgggaccccggccgcgaccttgccttcccccctgatccattggcatgccttcgcgcatttttgacaccggcgcgtccctccgtgacgtccttttcgccccgactacctccctggattcccttccctcctccgcgcccctccctccccctcctccgccccctccccactccgggaggtactccatggctgatcggatctgccccacctcctcacaatgctggagcaaggaggccaggaaggggtgcctccccaccgtttccgagtccccgaccaggcaacagtgccgtttcgcccgagtaacggccacgttcaaccgccggtcgtcccggagaaagcccacctcgcctcggagattgctccggaccaaggagagcaccactgc

SEQ ID NO: 2294 - DNA, 703 bp, Nannochloropsis_gaditana
ctgcctcccgttccccgccttggaagccgtccacggatcggacctgcagatccgggtactgcgggtgcaacagcgagcggaggcgctccacctgggcgttgtagggcgtgatgacggccacgtcggcgggggcgaggccggtgcggcggagtaaggcctggacatgggccgccacgacctgagcctcgccctcattggcccgagaagagcttaggaggctgcgggcgcgcacgggttttttgggagcgcgtggccgggagggggaggaggagggggaggagggcgggggagagggggggtctttccccgttcttcctcctccatcccgcaccccgccgtgtccaggaacaacaagactgcctccgtcatgtcctcgtccccttcctcttccccgtcctccctctcgcccttcccccagccccgccacgcgtcctcccggccacggaggggtcgggctcgcaagcgcccttggtacatcgcccgggacgcccatgcgcatatgtccgcatgcatccggtactggacctggagcatgcaggcccgcccccccgccggccccccgtatccgtcctcccgcatgagccggtcgaagagcgtcacccccagacccaaggcctccgcccgcccgctcttgaccgtgggcgcgagctgcttgtggtcccccgccagcaccacccgcccgccccgttggatggggatccag

SEQ ID NO: 2295 - DNA, 703 bp, Nannochloropsis_gaditana
cgatccaagcgttgccgatttgtcgacagaattttggattgcttgtgttgatcatgaaatatggaggttgtgtctttggggaggtacacatccgacttatcgacaatcgaaataatatgcgccatatattgcaaatgtaaaagagactatcatttctctagtaagccgcgcatctgctgttggcattccacacacaatcctacccggaattgacccttctggctttaacaagcccaggacagatgctcaaacattttgaataccaagaaatctagtctaccttccctagcaaatagatgaatatcgaacccctcgactcaagtttatactcaaacttgattgggaggttaaatgaggactgtagaagtgtcagcgccgtcgacggcgaacagaaaacccctcgtctccttagtggcaattgatgaggaaaaggatacttgttagcttgcttttttgtttagtatttatgatctctgctttcgtccttcgtacagtcgaaagcttcatgccatctcaaaatattaggctagagctgactacgtatcttcagggtggagcctaccaacgcttacgtgcacacccattgaagtaagagaaagcttttctcattgcgtgctttgtacaacttcttttccacccggcaatgctgcatttttcttcacgcctgcacaacttgcacagggtgctggggttctgctgcatg

SEQ ID NO: 2296 - DNA, 703 bp, Nannochloropsis_gaditana
acgggttcgtcagcccctgcccctcgatacgtgaccctgagataccagcccgacggcacaactcgcacctgcatcgagctcccttccctatcgtcaggccctggctatatctccgtccggaccttggagctggtgcaggcgatccggcgggagggctgcctcttcgtcctgctcaccggggcgcgcagcagcacttacctgatgcgtcggcgcacaggcctgccagtggtagactacgaatgtatcgagggcggaggcagactcattcacgaccctaacgcccgcctggacctggcgtcggacgcacacagcgaggggcatgagggctgggaccgcacgtggaaggaggccgtcgggcccctccaggggctctggggactctacgaggagctgaaaggagaagggtggggcgtggacgggcgtgactattacacgagttttcgggtagatacgaggggcaagatgggggagcagtgggagggcgtcaagagtcggtgaggtggcgcgggaagtggaggaggggaggaggagtcgagggagtggaacaaggaagatttgatttatcttcttaggggtaggcaaggatagagaatatacttttcaacagcatttaaggggagtggtgtgcttcaagcaggcacttgtattcgccaacctcaccgttcgattgccctctctcgccttgttccacactgcggcaggc

SEQ ID NO: 2297 - DNA, 703 bp, Nannochloropsis_gaditana
gggtagagaaattgacagaggagatgagacctcgaaatgtcttacggggggaggttgcatgttttacaaggtggacgacataaattgcagggaaaacacacttaaagtccatttatatcaatagactagatttatacatacaagcagactgacggcattgataagaggaaatatagactgggacaaagctttgtgggtgctggcacccctctacaccccactcccgcaagtctccctgtgctcaggcccctcttatgctcctggaattctgtctgtgataacttctaatttgcccaggacaaatgtaactacaggatgttcagtcctttatatgatcaatacgatgattaaaccaagtgtctgcgcgcttgtgcccacctcacgagttcacagcgcagacgggtgcagtcctgtatgtgcccgtcttcctcgctttttcctgcccgcagccacacagactgggtcggcgatgacgtcctgcctgtcgtccaccgcaccctgtgcacgctacagaattgactcaatcgtggcacaaaaagcatcgacttggtatacgagctttacgcattgacacacggcaggggactctgaactgtgcaccacctgctgcaatctgtgatagcttctatttcacatcacatgatcgagagcttatcttaaacccacacttcccaacatcggtaccttcttaggacgccctatg

SEQ ID NO: 2298 - DNA, 703 bp, Nannochloropsis_gaditana
atgtgcgtcctttgaacccaagtccacacttgatgtgatgctcgtagagtagtttggcgcgtcacgttaaaagttccgcatccttggaattcaatattttgctgcaacaagtgaaaccactcagattaaataatagatgaggttgtcaccaactatgtagatgtgcatgcatctgcatgtgtgtgattttctcagctcttctttggcactacgcaaagtgctttccaagggtctgcctgacccagagccaggccgtggcagttcaactaggccagaaggctaaaacaagataatcttcatgaaaagtaaaagaaattcttgagcccgtatactaatgattgtctctcttatgtagggtgttcgataaaggcagcgccgtatttcgatgcccttttcatttcccagcaaagctacccggaaggccacatgccttagatgtgtcggccttgcagtgtgatgagtgtttaccgtccaccgacatgccgaccgatgcattcggtgcatatgaattaagtgcaggcagtagtccttgaaaatctttcgtggttggcgagcgtggcatgtcttgcgggacgagggtggcagtttgattagaccattcatcatacctcaagcgaggaagaacagtgtccgtctcttcaactacttacatttctgtcttccacactgatttcatcttcgctcgtgcctgcgactaggaatg

SEQ ID NO: 2299 - DNA, 703 bp, Nannochloropsis_gaditana
caatcgagctatgatcaatgctgaagatattaaaaatagaatggagagcccaccaattcctagttcgagaccaccgcaagcaataggattacaaaccagtccgtcatattcatattttatttcatgaaggaacaaactaaatgatgcaaggtgccatgcgtctgcggaaacgcaattgggaaaaaggcccatgcgaagctaccgccacgcatgttcgcagcacgtaccggatggatacgcgatcaacaagtcgtacctgaaagcggaaaatatccctccacactttacaaaacctgtagacaaagcaattgaccatctttattcctcttctctgacattcattccccgaatttcagcgagtgtacccatcgcgttcgataaatgcgttcggcttgtgtgcatgtgcaacgtggtgggagctggtggctgcaacacagagcgaaattggaatgagcaggtcctaaatttctgactcttgaatcttagtcatccagaaagacgtctatggacgaaagatggattcttgtcacattttgagtgtacgaatgagcgcaattccaattgcttgtcttgacccgcaacagaacagtcgaccttcctctttgttcctcctttagcccgggagctttccagaaagacctcctcatacccctctttacgaattgtccatgcgttctttcgtaaacagatctcacaagtcatg

SEQ ID NO: 2300 - DNA, 703 bp, Nannochloropsis_gaditana
tattccatcactgatcacgtatggtctatcttattttactctgcatgtatcagctctgtctcaagtaagacgagtctctaggcgtgccgccatgagccaagccaatacccagatgccaagttctggaggaagttgaccgctaggactggttgccaatcctgaagagagcttcttgttcatctaaattcatgctttttgaagaagatctggcaagtgtgcgttaacagctatgttttatcattttttgggtacagggaggaagagctagaagacccacgcaagagagtgtcaggcaccgaccccgacaacggtctcctcgacgatgatggggcggatgaccatctcaagagggcgagctgtagtgtggctcacatcggtggcggccccggtggtcctttttttaaccactttgctgcttgtgaactccagatccactgcctttgtccgttctccaatccccaggaacccgcaatcccccttcagcaacttttcaggcagcaagaaagtcttgccacggtacccgtctgatccttcgtcctcccgtatcggcatgcactcaagcgccagcgcgggagccgcacctctggaagggggcctccacgtacctccgtctaagcagggcggactccgggacagactggatgctctctatcgcttcactcgaccacacaccatccgcgggaccattctcgcctccctaatg

SEQ ID NO: 2301 - DNA, 703 bp, Nannochloropsis_gaditana
acatgaaacgttaagggaggtggagaatcgaggggaagggcaacaatttacatacctccttgtcagtatagacgctgtgaatgacaatgtccaataattggcgtgtctctgcctgaaattcgtgtgcttctgctgcaggagggttcgccggttttgaagaaaaaaatcgaagcgactcgagggcgggtgggggtcggaagctgacgggataaggttggctgcacgcgtgaggacatggagtccggcccgggggggtaagggagttcaacaaataggaggccgtgcgcatgcaggagacttctttttgcgtggtcctagccagcaggcgccgacccaacgtcgggtttatgcgtaacattgatgatggggactcttttggcctatctgtataacttttgtggaatggtataaagccgtgactaagcctgacgggagcagtaagaggtatggaaatttttccatatgccctccctttccaaaatttgttatcggaggcaagaacatgtcgtggagcacatggagaagagaatcgcacaagggatagatagaaatgcctccaagcgcggggagtgagacatgaccgtggttgtccgtggaatggaacaagtcacgaggatactgcctcgcctcgccgaccccaaccagcggtccccaggtgcctgccagcatcctgctcgacttcacagacccattccattttaca

SEQ ID NO: 2302 - DNA, 703 bp, Nannochloropsis_gaditana
gtggcttgcgagcccaaagatcaggtcatgtgcgcacctgcaggcttgaaatgcgccccagcggcagcaagtctcaaaccatgtagtacgagggtcttggcttaacctcctccctacgaacgacgccgcatacattcgagtacagacggtcggtgctttttgccacgctgaatgattgagtgcgtgattctatgatcctcgcctcttcctgcgcagaacattgtaataaagaatgtgtcacatgagcttctgtgaattcagcgccaattttcgtgactcgcgggcgcgtgcattttgctcaaaactatgcaggaggtcgaggctcgtgctagtccatgccaaattctggatgtacagcgttccatcatctttcttcctcagctacaggtgatctcaaacacgtcagataataaaccccgtcctgcttgagattttagctcgcgctggctttgattcctcccgtttcgcatcgctgtggaaataaaagcccatctctttatcacgattatattttatttcacatcttacagcagaggccagagaaaagaaataaactgaactgcagcacttgttaaggtcggatctcgatagagcgaaaaaacttccttggagctacggcgccaaagtcaaacaagacgagcggtagttctgagttcatttggcaacctgttgcttagactagtaaggaggcacttgcaacatg

SEQ ID NO: 2303 - DNA, 703 bp, Nannochloropsis_gaditana
aggaggcagccatgaagccattcgtgaggctcagagctatattggggcccaaagattgcgcagatttaaacttgggcagctcttgaggagggcgctacgccgcgagggagaagatttatccttccttgtggggcattatttccacgcagaccagtcgaccgcaggaacggtatcctcctcaattcaactcccatcgctcgcttccccgactcctctgtccggcccctttcttgcctgatgaactcattccaggacctagaccatgcgtttccctaggacctattgagtcaacttgttgggaccgaatacgtccgctgatagctctcatgtgcgctcttgctttatcgaagcctagggccagcaggcgctaatgagaagcacagtacggcgaggcagagaaggattttggctccagaagacatggattcagacgatgaattcttttgacttgtcaatacatggcacctcatacacttattgtagttgagtgctttccaaagattcaaagagttgtaacgcacattcacgctgccactctgagaaagtttaaaatctatctcgacctcgcgctgtagtgagagaccatgtctttgaagaccaaagctggtgctattattgttcgtaaatccgcactccctctaatctacaccttataaatacattccgttccaggccccctatttgcgtcctatcaaccgcgatg

SEQ ID NO: 2304 - DNA, 703 bp, Nannochloropsis_gaditana
ttcctcccctctgcgtactaagtgtcagaaacgggttgtcatctggctatcgacttgacaaattagttcgatgttgaaggacgtgtcccgtgtgtttacatcacatagtgtctgcaggcggcccgtcaagccactgcctcgtacggtcgacgattgttcctcctcgctgagttttggcgcgctggcctcattccctccattttccaggggcattgagttccattttatagtgcctcgagcacgatatagaagcgcaataaaagatgcttgtatgcgcagcaagtgaggcacctgtttggtaggatttttccgctcattgaaattctcaagtgtgataagagcttggggcctaaaccagcagcgccccgatttaaatgcagccattctaggtacttttccgcgtatagcagcttattttggacttgccacaattcgacaaatgacttgagtaaactagattctaactgttgcatcgatgcgcattcagcttcttcatccgagcaattccttattcgctcttacccttcctccatctcgctactcgttcccttccacgcacagaaggcattacaaaatgatgttgcgccaggggctccggcatgcggctttttcatctatctctttcaataatatcacaaatgccgccacgaaaaaatgcacagcgacaggccttataacccggcttttctcgagtcaaggagca

SEQ ID NO: 2305 - DNA, 703 bp, Nannochloropsis_gaditana
ccaccttcgtagcagtgtgaccatcgggcttgaaatacgtaatgccaatgcttttcgcacaaatgctgattccacgctacgctcactcccgaaagcgcgacaagggtccggacaggcagacaaagctccatcaagaagaccacgtccgctggtagatgcgtcaacgggtccacgaagagcgcctgtcgcgattctgacagagaccgagcggcaacaggcacggcgctcgtctcatccaccagcatgtttcttcttgacgaacagggggccatggctgcacgcggccttacagtgctacctcaatgcggatggcctgcaactagcccggccgcgactgctggttcagacgagtcctcctggtgataaggatcagaatacagcgtgagagatggtataccggtaagtatttttcaatcaggccttggtgagaccctcatgacagaagctcaatggcaagtgtaagttggcgaggagcgagacgagacatgcgaccaaggggaaaacaacagatatgacaagacgggaaaaaacccgacaaagcagagtcatcttcggtctctgcacagtaaataatatgctggttccatttgatgctcaaggacagcttcttacgagaagtcctgcctcttctcacgttatttttcttcctttttccatggcagtagtctccgggggaagactttcttgtgctggaacgagtatg

SEQ ID NO: 2306 - DNA, 703 bp, Nannochloropsis_gaditana
atggaaagcggcatggaatgaagaataagcggcatggaatgaagaataagaatgaggcgacgaaccatgatattgctttggtccaaaaggaacgcatccgctgacgcgcgatgtactatttgctctaccaaaaccctcctgtaaccaaggacaaaaatgatactgtcaagcctatattgggttcgcgcaatttttctcttagcgagcgtcatcacccaggagtttggctggcctgtcccccatgggcgtgagccttacgtacggcactgcgtacaaacaatagttttgcgttagcatctggatgcatgaagaaagtaaagaaaaatctttagtgcctcggtgctgcattcttcaattatttgtaccattgccggtcttgaagcaatcgccaagaaagtcgtcctgttctctgccccccagctgctacaaacacattgatctatcccattctatacgccgctctgatatacaggttgctagcttgggttgtagttgagtaagtcgccaggcttgcaaggattgcggcatcggtcactcagcgttcctccgattgcgtccaccttcgcaagcagcgtcgtagacctgtcggtccccgtagccctcctctgcagaaagcagtatgatctctgcaatctttctggtaaatcagaagggggaggtcgtggtcaatcgactgtatcgggacgatgttagccggtcaatg

SEQ ID NO: 2307 - DNA, 703 bp, Nannochloropsis_gaditana; identical to SEQ ID NO: 452

SEQ ID NO: 2308 - DNA, 703 bp, Nannochloropsis_gaditana
caatcaaagcagttgggcaagtaagtgaagatcgaaccacacaaatgcccaataggttgcacgctgtacttgctttgagttcacaatagtttgtacttgctcgccattgataggtcttcaaaaccgttgccccaagtgtttgtaatactgctgccatagcagtggtcatagcattcgctacatcgctaaacattcgaaatgcgtgcatgtccgaaggtacgctcacaaagtatggcccatacaagcaggaaatatagggtggatagggtaggagaggcgggaatgtgcgacggagaatgtggtgagaggctactgatcctgaggcgcgtgcccctcttctctctcttctcatctctgcgtggcgcgtgccggcatccggttacctgagaccacttctgcccacactctcgagcacgcgttcgaaccacttgcatgagaacctcgccgtgaggtgtgcttacatgcgaaacaatctcgtgactttctgattttcaagtgtataacgagatattacgacggcacgcgcgcgacttcaaaaatgtcgtcatttcgtgttcgccttaaacgcttgcttttgaaaaactcgacatacttttcccatgccattctacgcgcgacaaagctggacccctttatcgttctcatcccatgtttcatagttgaagtcatttcaaacgtttcgctttggtttttcaggtcgatg

SEQ ID NO: 2309 - DNA, 703 bp, Nannochloropsis_gaditana
gcaaggaataagaaagaggacgaccgtcgattcaacggaaaatttgaacgtcactttcccctcctccccctctcaggttttggaaatgtttttaaccatcacccagaggtcgtgaaaaacatgcaatgctacgatcgacgtgaattcggtaaggcatggggggacactgcgcgggggagggagggaaggagggcgggagggaggattgtaacacaatccgggggaaaagagggagcgagtgagatctcattctccttcttttgcaacgatgtgaatgaaatgttctaatgtctcttgccttgcaatgatcacctcctctcccaccctgcaggcgtgcggcttcagtacttccttgcacagaaccagggtcttctggcgcgggtcatcaaagggccccacaaccgacggttttttcaggtccctcctccctcctcccttccctccctttcctttttccccctccttccaagtcctttttgtgaaggacgctagcggtaatggggcgacatgtccctcgcgctggattgccttgcctccttcagacggctgcttgcctctcttcctcactcaccgcgcgctttgtccgttctccctctctccctgcctcttcccctacctcgcactctcttagcccgtccaagtcttcttcggcctctctccccacccgactctcttcctctcctcgggttcttttcctccatcc

SEQ ID NO: 2310 - DNA, 703 bp, Nannochloropsis_gaditana
ttcatggaaaagatctacgtcacagaacttcttccatgatctttcaaaaagtatcgttcaggcaacaaaattgtagtaaaaagagcaattaaaggttatgtcttatcattacgatcgtgccacgtttatttattttaaattaaatcgctacgttgaacttaatgggtgagatttttaactgtcaggaagaaatcggggttgcaacatgaacttccgtgaaaggcccgcagccctaaccctaaaactaaatctgttttagggttgagctaatgaaaatacatgaagcttcgggatcgagtgagattctggtaaaagttgaggcacgcgccctcacaacgtctcaaatcacgtcgaagccggggaaaccgttaaatgaaacgtcttcgcacgggagagaaggcgcgtgcccctctccatctcaaaagatgtccaggttccctgcgcgtgcttctcagattgatatcctggaagaattcttggctagttctggacttgtgatttgtttcgtgggaagacatagattcaagttgggcccatatttgaagtagtgtgggtggtatgttgtacactctggtcttgcttgtaaatgttttggagcttatatttactgccagagcctcgagacacattaagatcatttccactactagttacagagaccaaataatagcagggacagcaactgaagaaattctacaccatg

SEQ ID NO: 2311 - DNA, 703 bp, Nannochloropsis_gaditana
ctggtgcgcgagcattacttgcggatcgcgcggtgcgcttggacagcattttggcacctgctagtctttccttctaccgcctgcgacggcggaggatcacattgcatatataccgtgtgcgctcactcacattattcagcggccctctcaatgactaccagtggcattacattccacgcttgttcaaattattgcattaaataaatagatccgacagctccagcacgaaacatacaaaccgtgtgtgacagaagcccctgttttcttgtcgccgtgggctgagacctcggcgacattcggagcacaggtatcttgatctttaatgaccgtgacacgttccagtgggaggcacaccccgctgggaagacacgaccacgcaccgctccgtacgtaagttgtgaataaatcctttcgtcgtaggcctgtttgaaagtgcaacacttatctctgccaatttgggggcatgggtatactttctcgcccgtcccagacgtcaagttgaagcccgtgactagggcacgcagggggatgtcaacgccctgcatacttaataacatacgggtacatttgagaaaccgcataagttgaaattcatagattgcccaaggaaaatttatcagatgagttgaagccgattctttaccattatgcccgcattattcctttttttaggtgttccatctctgtgaggagggtcaccatg

SEQ ID NO: 2312 - DNA, 703 bp, Nannochloropsis_gaditana
gttaaagtcgagggctttcagtctttccccggcattatgcactgtaaaccaacaaggcgcaatgtctccctctgatatttgcttctcattcattgacgatgagatatttatttcagaagaaatatcgtgagctactaaagctggaatcctagtcgagaacaagccctcctttgaggcgctatcacctctatgtttgagaagaagcatggagacaagcaagagcaaggtactaagaagtctcagcaatgatctcctcttggtacgaatagaaagccaactcctttttaggaaaatcattggggtagtagcgctttccctatgtgagaaagcgttatccgcaaacatatgttaagttctgtgtcattgccacatgattcatttgaaatccttagaaacggctcgttgtcagttaatcggatttaacggcaagatgtcggggcacgcgcccagcacaagcgctttaacgagtacccctataaaagtactgtgcctctaacgcactcaatggaatgatctatttcttatacatgcgagtaatgagaacattttacaccacacagctggtgtctctcctatcctctttttactatgcaccgtcttttgcagccaattttcacgctctaatccctcctatggaaacagggcatccattcttcctcccttgactctttttttgggggtcagcgagatcgcacttagaatg

SEQ ID NO: 2313 - DNA, 703 bp, Nannochloropsis_gaditana
caaagggggggaaagcaaaaaagagcagtgctcattattctgaccgacttgttgcttgtgatttttaaaaaatgtggggctagagaaggaggctctcgtttctttcgtttaaatcttgagtagactttatttcaatggatcacttgacagctcgtgtggattcagtcgaaagaataagtgaatagtttaacatgtattcacaggtaaaacttaattttttgaacggcagcttctgtactcttttatccttttgcgtaccagtaaggggaatgccattgccgtaagtggcacaggttgcacgtcagggtagaaaagatgtaagaatttgtaccacaaagctgaatttgtatgagtagatgccttctgcattttgaggtttagaagagttatccgttaggtcgatttcaaaaaatcaaaaatgaggccaacggcacacgtagggcacgcgccttagatcccggttgatacgacgactcacctgccccacgcgaatattgccttgccaattaaaatgttttcttaattgtgtctgctgattagtaaaggttcactgtcgtagattgcaacatttaagagctgcttacaaacaactcgaatatgaatatgggccaaaaagccaaaaaccgctacgttggatctcgtcctcttttcatgatcctccttcccccaaaatgtataccgtagaaagtaaaaagatcagatg

SEQ ID NO: 2314 - DNA, 703 bp, Nannochloropsis_gaditana
  misc_feature (1)..(35): n is a, c, g, or t
  misc_feature (417)..(426): n is a, c, g, or t
nnnnnnnnnnnnnnnnnnnnnnnnnnnnnnnnnnnggagggagggagggagggagggagggaaggagggacgagcggaggcggggtctgtgcagttaggaggaaggaggatgtgtacgaaagggagtgagggaaggaggggggggtggagggaggagtggggaagacaagtaagcatgcaggctggagggtgcaagtaggcagaagaaagcccggagaggtacggaaatttttagaattgacggccgcaatcgcgcatgacggtgcgtgcgagaagaacaattacgtcgataaaatatacatacacggtattaaagaccccgcttggtgttaatgtatgcgtggcatcggtgggaatggagccctgaagctcttccatgcggctcgagtgccatgcatgcctccgatcgatttcccnnnnnnnnnncgacgccggcctcctcctcctcccccacgtcccctccctcgccctctgcccccccctccacgtcctcctcgtcccgggggggcccgggcaggtggcgatgatggaagacgaacacgtaagcagtagggaaatgcggggcaatgggtcgagatggccacagcgattgaggcgctgccccgtcctcccctattggcggggtgcggggcggaggagggagagcttgcacaggcaaagggcccccaagaggctgctgtctctcaccttcccttctcacatg

SEQ ID NO: 2315 - DNA, 703 bp, Nannochloropsis_gaditana
tgaaaaggggagggagaaagaaaaaaatgggtcataggaagcgagatcagaacaaaggaagaggagtgtaaaacgataatggctttgcttacctttgctagatatggaaggacatgagacacagcattgtgcgataaatgattgtatatcaaagatgtagaaagtattgtgcgaatgagaatagagtacgacggagttatcaccagaacacatcactgttaccatctcattcatgctgagctctgacgtaccggacagagggacgctttcgcgacggtgggacagcaggttgtcctgtaccacttccagagctatctgccatttgtttgtgtctgtttgtgcagctgtggacggaaggaaaatcgggggatgaagagatagctgagggtgcatgtgatgaaatacctgcctggaagcaagccacgtcaagcgctggtaaccgtgacctctacggaggtgcactctccacgcattcagcgtgttggtcacatcttacactcgatagcgcggcagctcgtagcctggcaacttctcgttgtgtttttaagaccgctccgtgtcctgttacctccccgccctcgctgaagaagaaagcgtcacctcaagtcaatcccactccagaacactttcacacgaccgccttttccaactctaccacgaattgaaacggacagacgatcgacagcactccggggaatttatg

SEQ ID NO: 2316 - DNA, 703 bp, Nannochloropsis_gaditana
acaaaaaaggatcttgcagagtgtggagagcaaagctcacgatttaaagaaggaaagggtgcgggtttgtgcacgcatcaaggcgcggttggacggagagggtgaagtgcgggggaatgcacgaacatgacgcatgaaaagggggaaagtattgacgcattgaagcaaaatattgttcctgttggcttcaaaatttaaaattgctttctttcactgtgtcgaacgatgctagttccttcttagtacgccctaagtcgaccgtgccacaacgtgagggcggtcaacctcctgccatattgagcccccttgtcagctcctcaattacaccctttgtgttgtatccttttcaggacactatatgtcacatctgtttcaatacattgggtactctcagagcgtctgtagagaatcgtgtaatcaataaggcgcaaagtcaaggatttgagccgcacttatgggccgacgggatgctggctgctgatcgtatctgttggacctttgtgcctcggtgttcttatcgcagtcatgtttgtgacttcatcggacaaattctccctttcacagtgtacgaacaaggtacatcttgtccctcttgtcgtgttcatagtaatgactggtttatcttccatcctttgtcctcgtttcactccacagcgcccaactggaaggtcggtgcggtcgcattgctcagaagcactgcatg

SEQ ID NO: 2317 - DNA, 703 bp, Nannochloropsis_gaditana
tttctcagcggatgtcacaccctgtcccgttcggaactgcctcaagaggcaaccggaaaagactggagaacaagcacggccagggtgggaggttgctaccgaggccagtatggtatgcatagaatcgagactacaagcctagatactcggccaggttcggcaacgttgcacgtcgcagtgtggagagagcacactgaggcgtgggtgtacgcatattttaatttttgggtcccatactaaacggccttgacgaagcctgaccaggtctacacgagcgctcctgtactgcctcaggctccgtcccctaatccaagcaaaacgacttaaagctcggacgattcatacacgtatcttcacgctgcccctatataccgtccacagtacgcattggcctcagtggctgctccttcattcaggttgttgtcttgttcaggagcatttgacacccgccacaggcctctgccgttcctgcgctgaagttgagcttcatgaggctgccatttactctcctacttgtcttcctacacattatccgactcccgcctcatggggctgctttcttcttctcatcatgtggggtttcgcagcggcatcacccacggcaccggtcaattctaaaagcttgtgcctcgacccctgaaagcctgtcatctaccgccctcagacatccttacgataacttgcagcaacaagcatcgatatg

SEQ ID NO: 2318 - DNA, 703 bp, Nannochloropsis_gaditana
  misc_feature (1)..(624): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaggaggaggaggaggaggaggaggaggaggaagaagaagaagaagaagaagaagagagaaggaggaaaaaaaatg

SEQ ID NO: 2319 - DNA, 703 bp, Nannochloropsis_gaditana
  misc_feature (1)..(106): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggaggaggaggaggaggaggaggaggaggaggaagaagaagaagaagaagaagaagagagaaggaggaaaaaaaatgccagcttgcacacacggcacgtgcagctccaagcgttggtggagaaaagaatactgaatctggactacattcgcaaagtacataaaggtgaggtcatgggagggctaacacaaatctcatccaaggagaaggtatttacacgctgacaattatttttcagtgacgagacgcgagaagtaaaaaatcaatttcatgtcaagatgttcttgtcccatgtctctctccgtcactccatgcctggtatccctgggcaggagggcagtactggctccacaccgtccttctctcgcaaaacgtcatccatcactacgtgcgctcccaggtacaaaggcgggaagagaaagaaaaagcctttgtccttgtcgatcagtcttacccatactttggcgtcgcggtccttaacacaggtgccatcctcccgggccttagttttcttccatctaggggtgtccgtcttccccctgctcgaggcgccatcagccttgcgtcctcatccccactctgggggagagagtgaa

SEQ ID NO: 2320 - DNA, 703 bp, Nannochloropsis_gaditana
tagctactggtacgctcttatacgcgtcatatgtatatatatatatttcgctctctttgcgatttcacgtggcagggtcgaagctatttcattttattttacgtgcagttatatgaagcgaaagtctcagaattaattagatgtacatgagacgttgtaatttcactttttactatcctcttggcaaatgggaaaaataagtagtggcccatgtttgaatttctgaaattcaaacggctgacggtttttccagcgcgggaggcgcgagatcccggtggtggacgacgcgctgctggcactcgacgacagaagagagactcgagaaaagacgctcatatcagtgtcccggcatgcttttatattttacttttaaaatgaggcttttcaaatcaacatatctggcagtcagacaaagtcatctctagatttaagttcttcaaatttggagtaaaacacctcgaaggcctgagtgcatctctctcttctccgacgttgcccaatttcatgtacttgtcctctttcggtaaattacattacagacatagtaactccgcgggactctctcctttctggtttttgaggaacagagtcccatgaccgacgagtgaagaagcggccatttcgcaatttcctaggcggtgtggttcgtgtaagtaggaaaattccagcggaaagcccgccggctaccgcctatcacgaaatg

SEQ ID NO: 2321 - DNA, 703 bp, Nannochloropsis_gaditana
tctaattccactggttttccaaactgtaaatcggctgacactgccactttgtagcctcgtctgcagcatcctcccgtcctcagcgctagctctttctcttcctgcctccgccggagccacaggcacggccacttcaagcatttatcaagaaagtagcagcagaggcactgatattgacacgaccctcctctcctctccacgcattgctgcccgcgggagcggccaaacctattcgcaggccatggcttcggcggatgctcgccggatccacgacgtcaacaaggcgttcgcccggcatgtatgggccacgattggactctccttctacgacaagagcggcggaggggtgctcggaggacggggaggacacgacccgggctgggagcgggtgtgggcggcggcgaatcggctgggggagggcggggccggggggggaaggggcttcgacagcgtggaagggacgagggaggtgattcgcttcatggtgcgggagctgaaggacgagtactcggcctacctggccccgcgggagatgagggggctgagccggtggtcacctcggtcctcgtatcgcctcgaccggatgtcgtctcctaccgcctcccagacggggacctggggcccaaggagcgcccagacgatccggagcagcaaggaggacaaggcggatggcacaagctccctcacagcttcggtggggatg

SEQ ID NO: 2322 - DNA, 703 bp, Nannochloropsis_gaditana
acctagcatggatatcggtggctttgttgtgggtggtgagtacgctcgattttggcaacggcattgtctctttcccgttgctgctttgtatgctttatatgacatgctactaaaattctactttttcctttacataagtgatcgtaaattttcatgggcgtttttcggtgaggtatttttatctctgcactccacctcttactccgctcctgcgtgctttcattgctatcatcccacagaaacgcctacgaccgcgctcctctacggaaaatccaaagggatcctttgtggaaaagttttttttgacgcggtctttaaagcgttggattgcacggtggagtggatggaaggaatggaagatggagcggtgttgtctcctcctgtacccagtaaagcaaccacatatcccaaccagggaaagcaagacgagactgacagagagcagtctataaaggtccacgtggcaacagtcaaaggcaaagcacgccatattttgcttggagaacgcacggccttgaatattttgactagggcaagtgggatcgccaccatctcccgggcctcggtggacattgggcgtcgcgcagggtggcatgggaccattgcgggcacccgcaagaccactcccggctttcgaatggtggaaaaatacgccctgttgatcggaggggcggccacacaccggcaggatttgtcgcagatg

SEQ ID NO: 2323 - DNA, 703 bp, Nannochloropsis_gaditana
ataacgggagaaagcgaagttgtcacatgtctgtctttagggtgcgagagcatcgtacctggaggagggtggcagcgaggagaaaaataggggcagcaaaagacttcatcgtggctttggtttctgtggtatgagggaggcatcgtaatgagttgagtttcggcaaaatacaaggtgccacggcaaaatacgactccttgtatgtaagtcgtacaaatacacgaaaagtcagcaacgcgtggattaatttggcggacgaaattgtccctctgaattttgaattacgtcgatttgatcgccttctatggaggcgcgtcgctttatagatcctccgaacacaactagaccgtccgaaaaccagccggagtcgtgtaccagaccctttgaacacaaatagaccctctgagcacgagaaacctccaaaaactatccgtcggtttgaaatttccagggtcgagtgaactaaagctgtatttgggttccatgcctgttttccttgctttgcacccttttccttcgaatagtgccagatgaccgagccgtgaaatgctggcccatatactatattctagtaaagggtaagcggtcctacgtcccctttctgccaccactttaaatgtcaaatcatggtccatcaattgcaaaaattgcaaaaattgacgaacgtacatcctttggacatactctcaccccagcagccatg

SEQ ID NO: 2324 - DNA, 703 bp, Nannochloropsis_gaditana
atggaacatccttggagctcaggaaaatgtcgaactccgcgaaggtcatgaacggaggttaatgacgggaaaacgcgtcgccataactaaacctgcctgacagacgaaccctcccttcctctgaccatatttatctgtcccgcttgcaacaaagagtcttctcgctaccaacctcttcataggcttcatctgatcacttaatcttgcatgatcacggttttggcgctgtgtcaatgttttataaagctctgaccgtcggaagggggtatggcagactggcctgtgagccgttaagtccgaccgttaagccctccagagcccatcggcccattcccatgacaggccgtagacaggggcacatacagtgcgcacagttctccgttgcaccaccctcgccattcacatagcctcattaggagatagaaatgggtgatgtggtggaggaagggaaccttggtgacacgatttggccttggcacgtccaatattcatgaaagctctggcttctgacagtcattttgccacgtcctctgatcgttttccattcgtacaggtcgcaccgtcccgtgcctttcattcattttttgaggctttctgaagagaaaacgggagcaaagagagaacgagaagagaatacctgtgcgtcaagatcattgcctgtacttgcgcaaggtctcgagcgcaaaagattcctcttgtcatg

SEQ ID NO: 2325 - DNA, 703 bp, Nannochloropsis_gaditana
aaatctacccttaactataaggtgacccgcagtttctagctccgaaaacgtcctgtagcctccttcgccctttttcgtcgtcgaatgtgtgcctgttcaaggttctccgatttgcgtgctattacggttgtctgcgcttgaaggagagtcctgttacagcaacctggccagcgatcctccttgacccactaaatctttcctttgaaggaggaaggcaccctgggttttccctctcattggccggtgcatgcaccttggtctccatgaccagacccacatgttggtatatcgtcaaatagttgatgttggttgggttgatgggtttgcgtgggtggtcatgatgagtggaggattaggagcaatccttcccctcctgttgccttgtggaagggaagcgagcgcgggtgtttacctttactgcaggccttggtgttatacaccctgtcttcgtacactcagatgaataagaaattttgtggcttgtacttacttaacagactgtggcattttgtgaagttgtggattgtcttgaagagggctggtatcatgcactctccacccttctgagagcttctgcattcaagacacatctctgtttacgtcgcaaatatgtgtcaattctcacatgacaattttcatacaacatttttaccattgttacagtcgcctttccattcctagtcatcttctcactaaaaccatg

SEQ ID NO: 2326 - DNA, 703 bp, Nannochloropsis_gaditana
gccttcccggggtcgaaggcctggtgcatgcctgtgtgtgcgataccccaaggcgcagcacctagaggaacgggtgtgctccaagaagaattcagcaagatgtcgtcaacattgtcatccctccatctttctccttcacatttcctgccattcatgtcccatccgcccatgcgctcgagcctaaacgatgtatgtcatgacaagtgtcttgataagaatgaggtcgggacgggggaaggagataaatgtacatagaaataacacatgacgacccgaggtatattgaaaacgacatgttagagggcaaaggagctctctacggctgtgcgtgtcctatgatttttgtcccgtggcccctcacgttcttaaagacatggaaaaaggcagggcaagtggggggctgcaatgggaatggaaagctttcggcgatatgatggaaaagggacctcggcccaccgatccgaggctgatccctgcataatggcaacagagttgcgtgatagtgtcgctcacatgtgacctgcatgcttgtgtggggttttaacaggtgctgaataagagcttgtcgtcatttttataaattttgatgcgattctgtggagttgtgagggacgtaatacacaaccctgtctttgttccgcaaatgcataccaggtagtttgaccacgtcgaaacccggttacaagaaagtgctgctacgatg

SEQ ID NO: 2327 - DNA, 703 bp, Nannochloropsis_gaditana
aatatatccagtccgattcctgcgtgcgcaggcgcctacgcaacgcactcaaacggcaaacgtgccgaggaccactccattttatcgagtacatagtcctatgttatatcagcataggatatgtcaagcttgagagtaatattattctttcatggatccccatttcaagaagcatcttacaaagcgagctctctaccccaacactacccggggactcctaacttgaggccctcgtcggcgcaaatattttgtccacgatgagaatcgcacatcaccaaaaaagcgcatacaatccttcacacaacaaatgacccgatgatatatgtggaaaaaaaacaccctttccgttcttcaagggtccccgcggattctgatctgagtctgtccgttgtcagggatccttacgacggaataagaccgaatattttcctgaggcggggtaattaactgctggcctcgaagacgaacgttccctaagatgtggtcccgacgcgagctcccagatttttcttgaggtagttcctgctttctttggtaacatcatgagatatgacagacttgaaacttgtttttgattgcgcagctcatgcatggtgagatggtctgagatgacacgtaaagggcgacctaattactgtcgctctgattttaagggccatatagtcatagcttatatatacccgactacagggggccttatatg

SEQ ID NO: 2328 - DNA, 703 bp, Nannochloropsis_gaditana
atctaaataggctagaagacagaataagaatcccgtcgacaacgaaaagaagacaatcctagcattcgcggaaaattgcgaggaagggaaagcagctaggtgggccagggcgtttatgattgtgacgagtaggacagaccgcgaaacagcacaaatcaccgcacggcatgcctgcaaaacatcagttgacatagctaggcacctgtgggggtagtgtatgtgtgaagtacaccgacacatcgtgagatgatgctggtttctcaagcattgtaatggtagtcctaggggtcttgagacgcgtcgggacagccatcatcatacatgtcatatggccacagttatcgtggaaaaaagtcacttatgagataggagcaatactaggaggttggactttctttgttcgatttcctccttttttttccctcctttaggccgcgcagactcgccggagccaggaggttttcttgggcgagtacaagccatggtgcagagcagtatgtgacatggcctgcacgcggcgcaactttacatcttacgaccaacaattggtgctcatcgcaggaaaaggcgttctcgtcgtagaaggaggagtgtggctggcgctatttcacgaggtctccccacctgaccgggcgttcaaggtgggcacgtaaacaagactcaaactgctgttttcatctgcgcgattctatcgacttgcatg

SEQ ID NO: 2329 - DNA, 703 bp, Nannochloropsis_gaditana
ttatgctactagcgtgccgtcgccgctccttctaccgtgtctctggagtgggtgctgtgatgtgagcactgtttcgaacaaagtcaccgtaacctgcacaccgcaataattggtctactcgccaccgctcggcgtgggcaccactggttggccggctgctgggacttaaagccttacggaaggccaaggtcatgcgcgtgacggcatggcgagaaagagcaagccgacctcccgcccccggtcagccaccccgtccacggtttgcgagtgtgagacccgcgcgaccagtcacaccgtgtcgcgggttctcgataagacgttttcgatatggctacgtatgtgcatttgagcgtgcggcaacatgttgtcccgcgagaagcatgagtgtaccaatgcccctttccccaaagcagacgatgagcatctttttatttcgttgtcctttccgcacacaattataaaattatcgcagatctcgacgatgccagcgacaccagaggagattcaagaaaagctgagtaaagacctggatgatttgatcactccagaggatgaggcgccgggagacaggcatcatcgcaatggtccccgtcgagaagatagaggcggccgtgcgtttcgaggtgctgggcgaggaagggaggggggccgagggaatgctcagccattcattcgagaaggaattgggagaggaagaagaatg

SEQ ID NO: 2330 - DNA, 703 bp, Nannochloropsis_gaditana
  misc_feature (1)..(315): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccttacctcgccgctcttgaaagcgtacagccccgcgcccaagcaccccagcgtggccgtgcaccctatagggatcagggggtccttcttggtcttgtcccacaggcggctccagaacgtctgtggcatcctatcacgggctcgtccctgtttcttgtctaaatactgtgatgcatcgtcagtcagtgactgacaccactcagtgaccttcgaatttgagagtccggaccgtctggggtgtgtcacggagttttgccacttctgccacccacgtcaaggtcttttccgcccctcgcagcacccctcgccagcgactccttcacactttcctggagagagaactcatgaccaatgtctgtttcgttccaatcacactcaataaagcag

SEQ ID NO: 2331 - DNA, 703 bp, Nannochloropsis_gaditana
  misc_feature (1)..(44): n is a, c, g, or t
  misc_feature (691)..(700): n is a, c, g, or t
nnnnnnnnnnnnnnnnnnnnnnnnnnnnnnnnnnnnnnnnnnnnagggcgcaggcggacacgaaaaagggcggtggcgggcgcaaggagaaggcgccggagggaccagaattgcatgtggctgtggagataacgccggagtatcctatacgccccccccgtttccgactcctctctccctcctccctcgccgcctccaccctcgccgctcacgccccctttcgagaggccttcgcgcacattctcgtggaggtgaacgtccactacgaggagctcctcatgggcggctcggtgagagactggctcttcccccatcaagtgcacaagctgctcttctgcttggaggcgtcgggcgccgttgggggctcggggagttcggggggcggatcggaacgactaagatggggtaaagacaggaggaggggctactccttcgacacgcactgcgccttgctcatgcctcgatgacagtatgtgtctcggggctatcagaaaaatgagccagttcgaccgagatggcgtggcctttgagctgaaagaaaatcccaaatttcgtgttcgccacgacggcccggctgaccccactggcggcgtgtttattttctttccctccggaggcctcgtatctcccctctctcctgacctgacgaattactcggcggaggaagctcagtcgcaaagtgtgccttacnnnnnnnnnnctc

SEQ ID NO: 2332 - DNA, 703 bp, Nannochloropsis_gaditana
cggcccctgcccgggggtgcagagcccgggcgacctgaagggtctggtgtggcagggcatcccccctgacctcagagacccggtctacgagtggttgagcggcgcgtcctgcaagcgggaggctttgggtgtgaactactatcacacgttagcggccgccagcgaggaggagaacctagggctgggtgtgatcgggggagaggagggggaggagggggaggaggcctgggtgtgtgtgacgcgggagcgggaggacgctggggtggggatgggcggcaccggcgtgcacggaggagaaggcctcaggtgggaaggtggggccggttcaggcacgggtgggggctatgtaggaaggcggggggcggggggtaagggagggatggtggtggatgtggtcatgccggagctggatgcggcgtggggcgccaaggtagcgcaagacatcgagctggatttggggagggccttcacggattcggatgccgccatcaacacgcctgaggggagggcaaggctccgccgggtcctgcgggcttacgcacttcgaaacccctcggtgggctactgccagggtatgaatttcatcgcaggcctccttttgctggcggtgagcgaggagacggcgttctggaccctggcgcacgtttgtgaagaggtcagtcccctttgcttctccccacccctgctggggacgcgggccgac

SEQ ID NO: 2333 - DNA, 703 bp, Nannochloropsis_gaditana
cgcctccctcacataacaacactccagcacgttgccctacaatccactacctaggactagttccaacaccaccaaacaccacatgcatgccgcagtccagcacatgcattcacccaccacgatcatcccaacccttccaccgccccgaccagtccgtgcgccttgcagaacaaacgttatcttgcctttttgacattaagagtccttcggaaccggcggcacaagagcgtcggtccgagggcctgctgccgagaagccctccttcaaggataagacgaccacgtttccgacacactacgacaccagccccgaaatcacgaaatgcacacaccgctgtgtccaacgtcccacggacgaaggaacaaagaaggagaccttgaacccctggggtagtttctccaaattatgagcgacgtgtcccaaaaattggctgcccgcgcctgcgccacaggatcggcgccgacggcttctgtacgtcggcgcaactgggtgcaaaaacaccagcaatggcacaaaaagatcggtatcgcattatatgccagtaaatttttcgttaaaacatatgttttttccgcctttctgccttcgcaatgcatcaattttgtgaaaaagaatcattttttcgaacgttgcctctgaaagtgatctgcctgctcttgcctctctttcagaaagtgtacgtatcacatagtcgtccaaaatg

SEQ ID NO: 2334 - DNA, 703 bp, Nannochloropsis_gaditana
taaagtactttgttgcggacacatatgtgagtccgtcattggttttactaaaacatcacccctgatcgaaaattcgtttcttttggcacttttgttttctttgtcttttatattctttcacaaaagttgcgcgcaagaaagaggaaacattcaacatttatatccagaaagccttcgcgtatcaaacttgcaacaaagcgtgattgtttggtcgttacacattgcacatcgttgtccgagctggttgccagatgtgagtgccatttgtgcaaaccattaggcctgggatatctttatgggagcatgccctcacattgaaagccttgtggagtacgcatatcgcgcctcgtcgcatttccaacttaattttggtggctgcagtttgttccgcatagcctcgggggcttcgtgcgctccgaacaaaggagcctccgacagtatctttgtcatcatcttaccggcttgctcaattccatgcctcttccgacgtgcaatgtgcggcatatagcacagatcctgccatcattgtgtgatattctctccgtcaaccgagaagcaactgtatctgtccactctgagttcacagtgatggtacgtgacggacgcctccaggatgggccctacaaagggcagcttgcatcccctctcattaaattcctcgccccatccttcttaaaagctaccggcaccacgcagggaaatg

SEQ ID NO: 2335 - DNA, 703 bp, Nannochloropsis_gaditana
catcctgccctccgcaatcccacaggttgagaactaaattgcccaggaaacggacgtgatgatgttccacgtccagagtaggggacagccgcatcgtatcccgtgccatgtagttcgcaaagatgaaagagcgcatggacgtcttgccagaacctgatttgcccatcaacaagacctttttctttcccatgctggaaatttttattcgtgcacgctagggcaagaagaggtaaggaaggagtaaaacggcgcttgatccctgtggctactgttagggaaaaggaggtgatgctgtgcatgaggaaaactataaccacctgaaggcgtgcatgacccctcctcgtactgtgacaaaaaatgcatgagttaagattgagctcctttattcgtgtgggttcgtactctgccacctcccatcctctaacctcccccccggcaccacgatcacctgtcgcggtcttccctccatgtcatcaggctttcattccccctccggtcgcggtatctacaacctctgacatgaatggaaaatggcctttgaggatgtgtagtcgtgttcgaggtgctatgtctctgccgtatgccagctgtcacatgcacgtcaggagcatgcagcgccagtatcttacccaggccgtcttcccgctcgcgtaaccccctctttattcattcgttgacattcacacagacggcggtggtaatg

SEQ ID NO: 2336 - DNA, 703 bp, Nannochloropsis_gaditana
caagtccttaactctggtcatgataatgttatacaggtatgagcgacttcgtgcgagctttcaggcaacacgtcgctgcggtccgggcagattgacggggcctgtgtgccataacgcgtgacaacggagcagtcggtgtaacgcccctgggccctccacaatgtctccttccacacaaagccatgtttgctggaaaaatgcacgcatacagggcaccaccttggacacgagtcatcccaatgcatagacttgcatgtttactacctttcttccatcctgtgtggctttcaggtggccctgacgcccaagaagctcgctaaattaaatttgaatcgggggttccgagctgtctactgagccatccccacctatttgttttttactttcctatgaatatgtcgtttgatctacaatttcctttgtggagcgtgtcaactatagctatgacataatttctacatcatataaaaatgaattctatacatcaatgcgatttaaaaagagattttcaccctttctctcaaaccctagcggagccagatgtgccatggaaagtagcaagcactcaaacgcgcggcgacggccacgaccaaaatctgcaccaacgggtgcaggcgatgtggtaagactgtaaattggtgataaaaataatagtaaagcctacaatcatccttattttgccctgacccatccacactaggcc

SEQ ID NO: 2337 - DNA, 703 bp, Nannochloropsis_gaditana
gtcgaagtgtgcggaccaaggcggacaacccacagcgtcgatagggctgaactggcttgcaaaccgcggcacgcacgtagaaaacactttgtgaggggttaaaaagccgatgagtgcccgcggaaagcaccattagccgatagattctgcttttgaccgaatgatactatgtcgctatgttgttcactttgttcttaaagtcctaggagggtgcttgaagggagtaacgcgtgtcagaaatgacaggcaatatcgcagaatcaagcgcaatcacacatgttttcagtcatgtgattgtgataaagcatcatcaagttttttatctcgacaatcatctctggtggatggtgagttgctggaacagaggccggggctcacacatgcagggatctcgacatacgagggagaatcgagtagctcctagatgtaaaaattcgtcccggaaagacctcaagcggattacacgcctctaggttatatattattgttgtacaacggaccacaagcattctaaaacatcggcggacgaacatatttcttgtgtgagcatctatatcatcgccgtgtcgtcgcgactcgctctttctcttccttgctcgtgccatgacacctgcaaagtttggccccaactctgtcgtaatgaaatcctgtctaaacttggcttccgcaaaacacacttcatttgtcaggcacagtcgcaatg

SEQ ID NO: 2338 - DNA, 703 bp, Nannochloropsis_gaditana
tcccgtagctctctcagttgcgagagcggtagctctttacctctcgttatttccactgcgtgaccacaacatgacagtattacttcccacgtgtgataaatgaggcaacctgcacacttgcgtgtatcgtagggatcataatcctggcgccttggtctcgatattcattacttcctcggcttcatgtgcccaaacccaacctcctcaaggagctggggaagtgaagtgtgataccacgttgccacatcattaagcttgactgtccactttccaccacattcaaaaagctgtcaaggacacgattgcagcagctatcgcaattcagcaacgattggtggctccagccttctcctttcctgccaatttcggagcgtggcagtcgctaccatcttgctcagtaccctttttcgcacgagtgcctggtcgccgttcctccccgatcaaaaggcgtgggttgcaccagcacgtggacaactacttttacccgaagtcgtactagccctcgcgtgatcactcccatgagcgcggcgaaaaaacgaagcggcgctatcgacgaggggaccccggccctaccaagaagcccaaggccggagactcggcctcgataaagttgcccgactggttcacgccgggtcggcttcgtacactcaccacaagctgcacaaaaccgcaagcggctggcaagtgcgttgtgtactggatg

SEQ ID NO: 2339 - DNA, 703 bp, Nannochloropsis_gaditana
tcaggcagcttcgcaggattttccataatatggtttatgctggcatgtaattgcttgtaaaggatttcgtccattatgaaggctgccccgaaatgcaacgcctcctacatttagggagagtaagagacagggacaggtataactcgattagtccgcttggcccatatgactccgacctccgcgctaactaacctatatccgtggtcactcgtagcttgtcgacactaaagtcgaagtttcctcatcgtagtctacgaggtaagctcccgatacgatcgtggggagcgagaaaggagtagttgagctctctgggagtgagctcctcgggacgcgagaacctgagcgggagtacctcacaggcgccggggcatgcaccgcagtgaaacgtacaaatcgctcacctgtcttaaagatggagtagttgccagataggaagatgcaaaagagtaaggctcggtcataattgatatcctttggcatctcacggtggcattgcgtgcatgggccctcggatcggaggcgcgaacaagcacgtcgagcggacgagtcaacggcagcgccgctcgaattttattgccaaaaggaaagcccaaggctcccaggtgaatcgatgcaggccgcgctatgagtaattacatgaattattgacaattaaaaatcatgaccaaggttctgatttccatcgcattttaggacgtgtatg

SEQ ID NO: 2340 - DNA, 703 bp, Nannochloropsis_gaditana
gagcacgagcagatcccgctctttaatggcagagaaatctcgctgcgccatcatggctgtatccaagaaatcgtccaaggaattcatctccaaaacggatgacaattgcttgcgtccatctagttgctgctgctcaagcgccccgactactgctggaccttgctgctgatgttttcgcatcaaagcccgccccaccacgccgcctccgttggtttttttacctgctttcggaggcatggtggcctgttcctgggtcatttacgtgcaattaaaatgggggggggcgtacgcccacgtattagatactatgctgatagagactttttatttgccgatcgcgcaccggcgggaacaaatggtgccctcccgtggcaaaaggcttctaatgcatgctcgagaatacattgaaagggcttcttgggtcgggggggcttcaatagggactccatccggggccccgtggccactgacctcctgtgtcccttccgctcgccgttgttcgcccttctcggggtttcaaacttagccctccacctgtgacataggcgcttatcgggggcctgagaaggactgaaacatccaatttcctcacgcatgtctcgcacacgaacgacaacaggcgggcaacttgagcgcgcaactgctacggtcgcatatcatgatttcctagaccaccagcatcacatcaatctttttaaatatg

SEQ ID NO: 2341 - DNA, 703 bp, Nannochloropsis_gaditana
gggcctgctcctacaaacccgctcgctgcatccacaattgtgaaagactgcgaggaagggggaacaaagcgctttatcgcgatgtacacgaagaacactcagaaaaaaaagaagacgtggctggagggtgtcttgctcgtggagccgatgccgggcggtaatagcaaactttctttggaaagcgaatcgggaaaagttgaggcgcgaaagattttgtacgcgggactggatgcggtcaaggaaggggacaacctgacaatgatgcacttccaagtggaggtaggggagccgagggccgcggtgctccctggtttgctggcggggatgctggacgaccatgaggaagaaaatgaaaatgagtggcgccatggtgctcgaaagctgaccttgggtcaaagttcatggtgaaagcgcccgcgaaagccatagcctggaggcagcgcgtcggcgcggggccactccagtgccccccgcccggccgttggaacctcgagtggtcaaggaggatgaattgctgctttacgatcccgcctgggggacagaaaagcaatcgaggccggcaggacgacatctgaagggtgaagtgccgaccaagcccgtcgttttggaagcttttctggggagaatcttgcggccacaccaacgcgagggcgtcgcttttctttggcggtgcttgacgggcagggggcagcctagccggatg

SEQ ID NO: 2342 - DNA, 703 bp, Nannochloropsis_gaditana; identical to SEQ ID NO: 1988

SEQ ID NO: 2343 - DNA, 703 bp, Nannochloropsis_gaditana; identical to SEQ ID NO: 1990

SEQ ID NO: 2344 - DNA, 703 bp, Nannochloropsis_gaditana
ttgtttcaatcaaagtttctctgaactggaaggagaagaaaataaaaaatagaaaatcccataatgttttagaaaaagtccggacccacacggataggagacaagcccggtcctctcacaaaggagcgcctcgccgctcaaaaggcaaacacgctagcagagcgcccaggagtccaccaagtcaaattctcgtatctcaatctcactggttcatttgttgccacagattagcttgattttgcggtgtcagttgaggagccatgtctgaacctcctggcgctcggtcttagcctgaggatgcccagactgaacgagtactgccttggatcgaaatctcaagccgactatcctataaacaatgcattccatatcatgtttcaaatgtgcggggacgggtcgcgtgcaaattaagcgaaaggtcaaacgatctcattgtgctcaggacagtcccaacgacactcctcagtcgttgacgcccctaccaaagttacaactggctgcggacgaagccctggtaactaaaggcaaccacacagcccaaatcactcgaacgtgtcatgtttgtcagggtcgaggagaaatcgtctcgactaaaaagcggcgggggatggataagaccggtgtcgtcacgatccctcgccgtccacctgacttcaaattacgcggccccttacgtccttcgtctatgacaagcccgcagcct

SEQ ID NO: 2345 - DNA, 703 bp, Nannochloropsis_gaditana
accaatcccgtcggcagaataactttcgacacactttccaagtcacagtagtattgtttttctccatcgcttcgcaaacatgtcatcaactttccccaggtgcctatgcctccggcggggaagccgggtttcgcgccatttttcgcccgaagcgagcatccgttgtgatgaagatggaagaaatgccttttaattccctcaaaccgtccttgtgcgaaacggccatcgaaaagagatgagtacgttcgccacttcaaatcctgctagaaatcgaagaaggccagcgcagtcggacgtgatgggatgcgggtcgcgtgagtctggggcaggtggccacgcagcacgtcaccattttcgcctcccctgtgttcgctctccatttgccgggcccgggcattctcctccacgccctcccagtggcttgcctgccttgtgatgcgtgcacccaggcctcggcctgccctgcgtgctgttttcatttctttgacgttgcttcacttgacaatgcagacacgtcctcaaccaggcgtatattatgcctccttgccatgtaccagtatgtcggttttccatccgtgaacagagacatgcgatcacgaaaaagggggagggaagaaagataaagcatgaattcgagcacgtacaatttcactcatatccatccttcttatttgccttccattatacacagcacgggacaatg

SEQ ID NO: 2346 - DNA, 703 bp, Nannochloropsis_gaditana
atcaactggaaaattctaagcaagctcaggtagctctcgcaatactttacaaacgacctggttttaagctaatgcatttttctcttctgccgtaggcgttgacggcccattcgatggcctgtccgcttacgcgttcgacgcgttccttgacttacctcggaaagcgtttgaagagtgtgacaagtgttggtttttaggactctgatgaatcaagcaagaaagatgagctgatactacatgagttgacgtgaaagcgtatccgtgcaatcaatatctcgttagatgagacccgacgtttttccctgcgggtgtggatgtgaggcacgtagaggggagacacgaggagcagattcctcagcctgggctcgagtaacactcttgcaccctgcctttgagaccgttttcttcgtttcagtattgctgattatttgaaaacatctcaaccacattgaaggatgggggtttgcgtaattttcacagcacttacataagggtgtttctttactgctttgcaatgggtctcggtaaaaataacagcaaggcaagcaagcgcatcgctggtctgacctcctccatcgattgggccgaaaaacgtataaatacatccacgcatcatccttgacggactgagtgacacctcgatgtgcgaagattcaagagatatgttcagtggctcttcttctgtctgctgagcttttaaatg

SEQ ID NO: 2347 - DNA, 703 bp, Nannochloropsis_gaditana
cgaatgttgcttgttgggcaaaaatgttgggcaaaaatcgtgtcttttttgcttgtgtcacaacggggacacctagaccaggtagctgcagcgtgcatgaaacttttattacttcatggtggtttcctggaataaaaaagtccccttggggttgcgaccaagagcgagacgcatgatcatcatcgctcattcaacttaccacacccttcctgtatgtgcatcatttccttccgaacatttgcctgtagcctcaagccgagggtcatttatcaaaagtgaggcattctggctggggcaaagctcaagtgggcacggtcttgacgtgtgataggcaacattggttgaaagatcgagctcattcgctgcgaagttgctgatcagcatcatgctccttatcttccagcgacttgacgtgcctttctcgacctaggcggagaatctcccttatgtgtgctgtgtaagcaggcccacgatgtattgcatcctctcacccttgcttcacacctttacaaatcatagccaaagtaacgaaaaggattcgcaggtggataagggtttaaggggaaaaaaaagaaggggcggaggacacatcctgtaatcgtcttctatcagtatcagttcttgggataaactttctcgctaacgacacaaagtcattgaagttccgaggaaaatgacgacccgaacgacgtgctcgcaggct

SEQ ID NO: 2348 - DNA, 703 bp, Nannochloropsis_gaditana
atgcgtacttgaggcgttgtttttttttcgcagcggcggacatttcaaagattatgtcggtaagggaagctgctactgcccaaaatgttcggttcactcgtctcccttctcaacacacactaccactatcgtatttatcagccaaacgatgaaaacaaggggtccggacaaaggcactagcagcagtgaaggccctgagcggggagtagaactagagaatgacgaacggggtatgtctgatacctaccaaggacctgtacccaacacttccacaaaacctttgttattgccgctttcgatgacaagtttggacgttaactccgctgctagtaaacacaagggagacgcattgattttatcaggggaaccacatactgatctgtcacctgctatggccgtggccgagcataaaggcacggcgaggtatcgggaacttctgtacgtctacctggccattgtagcggacgctgtcacttccaacgtgatggcaccctatgcccaagaatgggtactgcatacatttcaaacgaataacatcggactctactctggcattttggtgggctccatggccttcgcccgggccctgtcatcacctttcttcggctggctttcggacagcatagggcgacgtttgttaatggcggggggactgctggccgctggcagccttacgttgggagggggactctcctagagattc

SEQ ID NO: 2349 - DNA, 703 bp, Nannochloropsis_gaditana
gcctaagttgacatttttgcgccgtgatatctatattttacgtccacaacagtcgtatcactcattaaatgataaagataattcgtcgtctatttggttgctcgataagcgatgaaatgcaatcaaagttctgaatcaagacaacgaaaaccgagcaacgacctccgttgctgatagttgtgctggtctaggaccgaattgcgcagacgacattaagccacattcccttcattggactattaaaagaaaaagacattttttcctcgtgaaggcttatttttttgggcagacctttgatcatagttaaataatttgtgaggtagaaaggaagataaagacacacacatgtgttgagcggctcgaacgttttggcacggtcaggaatggaaggctctcgcggttccagtccatccagacctgcataagtctcaaatgccgtccaagttttggcttaccccgctttgcaaggacttccaccgctctttgttttggaggcgcatggggcatttcatgttccaccggaccatggctaccttggatcgaggcatgctgtgtggcggggaggctccatactgaccaatacttgtctctattccctttgtgtcatcgtgtttgtgtgaactattgtcaatcaatctattcaaaaaatcaaaccttttccccctccattccatgcacaatatagagttaacccacaaacatg

SEQ ID NO: 2350 - DNA, 703 bp, Nannochloropsis_gaditana
ttattttactttcccccaaaatacaggagaagcctcgatcgtgaaagttgagacgttcgtgggtcttcaatgtgactggaggaaagagagttgatcatcaaccctcattcgaccggttggagtctaagaataaaatgttcaaacgtgggggcttgccgtgggactggtctctctgaatgaaaggggcgggtgaccgtgcaaacgcgcaaagttgactatgggagttcacttcagaaagaacaagaatagcggttttctccacttgcgttgcgaaattctggtacaactcttgtcaataattggtttttcgttgcttgaacgctttcagggcccatgtcatgtcccatccccttccaaatactcactttaaaattgcagtaaggtgcagatattgtcacacatcctataaacgcagacaaacccgcatgcgtagttattgccagggcagtgtttgcgcagcgtggacacggcaacctcctgcgggtctcaggagacgccttcgctatctcgtccacgccctcgccgtcggcagccccataccaccttcaatctcaccgattcccgcgactaaatcatggttcgatgagcggaaatcatctcacatcactttcatccgttattaacagggagtaggaggcctgggtcgtgtagtcattcagccgaggggacagaatgagctggcttttacacggcatgcggcatg

SEQ ID NO: 2351 - DNA, 703 bp, Nannochloropsis_gaditana
ttagagggttgccgcaaacagcaaagacacttccgtcacatgacataaaaaatggttcaccaaatgacaaacgtattcattcaatgcggtgccgtgccctggaggccagtcaatcgaggtgttctcgtaccgcccatctagtggcttttccccccgacgggagaggcctcgcccgggacaagtgagccggccgtgccgggcgactacagagggaggggttttgaagccaaatggccaagatgaaccacggttgggagtgtcgaacgtccctgcgtaccactcggacgactgaggtgaggcatcgcggcagactgcccccctttatagctctcagtgcacgctgggccggcaagttgacctttttccttcttcaaggcagaccggaagcttccgcttgctttttaatggccggaagctctagactcctgccgccaagggacaggctatacaaaatttgtagccacatcattgaagctctgcaacagcgatgtaaatgagtgcacagcgcgtggatcgcgtttgccaaaacggtttttggaagaggttttgcagcggcttggccttgccagcttaaaggcctcggagacccgagtatggtcccggcttaccccaatgggaacacaagtagtcatcaacgccgccttcgcttaccatttccacattcttatgctttctttgaaacctgacagggagcgcagtcatg

SEQ ID NO: 2352 - DNA, 703 bp, Nannochloropsis_gaditana
gagcatttccaaagcaaacgccaacaaggtctacgtcgaatctaggaagtaaccaaccaccagaaccgttactttttcaggtgaaaaattcaaacaaccaaaaacagcgaaaaaagcaaaaaaagcaaaaaaagcaaaaaaagcaaaaggggcggcgagagaagtttctcgcagtacttgatcattgctcctctggtcctggtattcgagactaagtcatctcctgcacttgtgatatttgatggcgacgtatccaaccctttccatcttgctcatctctacttgtggtcgtgagtcgacacgcacggactttgtgtaccagtcggcgccggaacacgcgccatttcccgcgctacaggcaggggcgagagtatagagtacttagatacgtttctgtgccggtcgaggacctctctaattgggtatgaatgattgggactcggtggccatatggtgtattttattgctgcgaggactgtacatccgtgcttatactcttccggcagagaagtgggtgtcaatcgtttctcctcgtggatttttgcgatgcaagctttccgtatatctcgtttgtgcctgtttcgtacgtcgtaccgtgactgcgagcaaatggacgctgctttcgcaacatcttccaggtctatattcattcctcctcttttccactcatgcctcagagacatcacacccttttgcaatcatg

SEQ ID NO: 2353 - DNA, 703 bp, Nannochloropsis_gaditana
gtgcacgccttaaacaatcaacgggactatgatccatgtgcaactttatcatcagcacattcccatcggctattattcagcagccctatattctgcgtgctcgggggttgtatcatagtaagtatcatatccggcaagattgaccaggtttgaagcaaaaacaaccatttcaaccgtagtttttggcaacccgatgctatcgaagcgggataaaggcctcgcatgcaaattcgaagttcctctgcgggactggcccatattaagtgttgtcgaggcaacgtccggcttgcggcgtccgaggacggtcaaatgtttccctgaggcaaaagtccgttcagtctgtcaggagtcgtacggatagatgccccagaaagagtcacgaaaggaccttgttcgcagcatgaggtggatatcaccttgtctttgggcgtttcccacgtgctgtgtggttcattcgggttgggagggtcgcgggtgacgatgaccacctctttctgtcagaggggtacggagatgctatgattgcagccaggcccacactatcttctatgcgtgtcgtcatgcatctatgctctcttaacacgtgcatacctgaaatccatcacacttgcgggtgtttacatattattttcttcctaccgtcatccaggatagacgtctttcactcgtgcaatcacctgtcaagctctgtaaactgcatatg

SEQ ID NO: 2354 - DNA, 703 bp, Nannochloropsis_gaditana
aacagtgtcgtaattctaacgaaaacagtctgaaatgaggtaaggactcacaatatttgaaaatgcgtacggcttcatcaccttttgatattggacgcgaattgatcgatttctggaagaaagtggagtgaatgatacttgaaacaaaaaatactctgtcaattggttgtattaacgagtgatggaaaatgaatgctgagaagagtcgatttgaaaaattaaagtacttggtgaaacggtctgcaacggccgcccgttgcgggccgttgcagaccgttgcgcgcattggcgacgacgtttcgcgtctttcgaagcgctgttcctcaacgagtggtgttctttttatgttataaagcagttcctacgtattatttttcaaatgcaatgtgtcaatgctttgcgaagaataaaacgaccttgtacagtccattttctgtttcttcgtcgtgttgaagctgaacacgattatgctgtcgaatagcgcattccctttacactttccacccggcaaagaacaatcggacatccacttgcttgtgactttctacaacgcagctgtaattgtatttcgagtgtgctgcatgttggtgaccaccaaaagcaacactttgacacacatgtctcactaccctttatatgacgttttcatgcgcacgattcttgcagcaactacaagcaacagctacaataggtttcaaccatg

SEQ ID NO: 2355 - DNA, 703 bp, Nannochloropsis_gaditana
ttgacaaatggcatttgcatgattggaaaagcctctcctacagctggcgaccttttggtcagagaggctggagaggatcatctccttgtcatccgcccttcctcctcaggaggcgaagatccagccaatagcccgtgtccccttgcccgttcccctccgcaactattgcgttactttctttctgtttcaacacgcctggagtaagacatggacgagacaaggccaatcagacaccacccccgagcgtctgagacgttgcgtgtccttatcttgcgccagagcctggtatcttgttgctagcgagacggcgaggcgccggcggcgtgcaaggaagaaacgagctcctgcaggcttgagcgcttcgactgccccattgaccattctttggttaaaaaaaggtgtcgagaacttgtggtccttgtccctcggtatcttgctcgtcccgaccaccgggattcgcactaacgctgtacgattctcaccccctgcttaccccccggtttctcctcgctgtcgctccgcctaccccagttagctttattgaattcttgccgtagcttgagtccactaaaccctacgcgcttgttgaacactgtggaatggactccttgcgattgccagcggtctccgccgtgaatgaatgtttctttgaccctccctccttcccttatcccgcgtcatcccgcatcaggtgctcgcaatg

SEQ ID NO: 2356 - DNA, 703 bp, Nannochloropsis_gaditana
tccctccgtctgccctctttgcgggcttccactccctcctgttccttgccgacccccctcccgcccagcccggatggccaagggacgcgaggagagaggatcacgccctcctttctctctgccaggggacttctcttctcccttcctatcccccgctcaactagaagggaggagattgagagacgtgacgggcgggagggcgggagagtgggagggatggagggagggaacgaggataaggtgttccacccgctcgccgaacggggaggaaaactgtacacgttctcagtcggtcactcccactatgtcctgaagcgctaccacaagcatgctgcaggtgatccctcccatctcccctccctgtctctcgtcctccttccctgcctgcttcccgcccacctttcctctcactgtcgacttttttgtttgcgctgacgtgagagcctgctccccccccttataccggccacccgcccatcgacaggaaaggctctgaaagaacttgccgtccttcttcacctctctgcctccatccgcgcgtgcccatcctcagccccttcagtccaccctcccttcctcgcctctttgtgcggagtggtctggaaccacaacaacacggaagcgggaggggaaggggaaagcgggtcgaaggaggaaaaagcgtcgcgaccctcggcgctcgtcttggagagggtattgctca

SEQ ID NO: 2357 - DNA, 703 bp, Nannochloropsis_gaditana
tctatccctctatttcctctgacatgattggcacctcagtactcccggagttccacgccccaatttactgttcgcatgtgttgctagccaccagggctgaaaattgaatgggcccatgtatatagaatgagccatacgcccgcgcggacagccaggcggtgattgttgctaccttatacccgttgagcggagaggaggaggcaatttctctgcaccaagaggatgggctttgtctgcccctctacgataaagtcatgcagaagaattcaacttggggtgtacctcttctgtcttatcctgagcgcgtctcgctcttatgagcagtggaggcattatcttgtagtctcaacacagaaatttggatttatggtcacgtcagcctaacttcgtgacaagaaatgtcgagctcgcgagactcaggacagcatttggtcgtagtgcagccttagaatatgttgtcctttgcttactttgcgtagtgtccttaccaaagccctttcactgcttttttctcgcgcaatcctaggtggcttggaggtagataatttgtgttctgccttaaatagtgaaagcaggcgcagatttggcatgcgagctcctctacgctgccatccttacatatgctcataggtctcgctttccattacatatttgcagaaaagctctctcaaatcgctgtgtcaaaaaacagagcatttaaatg

SEQ ID NO: 2358 - DNA, 703 bp, Nannochloropsis_gaditana
aaaatcgtgtacccatcgggccttggacacgatgcagtccttcaagcctaccctccttcccccacgtgtgtgcatgccgatccatgcgcgcggaaaggaacattaaaaattacggcaaagtgcatgggtgaccccccgcaggaaccaccttgacaccctcgtgcatgcccgagcccgtatcattccacggcacgcacggcttgacaatttccctcgcacgaccttccaattgggatgcacgcttacatgccatccaccagcttacatccgctacacggacgtgtagcgaggggaaccgtggggcgtgtgcggggctaggtctggggtgcggcttgttgagcttccctttttcctactcgctgtcctccgcgatcggctctttccatctgccgaacgcgagctagggactgaatgggtcattggagacccatggatgccgggacgggcgtgcaatgcgtgattttgagggtgaaaggatgcataggggtgtacagattgccattgagggaactccgtcgcattctggcatcttctcttcgctttctctttgtctgcgccgtctcacagatacgattccgtttgggggggggggggggggttctgcgcgtgacctgtattcctctgatccagactacttgaacattttcttctcacttattattccaaccattttttcatacgacagcggagggacggaagcatg

SEQ ID NO: 2359 - DNA, 703 bp, Nannochloropsis_gaditana
gataaaaccggtgaagtacgaccatacagaggtaagctttgcgcgactctcactcgcaaccaataatcggtcagatgtccgattcacgccctgtatttttgaagtttgatttggattttcatagaatttatttcatttctgctacgacgcgctgtgcttcgcagagaagatttttgtttgttcagaggtgatgaccataagagcggcccatccgcacgagacggcaagcattctacagcccgatgccctcaggactatcgcatatgcactcccgccactcatatcatacgaatactgtgcagacagataaccggctagccaaattgtttttcaaaagcacggagcatgaatctacgatggacggaccggcctcagagaacaaatattccctgagcccagaaaccgccgggaaagtaacggttcaagggggatcccggcacccaaaataatgtcacatgacactttggagggcggcggtggtatcaaatgtccaatgcacgtatggctttgacactgatatggtgacgggttaggtgcttgtggcgtaatttcaggattcttccttggccggttgttgcgcatgcattcgcaacgaggcgctcgctcgttgtgcgaaatggaacactccgcgactcctcaccaagggaggaaaatatccacccacttccacgtgctgattgcatcacacatactaggcaacatg

SEQ ID NO: 2360 - DNA, 703 bp, Nannochloropsis_gaditana
aagtatagatgacttggagaaatacgaggtaagggccgccatcgacgagcaagagtttacacaataacatcaaaaactaagcacatttgtgagcaagtactgggaattgtgacttggttgcattaaattcaagtttctccacattgatgtcgtgcttttcaagtattcactcttcacaaaaaccttttttcgtttggttgatctctgtattcacaagccaaattttcgttttctttccgtatttttaatcctttcatttgaatttattttaacatcgacgtgttggccgcaaaacttttttcagtccattatttctcaatgtccatccatccatcctgttcttatcctttttcttcccgatttttgctactcatttttcctcgtctacaagccctcacgagaatctcgacacagctactcgccttttctcttttctttacatacgtaaccattaattcccattgtctttctacgaaacgtattttagtggcgtcgtgtctccctacggacgtgccattcaaatggatggcgtcactccttcgtcgaattgctacttgtacctccccacccccttggacgcagcctctctgcacacgtttacaaaaccatttcctaacatgaatgcttcgttgtcacagataaaagctggccgttggcgccgatgctagcaaagggctccacaacgctttacatagtaagcttt

SEQ ID NO: 2361 - DNA, 703 bp, Nannochloropsis_gaditana
aaggctctgtcggcacccaacccccctgtcgtcaaaaacagacggtcaagaaaacggtcaaataaagttttacggtgtaaaaaacttacgtgctacattctgatgcggaaactgtgaaggagatgaagcgaggacggcgacatacgagggggtcggacagtcttaggggaaatacacctcatgcaaaaagaaaggggaatatgcaagtgattcccgggggcccgtgttatcatctcatgaaattggacgacgtaggggaaagaagacagatatgatcagacgggattctatcaggtataaatgcggcctcgcaaatatacgccatgtatgcctagggcccaccactgacgttcttcgcgccagtcatctttaaattaattgcaccctttccatggccagctaacccccgccacccgtcccaacacgggcggtgcattcacgccacctgccttgttgtgtctcccccgcatgaatggggagagcgtcggagctagagtcaaaggaaagcggacggacatggggttggagtatcttgagcgtcttcttgtggttgactttgaagctttccttcccttcttttcttttcgtcccggactcgacacaccgtattcacccgttcaaccccatgatgaacggaaaataatcccgatacaggcatacaggctgcccgtccgtccttcgattcccttggtgcggcgcgatg

SEQ ID NO: 2362 - DNA, 703 bp, Nannochloropsis_gaditana
ttgcgcggaggtcttctcccaatcccctcacctcgtctgtctgcttcgtctcccttctgctcccggggctcctctctccccctaacaacaaaatggtgagcgcacggccggagccacgctgaaggccatcagctccacttcgacttctcggaggagggaaagggcttcgtgcatcaccctcttcatgtctcctgcgtcctctatgtgagtgaggctcaaggggggggggacaatgctggtgatcgatcaggaacgtcgcgaaagagggtgtagtcgattaagaaggccggacccgcttctatccttatcagacgtcgggagagggcgcaagaacaacgcacatgaaaggcccctcttctcaagcttgctttttttgtggggctaggacctcttcgaaaggctgaatatttccattgcgtcctctctttctgacgctcggcgacggacacagatgcccagaataggccccctaatcctaacctcatccctcttcgctgatcgctggaaagcgatgagcaaggatcccgaaggctgcgttcgcacaccctggacgcagttttcatcttattacgacctcgacaagactactcatgctgtcatctcaataccgctatgtaaaatgacagcaggttctatgcgacttaaggaacgatattgaacagccggtgcacttgcaccactgcgatgcattatgacaggtacc

SEQ ID NO: 2363 - DNA, 703 bp, Nannochloropsis_gaditana
ctgggacttgatgaggaaaatgacttgccaatgcctgggcccattttgttgctcgccacggtggtggagctggatttgcggactcgtgtgcccatgctctccgcatgaacctcaccaccatccagaatttcacttttcaccggaagaccagtcacatttgcatcaaggatctctacaggtagcgtttccgcggcggctgctggcataacgccacttggaaggtcctccatgacttgaaggttcgttgccaagaaacgccaatcccgacagcttccacctgttggttaagcagagcatttaattaaatacggtttccagtgtgcatcattggcacatgcagccctgtacattctgcgctgtaaagacttgtcttgaggcccatggacccatggtccccaagttactctatcagtggctcggaacgggggaaatctacctctggtggcaaacaattatcatttagattcccaaatactcatataaatgggcctccggcatactgatgcattgtattgagaggagtttttgtaattgactaggaaataatgagcgaaatgtcttcttggaagggtaaatattttggaattccactccttttccctttcacatcgcgactacctcctcacatctctggtccgcttttcacgtagtttttgtgctcatttcaaggaaagtagcgtaatatctaccttgaggagcgatg

SEQ ID NO: 2364 - DNA, 703 bp, Nannochloropsis_gaditana
agtataatctcgagtgatacccccgccccccggtgccccgggcagcatcgccagcgtcgtcaaccctacaagcggagctgggactgagggagggatggtgggtccgggcacgcacttgaacccgtacggcctgccgtcctcctttggagacccggagttgatccggtccacccactcggtcaaactcttctcctcttgtttggtggcaatatgtgccatgcaattgttgttgctggggctgcagatgcttgcggcttggtctatgggtgcgggagggggaggagaggtgcctgcgcctggtgatgaggacggaggaggcggggagcccggggccaagggcgcgggaggtaaagggggcgggggagtggacgggggcagcgctctcttaatcctgcaggtgatgatgaacaccttgggtctatacgtgggcctggtcggtatccggagcgccaacactctccagctgcaatcgaccaaggtgtacgtgtacggcttgctggtggtgggcaccgcctggatggccagtcggattatatgggccgtgaatagtgtgaacctcgggtatgacgtggacgtcggcccccagccctccgcgtcctctccgccccccggcgcaggaaacggcacggatgacggaggcgggggaggcggggaggcgtatcagcagatggaccgaggggaactgatctacatggtgtccctg

SEQ ID NO: 2365 - DNA, 703 bp, Nannochloropsis_gaditana
tcgttggacatccatggatccgtgcagtgaaggcttcgacggtaacaggtaagaaaagggaaacaaataaaaagaaactcaggagccggctgcgctggtggagctccaaacgccacgatcccccgataattgcggccatgtgcaaattaagcgcgcctgtaaggtattgaaagcgactcacaactcagtccactacaccgcatcaatcaccatggttttccactgtccacaacccgctggcaggggtattggtgaatggaggttaatggttttttcccagagcaggggcttagggggggaggtggatggcgggaccgtcttggcgagatgcatcagttacatccgagcttctacctgcctcggccgcattcacgtcccgtccctgcggattcaagacgccgtggtagagctctcccatttctgcttactgttgtgtcttttcgcgtgatgtgtcatgctggaacagtcggcaggtcttgcgcgtgtgaatgtcgacttctttgtcttgagggaggccatactgtttgaactggcgattcaaatgtaggacggaatgtacgtgacggatttctcttcttcttggtccttatcaatacctgcacggacaggaaaaacgagaccaacaacggtcatcacgcggaaaactgtgcgtaacagcgcaagttccggaagcggttggctttcatccttgtcttcggccatg

SEQ ID NO: 2366 - DNA, 703 bp, Nannochloropsis_gaditana
tctcccaagcgccggactttcttcgcgttgggcttgacgaccgttgcgccctgcgagacctgcccgtcccccatcattaccactttgtcgcccttgcgcacacacagaatggtggttgcatgcatggtcaagtgtcctgcgtgatcgcccccgtaaaacccacttctcggatgcctgagggccgccgcttgatgcaatcgtcgacagcctcccggcccggaagcatccgtgtcccaattaatgctgcaactcgtcaaagaattgctgctgcatggtatcgaggctaaaggtgacgtaaaggagccgaaaggcggttttaaggcagtgcttgtccccgagacggaccggcggaggagatgagagagcatgtttcctgtccatggcagggcggggaggaagagggggggaaatttggtcagtactccgcgactgacaaacaagcacacgttcacattaaaagtgtggttttgcgttatggtacatttattcaatgaaatctagaagcgttataatctcaaagagttcttatttgtctggctgctgcatagctggtgagagctggtctggaagccccctgccctcttctaagctacaaatatcgcattcaaaataccattttcagtcatcatccgcgagctttctttcacttccagaaaccacattcacccatatctttccttcatagtactgcttttggtcaatg

SEQ ID NO: 2367 - DNA, 703 bp, Nannochloropsis_gaditana
tgaggctctggtggaattgttgaggccttttggcaggactgccgttaaagtgaatcttatcccttacaatgacactggcgtcaatggctggatgccttctcccccgggaaacattttggcattccagacgtatgtacggactcatggcgggtggctaacatttgcacgcactcctagaggaagggaggagtccagcgcttgtggacaactggctaccggcttctctggacaacctcaggaaaagatgttgaaagctcaggccctaaagagctgatttcctcgggcaaattatagtccgtcagttagtgtacagtgaaaggaaagtaaccatgtgcagcgcaacaaatcacaaatagtttgcatgcgtgaattcttccattttaatggtcgtcgtctcccaatgtctttgccctctctgttgtcgcagaacgagcaagttgaagtttctttggcggatgttcttttcgaggagtgacacatgcgtacacgcgtctcggggtttgatttccggacggggtgtcgtacggttctatattttacctcaactagcctacaccgcatttcttgaagttgagagctgacaatcaagacgagctggtggattttgttcatcgacatacggtgaagcggatttgttccgcttggatggttgcacctttttctatacaccatgtggcccatttaccatctgccctcattccaa

SEQ ID NO: 2368 - DNA, 703 bp, Nannochloropsis_gaditana
ccatcagctgctcggaaggcacttgctcaacctgtgtccagtctagagacggacgggtacgagactcaagaaacttcccgaaaagcttcatgaaatttttacgctggggcggtggcaatatgttatcagttacaattgcttccctcatagcttcttctgcagaatggcttatattgcctcgcaggtatttgtcctcgaccttatgtaatggtgcccgatgcatggttgcttagaatgggtcggaggtgtcgtagaaggcaacgaacgcgaatgagatacgaaagcgtacagcagccggcaattctttacaagaatgtccttatcagtaatttcttggtctgagagaaacaagcattcgttgagaatgtggctgtgtcatgtaaaatgtgggtactcttgaacacttgaaatagtcgaccctttccagtgagcttgtgcactagctcccttcaaaaagcccgtaaaaatcatcccaaaactttcaaactctcaaacatgtaacttgttgcagtcatagcgtcccatttcccagagtcgggtcctttaaccttacacgatgaacataaaggcagccccgagcgccatagcaagataccctccagagccctaccgcgagcgatcgtcatcgggtttcgacctccccatgaatgcacctgcaccgcttccgtcgcttacttgcctgccctccgtattcttccttaca

SEQ ID NO: 2369 - DNA, 703 bp, Nannochloropsis_gaditana
ctaaacgaagcagcaggaatggcgaaacgcagggtggacgactggaagggtgagcggcgggatgactgaaccaaccgagggcagcagctccacgtcgacagcgctgtctggctgggaggaaaacctgacgttcgcgcgcccaaatgtggtgtggcatagtgcaagggggagttccaaacaattctaaaacccaaaactcgtcgtggtgcggagccatagcataaaaacattattaagatcaacggcgtggaggagagggggggcatggacaagtatcttggcgctgggaaacggggagtgaagaagatagttggtcaccgcccgctgcgcggatgcagcaaggctatcgccctgctctaccctgtgtacaacagatcgtgaaaatgtgcgtaacgacgtagtatgtgcaaggcaatagtattgtcaaggacttctaaggtgtttttcccccctctggcccaggctgctgttgaagaacaagggcgagaggcgcggcgagtctgggagcctcaaggagcacatcgtccccctatctgccttctaaaggcaggcgcacgcgtgcgaccctgaatatgtcgttggcacggttgccctgagggttgctaccagtgcggtttttgattcacgaaataattcctctttctatagacgtacagcaacacttgtcgtaccagccactgagctctttcctaccgtccagatg

SEQ ID NO: 2370 - DNA, 703 bp, Nannochloropsis_gaditana
atgtctgagagccatgagaagggcgtcgatggaggaagtgatggaatgggcatgaaggaggaggatgatgtcgaagatgacgtgaacgttgcactgcattccgaaacctcggacccagaagtcttgggtgacagtagaccgaaaaacggacgagaagctaaaaatcgtagtggcagcagggaagtgccgggacaaattgcagcggaggctgaaagtctgtccgtcgaggccttcggaggggatgtccgagcgatgcgacgtgcccgactagagttgaaaaaaacagagattgccaccttgtgcgaggccatctgggaaaaccccgagggagggctcttaggccggtccgccgggggcggatggaggggcaggggcagccgaatgggggctttgctcggcgctctggaggatcaggacaagcaagtccaagtctgggcaatggcctcactggtggcggtcttcagagacctggcccccgcctaccggatccgcctgcccacggagaaagagttgcaggtgaaggcgtcgaaggaagtcaagcgcacgcaggagtacgagcgggtcttgcttgccagctaccaagcctacctcaagtatttggagcggacgagtcacgcaggccgcgcgtcgccctctggaaagccccaggtgtccccagcggggagggaggtccgtcggagcgtggcagccaagtgtctgtgcg

SEQ ID NO: 2371 - DNA, 703 bp, Nannochloropsis_gaditana
ggcagtcccaagacgtaaagctgccgcgaataaagggcttcatcgacgacgatggaggcttgaatacgctgctgttcgaggaggaccagcacatggatgaggaataggtaaagcaccaaatacggtcgaagcttgtccctttgtcttgatctcaacattttcgccttgtcaaataatgtgtccagttggggaaagaagtaaataagtgaaaagagcattcttcgcactgaggtctttcctagcctgttctggcaagtccttactgcttcaagctgaagttcctgggatgaggacggcacgggcttagatggcaaaatgccaacgcccactatccaaatgtcctgcattatttaatcagtcagtcaaacaactgtggtaatttgtaagaaaaagcgctacacggacgcgcaacgacttattccggacggcatggctatcattgtggggccgggactggagcaacgcaacgggctccgacacgccctactcgctgtcccttatccctcgaggacattgataaggaaaagggcaacttcccccccccccacgttttatcgttgtcaaacaatgaaatgctttgtgcgcacgattgaaaagctttgactctggatggtcgtttggatctctccttttttacatacaaagagcagggagtacctactcatccgtggcgctggcaggactattgttgtctatcgcgatg

SEQ ID NO: 2372 - DNA, 703 bp, Nannochloropsis_gaditana
attacgtgcgcgattacacgggatgctgctcgcttttttccgttgtcttttcacccaaatataccgaggcagccatgcacgccatgctaaatagctatcatctgttcgccattggcgcctcctggggcggttatgaaagcttggtactcccaacgacgcggacaattactcgctctgttgagccaatctcaccatttttgacaggccccacggcaagatatcatattggattggaagaaatcgaagatttgaaagcagacttggtgagaggattcgcggtcttgcgaaatgtcaatggaaagcaataatctcaatgattaaatgcttaaagagctgaatgcaggtagcacatatcaacctcccgcctcccttgtcctcttgcttgcttatcatcagtacctttacctgtccctgcctgctaatgagaacccatctttgaaaacgaagggaagaaactaggagattgtcaagctctatcatggtcaagctcccccctttcccactgttgttgactctcggtttcgcctacgccggcccatgcagcgctccctcgctttcccggggcccgtgagttcggggtcggcccaagcctctagtcagccgaccatcattactttgccatcaccggctcaactttcccaggaattcttatttgtaatattcaccttcttaggctaccttcctcctcggtggcggcgctatg

SEQ ID NO: 2373 - DNA, 703 bp, Nannochloropsis_gaditana
aaagagcgtccccacctcgcgaataagccagactgtttagaccacagtgctacgcatccatttctgccatcatcaaccaagaaaaccgtcacttgcaggcgcgagggtgccagcgacggtcatgatgatagtaatgtttagaaagcaaggggtggaaatccgcatttctatgcgcacccgcgcaacaccggtgactccatccggaggtcgttgaactggaccatcgcaagattttcttcctccttgagggcagcggtcccgtgttgcgccaagaaatagcggcgagtccagcggcgagccgcagatgcgcggtatgggggtgggccgaagtgggaggtaattacggtctgagggccctccgtcgccgccctggccgcctccccgttcgcgtgtggtggtaaagcactggcgagccgcaccccgcgcatggtaatggtagcacgggttttgaggatggtagacggggcggtggcagtttggttgtgaggctgttgtcgtccaggggcccgctccttattttccttttcctgtgtggcaacggacggctgtcgagcatcgcgtgcaccgccctccacgggcaagctaggccttcccttttttctctcttattgtcgtcacggtgatcaacgacatgtggcatcaaatgtgaactgagtgcaatgcaggatggcatgactgtcgtcctgctggaatagcgacaatg

SEQ ID NO: 2374 - DNA, 703 bp, Nannochloropsis_gaditana
tgaagggcgctcaaggggagatggtcatggaggaataccgcaacgaatcgatttgccacatgccaaaccgcgggaaaaataagtaggtcaaggcgacgagggtggaaagcgtgaagggcgctcgagagaggtaaaggagtgaaggtgcgaggaccatcacagaagcgtgagtgacggattcacagcagattcggctccgcgcctccccgaagtcggagtagaactagactaccccttcgaacaagactttgaacttgcgttgacagaatggtatttgaatgtcacggcgaggtaggagacggtcgagtagttgtgtgcccgtttagacgcatgcagatcgggaagttctagcctaaaattcggtcactactagcaaggactgcacatcgtctcatgaaagctgccagcaagaccaaaaagccggcggaggtctctgaaaagggtagaggacatggaaaaaatgcgtatgatacagtgaatgtgcgcgttttgatcatttcaatggcaaaattgctcctacgacggaagaccaaaagctccacgtcgactattttctgatctttcccccctctcgatgacgatcatcgctcatcccaaccccgcaagcaatcgaccaaaagggctgccacacagacccgcacgaagaggttctttgaagctcatgccttcccaccatgcaatatataaggcacagacgtgcatg

SEQ ID NO: 2375 - DNA, 703 bp, Nannochloropsis_gaditana
gcaaaagctcaagcacttggcgacttgtttgttcttgtcgggtcatttttgacctataaccatgcggtgagattgttttgagggacatgtccggtctctgagaagagcttggaattggcggcgatgtgggcaaccgacgcactaacggtggagaaggcgtgccagataattattttcagctagatagcatcggaagtgttcagggtagataaagaaaaggcacgaaaaaacgtccgtgctcgcgtgccggagcacgaaaattcaccaggctttattccggtctgtcaagccagttgaagtatgaggaaaatttgaggcggcgggcatggagcggcgaaagacatgtcttaggaataacacggctggcacgatctggcctgcttcttactccatcgtccgtacctgcgtatttctggtgtctgaaatattagtggtggtgcacctggcacattttgaagttggaggcgagtgtcatgacaagcgaatgccatgcgtatagcccactctacccctccccctcctcaaaaaaggcaaatagagtaagacgcaaaatctgcctgttgccatggagggacgttcgagccggccaagtattgaagaagttatttgaagtactgcatccaaagggcgtttatcaagattgacgctcgcacagagcagggctgagaatattccgtctgagatcagctctgcggtgtctatg

SEQ ID NO: 2376 - DNA, 703 bp, Nannochloropsis_gaditana
accaccatgacaacaatcccttcaccgtccttgtacatgtcgatgcgtgcacggtgaatgcgggagcagggaacgttatctctgtcagacccctcgctttacaccatccctctccagctcgcctcaaaacatgactcgtgtggccgtgggccgacaaagaccctctccatgtgtattgccaggcaccatttcctctctactgggcacactcgtgcagaagtttgggtacaggtcgttgacggtaaaattattcgtaagacgtgtgggaggagtcatgaccagtcccttcattagggcctaatgaaggatatctaaccgctggctgggctattggttgcctcttgttccttttcaggcattccttttttttcaattacataaaaaggcgtcccctgacatctacaaggtctctgatggatgagaagtggccatctttttgtgattaaaaggcgtttaacgtccagactaggaaggacttcctttcactgctggctctcgcgttgtagtacccctagtaggagccctgagtatttcgtactaccatagtatgcctgcgtccccatctaactcagctaatcacttcatctccttcgctttctaatacaacatttcagaatcgaaaggcatctacgaaagcatttcgtgccagcagattgtaccgtagataaaaagccgtgccagcaccactttatcggtagccatg

SEQ ID NO: 2377 - DNA, 703 bp, Nannochloropsis_gaditana
atccaacattaagagcggttgcgtaagcatgtaccgatctttgccagaccgaaacatatgcttacctccgggagttccaatttttttgccgcagcttgtatagcctggggagagatgagtcctgttggcccgagcacggggaccttactgaccgggagggtccgcttactcttcttagccggacccgtcgtagccataaatgtacgattagcgttgctgctggtgatgatcagggtgctttggacgcttccgtccttcgcgcgcacgcaccctagagcgcacaggaatgtagcacgtagatcaaagtagagaagaggaggagagtagtcatgagaagccgatgaagtcctgctcatccttgcccgtgcaccacgatagaacatgtcacgcgtcggcactaccacagtattttcaaatacgacacctggcatatataccggtcgacgaggctctttcaggggatgactgtggggttctttcaggggatgacagtggccgtgagagaggaaaaggctgaagcccgtcgccccagttgcttcatatcgcctgatgatacgcaaggagtaccgacctttattttctggactgtcggcacacacacacacacacacacacacacacatacgaagtaaatttatccctgagaccaacaatattgttcccattatcctttacttgctgacttcatcctctccttcgcatg

SEQ ID NO: 2378 - DNA, 703 bp, Nannochloropsis_gaditana
agatgagagcgcgagccttaagaaagcgttagatgtcagtcccacgtgacgaagcccaaccgatttagataacgtgagcacaatctcttgtcaaccaaattttccaaaaatctttaatgcaaatgagtagcttggatttttatttggctagaatgtggtgtgttctctgtagatatttcaacatggcaagagtgtcagcgcttgcgtcaatttctcgccctccgagtactactactagtaggatacccgggaggagagttgcgagacggaaaggtctcctgtaaaatcgtacggttctcgccttttgctgtacttgtctgcactgccatatcgagagcgagttgatagaactgacaaattgcatgaagggagaacgttgggtttgccttttgatttgctgtttcacagagacgcaactcccacggcgtggcttccatcgaaatatcttgctgctagtcataggttgactgaaatttcttgataaagtatcgaacaatctgccacacttctccagctctcactcagattgcagtgtttgcaacgattgcgtcttcacaagaatgttgtgaatccttcacgtgtccacatcttcctcctgtaacccttctgctaatgcgttcacaacatcatgttttcccctttcctctttccgattctcacgctcctctgatgccggtataccttcaaaagccaaagtatcatg

SEQ ID NO: 2379 - DNA, 703 bp, Nannochloropsis_gaditana
gaaaatgacgtgcaaggacacgataaacgaggtgtgcaggcgggatatctgggcatatgtggtacggcggaaggccgtggcgtgtatcagggtcaaatggagatacgtagcgctttaaagcaagacgccaggcaagaaaggggaccaaaaactgaccattctcatcgatatcgttgaaaccaatacagtacagtcctctgataaattcctctgcagggtgttgtgtgcatcggatagtttacctcactttcccaaaataattttgtcacagacaaacaataggaaacgacaagaaatcatgtacctcacgtgtgccagcatccgcttcatactaattttggtagactgcctgtttctatggtatacgcacggagacattgattcagacagaaaaatgacgcaaagaaaatatcggcgggtgcccgttgctctgagcgagacggctctcctcttttgagagcgacaaatatcccgtaggagtgaattctactgcatggcagccggacagtaaaatttgggagttgtactgtgcgacatagagagttggatgtttcttttaacaatatccttcatctatcactaagtcagaagcacggagaaggaggggaggttgaagcagcgtgtactgcgtttttaaagcagccatgtgatttatctgattccttcttttctccaccaactttctaaagatatcaaacaaatg

SEQ ID NO: 2380 - DNA, 703 bp, Nannochloropsis_gaditana
actggtgggaagggagggagaagcagctttgttgtcaacactgtcgggcttggcattcagagcacaacctgacgcggatcgtgtaaaggatgtgcaagatagatacatggatatcgaagacagggacgaaaattccctgtcaaaaaacaaagcgagataaagtaaatatagcaaggggaaagcatatggtcagattcaaagacagatatgtttctttcaacccccccaatgaattctttcagacttcgttcatccttaagggctaccattcaaatgaaaatggctcacatgctcgcgcttattgcgagcatttttatgtttatggcacgatcgaatgacaacgaatcaacgcagcggcaagcgtcatcgacaaatctcccctggagccagtcttcaaacagtatatttgtcagataacattgttgaattcaaccggtaaatatccttgtgcttgtgcagcgatctgacctgtacaaacagcagagggtgcggtcaccttcgcaccagggctgtttataagtgcactggcctttggtttccacccctcgtgtgtccgagcccggcgacggcagccaaaaagcgagcaatccgtcacaaatggaaaaccaaaattcattccaacatccacctggtttccctgcatttttcctataagagcagacgaatatagtggaggtcaaacaaaagctagcacattgccatg

SEQ ID NO: 2381 - DNA, 703 bp, Nannochloropsis_gaditana
aaccaggctttaccattttcatttcccgtcctggacccaccgcccaggacgcaagtacgagaaatagattaatcatacatgcatgactaggatgtgtggattgagtgtacattctcctgttattggccaggacaatttttcggggggccctccccatagcccatggaatcagaaatttcatttttgaaatcctgaagaggtgcaccgcccacctcgaggtccggcgcggcccctggcttgtccacgcgcttccggcctgtctgaggcgcaaacggaatgtttggatgggcattgatgccgtggtggtgcatgtgtggcgcgggacgtttttaacgcaaacctggcctttatttttgcgccatgtgtacaggactgaccgttgaccgaagcgagcaactgttcgctgatgacccaaattttgacattcgtctacacgtccatattatctggacacgaaaatcgctccttgattatattcacccactcacgctgtcatatcaggcataccatcatgtataccggtcaagtgctaccagctgcaccgcctcaatccttgtcgtgtgcttcagattctacgataagcatcactccggacgcaaatacctattcaaatccaaatatcgatgcctcagactgcaaaacccattctcctccagcggccgcagcagccacggcatgcggtaaaaccaccgtttcaagcatg

SEQ ID NO: 2382 - DNA, 703 bp, Nannochloropsis_gaditana
aaccccttctcaggagccattctcgacgcgactacgcgtcccgatcccccttgggcccatttaggtcgtggctcctcccgacctcacgtggtcagaagaccagtacatgtcgacttaccaagcagtgatgtaccgccaatctcaatgcttgctgtacagcagatgtctggccttcacttcccatcggtacttgacaacacattcaggcaggcctcgccaagacaggcaaagcgaagggatcatgatggcacaggacctctcgactgcggccgagggtcagtgacattttcagtgctcacccagccgcgcagtgttgaggtacggggggcgatggacacgaaaatgagcggggcatgggggccaacgatcagtcactccccgcaacagctctgctgtaaagactaggaagatgcattcacgatcacttttttttgacgcttacgccatcgccgacaggcacttgacaggaaaggaagacactctaccctgaatccgaaccataccattgacaatttgtccctcctcccgtagatagcagcaagaagggtgcattgtgaatgtggcctcaaccagaggacgcggtttgagttgttttaaggaacagccactgctgcgacaacagatcaaaatctgaatttgttccgctctacgccgatccgtgtacttctgtttcagccataggcacgctgcctaggaaggaatg

SEQ ID NO: 2383 - DNA, 703 bp, Nannochloropsis_gaditana
  misc_feature (1)..(70): n is a, c, g, or t
nnnnnnnnnnnnnnnnnnnnnnnnnnnnnnnnnnnnnnnnnnnnnnnnnnnnnnnnnnnnnnnnnnnnnntgaccatcctgcccctccccaagaagaccgagcaggtcctcttctgcaagctcacgccccggcagcgggccttgtaccgggcggtgatatcttcgccggagatccgtctgatcgtggaggggaaggcgtcgcattttcgcgccatcaccgtcctcaggaagatctgtaaccacgccgacctggtggcgggcccggacgaggaagggacggaactgatggcccggctcgtggcaggcgggggctgggcggacgagtggagaggggaggaagaggaggaggaggaggaggacgaggcggcccgcatggtcatgccggcggcggccagggaggccctcgcctcggtgacggaggggaccatgggagccgtatgccggtcggggaagatgcaggtgctggcggcggtgttgcctcggtgggcgcggcagggtcaccgggtcctgctcttctcccagacgcggcagatgctggacctgctcgagcgctttgtccgcagtcgggggtgggaatacttgcgcatggacgggagcaccaacgtgggggcgcgtccggccctgatcgagcgcttcaaccaggacacccgggtctttgtcttcctcttgaccacgcgcacgggggggctgggcatctccctca

SEQ ID NO: 2384 - DNA, 703 bp, Nannochloropsis_gaditana
tgcccctccccaagaagaccgagcaggtcctcttctgcaagctcacgccccggcagcgggccttgtaccgggcggtgatatcttcgccggagatccgtctgatcgtggaggggaaggcgtcgcattttcgcgccatcaccgtcctcaggaagatctgtaaccacgccgacctggtggcgggcccggacgaggaagggacggaactgatggcccggctcgtggcaggcgggggctgggcggacgagtggagaggggaggaagaggaggaggaggaggaggacgaggcggcccgcatggtcatgccggcggcggccagggaggccctcgcctcggtgacggaggggaccatgggagccgtatgccggtcggggaagatgcaggtgctggcggcggtgttgcctcggtgggcgcggcagggtcaccgggtcctgctcttctcccagacgcggcagatgctggacctgctcgagcgctttgtccgcagtcgggggtgggaatacttgcgcatggacgggagcaccaacgtgggggcgcgtccggccctgatcgagcgcttcaaccaggacacccgggtctttgtcttcctcttgaccacgcgcacgggggggctgggcatctccctcacgggcgccaaccgcgtcatcctcttcgatcccgactggaacccgcagacggacattcaggcccgggaacgtgcctggcg

SEQ ID NO: 2385 - DNA, 703 bp, Nannochloropsis_gaditana
tcattactcgagtttctctcaaaaaccatcacgtctgtcatgagacttgttggttgcttttgtccttgtgtgccttgcgctaaaaagcaggcgtcggcccagatcaggatgcacgcgaaacaagcttcctgtcgtagcgcttgtgcctcccaaataaggcgtgttgcttgcggtgggcaacaaaaaggcgcttgttagctgcgatagtacaattgcagagtataaacctatcagaagcaaaactgctggcatgttgatgagacatatgatggtgaaacttaatggggagctgtggtagcgaggcctggcagttccttttgacaccggcatgtgacaggaagccatagacactgtgcgtgtgaaaaatgaaaggttatacttactgtatttactgtaactggaaaagcaaaacgggttgcctgcatgagaacaggctcatcgagtgaatgcacttgaagcacatacaaagcgtggcgaacaacgggagccgcccgtgcgatggcctcgatcagatctatcctaccatgtatctggacggatcttgagccggaagtatgactgggcgttgttgtggggcagagtcacccacctagatgtcttgctcttttgccactcgtcgtccaaggataataagacacccgctgattgcatccaccttgcccgtatcagcacaggacccagggtagctgcgaccgcgatcatg

SEQ ID NO: 2386 - DNA, 703 bp, Nannochloropsis_gaditana
  misc_feature (1)..(166): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagatgcgatttgaatgccgctgtggagtatcgaccgtaaagaaatagtaatatacatgtgattaaagtcgaaatttccctcttttatcacttttatgtggtttgatttctgtctctccaccgacgtctcgccataccttctgagtctgttgttgaagttgtttccagttatacgtatgttcttacttgaggcaaggaacgcttatctgtagccaatagggaaaaagtataagaacaattataatctttattgcatatttacagcccaataaagccgagaatgcccctacatgtcggcttcagcagcctcccaaaatgccgcaaattactcccactcctcttccttttcttcgtcacatgcttgacccccactttacgggtatctgggtttgctgcccctagccctgtatcccacatcgatcgtttcaaacgtcttcaaaatcagtttgatttgcggggcacagctttggccagcaacgatggcagcaaagaagtgaccctttctccgagagaggcttatttcctagggcaagcgtt

SEQ ID NO: 2387 - DNA, 703 bp, Nannochloropsis_gaditana
caggagcgtctccgcgcctacgaggtccagaagcttcggtacttcttcgccgtggcggactgcgacaccgtgccgaccgcctccgcgctctactccgaggtggacgggctcgagttcgagaactcttcctcccaggtggacgtgcgcttcgtgcccgcggacgttgatttggagggaaggaaggtgcgggacgaggcgagcggctcgctcccgcactcctaccagcctcctgtctttgtgacgcgggccctgcagcagacgcgggtggagtgctcatgggaggcggggggacggggagagggagaggaggttgacgcagagccatcaatgggaggagatggaggaggacgacatgagggcctacctggcatcgagcagcagtgaggaggaggaggaggaggaggaggaggaggaggatgagaaagggggaggaggagggagaggaggaggggggggtcggggggaaaagacgagaaaataaagagcagaagagaagggcgctgcggtcgctgttactgggtgacctggtaggggaggaggagggggcggacggggaggtgaaagaggtgacgtacgtgccgggggagcgggggaaggcgaagtgggaggagcggcaagcccgcgtggcggaggagaagaagagacacgaggagacgcccttcgaggccttgctgcggaagcgaagggagaagcgaaaggagaa

SEQ ID NO: 2388 - DNA, 703 bp, Nannochloropsis_gaditana
gaaggcgtggagaccgtgtgtggtgctgcggcgccggtggatctgggcctctgctccaccccagccaccttccatgcatgccttgacccgccattggggcttggcgtctctgcctccgtcatggtaaccgcttcacaccttccgatggaccgaaacggcttcaaaatgttctcacgtcaggggaaaggcggcctaacggaggctgaggtgtcggacgtcgtggcgctggctgccgagattttccaggaccagcatggggcctacccaaacctggatattcccaccacgcgcccacacccgcattggctaaaggcacaccgtttcctgcaggacgtgtacggggagcacttgtcacagctgatccgaaattgcgctgccaagggccggaattttgaaaagccgttggaaggcatgcgggtggtgctgaaccccgtcaacggtgcgggaggatttttcgttcacgtcttggaagcctgcggagcggacacgcgagggagcttcaacctggctccagacggacacttccccaacgagcctcccaaccccgaggaccccgccaccatgcgggccacggtgcaggctgtggcggccgcgggggccgacctgggcgtcatcctcgacccggactgcgaccgagtggggttagtaagcggggtggggaaagctgccgggggcgaccgcgcgcctattgccttgaatcgga

SEQ ID NO: 2389 - DNA, 703 bp, Nannochloropsis_gaditana
gccaagggccggaattttgaaaagccgttggaaggcatgcgggtggtgctgaaccccgtcaacggtgcgggaggatttttcgttcacgtcttggaagcctgcggagcggacacgcgagggagcttcaacctggctccagacggacacttccccaacgagcctcccaaccccgaggaccccgccaccatgcgggccacggtgcaggctgtggcggccgcgggggccgacctgggcgtcatcctcgacccggactgcgaccgagtggggttagtaagcggggtggggaaagctgccgggggcgaccgcgcgcctattgccttgaatcggaaccgtctgatcgcgatggctgcggccgtggtgctccgagatcatccgggcagcacgattgtcaccgactcggtgacaagcgagggcctctctcgcttcatcgccaaacggggggggaagcacttacggtaccaaaaagggtataggaatgtgattgagaaaggcgagtccctcccagactgctggcttgccatggagtgcagtggccatgctgccttccgtgagaatcgatttttagatgacggagccttcttggccgtgaaattgataggagaaatggcatcgcccgtgtccgccttgacaggagggaaggacatcgctgtctttacaccctcagcgggcttcgaaggcgccaatttgctagcactgattgcgg

SEQ ID NO: 2390 - DNA, 703 bp, Nannochloropsis_gaditana
gaatgaatggagggggaaaacagaagaagcagcggcgatgacagggtcgcggaggaggcaagggcttttaatggtggacgatttcttggaggagaactaccgcagacggcttgaggagtaccgcgtcgggctcggggccttggggtccccgggcgaggcgactgccttggacggagacgaagacgaggaggaggtggaggacgaggaggcggctcccgcgagcctttctgggggtcaggccgagggggaggtgacctcacccccacgtcccgggtcccggggggcgcaggccactgcccgacgggaaggactgggcgagaacgaggtcgcggggccactggcgctccctgggggcttcgtcctccccgcctccatcaaccggaagctctattggtaccagcggacgggagtgcggtggctgtgggagctctatcgacagggcgcgggcggcattctgggggacgagatggggctaggcaagaccgtccaagtgagcgccttcctgggaggattgcaccggtcggggcggttggagggcggggccctggtcgtcgcgccggctaccctcatgtcccagtgggtctcggagctcttcgcctgggcaccacgcctgcgcgtggtggtcttgcatcggtcggccgccgcctttgccgcccagccgggtcccaaggtctcccgatttgtccgccgggtcctcggcatg

SEQ ID NO: 2391 - DNA, 703 bp, Nannochloropsis_gaditana
cctcgggatagagcgtggtttcctctgccaggaaaatagcgcgttgagctgcaagtcatgcctccgcaacggctcgcattctcattaatttccccctgtccgcagagaagtagtacaacggggttgattcagacgcgttcttgtgcccggatgtcccactcttcatttttatccgaacgccggcccccccgtcggccctctcgctgataaaattccatccccttcaaaccaatgtacccggtctgtcccaccacaacctcgagccccgtcctcacccgctgtgcgctctccgacccccattctgcacacagcgtgcccatggcagcagacagagacgaccactcgttggtggaaagtgaaggtcgggccaccgccgccctccctattggggaccccgcgagcgaggccgcagcagccggaacaggaccctgcaacgaggagtttcaagagctactagaaagcctccacaatgaattggatgaggtcacaaagaagaaggcctcagtggaggctgctttaggcgatgaattggattcgttgcttatcgtcgaggcaactaaggcagtgcctgccccggatggaaagcaactcgcccttcaaatgaaggacttggagaaagcttttgcacccaccagggtggccgacctgactgcaaaagtcagtgcattgacggaacacgtgtatgggtgccaagagcttgcgg

SEQ ID NO: 2392 - DNA, 703 bp, Nannochloropsis_gaditana
gagctactagaaagcctccacaatgaattggatgaggtcacaaagaagaaggcctcagtggaggctgctttaggcgatgaattggattcgttgcttatcgtcgaggcaactaaggcagtgcctgccccggatggaaagcaactcgcccttcaaatgaaggacttggagaaagcttttgcacccaccagggtggccgacctgactgcaaaagtcagtgcattgacggaacacgtgtatgggtgccaagagcttgcggataagatgagttccagcgtccgggagctcgacgaacggcaaatgcgggtgcagcgggtgttggccatggtggaagacatcataaatcttaaaacctgcgcggagggtgtggcccgtgccctggaggaagatgatctccttggtgctaccagctacgtgcgccaattccacagcattgagggagcatccgcaaaggcatcggggcattacaatgtcctcgtggccgcggaggcgcggttgaaggagacggtgttgagaagggtgcacttggcggtctcacggtccgagctggacgacgtgttcaaattctgcccgcttctgggtcccttgggcctggccaaggaaggcgcgagcatttacgagtccttcgcggagcggctgctgaaagaggggctcgaccccctggccgcggagacgaataagctcccggccgtacagctgttgccca

SEQ ID NO: 2393 - DNA, 703 bp, Nannochloropsis_gaditana
gtgcgctcgacgtgccttggtcaccgggcacgcagggacggcctccgccatcatcaattacatcaatggtgccctctcggacgagctcatgtccgtcttgagcgccaaagtccggtctcttcgagagctccctctgccaatcgggctgctccccgccgcctcctctttgggggcacccgttgcaggtacagcggtggtagctgtcaagcagcattggagcaaagtgaaggagggaataggtgcgggcctggagactgcgcaacagctcaccgcggctgcggggtctttgatgggcggcgctgccggcgtgggcctgggcggggggggattgggggcggtgacttgttacccttacgaggaggcgaagaacgctttggatcgtctggtcatgctgaacaacctgtccgcctgcgcgcgctacactcttaaattgcagcaagaattgatggccgaggttccctccattttccaggacgacccaccgacgcagcagctcatggcgtgcctgcaggacatgtcggtgacggcgaagcacttcgagcagacggtggacgagggtttgcagcacgtggcggcactcatcaagcccaagttgcgcagcttcctccaggacgcgttgggggtggcacaggccgtggggaaagggcaaggaggggatgcgggccaggggggggcaagagggggcagcaaggtttcctacgag

SEQ ID NO: 2394 - DNA, 703 bp, Nannochloropsis_gaditana
aatatcgtaccacctggtttctatgtcctttattaacaataattcatgttcggataagttgaaaaactggtcgtatctggtctaatgggaaaaggaagtaggacaacaaaagaaaggagggaacatccggaaacagctgctcagccgtttttttttgaatttgtcgctctcaaatctcgaaggacaccttgctcgctcaaaccgcgtccttcttgcggcaagtgaagaaattcagcttttactttgcatttccacgtttttattgctcgttgctgcaattaacaaatgatttgcgttgataggtatattttcacctttgtaatttggtctaaatatgtggtcgtttgttattcgcgcaagcaggtcgagctttttgtgaaagcttacgattctgaccgaatggaagcccgtttctttgaaaggcgttgtctgtactccaccatatgctgagcgtctccgcagaagtacatttttaaaagtggattttaaaggcaatctgaaataggacaaactacacaaataagatgagtgccgcacgatgtttgcttacgcggtgatattgatactgctgactgtgaagcattatttatatcatcttccctagtggcctcgagtattttcttgaaaagactttctgcgtcttaaggaagctctttgtcttaattcgtcttttctttcacatatgagaccagcttcaaaaatg

SEQ ID NO: 2395 - DNA, 703 bp, Nannochloropsis_gaditana
ccctttttgatcaaaaagtcgttgctccaagcatagcaagcagaacatgatctcaatatctgaccccaggaacgggactggaaaaggatcaacattgcgaagagcatgccaaggagaacatgacatgagcatggacctccgcatgtatttatttgacattcgactctccgcaacagagttgtctgtccgccccagatcctgggcgcgatcttttacagctttgtatacaccgccccagagctagatcaagcccagccaaatccgacaatttaaccctttcgttgtccaacgatttccttgcccgtaacatgtactatcggtcctcattatgaagctaacatgacagtgttgcgtcacctgagtgagatgtaaataattcagccaatgtggggaggtcgagtagatgattgtttagtggtacttcaatctttacctattatacgatttgaattaattcgccatccaagattaaggtcgacttgtccattcagatacttttgatggtgatgtgactttgaattcagcttgtattgaacgcgagtcgtcccccccccattgcgaggtctctttagaccctggtcatgaagtaaagtacacaccccaccacaggcacaactagggttgacaagctagagagcctatccgaccattgcggacgatcgcttcctcgacctccaccttctcaatctctcgggcctcaatg

SEQ ID NO: 2396 - DNA, 703 bp, Nannochloropsis_gaditana
tctcagagaattgcatcatgcccatttgggtcatgccgaagtaggcctggcccttaaccatttccatcatgcccatcggattcgacataggattcaccgccccaggcactccttcctccgatagggctccttcttgttcgtccttgccgacgaaccatgctttccgggcctcaaagcccgctttgtgaatattgttgccattggcacgcaagcggtcagcacgcgccaggacctgtcttcgtcggagatcatcgatctcggggggtttattgcctttgcccaaatgagtcaggtacgctcgtagaagattaatgcacagcacaaagaccaaaatggggaggacgccccagttccggatggccgggtcgagtagaaggtcgcggctgctatggccgagtgttggaggctgcatactctgacaatcaccaaagataggatgatgagtgaaggttaggtctcagaatatgtgtattgaacatgtgcagttaggcggtgcatactggaaaaccttgcggcttctcgcatgatcgagggcgatgactggagttgtaggtggcggcgatgacgggcgatgtgccttgggatgaatacacatgttgccgcgcttggacgacacgtacagctttcctttggcagcagcgtgcgatgtgcgatattttctgtgatctttgtgatttctatgactttggcatgtcacgacaca

SEQ ID NO: 2397 - DNA, 703 bp, Nannochloropsis_gaditana
agagcaccgtgccggcgaagagcccgaccgcggcggtcgtgtagcttagtgcgtcaagggtcttctgccccgcgttgttccgcagtctgtacgcacgatcataagcgccccatgctcccgattctttcagcttctggtttgtccccattgccatgattgcaccgcctaaaacgcttccaaccaaggaaatttgacccaagcgtcccaacagaagtctacccctcagtccccgcttccaacagacaggtactgccagaacagacactaaaatggaccctgcctgcgcacccctggtcatggcatgcaagtatacctcagtcaccgctcgctcgtgtggaattggctcgggtacatccaagtcttcctcttcagtggggcctgaatttggcatctcccctggatggagaaagcattgtgtgaaggcgtaagcccaactgaaacaaatgtgcgcggaacatgctgttattggctcataaagtatcaccatacacaattgatgacggcgagcgacgaagccgagggagtaatcgcacagatgcaatgcccgggtccaagcatcggtgcacttgaaggactctgttcgtaacgcccgtcaggactcactgccccgttctcttcctgccaacagccgatttcgccagcttgcacctaccaatcttctcttacggcttttcttgcaggcgttacacactgagtggacatg

SEQ ID NO: 2398 - DNA, 703 bp, Nannochloropsis_gaditana
acaaattccctcataacatcgtactcgacgactctcgacaagagaatgtatttcattttctcttaaacctgttactgtgcacatgcatgtttggtcgtgactggcttctgtcacatgacatctttcccttcattattgctatgttccatcagtccttcgtgctgtatcctgtatcagtgcgtcaacgcaagcctctctcatgataaagccgcacattgtctcccaatccagcatgtatccttctcctgtgcaacatgacgtcgtttggtggtcctcggccttgtgcacaaggtttccatgtatatagccatggcaggcagaacaggcagtgccagattttccaaccctccccaaagcctcctcttcccccccttcccgaaattctttacatttccgccgcacgacacacgcctcgtgctttccgtctacatccagcccccacagtcttaatattcagccttggtcggagccgggcaggttttgggtgaaccgtgagcgatttttgccgcgtactttaaggcacgctttagtcgctgcagggccgtcgccaagttgtcatgctgtcaaatcactcgctttcgcccgcctttccatttttaacccccattccataacccccaacccttacatgtagacactcttacggtcgccatcagaaaaggacattagctgggctgacagctttttcaagcgaccaatcatg

SEQ ID NO: 2399 - DNA, 703 bp, Nannochloropsis_gaditana
ttcggagaaatatacgtgttcaaaattacttaatagcaacaatacagatccccccctttttgctgataccgtgtaaatgtaaaatttgaccgaaggtaagaaggcctccaaaaaataacctcccgccccccccttcctccgcgacgcgaccgcaaggaacagcgtccaccctggcccctgcctctgtcctcaacctacacacggttaacttcaaggtcaactccatgctacaggtgtcatggcgaatgtggatttgaaacctgcatggctatccttcatgctttttgtttttgtcatgtccaattttgtccgagatgcctgggcaatcacttctcgcatgggcacggtaccctccttccaaaagcaacaagacctaccctccttctacacagcaaccgatgatgacattaattggagcggccgcgtactacggaatgaagaatacatgcgtgtcgtatttgactggcccggcgtgacagcttcgtttcaggtggatgaaaatgccacagctgtgacggtgatggtggacgactcctcccttgtagggacgcgttttgcggtcttttacgactcaccaacagcgcgacatcgaaaattgagagaattcaggacgttgagaggcgtattcagctacacattagccgacgtcggcatactcggggcacaaggattgagatttgagcccaacgtaaccatctccatg

SEQ ID NO: 2400 - DNA, 703 bp, Nannochloropsis_gaditana
tcacaggcccgtcggatcgaccctgacgatacgtagccccatcggcagcgtccgcgacggacgaggacggggacgacatgcgttttttctctaagtgtggacagcttgtggccgaatcaccgccagaagagctgctcttgcgtttgctgctttgcgtagagggcatggcggaggtctactgggacttctgaaatcaatccgggaaggcagcagcaacagaaaaaagcgaaagaagtcgtctgttacaaaatatatgcccaagcagaagcaaagcgaacagcgtgagcgatagctgtgaccatgatgacaacattcctgctcgtggtgcgtgagagcgggcatattgtgcgttgtatgtggtatttgacttgttgcaggcacaagaaagagctcgaatcccgccttcccctgtgcgggcatggcgacagaaaatgatggcccctccgcgcccttttccagtgtctgaacttgttgcagtgggctaggccgaacaattttgctcacattgccatgtttttgcaatgttcacatcgtgaccggacgcggccatgtggggtggatcaccccacgtatagtgatccagcgcctagccacattcaaaaggttccttggagttcaagcgtacccacagccttcttcctcccctaaatccacgaacgaacatacagagggcctgtcggcgccgaacgaaaggcacgacatg

SEQ ID NO: 2401 - DNA, 703 bp, Nannochloropsis_gaditana
ctcgctcttcatcgccgacaagtagcttcagcagtggaaatggcggccactaagtgatgattacaccatttaaaggataagagtgtaattgggagacatgtattggaagggataccaaataaaatgtaggaatgtcgaccgaatactttatctgatctttcactttgcttccacaaaagcagtgacttttccaaggtgacattttattccattctgtgcaggcattgtttttttggggacgactcgactgatgttgtcatcgagaaccgacctacaaggaggggttgatcattttcaagatccacagccatatgcgaatgcatcttttctcagatcttggtctttaatcttgccgacttggactttctatgctctctcagttggctccgcaaaggaagcggtataaattccttgtaagtgagctggacttcttcttgcgcggcaagccccaaccgttacgctaacggctcggggaacgagtaaccggcacgtaagacggcgattcgcggtattcaacatataaatgcgcggcttggcctttgacataccttactccgattaatcgaaagaatcatgcagcttacattcaaactacccattatacgcgtcagctcttgttcaataagcctatcctccagaggtatctgtcagttgtagacttcacccatcaccgctgtgctagacagtttctacgcccagcatg

SEQ ID NO: 2402 - DNA, 703 bp, Nannochloropsis_gaditana
cagcgcggatgcgcgtatcgtccgtgactttcgcctctttgtcgaggggaactgtgacaggagagaggggaagtggggaagcggtcagggttgggagtgaccgcacgtagatcctcatgacaccagaccagtaagacgtaccattgaagtccactcgacagaagacacgttgattcttgagatcgatcttgcttgccagacttttgagggtttccttgcctagggtcgtatggtggggcatttgcagcgttgaactttttgttccaagatgcgtcggggcgagcacgtacagctcaagacctactcaccagacatgacgacgacgatataaagcttaagaaggaagaaagtcctgtttatacagcgcaagtgcgcaaggatgagtgtgcatggcccaggcggtacaagcccgcgacgtaaagatgcgatgtactgggttgcgcagggaggttgtttggatacctcacagccttatctatcatcgacgcgcccttatttccacacctggccgacaacgcatttatcacatatccgagccggacaccgattcattccgataacgatttgtgtctcggttagaggcatctattgcctgacttcgccacagcgttgtcttccttccgaatcacagcatcctgctccttcgtcgctgaatcacacgagctcccacgtccccgacctcagtatgtcaacaaaatagatg

SEQ ID NO: 2403 - DNA, 703 bp, Nannochloropsis_gaditana
tcgagcgggacccgggggcgatgacgaaatgggtgactccgttccgggccagctcctccaccaccagcgtcgcccacagggtggccaggttagggaggctgcgtagaggcggggaggggcgagggaacatgcggacaaaattcgccattttcgcgccaatttccgcccactccccctcggccgtcgaccccggcacgatccctgccccggcgaagacatgagcccgctcgcgcactatcagcaccgatcgaatcgccaccgcaaactcggcgctctcgcgggataggaatccaatgggccccgcgtagaagccgcggtcaaagggctcgagctgacgaatggcctgaagagccgtgagacgaggctcgcccgctacagccggcgtgggatgcagggcagccaaaaagtcgaaggcggaggaggaagagcatgtctccgggctttccctccaatcctcttgcgtatcgctttcggaagcagcaccgcttcttccgcgcagccggccggttattttgtgacagatatgctgcacgtgttgcaagcgcaggacgaaggcgggaaagcgctccaccctccccccttggaccaagggccgcagggcatcttcgatcgactccgccgtaacccgattctcgaaccggtccttgtgagaggccatcagctccgcagccagggcctcgtcctcctccggcgtctgaccgcg

SEQ ID NO: 2404 - DNA, 703 bp, Nannochloropsis_gaditana
tccgaatagtaggctgctccatcccttctggaaactagcccacgttcttttgtttttggaccagaaatagcggtaccttaaaatcccttaaggtctcaccttcgcaatctttggggtcagatgcatgtgcgaggttcgccagacccaagagggcggcaagggcggctaccacgccgagggagagatgggcgcgcatagtgaaggtcgtggacgtccggactgacgcctgtcgcgtataatgataaggagaaaatcgtgaccacagcatgggttaatataacctttgtcaaagtcctagtgtcattatcctgcgcagatcacctcattctactacgattacggctagggaagtgcttccgaggcggcttgggggcagtgcttcgtggcacatcttgagcgagcggaggcgagagggagagcctttgaggtgcaggtttgcccggacacgtacaatgacagcacgcaaaacgcggccgaggaggcgtccaacatgacccgaagacgtctaattaagaattcacgccgtcggcgccagtattgtctgcctgcgcgttgtcaatgtgcgggttagcccccgcgggcgtggaatgaacagccccgggccgcacacagcctcgatcaagtcatgcagtcgagacctcccggggcaagccacgccgcacagcctcacacacgcatcctacatgtttttcacagcaatatg

SEQ ID NO: 2405 - DNA, 703 bp, Nannochloropsis_gaditana
tatcattgagtcgccgggcaacctcttgggtcaaagttgactttcccgacgccggtgccccgcaaacaccaatccagtaaagctgagatgtcgcctccgatgcatttccagtggaggatggtggcaatttcctgatcctaagagcctcatctacttcgtcgatgaggtctgtgtatattttttccctttttagggggggcacgcgcttacatcagggaaacagggaaatcgagtaaagtcgctattgtttgcacctacatggtggatacttgatctcctaataaaacctgtattaaaatcatgaaataggatgctagtcattcattgctttctagcctttgagagggatgaaaacgctcaaggagcttgtgcggctcgacgagaagaggcatgccaccgtattttgcgcgaagggtgtgtaaatatgtggtcgactcgagtaattgcggtcgacaattctttacctgccgttcacggatgccaacccatgatacctccggccttgctctgctctgttctaatagaccacgatgacgacgtctaatatgcttgattataagtatcaacaacacaaaacatagcttgaaatttcctttcctgttaaccacacgctgctagttgacgttgctgctctcccaaatatcgacgatacggaaaatgttgccacctttacctcatgctacactctccacagtgacagatg

SEQ ID NO: 2406 - DNA, 703 bp, Nannochloropsis_gaditana
ttcaaaaaggatggggagggaggtgaaggtgggggcccacagagtggcaagaagtagaggtctgcagatgacaacttcaacgcgcagcatcacaaaaggtgtgaaatttttgatatcgacgatgaggagctggtcgcaaagctggcaaacagatggtattgtggtagccgccacaatataggtgtagggagctcgggctggtgtgacaggctgattcatgtttggtagggagacccccctcgtcagtaatgtactcgcgacaacgataaccgccacgtcaagaaagcaacattaattagtcaagaaaattcattcattcattgatttttttcattgaattgttatctcgctatgttatttacgacctggtcttaaagcacacatgcatgctcgaatgcgacagcttggaaaacgttatgggaatgctcagtggatggagcgggggggcaggaggttaaagctcagccactgcactttgatgataacatggtgcacaggaagcttgcacgtcgttatgatcggctgatatcgctacgtcataccacagagtcagctctggtcgtggatgcggtttgcccgaaataataattcagcactgcttgacttggtccgcgcacaactcttcttgctcgtcgttgctgtgggtcagtgcttcctgataccagcttcttgtcatcgcatcaacaatttcgccctgagcatg

SEQ ID NO: 2407 - DNA, 703 bp, Nannochloropsis_gaditana
cccatctgcaggaaggtccatcgcggcatcaccagcaattgaactcgactgcattatcaccgcacggataacaacctggcacaccccctgcacgactacgtcctgtgaatatagttggtttgaaggggttggaatccgataagacgggtctttgtttgcgaccgagtgagcacgagcgacatgcgaaagcgaccgcctggcgggtatttctccgatgccctggtcgtccatgtgcggcgtacgcaaaccccaaccgcttgaaaagggacacatgagggtgcctttaattctgcctttgctgcacccacagaaacaactctgctcccacgcactcgagctacaacgagcctgccttcggacggataagaacgaggaccggttttcgcgccatatttctccaccccttgaccatgcctcatttactacgacgtttctggacttaaattccgggtgtgaggtctatcgctgcatgtcggtataaatgcccaatcttttcacaagtttgagacattctcaagagcttgagctccttcttttccttcctacagtccgttcttcgtctccaagtccttctaaatatcgcctcccctccacacttcctgactcgcccccctctgacatggaggaaagcaaaccccccagacggatgaaaggggtcaccgtgtgcttacctattgcctacggatccatcgcctggcacatg

SEQ ID NO: 2408 - DNA, 703 bp, Nannochloropsis_gaditana
attaaatggttatttttctctcagttccggagaaaagatggatggctctaattgctttgtctccatataccctttctcaagaaactcatggactcacggccgtttcaagggcttatcgacatggaaaagagggggaataggcggctgtttgttgtcgccaaccctcgtgctcgatttagctcagtgacttctcgcggacagggggtgcgtcgcctgcgagggcggcgatggctctcctccctccacccaccgggccttttgtctggctgctcagttgcacttggcaatgggtgcatgttgctctataccgagtccatataatatctcgagccctcgtcttattctttcgaagctgacgctggacaacccgtggacgaacgaattgctttttttcgacggctgacatcgtgagcttggaggcgatggaggggcagtatctttcactctctcccacgacacccattcggaagctcgcaggtccaaactgaaaggctgcgggactttggagtaccgtggactgtatacttaatatgtgcatgacttgtagatgaaagtgactgggcaaatgtttgaacatcacgacgtgaatatgcgcacccacatgactcgctctctgccccctccttctcccacgtaggtggcttcgtacttgctgtcaccttttcgacagaggatacagctatcagcatccattctgaccatg

SEQ ID NO: 2409 - DNA, 703 bp, Nannochloropsis_gaditana
ccattgtgtttttgggaaggtcatcaggaagtccttgatactctcgttcgcaaggagagggacttgacctttcgactcggggcttttatgcgctagagcagcggctcgagaactaggaggaacaaggcgggaagactgcttaacattgcccagattgttgttgagtgctgtcgcccgcttaacagtggcaccgtgtccttgcaccatcgtgcgtgcaggtggactaggtcctgtttcatgttgcaaggttggtgttaacaagtattgaggcgtccaagttcctggcagtgggcccccaaggtggcggcaatcaagcggcgagttctcgcactacggtgacgaaaaagcgactcggcgaggcaggcgtagcaatgcacaatgttgccgggtaattgtgcgtgcacgaagccctctgctgaaatggtgcatttaaagaggtaatgtagagggggaaatcctcatcgtcactctccctgcgcgtctccggcattcacatgacaggagggaggggacgagtgcaagacttattcgatcctcggtcaggagggtccctggggcaagcacgagtttaattgcgtcataataagctccctacttgtaagccatgaagcttggtaatcttttgcccccaacggatgcatactgggccaccattttttttcccgccttgcttggatatcttgtgctgcttcaggctgctatg

SEQ ID NO: 2410 - DNA, 703 bp, Nannochloropsis_gaditana
cgcagcgtatctaacgacaatcttcccttgtgagggctcgtctccccgtcctcgaccatggtacacctccttcgagtgttcaagaaagaagaagtgaaggcggagggtgaggaggttacgacgctaaatcaacccaacatccaacgagaaagtcaaaattttcaagcgtactatgtatatttctcgaatcacaggtctataaaaaagtccaacagtcacgtcttggtcaagtcctaacgtaaacatccgcactttcaaggtcggtgtatccgcagcccgtgaaccgatgacaaagtgttgtacccaatcacgcgtccttctacctctactggcactaattttcttgttgtaggccccggctatgccttcgccacgcggcacttgccgttggcctggtaataatagaggtttcctagggggtggggaggtagagtcgaagcgagcaatcagcgactcatatccatccaagcctcttcccgccttcgtgtgcatccctgcccttctcctggtgctaagtaccatcgcccacctcctcccgcacctgtctctcaggttttcacccctgcttggtacgggggcacgggtccaggctgctctatttcacggcgaacgcagtctgagagctgagtgacgaagactgactccggccagttgcgatcatcgagggcaaagtatctatttgcctcgttacccgcgtactatg

SEQ ID NO: 2411 - DNA, 703 bp, Nannochloropsis_gaditana
ctgcccctcgcggtcaaatcgccctttccacccgccaatagttatcgcccccggcgcggccttcgtgttttagttaaatcgctatcgccttcgagccttattaggctgctaaagagaggcccacgcgtacgtcagcctcctaaagtttttctgtactaccgcatgaaaagtcacccttctcgaaagcagaaagtgctcactccaattagaaaatcaatgttacgtatggcgtcgagatcttgcttttccatggcactaaatcttgttctcatccttgcttcgtcacagttcaggcagaacgagcgatctctccagcacccagcttcactctcccgcgacttttgtgcaataagctagggtttcctccaacgaaatagctctgctggagaaatgccaaatataaggtgtttgctgactgttgtaatctatgtttacctcacaacattggctgcctccgccttccttccctcccacactataacctcgccgtccgtagcgtcttttgcggaggtcagttccaaatgcggacgcctttcaacaaaactggaagccagtcaaagagaaacaaattttggagccacgcgtcgccgtatacttaccgggtacttctcaaaagggctcgtcagcgcggcggctcttcaagtgctctcttttccatccccaaccatcgcggccacgaataagacagcgatagccgcttatg

SEQ ID NO: 2412 - DNA, 703 bp, Nannochloropsis_gaditana
aaccgtaagttcaccccattctctacgcatttatccacacgcagaattaaaatcctgttgggccaccgtacgcgccaggtgatcgacctgccgcagtaccggatccacgattgaaggaagctcgaagcagagtgttccgctccaatctcctctccagtgtgcctctcaagtcacggttgcttcctatcgtgcttgtcgtatgggcaattgcattcccactgtacgtatgtgacactctgtgatacgtagcgaactcatatcagctttccacccaaagtttgcgtaaatatcgtccgtcgccttttttctcttcagcaggcgcgcgacggctcggtctcgaaaagcttcactttttggtctcgatgacaattttccagtcccatttttgtcttaacctcttcgaggttctcacgcttgtgatttgtctctattcatccttcaccaggctcggctacaatctatgagtacaaagaaccacctccgtacacgaggacacagcagcacgataagcgatgccagcaccgctacctgtagctctgtaacgagcaatcctttggcgtcctcctccccatccgcaccaacccgcggacatcatccttcattgacaccatgccaacatgctccagtggacgtgacaaatcgggcggcggtcagtctggttcggaagaaggcaaagcaatcgcagggggacgaggaagggatg

SEQ ID NO: 2413 - DNA, 703 bp, Nannochloropsis_gaditana
aactgtccttcctcgtgccccgccgaggccatggatggaatctttctcaacttgttcctatccgcttattgctgtctggcgtatccccctcgctgtggatgattcgagacttctcgcagatgggaatgcgtcgttgtgcacacgcgatgcgcacagatggaggactctcgggcatttaagttctagtcacgccgtaactgggagcaacccatttggccctcagtgcctgatgctaagtagaacttgccccccggctacccccaactggaggcaacctcctgctcctcgatgagaagaacgtgtgatgagtggattcgatacaatctttttgtcggatcaatcctgatgtatatgtttatttctactctcgctcgagcccgtaaaaagttttcgcggatcatacgggggcattaaattttctaacttgcaacacatacctccctcacgaagggcaccggtattgagtattgagaagtaagcatgcagcaggacaataatcatggatgatacactatacaaggcattcaattaaaatacgaatgttctattttggattcactgacgcgttaaatgactccgacgcatttatcctgcaggttctttggaggcgtaagctcgttatattaaaaagacgtaagtaaacgaggtagcctgtgcaccatgagcggacgcgggcgcggggagtactacaagcaaaaatatg

SEQ ID NO: 2414 - DNA, 703 bp, Nannochloropsis_gaditana
attgttataggaggcgtacgatgtacgtaggggcctcgctcttatgtgtcgatgaaagtgtggagtgagcgttgtcagaacacggagagacacttggggcgtcctgtcctgaaataaaaatgaaaactgattgcaaaccatgtttgtgtcattctccttcctcttgtacatcattctaatggcttttattctagacaatttgtaaacgcgttcatggctatcaaaaaccatctgacggtgagcttggagccaggacggtacgacgtcccaacgaacacgtccgcaaatgcataagcctcctaaatcccgttactgtgacatagcgtagaaaggcaatcatattggatcacacctcgacggcgatgggaatggacattagggactgtgtggtcgtgtatggagattccggacagttactagtacccggaggatggaggcttccatatcgagtcctcggtgccttggtggcagtgtcccgcactgcgtgatcactggctttctctcgactaattaatgcctgtacgcgcgcacatttgtcattaagcgtgtccgagggagtcaatgtgcgaccatctggcctttaacgcggtaaattggcttgcatttttggtttcttccagatgctaagctactgggaagcctgaatacataaggctcagctctgatttacatttgcgtttcctttctcaaccttgattcagtc

SEQ ID NO: 2415 - DNA, 703 bp, Nannochloropsis_gaditana
cttatcgaagctggtgtaggccgtagggagtagagatccacgattatcctccatggtggatgccgatctcggcaacccggaaggttttgcggcttcattcgatccatcactacccttttccggcttatttgatacctccttgtcctccttgtcctccttgtccttctcctcctcctcctcttcaagatagtgcaacagaccctgtcacaggagatcgggacacacatgtgagacaggaggccaaataaaaggtgtgtgaaaacacaaagagagtggacattgcatgaactctttcatggacttacctccatactgtcttccaacgtctgcctccgcggcgtttgtcgcggctacgacatgtgtgctctctgcctgccaaatccccgtgacaagcctagcccgcctcagaatgacaaagactccacaggccccattaattgtgacgaacgtatgctgcacagtctcacgacagtaactgtgggtatgcattgggcagtcaaaggcagtcgtttgggggggctggaaaagggatagccaaaacctcctggctacctcgcctactgcctcgtctgcacaaatggatgataaataaagggcatattttctattttttgagaatgtttcaacacaccgcccgcacacagccacgaacgactccatcgatgccattcaggcatgcagggcgaccgcattcttgttcatg

SEQ ID NO: 2416 - DNA, 703 bp, Nannochloropsis_gaditana
gcacagtctcacgacagtaactgtgggtatgcattgggcagtcaaaggcagtcgtttgggggggctggaaaagggatagccaaaacctcctggctacctcgcctactgcctcgtctgcacaaatggatgataaataaagggcatattttctattttttgagaatgtttcaacacaccgcccgcacacagccacgaacgactccatcgatgccattcaggcatgcagggcgaccgcattcttgttcatgcgacagacacttcgcttctcgttggtatacgcccccattcccttttttcccgttcggccataaacctcctgcccctccttttcctttcccaggtaagcgaacctggcatgaacacgtatacgctgacaccgctgcgtttttcaaggagaaagggtcctctgtttaatccgtgacaattctcactccacgtctcatcacgctccgctatctccttagaattactcccgcgggctccacctttgccttcatcctccagagaggtaaacccctccgagacgattcacgttgcctccccctgccagtcaggctgtcagggtcaagaggcggcccagcaagcttggcaagaaggggatcaccggggggaaaggcaaggctctggcccaaccgaggacaggaggagagggcagcggcgccttggggacggggcaagtggatgtacgtcgatgagggacatg

SEQ ID NO: 2417 - DNA, 703 bp, Nannochloropsis_gaditana
tgttcatttttctgataagaccatgcaggtcggattgcgcccttgaagcgtttaaattttgaaattttgaaacagcaggaaaggagaaatcagctccgcaagtcgtgggggtttgcgcaatgcgctttggctgcattgtaaatcacgtgcctgggtcgttgccgccagtagctcagtagcgatacttatctaccatttcgcacattcagcttgttttgctgattcgacaacgtgaggactgtccaggacacgtttgcttctctgcgacgccttccctcctttttgctctcttccctttatggacaatctcttcacccttataatcttggattaaatctaataatttccaaatttaatatatatatatatatgtatgcgtttttaacacttaaaaagcttcagctgctcgaaatgggaggaaatgattgtgtcaaatcagaattcaaagacccgaacatttgtttacgaccatccacacttcatttttctcgcacggacacattacgatacctgacagggacaatactttttgtgcagtgtacattcacattcaagctgtcttggtgttttagctaatccatacctgcgactatgctgcaaggaagatggaaagcgccaagaagaggacctctcaatttgttgtttgggtgccttttgctttgtatgggaataagactgcagcctacgcacgcggaagggcatg

SEQ ID NO: 2418 - DNA, 703 bp, Nannochloropsis_gaditana
gactccgccgccctctgatccaagcgacctgtgggtccggtcaaaaccacgcgacgacagcctggagattctagaatgcggtagtgagtggttgaagccctgctggccatgttcgtggtcttgatccctgattcctcttggggcttaagcggagctgtcttgagtttcttggcctccagagcgagcttggctagcttcgagcgcatcatgatcgacaactctcaccccactggcagtaagccgccctccgatgctgtatgcgcctaataatttgtggcacttgatgtgttcaaatgtgacacgaccacagcgtcaacattaaaataccttcattgagcgatgtgcgagcatgccgggtatcagtatactctctccagtggctccaatagagcacgtatcccgacgcaaaaagcactaataggtcgtctacgccgacagcgcgaacacacactgttggcttagtatcgggacatatatccggaccattgatacgtggtgactgatttcgtgtcttggggcgggtagtgaggggcagaggcggccgccgccacgttctcgccaagaggaagacgcctcctgaacttgccttcgacgcaacaataccgttgcagtcagctcaattttaacagcatacatcgcatcattgtattttcaggcatagcacaactctgggatcgtagtgctgaaaaatttcagcaccatg

SEQ ID NO: 2419 - DNA, 703 bp, Nannochloropsis_gaditana
cgatcgagcctgttgggtgccggaacaacaagaaatcttccacaacaccgacgagggtggaggagtagaggggagcctatgactcagcccgtctcacccagagtaaggacgcagtaggtgcacagtgttaactccactggcccaaaaatgcacaacgaccctgtttgtggaggtgtggtgttaatttatgttccaatcagtcatccgtcgaccggtgaaggggcctgggttcctccttgaggcggcaccctcccctccctcgccgttcgcacgcgacttgcacaatgttgcatatcggtaggtggaatgcctgcctgcataccagagggagctacggcatcaacgggctcggaagtaaatcgagatggtcacgggagagtcgcgctgaaagaactcgatatttttgaccttcactccggggtggagaaccaaggcccggccagacttccacatcgcgaaaagggaggacaaagtgacggtctctgataccccgcgcattcagccaattaagacatcgtacgtcagaaataggatcagtgaagcgtgcacggacatcatattttgcccttgatatcttatgccttgaccgtccaaatatccaaataaatgccactcgaccctttttaggctcggcttgaagcgactggagtctctactgaaagccgaggccaaggaaatcgcactcctcgaccatatctttatg

SEQ ID NO: 2420 - DNA, 703 bp, Nannochloropsis_gaditana
acttttggcacttgcttccgacagcgacatcaccaggtccagtccttcacgtctgcttctcgtgacaggcattgccttcgggcccaaaaaccttgcgctgggttgagttactattgcaggccctgaacccttgaagcgaggcacgaatgcctgcacactttgtttggcgacaagcagcgcgaaaagatatgtgatggctagctgacccatcgctttcgtgacactgattgtgcaacctatgttagatgtcaaaagagatggctcaatttcatataactgtgtcatcagatatgggtagtctacgatgtgaagcgcaaagggctccccgccagcaactcgagcggattttcgccttcgcgcataatatagtgcgctgacccgataaagccgcccgtctgccaactctcaaacagaatcattgatgaaccatccgtcggccggtgtggcccttgtgcttgtgtcgtcgtgtccgtggtcgcggcagggtagtggcgggcgacctcctgcctcgtccccgcctcgccgaaattttgaattcgagccaccgcgtccctggcccacgacgcaccaacgcgccgcatgccccttttgcccccccccctttttggggtgccttgtcctaacaagagcgtgttccacacttgtgtccatcctgcaggagaagcgggttgtggctcaacggcctggcatttcttctaccatg

SEQ ID NO: 2421 - DNA, 703 bp, Nannochloropsis_gaditana
cgacaggtgctttccccctgaacgcgatcacgctgggcaacaacatgctggacatgggaaacgatcagaagcgcccggacggtagcccagaccatccatcgagggtcacgaccgtcgccttccgcctcttagccgcgatcccccccctggtggcggctctcttcctgcgagacctcggccgaataagcgaatatgccggcacggtgggcattatcatcacccttgtgttcccagctgttcttaatcttcgctctcgtactcgaatgaaggatcttttccagctagaatctgcccggacatactacagcaacgagctctcgcgcaagcgctacggacccgtgaatctggccattggcatagggttgttcttatacattctgattaatctgcttatggattgaataaaatcatgtgttgactgtagcacgaagggataggttaaggcttgctgcacacgataacgtcttgtcctgtccatgtataaagaactgtcgtgcggggcatgaccgatcgccgccgtaagtaatatcggcgcgctttatagtacaaaataaatgtccgcagtcatgccgctgttttgcataacttacgaggcgtgtaaggctcgacacatcctaccggaattgatttgtggttcccgcgcttctctctggtactcatcttatgtcttccttccatgcgagcacagtcacagagcaagatg

SEQ ID NO: 2422 - DNA, 703 bp, Nannochloropsis_gaditana
taattgtgacgatgttaccgaatgatgaagtcttggaaatgtgagctccgagggcgggccgcggggcttatgtggaatcgtgctctgtcagtaatatgagattctgtctcaacattgtttaattctcattgtttgaacattttcaattcttttaaatgaagcgtgtcacaagacattgtgccaaccctttcgccaggcgcgcttcatatcagctgttcgaccgtcgcaccatctacgtctcgtgcgctcgcctctgtacacgctgcaaaagccgttgggtacgtgggtgctccagtctttgctcgtcctgagggcgtggaggaaaaacaagctttttttgtgatgggaggcacagatgttcgcgcgatgaaagctgcgaaacctgttctcctggccactggatcggatgttttcgagttcagtcgaagagatgctggggcgggcaatgttgtgaagctgtgcggtaattttctcatcgccagtgccatcgaaagcattggagaagcgctcgctctagccgagaatcaaggattgaatcgagtcaaggttatgtctatgctcagcgacacgatttttgactgcctcatctacaaagggtaagtggcctgtaaggtgtcaggagatcgctggaaggctacccggttcttttggatgatgcctcaatgtaagacgattcaccaaccatgcccggtccttggaagct

SEQ ID NO: 2423 - DNA, 703 bp, Nannochloropsis_gaditana
taaaatgactccttgcgaggccgctccccgctcagcaagcaggaggggatcctgacctcctctatccccaacagcggggggggcatccatgtccgtcactcgtacagcaagatcagccgtatagtatttggtgtcaagcgtccacatgataacttctccaccgtcagaaactaagacatcgaaacaagcattgtaaaatatgtgagctttaaagttcaatgccaccaggtcttatgctaggggatgaacatgcgagaatgactaacctgttcgcttcgcctcttctgcattggtctccaaatcaaacattgtatgggccaaaatattggtgaggtacgctctcatagggtgctccatgctacctgagcatgtgttctcattacctcgaaggccaaggatgagcaactcattcgcaggcgcactgtccattcccgcctcacaacttcaaattgggtagcgaaacataagtccgacgtgagggctgagctgatgatgcataccgtggggcagacaagcgggtgggaagggcaagctagaggccgggggggtggggggggccaggaggttagcgagatgcgcggaaaacgcgactcccgccctctccgcgaggtcccggcagcatccgcgggttgcaaaacaaccgccacaacgcataagtcgactaataacattcaaacaacacaggcttttcaagctcagcatg

SEQ ID NO: 2424 - DNA, 703 bp, Nannochloropsis_gaditana
caacaaaaacttactgcctcagcaatcctcgaggttcttcgttctttaaaaagctcagcgttgccgctagagcaaataagaccggccaggcatccgctgcttctgcaccggcataatatttttcgggccccgggctgaaggccgggaacggagtaactacacggcatatgttaaccacgagattgaaacagaggatgaaaagctatcatgcacgtattgagggggcagttctccaggttaccctgtcgggagcacggtagctctcaggacgctgcgacggggaggcattgaaagcgagggtttccgcgcagccacccgaggtcgctaaggttttatacacaaaaatgacgatgcctgcgaccgatgccgacacgcgcttgccaatgcgatggctagggcttgaaggcgagaaggagggcaaggagaccgagtcggcttccgggcgcgagccgatcatctcgcgcttgctatcccgcacccgaagatcttgcgtgccttgggactgaaagcaggcgcgcactctgccatcagccacatacaattcatcgggcttgaaaggattctactcagtcttgataagcgagaagaatctgcagaagtcgacaatcatcctcatcagacacatcacgggtgaactaacttaccactgtaaccgcacaggtagcactaacagcttacgcataaccggggggggacaaagatg

SEQ ID NO: 2425 - DNA, 703 bp, Nannochloropsis_gaditana
gtttagagccaacgaaaaagggatgacacagaaggctaaagataacatacagaagcccgcgatgtgtgcctgacgcatctaacaacagactccatttttttgtgcggcctcctacgtaggtatgcaggaccatccatctatcacatgtctctgccacctctcgcctttcatttatcgttacatatgcttgtagcctagtcgtggatcgagtcgcggcctgcctgcgctttaatgtttgccgaaaattgcgacggcggtacgagaagcgcgttgtctctgctgctgtaggagacagccagggcatcgccacccacccaagccctgtagtcgcgggaaacccgtgacctttgctcgggagaaatcatatctcgcaagaaagcgggaacgtattttttctgactcggaggcctcgctgatccgcttgttctgtattcgacacccacttcactccaacctttccgggcgtacatactttagtatctctcgacaataaaatcactatacttgatgaagtagcaaatacaattggtgatgcgatgagcagatgatgggatacagttttatatatgtgaaaaccgacagtgcgatgcgcccgcagcgacggcctgccaggtttggagtctcagagtctcaccaaaagcaacccctcattgctcactttcttgcaggtttcgccttcagaaatttgcccacagtaggaatg

SEQ ID NO: 2426 - DNA, 703 bp, Nannochloropsis_gaditana
gtcggttggacactcgccaagttacctctccaaagaaaatcctcttcgggagcccctatgtcttttttccctccttttgtaacggggctgaaactcttcgtggcaagagcatactaggcctcattgagacttgtcaattctcaagaatctttttatatgaattgaggacgtgtttggttgattgacggcttcattgaagtacttctggtcgcgcagtagctctcccgcgcttttaaagtggcccttcgatcatcgcggctcagccgatgagaccttgccgcccttttatgaattgaggtcaggacgcccacgccaacactatcctaacttatcataggcgccgctgactaagcgtggcatagcaaagaaaggctgccgccatcgctttgatggcaaagcaagtctgagctactgttttttccccttcaggaggcttcatcattcctctcctcgaccgcgacggggccctaatttcagttttaagctctcggtaagtcacctataaattatgcctatcgacaataaatgtaggctgttcttgcaaacctctccttcgcctccagttgtttcgtaattattcgaatcttaactcgtcgctctttacattctttctcccagatcgaaattcgacgtttgaggtaaccatctttatctaacctgcaccatctctggaaactcatttgtgtgaagcgcgtggaatatg

SEQ ID NO: 2427 - DNA, 703 bp, Nannochloropsis_gaditana
ctttgaagtatctttccaaaaattgccagacttgccccagctcatcgtagtaagccaaagcacacacagatgcaagtgaatcctcggcagcgtcgggagtgcgaggagcggaggggcgtgcgagtgaggagggcaggccagacagtgtggtgggaggaggccgcgagggcggtatatccatggcggcacgcccaaagggtcaggaacggcgttctagaatatgatgggaagatagtcaaagcttgttggtgtacagggcggagcaaggagggttgcccgtcgtgagaggtacagtgccttaatcgctcgaacttccacttggagggggcgatgggaagggagagcgatgattgcgatcgtattccaccctgggagagacgtcgtcgaacaccgcacacctggtcgcgagccataattgtcactttcattactctactatttacaacgggaagtggatggactcggtcgccgtcggtcctattttgggccgctgtggtttttgcgtaaggacgagcggaaactccttcgaaaccctccctcgagatgtgtgcgtgcggtcacctcaatggtgtaaatgtttggaccagcttgaagccacctatgcatgcgctatagcaggcactatttcgagcacgtttccctcgctttttttgggtctgcagatggatgacctcaccgtgttcgtcctttgccgcacaggatg

SEQ ID NO: 2428 - DNA, 703 bp, Nannochloropsis_gaditana
ttcggaattagttgatgttgaagacgtagtcgttcttgttcttggtagaggaaagtacaaacgtctgttccaaaaagaaatctggcgtctacccaagctagaagagaggaatctgcggatatatcgctcctgtgatataaatgatatgcaaagaagagtgaggtgctagccgtgcgtgcagcccctgatgccagactgcgggctctggctgtatccgcggcttaggcatgctcggactcgttagcgtccgcccgctcgccactgggcgaggacgagctgcctgaccgctttctcacgcctgacctcgtcgaagcgaggagttgtccgtctcgtctcacttttacaccactagatggcaaccaggtcaaggttgtgcttttctcaatctggtgtggcatttcgaatggctcctcatgcctcttgccccggaatcacgagcaggaatacgagagtcgggctgccgccccttacgttcctgattttcctaccaagactccactgccgcaaatcccatattttgtaaattcgggtgccattggaggcgtgagaattataaggtgaattcattcattcggctagcatgtcttcacttagcaggaggggggcggagaactctccgcccaaaaacttccgcgaggtcgtacagagacggttgatgcaggacgtgattgaggcggcagctggacttagtcgaggatggatg

SEQ ID NO: 2429 - DNA, 703 bp, Nannochloropsis_gaditana
aatattgtcagcttgatgattgtaggtcgcaatctgttatgggattcgcgtcatgcgcggagtctaacgtgaggacggaagatacaaaagagggagggaatgatggagatgcgctccgcgtcctggcgacggccttcgagaggggcctcgccctagccccggcccatttcactccaacgccctactggcgcctggacatccccctcaaaagcgcgctgtcttggacgcggggggcgcgcactctttgtttgtcgccctttctgtggcccatacatacccggttgctccactgaacggcgggtctgctgttgcgtagcccctgcttgacgtggcgggggacgtacaagcttgctacgattagtaggctaccagaggcaacacgaaacggaacgcaatgcctcggtttttgattgcaccaggcatggtcagggactcttagcgctagatacatacttcagcatgcttaagatgcatcgtatcgatcgcatctgccggaaaaaaaatgccctcggggcttggtctttttgtgattgttttctggggtacggacgcgtacctttcttgtcatactttttccacgactatgcttatggtgaaacatgcgattgttatttgcttatatgactgacgcagacaaataatccatacgatcccttatgacagcaagacatttgtgcggctgacaaaaaaaagacgcaccatg

SEQ ID NO: 2430 - DNA, 703 bp, Nannochloropsis_gaditana
agtaacctacgcggtaaactccagaatcaaacatggactgagcggtcgttttctgggaccttaaccagagcacacgacccgcagatggctgtcttccaggacatagctccgcagcggttgggagtcagtaaaaggtgattcctcgattacatagacaaaccgcgaaacaaaatatgactctagatatgcatcatacggaagcaggatacaagacaatattggcttatctaagggcgttggggaaaacttgttttgccaacctcctcctccctctcacccaggctgttgctcgagcatccttcctacacaccacgcgtcagaccagtctgagctctgtagagaaaagagtgtacggtaccgtcgcaaaattttttcggggctctcgcggagggggaggaggtgggaaagggagcaggctttaatctgtggggttgtgaggcacgtcggggggaacggcgaggggcgcggagacggcgacgaggaagctccgccggcgagcgactttctgcgggctatttcctcgtgctgcccttcactttggtccacgccgagccaggacttctcaataaatttcgaagttatattcgtgtgatcgtcatgatgtaagaatttcgattttcagcagctctctttcgcgcacttcatcctcacaaaaggcgctacgattgttagaacactccctcattcaaagtgaggaatcatg

SEQ ID NO: 2431 - DNA, 703 bp, Nannochloropsis_gaditana
agcgcacctacgactaaggccccgacatttgtaacgagctgccatgtactttgaagagtaacagcacccgggtcttctcctcctaccgtcagttgtcgaaccagccatggcgatgatgaagtagttacgaaacgcgagggagctgtagtacgacacggagtattcacgatggaacttcttagcgcagagggagtcagcacaaaggcctggatcgtagacacagccacggtgcaaagcacgtagagaagctcgtgccgacgcatataacaaatacgacttgttgccgcaggggaaaagaggccggggaggttggagccaggggcggggaggttctaagcgtgaggacattaaatacgtgatacacggtgtacagattacatggtgtcatgaccctgctttgagatgccttacaaggactgaagagagttacaaggtgaacacagacgccaagtgatctcgtcagatttaggggggctcgggtgtcacggcatgtcacgctctacagcgattcccgagactcgcgtagtagaaattgttccacttgatgcatatttacactcacgacagcactcttacacgcttctccagtccatgcatagactcgatgtcgtcttcccttgctccacatttgaaaccacgtcagcgcaaacgccaacagaacaggacgtcaattttggtggctggggacggcaaagttgggatg

SEQ ID NO: 2432 - DNA, 703 bp, Nannochloropsis_gaditana
cgaccagaggaagatgaccgagcgcttcttgaacaaacttcggcggcacccaaggccttttcatgctcccacctgacctgctttcatgggtctctagaatatctgccatttgttggcaaccaagaccgtgctgtgtttgtgtgaaattttaatgtttgttgcgtggagtcgtgtgcctgaacatcagcgcgtgaggagcgtaaagctaggaaacgagcggtcggcggctggatgttgcccaccttacggttgttgaccagataaagccaaacgatctttcttcatagggagttggtaacacctcggaggtatatgacaaacggtaagacgagtaacgaggctgctcgaggggaaagggagcaggagcttgcattgctatacttaatgaagagaagtggttacaacagttgtcacaccttgcaaagtactagagctgagtctaatttgctacgaaaatacatgcgggcatctctggctaattttcacgcggtgcgagggcggtaaagcgcgctgacctccctcctcgcaggcatgccggcactcgctccctcccggctgcccgctcagacccctatcaggggttcggcgagagggcaacgaggcgaggaagcatggtaacgctcttactttatcacttaaagcaacagaaaccgcaggactcttggcgtgcggccctgcaggcggacgaacgattggcagcatg

SEQ ID NO: 2433 - DNA, 703 bp, Nannochloropsis_gaditana
gtattgagtagggaaataaaactgggcaagaaaatgttttcagtgggaaccgggtcctaggacgcataaaacatgtcggcatgtgcctgcgccttcgtgatttgataacgcatgtcaagcttaccaagtaaacaaattgtatttagaaattgagacgtgattttatgacattatgaaataatgatattattgcgtatgatttctttaactaaaaaagtcgggattgaaatgaaagcgctgtctaatcaagctataggagtaccacacggatgccttccgtgccatttgaaaatttgaattcccgttggtggcaggttgcaccgattcggcgaaatcccggaagccatgaggaaggaagcagcaggtcagggatgcacttctaatgctcaccacaacattgaatcatttactttgaaacaagataaatttttttaaaggagctctgaaacccttgactatttaacgtagtatatcgttctcatctcttgtggaatggaaggaatttttctgataacaaaaagtatcacagcgacagacacaacttctggtcgatatcaagttttcgcgaatatatgacgcacataaattttcatgtctcatatattctcataacttatccatcccttgtccttgtctgtgtctcgctgttcgggaaattactctcaggcctttttctgcagcgccttttaggaggcacatcatg

SEQ ID NO: 2434 - DNA, 703 bp, Nannochloropsis_gaditana
tactgtggaggcctccctggaacaggagcagcgtcagtgtacaaggagaaaattgacgaatgaagatggggacaagaaggtgctgagcatgagctttcaaaccgatccgaatcaggacaaacgcatcgatgtggtcagcgctcaaaacgacagagctctgaataagactgttaacatcatatttgctgtataaaggtagagctttagcctgcactgccagagtggagatgaagtcgtaattttagacttgacggcaataatggacccgcacactggctgcagtgcagcctgcagaagatgtatatttgtgcacaggtagtgcacacgcctgcattttttaatcaataagcaaccatgccgaaaatcaatctatgaaacaaaggcactgagaaaacgctgcttatttctttcgggggggaagatcgtgacggaacgcaatcccaccctgcctggctggcactcggactcttcggtcgccccctggccttgggagcttgatgatgctttcaaccctcttcaaagttgtgcatgacctcgaatttccaagcgatcataccgtcggctttttcaaagccagtgatgatgactgccattactgaagggcggggagcccaaggccgtgctcgtacgtttccttcacccgcccttttctaacgcatgcatcctgtccccgaaatcgtgcacaagccagagcgaagctatg

SEQ ID NO: 2435 - DNA, 703 bp, Nannochloropsis_gaditana
catagcaacttcgaatgcatgtctctttgccgcctttccttcactggcaccatcgcttccgatcagcagatccatttactttccggcctcactctaagttatgtgtttaaaagcttcacggtgcgttgcaagagagaaagggtggcttgtccggccctcgccaagtcacgtaacacgcaaccgttgacggcgtccttctctcttctgattcaagtatgacggactgttttgcttctatgccttattgatcacaagcacccaggtatgcagctctaactttctctttccgtcgatgtacatcttatgaatttcgcgggcatcatcataaatttgtcttcgtcgctgtcttggaagaggcgcaagcagcgaatgagacgagtgacgaggatggtgacacgtctttttgctgtctgaatcgatgcacaaattcttaaatttcccatgaattgaggtctatagtgacgaactcattagacattttgtcaagaagtctccgtgcttgtctttcgcgggtatggtgcttttgcagccatatttgtggcgcccgatgcctttgttagtttagttggtttgtttgtagtaacggtctccccgtcctgggttcaagacttgatatcactctcaatttccttttttctcgcagtgctccacacagagtacagagtgaaatatctagattgtggcgctttctccgccgcatatg

SEQ ID NO: 2436 - DNA, 703 bp, Nannochloropsis_gaditana
aacggagaaaaaaacatcgagcgaaccagttgacataagtgtcttcttccttcccccgttatgccttcacatattaacgggtactcgatatctcatcgcgtaataaatcacataggcgaaagctcaggaaagccaaggcgcggtcgacaatccatttctacacttgctcctttgcttcgcgcccaagactgccgcaattcgtctggccttgcaaaaaagtgcccctggcggactcagcacaaaatataatgcctcgccagtccaccaacactacctcaatcttctctggaaaacaccatcttgcaagcttgcgtcgagaacgccctgcgtcgaacaagccttctacctcggggtccccacgttaccacaatctcctcagccgcctagtggacctcgaagctgcgctagaggttgccgcccgagagcgtgcatgggaagagagcagctataggtccctgaaagaaaaatatgcctcgacaaaagccgctcttgcggagcttaaggcagagaaaatggagctggaaaagcagtctgaggccacgatggcgaaatggcgagcacatcatgatcgacaagtgaaggagcttgccattttccaggtgatacaaatattggtttagaatctggtgcaacttgataagtgtatcccagcgtgaagatttggcgtgtcatgcccctccgatttcccccctattcccttcta

SEQ ID NO: 2437 - DNA, 703 bp, Nannochloropsis_gaditana
caaatcggggtctacgagctatcgagaagcaagttgttgatgtgccacgatctgcagggaggctacctaggagatagacattgttttggactgagttgtccatggggggaaggcacgtggagaaatgaaagggtatatcatggtaatggagtggaaatggatatacatagcacttatggaagtgcgaaagacgtcagtgacaaagaagaggcggccgaagggtacagggcttgtgaggcttcgcagtctgttggtctttcctgcgccgacaaaaggggtaagaaataaagatgagagattaaatcgcggacggaagagggtgggcgaccaatgcaaagcattgcgatgggaaacaagaaattgaagaagcgtaagagcaaattgaaaagggctgcgagaaggaagacgtggagttttggtgacttcaagagggctgttttgtggaagaacggctcaaacaactgtcgttaaggacagtgaaaaggagatgaacttgtctgaaagcgcagtctttttcatcccatgctcggagggccccctctgtctgattttaacggccggcccctctcctcccttcctccaatccccttccttctcgacagctccttgctccctcgcccccgcatttcgcttgcatgctattgaattcgccgacattttcgtctacttttcccaccatcttgtctccctgccgccccctagc

SEQ ID NO: 2438 - DNA, 703 bp, Nannochloropsis_gaditana
ttattttggggtatagaagactgaatgctggaagcgaccaggtatcctcgtccggcaaaggcaacgaaggtggtggggaaacaggcattacgcccgcctgccgctgcccctgtctttctataggaataaaatggtatgagcttactccgtcgaacaaagtacctccttttcaagagacgagtatcagtcgtcctaaagcgccttatcagacagcccgtgtaacctatcgcaggacgagggcaacggaggagaggagagaaaggcttttgagtaaagggggaggaggttatttcgggggggggaggttagacgcgaagcagcaaacatttgagttacactaatgctgtgctttgtccctatgtgatcacctgtaatggtatcactcattatagccagatcgatgtgtgaacatatccctccctcgcataacgtgcacggcaacacatctgtacaggctatgcgttttaccagtccggagggaggtcgtaacgcgtcggctgtctctctggctaacttcagctatcttctacgagtactcctcctccacacgtttgctgttgtattactcagctcgttatcagcttgggcattttgtccttctctccccgcgttgaccccactgctcgcacaaaaaacgttcgccatccctagaattagcaccccctgctctcgttttacaagtgcttctacagcgttgaaaatg

SEQ ID NO: 2439 - DNA, 703 bp, Nannochloropsis_gaditana
tcaactaggccggccgcccgctctccctcatccatgaggtgcggaggtaaattagggcggacaggaccgccgccgcccagaaggtagttcatatttctcggattctctacggattttcacggcgacaatagatgatttgcgtggacggaacgtgccaatggaaggtcgaggttgaacgtgctgttcttcttgatgacgagagttcagtcgggagaggaaagaagaagagctcaccaggttttgccgccgttcaccttgctacaaggccacgtcccgtcaataattgtgccccacctggaagtgcatgcgtgtatgcggtgggtcaacggtaagattggcgcggtgcgcgtttgagaaggggagtaggaaagagaaagtcgtcgggggttctctgaacttcccctgtcccgtcaaggacctcgcacaagccgcctacgtcgtgccgccattccactgcgtgggtggctccctggggcagcgacaacccagtaaagcttttgaacagaccatgcgcgacgcagtgtgttgcatcgacatacggtggggttcaacgacgccaggaaggaaatgcaggacaaagcacgttggcgcagggccctgcgcgaggggaggtttttgacggcctcgtccacacctagaccggccacatggttgtctgatcttcgtcttgacactatttcaatctctgggcacagacatcatg

SEQ ID NO: 2440 - DNA, 703 bp, Nannochloropsis_gaditana
tggtggtgcgtctcatagacgaggggaagaggcagatacgggcaaaagagcagcaatcacggctccctccggggaagagtttgtggataaacggcaacgattggcgacaatatcgccgccacaactgccgttaccaagagaggaacgtcatcaccacgatgcaggagaagcgaagacagcaagtccagctgatgtaaatccagaggagagaaaaagatcaaaggaagaagcgattcaaaaggcaagggagcggtttttggcacgcaagaaaggcgaggtacacaacgaaaacatcactgagtcataaaaaacgttttggatgttttagcccctcaaagtaattaaatattaaatgtgatcatgagccctcaggcccagcgaagacgtgctatcagcatcggaaaatcgcagtttcgctacttgagtaggcgtcagctattacatgatactccccaccgttaccataattatacaggctactatccttgcaattatggcttgcttagcagctcaagtaagacttatctcctttgaatcatctctgtgttccgtttttccacttgaagcagatttaacctccccacccccttcgctcagacgcgtcgcaatacggtggggcacctgcgattgaaaaacatgtatcacaatcaacactcgcagtaccaactttatttcttgtgattttagggtgttccacctcatg

SEQ ID NO: 2441 - DNA, 703 bp, Nannochloropsis_gaditana
cgttcctttttccgcccgaaaatatggcgcgaaaaccctgcactattccacgactcgtgagtcaagaaaagaaaatatggcgcgaaatacctcttttggttctgaaaatatggcgcgaacgagcgggtctgatatcggagtcggattgtgaatcacggcggtgacctccaaccccgacttcttggtcataccccccgtgactgtgcgggcctgtcccgtcaggtgccaccgattattacgcttttctcgccacccgaacgcatgtcttcagaaacacacatgaattgcgccgtgaatttctgcacctgttcgccgtcgtcgggggcaggagatccttctctggcttgagttgaaggcgtgcgagttatgaacacccaatcgcaagcctatttttcactttagcacccaaaaaaagtgggggcgttgatttgcgttctttaattattgaccttgtacatgtcgagagcatgtacaggcgggttttccataatctctgatcgtgtgcactttcaaaggtagccgtacacggcgtgtgaatggttgggatgtggcttcctctttctagtgacacatccttcacgtgctgctcaaatccacccttttaattttaccgcatcacactccgttcatcgcaacctacagatcggttgcgttgacggaccgcgagagggtagtttgcaagtacggcactattttcacaatg

SEQ ID NO: 2442 - DNA, 703 bp, Nannochloropsis_gaditana
ccgcccctccttgtcaccccaaaaacccgcgtcgccatggttgtgaccaattttccattgccacctcaccctctccagtacgcctgtgggccgacccgtagtaacagcttgccaacgggagctcggatcgtgggggtcggggccccgtatgtcaccacctgaagtagcatacacaaactcatcaccgtctgaccatgccacagggctgattcattgatctttctctcttggtctgcgtgcgtggagtggcgcttgggatgcggcgcgtgtttcatgaaggaacgacagggggagagggaatagccagcgccttgcccaacacagccaccaccgcttcgaggtaagctccgttcgattttttgtgcaatcgtctttcgtgctttaatttcacgaactcgcacacgttgatatggaagactggattaaagtgatgccattgtgggttgtcggacatcaaggaataacctttaactgagtgttcgacaacacaacttcaactagggccattcatttccagagtcgactgcgtcttgcattccgcacgacgccgtcgatctgtgcccttttactggctatgccgcttttactttctccccactggacgcggtcggtttgcgtcgtgagtgcatttcatttaaggccatcaacggcctccaaggtctcccgtggagtgggccgttctcgcgaagtgctacgtatgatg

SEQ ID NO: 2443 - DNA, 703 bp, Nannochloropsis_gaditana
tggcttgtcgtctgggaaaatgggggcgtcgccatcgagtaaggggaatcggcatgctaaatacgtggcaaacagacagaggagcgcgagtgggcgggccgggagcatcgaggggtcccccgagaagggggctcgaggcgtgagacgcgcaccatcagcgccatcgggagcgcaaggtccctcgagaaggcggggaaggggcgattcgggtggtcggggtcgggcgtctgaaagcgcgggcttgaggggacgtggcagcagtagcagggggggaggacgcagacgttaggtggttgcatccatgtcatacagacggaatatcaacgagtgtaacaaaaattattggcatcatgttgtccttgctcttgattttttttatttgctagggcaaggtgaaaacttgatcgagggaaatcaagtcatcatgttcgtggtcaactttcgaggagggtgacgagcatgagcgttacatatttggcgacacttgttatcaccatttaagcgttgttggtgctcaagggcattgtggaggtatttcaaacttatgcgtgctactcgtccgcttcgtgtgtgctgctcccgtaaaaaaagatgctgcgacaaattttgtgcgttctcatcgcctgtcctggaaaaggaaagtatcttgttttattcttgttgccctaatcgaagtatctcttcgttgcaaccataggcaatg

SEQ ID NO: 2444 - DNA, 703 bp, Nannochloropsis_gaditana
ccctcgagaaggcggggaaggggcgattcgggtggtcggggtcgggcgtctgaaagcgcgggcttgaggggacgtggcagcagtagcagggggggaggacgcagacgttaggtggttgcatccatgtcatacagacggaatatcaacgagtgtaacaaaaattattggcatcatgttgtccttgctcttgattttttttatttgctagggcaaggtgaaaacttgatcgagggaaatcaagtcatcatgttcgtggtcaactttcgaggagggtgacgagcatgagcgttacatatttggcgacacttgttatcaccatttaagcgttgttggtgctcaagggcattgtggaggtatttcaaacttatgcgtgctactcgtccgcttcgtgtgtgctgctcccgtaaaaaaagatgctgcgacaaattttgtgcgttctcatcgcctgtcctggaaaaggaaagtatcttgttttattcttgttgccctaatcgaagtatctcttcgttgcaaccataggcaatgtttcaacttgctgtaatccgcgacactataaaagttcctccggcctctttcaatcgtaaccagatcgaggtgcgttttcaactcacgatttgtcccttgcaacatctgtcgtctaacctccctgtctggacactccactttaccatcattcttccccacgcctaaaaccaacaggtct

SEQ ID NO: 2445 - DNA, 703 bp, Nannochloropsis_gaditana
gctattcctgttcctgacgccgcctctggtaatgagactttctccgacaggcttgacaacgatttctttccggctgcaatgggcacatctcttttagagtcctgtactgcatcgctagacattgatagtcgcaacggggtgtcttgcggggtcgacgtcgccggtgtcgttactttcaatttgggaaagggttgctgacccgctgggctcttttttgatgctacgggaggaagaagcactggcttcgtgtcacctcccgtgggattaccgtcggccccccttcctgtatccatgacccgcctgtgcatagaatttgtgcttccacagttagcgaattggcaggccacgggcatacctgagcgttctatttcttcctgaacagaggaggcgatatactccggtgtaggcgatatcgtggtgagcgagcgaggagtctgtcacaagacccagagcggtgagttgagcttattccaaagcagtgctaaatcactgtctcatactggtaccattcttgcaccaggccgtacgttcgggggcattgtgtacctgtagctgaaagaaagcggagggtaagggtaggcaacagccctgcggaggatactccatacgtactgtattgtacactgtgccctggcacttaacgaggaccgcttcacaagtatcgtaaggtaccaaaatatctatagacgaccataatttgatg

SEQ ID NO: 2446 - DNA, 703 bp, Nannochloropsis_gaditana
cgatgtttaaatttttaaaggcgcacacggacgcaggaatgcttggagctcgtaacgatggcgtacaagttgtactatttttttggtgctttccaacttttctcgagggggaaaaacatcgcatgtgccgtcgtcaacctcagtcacgtgtgccgggtggtatgggccggaaggggcttcgcacggagggagtgaagaaaaaaaagtctccactgggctaccctaacccatccaaacaatcaatttccattcatgttaacacctgccaacgtgaatcagaagcttgtgtcacgcttccgggccgccagcataaatagcgggcggggttggcggccttttcaggctgacgacgcgatatggagcgccctgccgcccgctgacggggtatctggtggagatatccagtttgggtggccacggtcaccacatgatttaatggccctttatccttagcaggccaaggacaggccggcctttgggttaatgattccctgttagtatgctaaatcgactgattactcataaaaggtctacaaacggcccgtctaagggggcaatagctaccgacttgagcgttttgttccgcttcgaccccccccccaaaaacgagtccctgcgggaacagtttcctcttgttcaatgcatttgcacatgcatacaaaaacaaattgacttacaatcacacatcatagaacagagcatg

SEQ ID NO: 2447 - DNA, 703 bp, Nannochloropsis_gaditana
cttgtcccgaaaacagggagtagggcgtgaacctgaagcccgccccttcatccgatacacgggcccatggctgtaaggcggaacaaccacagtagcaagctccgcgggatggaagcgatgcccactgttatccccgcaaattaaacatcgagatgttcacgatcatagataacttgtccctcctttgcgcccatttcctgtctggctggcagtgttgatgaccaaagcgggggcggcggcgtcagggcgatgtaacggctcggattgatgaaagcttaggggggaggtcaactatgtcgaaatagaggcctttgacgggcttagggggccaaggccaccgtctggttgcggttcactcggattttttgctggaaatggacacgggtgcgctatggtcgcgactgcctgatctgggactacttttgtaaggtggagtctgtaggcgcaccgacgtggtccccgcccactgcctgcctgctcgacctgtgcggatgtggagggcaaatcactgacgcatcttgaaactcgaaagtttgcgggaaattgtgcatgcgcagtgtgtgcgtggtgttctcgtttaaggacaaagagaatcctttatggattcgcgaaaggagtactcatattcccttttctctccgcttgtttcacaagccaacacaatagcaccttatcaacccttgtcttcttgacaaagtaaatg

SEQ ID NO: 2448 - DNA, 703 bp, Nannochloropsis_gaditana
aacccagtgcacgcctcgctgtccacatgaatgacagatgtatgtctcaggaggcggaggaccggtggaactgctcatattcccatgaaatggaggatgaatgtgtgctgcgtacggattggacgggggacattgggctggttgatagctcccataaatgctagagggaaacgaggcattatgcggtggcgctccatggtaggggtattgatattgctgcggatattgttgctgagcttgaggcgcagatatttgcgtaaaggtgtgctgatacatggctgtctttcagaataatatgatgcagatagcctcccgttggtaagatactatctctggtacattgaacggcctacccgtggacaacgaaacacacaaattgtacaaggaaaagagcatctgtacggacgtattacacacctacacagacaagttaagggtgaatttctgtggcttgtcaaggcattcaattcggcggtcttgaaggttttatggccctgtttgtcgcgggcggcgatcacggtgtgctatggtacagcggcattttgaaggacagtttcctcttccccaccatgagaatttattcaaatatttgcgaatacacatatgtggggatgaaattctctacagggacatcccatgggcgctggctggagcagcagttacgcttgaggcattaaaccactacgattcagacaagacaatg

SEQ ID NO: 2449 - DNA, 703 bp, Nannochloropsis_gaditana
caaacgaatgagtagtggcggtcgtttgctttaattggtcttcaaagttgtcacccaaggctcggactaacggtgcattcgtaagaggatgccagcctcgaacccgaccgtgttggcaggcgcacggataattgtgcccgcgagaggtttcaattgcactgaagaaagaaagtggcgaccatgaccataggggagcaactgcgagggcgggcgagggagcaaaactggtcactgtacaggaggaggttccttgccggttaagaagcagggatggacgaggagtgtcctggcttctcgtgctacaaatttgctttcgacttgttaggggtgccgacaaaattgccaggcagaggatgaaatgctgagaagcccccagttttctctgtggcatgggcgcaagcgtaacagattcatgttagcctccgcaatgtcgggatatcgccagcacggatgagactcgcccaagaaaacatcgtttcaaaataaaagcccccccacgaccctcgaaaggccacgcttaatgtttgctgccatccacgtggatttggcaaattttactcgtttatggtattgcgcgtggtgaactagaggtagatatttctcgggcgtggttttccccacaactgaaacccgataatggctgatttgagcgacatgctgattcaaaccaatcccgatacagcgactcccgaaaaccaccatg

SEQ ID NO: 2450 - DNA, 703 bp, Nannochloropsis_gaditana
aagacgccgggtggcgggacgcttcgactcgcacatctcacactcttgcagcaacatcgagttcgcgaaggtgcactttacacatgcccatctcaaaccttgcttgtccatcttgacacctcgcggcgatgagagatccgctgccccctccccccgatcgtctccgctactcgttctgcgcttccccatcttgaacacgcgtagacagacagttcagccgtaaagaaatcctctgtgccaattctttccttcgccgctttctccgtcgctggtatgcgcacgtatcggccgtttccccctgcaacaccctgcggtgtacgcctatgctgccagacgcgcagggagtcgtcctccctccgacacagcggttgacagtgtccttgagcgcgcgcaaaacgtcatttttcaccattgaacacttacaacggcatgctcacctattctctggtatctgtggaggcgtagcatatagtgtgggggatgcgtgaggcatcaacacggcaaagacatgatttgcggcctccctcagaggtcgtgtctcggcgagcaagaacaccgcgagccatgcccggagatcaactcgtagagtgacgactgtctgcaccactcatatctcctcacggagatctcctccaacacacgagcggtccaaccggaaagttaaagacgtgcgcgcaatcttttgaccaatttttcgtagcgg

SEQ ID NO: 2451 - DNA, 703 bp, Nannochloropsis_gaditana
ggccaaggctaagattcctgtcgtcggcactggtggcacttcgttgggtaaagccgcgggcgacttgggctgtgatgttgtgggcaacagcggcgggtccgtctcaacaacgatagagacgaaagccttgtcgttcacagccagtctagccagcttctggggccttccctacgacccattgatttcttatccacagcttcacagtatcctggccgcgtgtctcccggttttcgtggcggtagtcctggccaaggaagcttggaggaaggctctggcgctgggtatctcggattggtggctggcacgtcagactcacgccaccttcacagggctgtcggacatcgcgaatgccttgccagtggtagtggcggtggtgacggcctctcaagtgggaagactgggagaggccgggctcttgtcgggggtattggcgggcatgctcgcctgtggcgcgatagggagcgaggagggtaccgggtctgagagcaccgtgcttgccggagcccttacgggcttgttggcaggatggctgagtcggcagcttttggttgccacggcaaagtccctgtgggtgccagccacggcatcttccatcataacagccggggcagcggggctatctgctgggctggggggtagattactcattcgacggccatgcgcctgggtctcggacacattccgaagcattcttctgtacttg

SEQ ID NO: 2452 - DNA, 703 bp, Nannochloropsis_gaditana
tgcctgtcgaatcaatagtacggaccacagtgagaagagctacgagttacaagcaaaagacaaagaatgaaacccctatgggaatgacctcgcttgcgtgttcgtatcgtcaggtcttctttatcgccgggggggtctatctagcttgtggaccgagatcgaggaggcaagcttcttgtggaccgagatcgaggaggctagcttcttgtggaccgaaactaagggtcgacgccaattgtggaccgaatagcgaggaaggaaagctcattggctgcttctgcaccgttgatgcctgtcgttttcctccccgtgtgtcgtagagccagagcatcgacgagcgactttgcctatagcggtacccgtgcactcaatccttctttgttctcggtggctggacactgacttgtacttgtggttgcaggcatcttttgtttgtgcacaacggatggaggggaggctagcagggatgggagatgatggagtaagcgaagcctcgatgcctaggcttcatgtctcgtcgaggaaagaacgcctgtctgattttaaagcataatctttctgcagtttagacttgggcagcgtgtatggcaagctgtcggccctgaattgattgcgtctcattttgctttatctcatgtatgtcaccctaaaattctcgcctcgtgtccgccacaggtggcttgctcttgtctaggcaactatg

SEQ ID NO: 2453 - DNA, 703 bp, Nannochloropsis_gaditana
aaggttgttggaagcagtattgggtctgttgtttgtctttcagcgattgcaagcaggagcaggcatggagtaaaaataacgtatggcgcgcgtggcttgtcgagagaacctcctcaacccgcagaagacccttcagtacaacatcgccgaataaaaaacaaaacgaagaaacggagaaaagtccttttactattatagaaaaggtcccagaagagtgcaagatcccgcttctaaaaaaatcgaaagagcaattgtttggaggagtgagaatgttagtgaagtctcatccatatatcttggtttttaatctacccctcagagccccctttgtcctttcctcaagccatggccagcaagttcaccatggtagaccccgcccaaggggatgacgtttaccagcacatggcacagacagtcaatgatcgaatgggtaaggctgtggaagaactgcgacaaaagaatgacgagcggacagccgcatcgcaaagtggggcttcgatgcccgatgaggatacatcggtagacgggcctacaggcagcgcgtatagacaagtcgaagcacgaaagcgtgcacagcagcatcgagctcaggcgcgaataaggaagtcgaaggagcaagctgtcgatgccgcgcggcaagaagaaatcgtgcaaaaattgcaggagtcacacctgctttctgatgaagaggatgacgaagcag

SEQ ID NO: 2454 - DNA, 703 bp, Nannochloropsis_gaditana
cggagaaaagtccttttactattatagaaaaggtcccagaagagtgcaagatcccgcttctaaaaaaatcgaaagagcaattgtttggaggagtgagaatgttagtgaagtctcatccatatatcttggtttttaatctacccctcagagccccctttgtcctttcctcaagccatggccagcaagttcaccatggtagaccccgcccaaggggatgacgtttaccagcacatggcacagacagtcaatgatcgaatgggtaaggctgtggaagaactgcgacaaaagaatgacgagcggacagccgcatcgcaaagtggggcttcgatgcccgatgaggatacatcggtagacgggcctacaggcagcgcgtatagacaagtcgaagcacgaaagcgtgcacagcagcatcgagctcaggcgcgaataaggaagtcgaaggagcaagctgtcgatgccgcgcggcaagaagaaatcgtgcaaaaattgcaggagtcacacctgctttctgatgaagaggatgacgaagcagaagacagcttggaccctgaatttaaactcatccgagaaagacgccttgctgaattgaaagctcagcaccaagaaaaggtcgacaacatgagcaaaggtcacgggcagtaccgtgagatcactcaggatgagtttttgccggaggtgacaggctcccgtcgcgtcctcgttc

SEQ ID NO: 2455 - DNA, 703 bp, Nannochloropsis_gaditana
tctccatcgccgggccctcggctgtgacaccaggcttggtttcaaacccttccatggaaaccgaaattttgcttcccacacccctccgcctctttatctgcatggtttactcctgtacgtgggtgtaatacggcgttgagtggagaagtcacggtgtatggccattcccgcaggccttcaaaggaagacgtcacgactggcgagcggagggactctctgcggccatgcttgtttatcgcctggatgcaaccaaaaaatgtcggacgagaccgctcgctgtccctgcccatgtccgtgcacgttgaggaagtgcgaaggagatgccgcaagtacgcgcatgggcacgttttgaagtatatcgtgggagtgaggtctcagtgaccgccggcgtcgggattgctgcgtggtgacggccgtgtcttttctatctctttatgatattatcgtcttgccaagctttcatgcgggctggctccccacgacggcaaaagcaccaacccagttcgcagatttaaatgatggcacggtcgagtgttcgtaaacatgtttgccatctgtgtggttatctcaggggtcttgggggggacaactaatgaagcttcgtgcagccaaaagaagcccacactcatgtcgttcagtgtacctcttgggattcctttgtatctaggtgtctcccttgggcgtggccgtaaaagtcaccatg

SEQ ID NO: 2456 - DNA, 703 bp, Nannochloropsis_gaditana
atgccttgcctcaccttccatcggctgccctcttattctaccccctctctccttcccgctgtcaggccaaccaaacggacaccatccccgagcccctcttggaccgtatggaggtcatcaatctcccaggctacacaatcgaggagaaggtgcgtcccgcgttgctggcttgctcgcttttctacaccttcccatccacttcaatcctcccttcttcccgatcctcaaggtttttattgcagagcagtacctcatcccgaagcagctggcagcgaacggtctaagtcccgagcacgtaatcgtcactcctcggtagggaagaaggagaaggacagagaaaggcaaaaaagagacgtggtatgacgctcaacctgcctcgctttttttatccagagcggtgcaatcgattgccacgggctatacgcgggaagccggcgttagacaggcacgtccgccttcctccctccctccctccttccctccctccttccctccctttcttccttcccatgactctcccgcacatgtcggccttacctccattgtcctctctctccctcagattgaacgagagctggctgcggtctgtcgtcacgtggccatgcaagtggcctctcactcctctcctgccgtccaagtggaggggggaagggagggggaggaagaggaagggatgcaggagggaggcgggggtggagaaatg

SEQ ID NO: 2457 - DNA, 703 bp, Nannochloropsis_gaditana
agcagcgccgaaaccggtggtccggccggggtggatggcttggctcggaaaaccgtcacccgcctcgtcttcggcaccgcctccagcgttgcccgccccgtcccatctaccgaggaggaccacggcggacccccccgggacgtgttcgatgcagtggagcaagaggccagccaaaagctgaaggaatggttgagaccccgggaagagcggcgacaacggcgcctgctcgaattgcagcatgacgtgaatctgaccagtcaatgccaagtcttgcaattccaagctctggtggagccgcccgtggcccctccttccagtcgctcatgggcaaacgaggaggtagacacgaagacgtccttgtcctttcctcggcggcacccgtcccaggggtgggcgatgaatgaagaggtggaggacgatgccgtcgggtgtcaggaccgaaaaagcagcagctccagccaccgctctccccagctgtgcagggacgtgaaagaagacaaaaacgtccgggtatattcctctcctctgtcgggatccgctccctcttccccttccaaacagcagctggacctgctggcagaggctgccaaagacaggaccgggacctcgcagcaaggccgaaagcgtcagcagcgcatgcaccaatacctacgtctccgtcgagcactgcacgtgcgggaactggaagcggaggaggaggaag

SEQ ID NO: 2458 - DNA, 703 bp, Nannochloropsis_gaditana
cgctcgtgaggtaacctatcatcatgcccctcctaagtaagtgtataaagctccatgagatactctaacatcggccgaacagtcgattccaaaaattgcgcatgaaattctcactttcattgtacaacaaagccaaatgcgtggtgtagtgtgctgggcacctcccctcaaaaacaaaacgtacggccttaaaaaagcgaaaaaagcgaccggaagagccgacggacgatccatcaatttgtcaattttcctcctggtctggtcacagtcttttgaacaatgaaggccgtaaagctgtctaaggaatgttatgcacgcgtgttgttccagtcgataatggcgtcatatgcatgcttggctgtgtttttggatgtattttgtcccgtaacagagcggtgccactcgtgcgtgccagagaggaagtcgagtacttccgtctcccgaggacgcgctaactcttaaatcgttagatgcgtgtcatctgtacatcctcgagatgccttcttccaggttatacaggtagagagttgggtcctagcgttaggccaggcgcgtgactgacatgcgccttgcatttcggggaaaacctcccttgcgtctctctcagggcttgaggttgcgatactcggaaaataggtcatttgacaacttcgacgtttccactcattatgttctactgaacgtttcatacacctctgcaaac

SEQ ID NO: 2459 - DNA, 703 bp, Nannochloropsis_gaditana
caaaaaaaagaatcttcgaggtgcagacgcgaggagtgcttgcatatgattcaaatacacatttctagcgtctcaggtgctatgtcaattcgtgggacgggccgtgttgggttgattgaggcccacgagttttacagccgaaacctttcttttctactcaaggtgaatttcgggttaattatcttccgaggatgatcgggctgctaacctctcccgcggcttttgtccttcgagagtgacaagtcgccgtcctcattagtatggccgaagtccctctaatgcttgatggcatactacgagagccatgtatatttttcatgttatgtgtacctttttttgtagcgtattgacgaatttggcacgtgaatcacgagtagttgggattcatggctcccgaacgggcgaccccaggacattccttgaccttgacatacaatactcacgcactggcaggacatttagggctacggcatttttcataacaaaattgcctgcttgtcagctctagtgcgaagaaatgcgacgggacgacgatgacgcagtagcagatcaagacaagtctgatgaatcatatcaagaaacaggccacgagactgaagcgtttgtagaaacgctcatgacaatgagctcgtcgtacgagtctgaatcagaaagcatttccccgtcacctatgcagtcaaatgtctcctcaaccagccacatg

SEQ ID NO: 2460 - DNA, 703 bp, Nannochloropsis_gaditana
ccttcgacaaaattgctgtcattatgcgggtacgtatctagggacacattacgcttctgtatcgtcgaacggatcaaaatgaattcacgtgtgtccaatccgaaggggtacatgggccacgactaccatatgccttccagtttatcttagaatagtcatgacgtggcaccaggtgctactgccatgcgctagcatcctcgcccccttgttgtgatatcgacgcagagctgtggaaatgtatgtagggtgagactgcaggcagtttgtggattttaattcctaggagtcttgaagacgaaggttacttccaggaggatcacggtcatggcggtgcaaggatcatgaaaagcctacaaaccccaggttgcactccttcaattccctcagcatagcctggacttgatcaaccagtggtgttgtcaactgatcttgtatgtggtttgcttgtattggtcgagcgcgttcggatgacaaagtctcgaatgaccaggattcctcgatcttgatcctcagctcgcacattcattgcaccagcaaagcagtaccatgcgctcaaactctgtttacaaaatcggcttttccaagataccttgattgcaaccaagatcatctctgtagtgaatttgacgctccgtggtcgcatgtcctttatagggtttgcttttcgatagtatgcctgagccgtgagaaaacgaccaaaatg

SEQ ID NO: 2461 - DNA, 703 bp, Nannochloropsis_gaditana
ccttgcaaaatgaccagcgggtaggtcggtgggatcaagcctcgcggaagggcatgccgtcactccatcagctttgcgtctctctacatcggcttgacgcatatctgatctacaacgtcgtgctgcgtgcgcttggttccgaggccgtgattcttgatcctttcaacaaggactacgcttgtgaaagagggtaaggggtgatgggaaaatactgccctttgtatactcctgacatgagtccccattgtttgctctatcgtcgcccaaactctatgttgactatcccagtcctctcgtagaagcatccactgtttctgatatagaggaacataaagccgaaaaaccaagcatagggaggccgcttaatcaggaagtaagcgtgcgatgaactctagaaatttatctgctgcagacgggtttgacacaaggaaaaaaaacattactcagttgtctgtctgacaagacatgaaaagaagaagtaaggaaaataagtaagaaaaaaaaaaagcttttttttcccactcgaccgggcaggcaacggccatcattatccagcgattacctcagtgcctgaggaatttaagcacgtatatgcgtcccagccaaccatattttcgctcaaaaattggctgctacacaggatcacgccgccaagctgccacacatgcaaagggaatgcttaagcgggcaaagggggaaaaaa

SEQ ID NO: 2462 - DNA, 703 bp, Nannochloropsis_gaditana
  misc_feature (239)..(248): n is a, c, g, or t
  misc_feature (653)..(662): n is a, c, g, or t
tgagggtcccattgcggttcctagcgagcctgctcctttgttggatgatgacggtactcctattatcggtgagggtcccattgcggttcctagcgagcctgctccttcggatgatggtgatgacggtactcctattatcggtgagggtcccattgcggttcctagcgagcctgctcctttgttggatgatgacggtactcctattatcggtgagggtcccattgcggttcctagcgatnnnnnnnnnnaagtcaccgattttgccctttttcctcgtatgttcatgttttgattttccatctctgggcctgaaattttcgttagaaagtccaccgccttctcttctttgccctgtatagcatgtaaatttgcttttcgttttaactgaccggcgatgcgctcctcaacccccctccctccctctctccctccctccaggtcgtggacgtgtgccagacgttgaccgaggagaagattcccttctgcatcgccacgaccagtcccaaacctcgcgtgcccatctccgtgaaggcggcgaagctcgacgcttactttccgcccgagaagattcactcgggcgaatccgactttgatccccctcggtaggtatcatttcttggaaaaccgtttcttggagactccggttttatttnnnnnnnnnnactcaggctccggcgttggctcggcggccaacgcaggtatg

SEQ ID NO: 2463 - DNA, 703 bp, Nannochloropsis_gaditana
attcatagcgacattgtcgggtgggtggggacatgtaccaatttcaatcatttattctaaaaaaaggtgatatcgcgatgtcaccatatcctttgtcgtcggatgatcatcctgaaatccaagatcgcttggcaagcaataatcacacacataagtccagactcatagatataatacttgaaatgcaagtatgtagtccattggtcacggtctttgtttgagattgtggcactttctcccgcccctcggaaagtcaaagaggtgggcagctcggatcggcctcgtcatcgcctgagctcgcaaatggctacatacatacacaccacacccattcacacacctcgcaagcttcgagagaatcttgcccactcgtaggcgatcgagtgggaagagcaagggataagtgcgtgcgtaggtgcggtgggaaccgccatccgacttggggtcctggaacattgttcctgcttggagctctgatctccagaccagatggcgatcaaaatgtttttaattaatttgccgtggcggtcagtcacctgcaagggtgtccaacccatttttaacactcgccctctccgtctctcttttccacattttcagttttcttcgtgcgttttctaaaggtgcttccttgctccgtttcctcttccgtcggcttacgtctcctgctatacgcgacgcggtgcactctagctttgacatg

SEQ ID NO: 2464 - DNA, 703 bp, Nannochloropsis_gaditana
ctcctcccccgtggccgtggtggccagactggccggccgctcttcctcgccttccctccctccctctctccctccctccttgccgtcgcccccccccacccgctcctgcttcacccggttcatcccctcggcgtaagtgcctcccatcgcagtcggggaccccatgcgccgaagcttggttggcatgtacacgttcacggaggaatcgctcttgaacaagggaggcagcggggggcaggccgagccgccctcctcctccgtcccgccttcccccccgccctctgtcccgccctccgccacgccctcccctaccaggtctggaccgcgctccgtccctgccatgaagacggggcctgcccctcccatcgggagccgccccggtcgaccaccgtccacggaggaggaagaacccccgccgcttcctatcatgctcaagcttgcttcgaattccaggctcgagatgcctcgcagcatgctgtcgtcccctccctcctcctcgcgtcggggggggtccacgggcaggccctccctttcttcctccacttggaggtcgctcatggtctgctccagtttcgtgatctttccgggctcatcttcgtccaactccttaccttcggcttcgtcgtgcatcgccgatgactcctccacttctgttccacctcctcctccttctcctcctcctcctcctcctcctcctcctcct

SEQ ID NO: 2465 - DNA, 703 bp, Nannochloropsis_gaditana
gaacgaaaataagcgtgagacaatgcaagcagaagaaaccgagaaattttcaccaagaaaatgaagaacatgtgcatgcgaggtgcaggtgtgctaagacgacatttcttgcaagggacaaacaggggttttgggtgaagcaatgggaaggggggcggcgccgaggtcccttccgtcgtagtcaccttttgagccatgaaaaaaatggggagcataaccagcatcttgctggggctttgcttggcttgggacatgctcgaaggggtgacgatgtcgcttgcgattgctttcgaggggcacggtggtcctcctgcaaggaacaatgggaggaagcgaaggagggtgggtttgtgagagagatgcagtcagaccatgcggtccatttcgtcgaaatcgaagcacacagatcatgagactgaaaaaaagcaggccatgtacccctatcgtgcctttcctcacaatgttgtgggattaaacgagtagacgcacgagctcctcgtgctcctcgcggtctccctcttggcgaggggcgaatcgaagctctggaattcagaacattgagcctcatcgtcgaagccgcaaaccgcgttccagacaggcggggagacctcgtggtgttctcgtggcttcgtattccacatcttttcacgcgatggcacttgtcttcttttctgactatcttgcacaggggtgtttcgctatg

SEQ ID NO: 2466 - DNA, 703 bp, Nannochloropsis_gaditana
gaagcgaacgtatagaattgaaacaatcatttacaggcaaaggcatgatttggttacatgtaggtttaaccgcattttaatagttcaatgagcgcctcgaattaaattctttctctagaaggaagggactaagtaaggacgtcttatagttatagccatgaatgtgaattcgttctcgatatacgtctacacgctgtataaatggattgctttgattcccccaagtccacctcatccgtccatttgttacatcgtgtgactaccttagcaacaggccgtcgaaatgggccaagcaagccgagagcgcgatacgagaacggtgtcgctcctcgtatgccgaggagtcgagcccgacacgctggccttcccactgtggtgtgagaccccatgcgacatttatgccgaatggtgtgctatattttatagctccataggaagccagggagctgttggagtctgtattggcattaaagaggagaaacgctcacggcccagccactccctttccagtatcttccttctgtctcttatcaacaaactgttggtgtgtacgtgcacactgaaaatagaaacacgaccttcctctcttcgacgcatacaaattacaacattcatgatgctgacggactcggttgtattaaacaccttctcaagtcttccctttcctcttctatttattctggccctctaagacagcgctatg

SEQ ID NO: 2467 - DNA, 703 bp, Nannochloropsis_gaditana
ctcagaagggatcgcgaagtccaggtttgcgtgacttttaactggcaaggaaaaagaagggacggaagcctcaagccgatttggcgacagagagtcacttaaaaaacaccggcacgcctgcctgatacaagccgaacagagacagagactgtccacgcatccctgatggtcgcatcgacgacatcacaacgcaaacggcatgacgcagatggtgtcttgaatgcctgtgtctgggcaacattacaaggagggcttatctcgcccccatagagatatgtcagccgtcgcacaagagggctactctactcgttcaatgaatcgagaacctcggggacacgcttacgagacctcgcgtgcagttacaacatgctctatctggtagtactatttggagtgcatgacaaagagggacatgctatagatcttggcatgctgcattttttgggccgcccgccctttgcctccctatcgtatacagccaacgccgtgtttattgccatcggttcggaaatcgagatgattttgtgcgtaataactttcaccatttggtctggcattgcatatcggatgctttcttctcctgcactcaatttgctttgtgggtctgaagctcctcgcctctaactaacctccctgttgctagctctcgaacgggcacatttcccgcgaattctccagggattgcgaccaaaccacgaccatg

SEQ ID NO: 2468 - DNA, 703 bp, Nannochloropsis_gaditana
tcatctcgtacacaaaaaataaggccatgaaggacaaaccagacccgatcagaatcaaggctagcgtgccgaaagccgctggattaacggggctatagtacggggtctggatgatcgaggaggaagtcagaaggaacgctaaaggtcgctgcgcgaaggaggaggacacggaaatatgtgcctcccgccatttattatacatgcgtgtaaagcaagaaaaaaattttcgtggtgctgtgtttacctgggaggacatcgtggtggaacgtggggagaggaacgtctggcgtcgaaaagctccgtcctgtgtcagatgaggacaggtggggggggaagtcaatcactgcgcacacagtagtccctagcaacgagtacatcaagttgcgatgacactgtatactcaaagctggtcatgagcatggataattcggttcacggggacggagcgagacatttgagtgggcattcaattcctcagcgagtcgagcgaggggtgtagtagacacaccgaagcacttacactttatacacagggagagggaaaaagaaaaacccctcccgtaaacaagaaggctatacaccattcttgtgctctggattgcctccgcacggccagcattgtcgttgtagacattgcattcacgtgcgcatcgattcccaccccctggcctccgacagtcaccgcatcggggggaagtggatg

SEQ ID NO: 2469 - DNA, 703 bp, Nannochloropsis_gaditana
tgtcaccttcatttttaccaaaatttatgcacacgatgaacattcaaccatcaaccaccaaccaaacatctttactcgatgtttcacaattgaaattattatcatttcccatggccgtattcatttttgttgcgtacgggattttttcgacataccaacttccatatcatctcatcgttgctgcgtcaagctccactttgatcaaatacaaataaaatctgctcgatgcacgatggatatgactttccccttgagcgttttataaaccctagattgaaagtaaagggcgtactaaaagctgtttccgactccttacctttgagttgggctccagctgcagatttcgaaacattgacgacgctcgggcctgagccgttagacgagccgttagacgagccgtttcgaagcagctaccgcagacctattacaatgtgccccctagtgctgatctatttcgcatatattgtcgaatgaaccatatgcatggtatgaatgatgattacacagtgagctgggttagttcgtattttgtcgctcttttatgtattccttccgtcatgggtgctcgatctaccgctagagcaccggcacacgattcaaacgaacaaattggcccccttgactccacattgataacgacgttacataatcaaggtccagcctgttactaatttacttttttaatattacaggtgactatatg

SEQ ID NO: 2470 - DNA, 703 bp, Nannochloropsis_gaditana
tagcaaaagcatggtaaaattgacagcaaaaagatagttggaggcagatttcagggtacaggtgtgggggctcgaaaaactcagccgctcctgtgatctccatgtgcacgccatgacctgaaatgtttgcgtttctggacaactaagagcttttgcccgcgcgtcgtcagaaagcgtgtaatatttcctacgatatgtatttgatccatttcaaaaattgatcccggcggcaaggcacgctctagattgagatgtgtaggcgtttgtacgatcatgcacgacagtccctacgtcctatctgtctcttgtcacggatttgtttgaggggttcaatcgcacattaatcatcgcatatagtatttcatggatcgtcaaatcgaagcgtcgggggctccttgccacaatctctcgcatttcttgcctgcctctacgggagaaatgccggctggaaaaagcattgctcattaccctcagaaactattctcttacagccctaggaaagctagcctatgaacgaaatgccaagtattccatatcctaacgacctatcttttttctcgtccctattttcagggactttctccattgactctgacgggagaaaagtggcgctcaaaagacgatatgatgccatggggctgcagcgacagatagttatagtctcaacgatagaccttgcagctgcggcgtgcccggcaccatg

SEQ ID NO: 2471 - DNA, 703 bp, Nannochloropsis_gaditana
gagtggcgaggccagcgtcgacataactgaggacatggtcttgacacgcgtctctcaaagcaaggcggacgcgagcaatacgctcgtcaacgtcatggtcgtgaggcatgggaaaacctgggaaccgatagggcggggaagaggactcgtgaaagaccttatcgcccggaaaggcaacagagaagccggagcgataatgacggtccaagcgattctccttctttttgaccttgacttgcagctgaaccagcccctttgcccgcccggcacaaagcacacgtagacataaacagcgtgtatactcaatatttattatctgtccggacgaggatattactgcggccgtaaagctgtgccctgcgggtggcgcttgctctttaccatcgaagcattacgagaacagagcttagtgggcagtgacacatcgtcgagccagtctgcttgtcaatttagggcatttgcgaacgcatgtgatgtgaaggatgctggtttttttcattgatgaccactattgtctaggacactttgtcagaaagggatgccctcttgctccttgtagcatgggctatgaaggagtggccttccaccaacttgatgtctctactcacgaataacggaggttttgcatttcatcgatccccttttctcccgttcttctaactgcaggaaacacagaagttgtttctggaagtcgattgacatg

SEQ ID NO: 2472 - DNA, 703 bp, Nannochloropsis_gaditana
gaacaagggcatctcgccccttctcaagatcttcctccttcccttcctcttccccttccttttcctccccctctttctccaggtcaaccgtcaaggtagcctccaagccagcaatgaacaaaggagggtagatggaccactccccccacactttcaagaccttcaggagcttctcctcgacgtgctgggcagtgagcctccccaacacggccaaggagttgtggaaggcagagaacacgtagggcagtgcgagttgcaacgatgttcgataggtagaggcgttcctgacaccggccgaggaattgtgcaatatgtctgacaccagataaagacgggccaccctccgggagagggacacaggctgttcccccgccaggtcctctgaccatcccttctccgcacacagactctccttgagcaagcccaccacctcctcgctcgcatcggcatggtccagggcgaatcccatcccctccttgattttcgcccgccctccgtccaatgctcgcagcaaggcaacaaaggtctcgtagtctttccgggagaggcgagaagaaggcgcccgcccccgcgcaatgtcccgtgcccgttcggcctgtctgcccgtcaagaaagcagccgcgggcatgacagcttcttgcccctcatccccaggggcccctacccgcccccgacctccccctctccgactcccgcccgggct

SEQ ID NO: 2473 - DNA, 703 bp, Nannochloropsis_gaditana
gcaccccggccctgcgggctcgtgcgacttcatctcgtctggcttcgtatttcacagagggattaagcgacaccggcgagagggctccctgacagaggaagcgcttctcgtgcctgtgagaagggattcagggcccgaccacgtgggagtaatggcaccatgcgaggacgagatgttgtccatgttggagtgtgagatgtattgagcgcgttgcgggtagatagcgccctgtggtacgcgttttgggacattaatgcgtctgttcaagcctcatgcaagggcgggagtttcacgaacttctgactgttccggaaaatcaagagctgaatcactggcatggcaagtgaccagacgcataaccattggctttgcttgaaagggaggaaaactggttacgttgtaggtggactaggacctcggaaactgtgctttgcggctatgactggtactgatgtgttgatatttcaggcgagagggaagagcaacccgagtgcagcgacagcgcctcacatcaataattttgtgcatcctacccactatttcgtgtatgtctgagtttcttaaaccagctttgaactcttattcaagcgctttcgagccttatgccttttccgatggtgagatagaccggaagacatgtctaacttcaagccatcctcacgaacaggaaaactacacacatcaaaacaacatctccaagatg

SEQ ID NO: 2474 - DNA, 703 bp, Nannochloropsis_gaditana
caccggcgagagggctccctgacagaggaagcgcttctcgtgcctgtgagaagggattcagggcccgaccacgtgggagtaatggcaccatgcgaggacgagatgttgtccatgttggagtgtgagatgtattgagcgcgttgcgggtagatagcgccctgtggtacgcgttttgggacattaatgcgtctgttcaagcctcatgcaagggcgggagtttcacgaacttctgactgttccggaaaatcaagagctgaatcactggcatggcaagtgaccagacgcataaccattggctttgcttgaaagggaggaaaactggttacgttgtaggtggactaggacctcggaaactgtgctttgcggctatgactggtactgatgtgttgatatttcaggcgagagggaagagcaacccgagtgcagcgacagcgcctcacatcaataattttgtgcatcctacccactatttcgtgtatgtctgagtttcttaaaccagctttgaactcttattcaagcgctttcgagccttatgccttttccgatggtgagatagaccggaagacatgtctaacttcaagccatcctcacgaacaggaaaactacacacatcaaaacaacatctccaagatgcaaatctttgtcaagactctgacagtaagtgccactttgagatttatcgctcttactgaatggtttgatt

SEQ ID NO: 2475 - DNA, 703 bp, Nannochloropsis_gaditana
aactagataggaaatcccttccagagcgccaagggatccgcccggtcctgccggaagaccgcaccccgtcgtcttaaggacgtattccgagtagagaacaacaggacatgctacaagtccgagcgctgttaccgcaagacccgctcccccaatctcctcggcttcatcgtcaccactactggccaaaagtagagtcttcgacgttggattcgggcatgtggcctttgaaggcgatggaagcctctttgacaccaggcgatgacttgtagaacgtggcacgaaagcttcaatgctgctgatgacaaccagcaatgaaacgcacaaaattatgaatttatttgcggtcattctcgatgcttcctaaccgcgacaatatctgaatgaggagatggcaaagcttgctacagtaagtcggtgagtacctaatatgtacgaactggaacctccctcctccgacggaagcattctgcgtcaactatgcaattaataacaccctagtactgccatgagatagaatagagtgaaagacgtcgagccaagagacaaggaagcccttacgcggccaatcatggcttatgtattcctttctcgtttttaacctcctcaccccccgaaacgaatcgctgctatccccaagtagcctctgtcgcattctaataaattcccttcacatgaatcctgaaattccacagccccgggaatg

SEQ ID NO: 2476 - DNA, 703 bp, Nannochloropsis_gaditana
agaatagagtgaaagacgtcgagccaagagacaaggaagcccttacgcggccaatcatggcttatgtattcctttctcgtttttaacctcctcaccccccgaaacgaatcgctgctatccccaagtagcctctgtcgcattctaataaattcccttcacatgaatcctgaaattccacagccccgggaatggtgaatgaagacagctatcttgtaccgccaaaacttctggaggcctttcgccgagacggggtcgtggtattgcctggagtcttcactgaagaggagatactcgaggccaagacagggttagcgacaacacttaaaatacatgaagtggtgagcaaaataatgatgcgatgccgatgattactttcccgttttcttccgccctctcgaagttctcccctgtctgatacatattgttatgtcgcctttcaccatgtctcgaaaaaccttctcaatttccttcgctcactgtgacaaattaggacgttcaagatcttgagaagacggctggtaatttacgcaaactttctaccaccgggggctccggaggcgttctagacattttttacgctccttggaagcttcgcctttcagaaaatcctcgattcttcagcgcgatttctcaattatgggcagctacttacgcagaaggacgcgcatcgtcaaagggaggcgtttgtatggatgtgagaaga

SEQ ID NO: 2477 - DNA, 703 bp, Nannochloropsis_gaditana
tgaggcaggaaaggtatttagtcctcgagctgacccacgcttagtgctacatgcttgccccttcctaggccccaggcttccacattcatggcattgaagcaccacaacgtatcggcatgctattattctctgagaatgaatgtgatgataggcacaacaaaatgcgcgcacgcacttaatcttgacgactctaaccagccttcacgcctgtaccctgtagcttgctgctcctgatgccctgttaaccgcaacctttcgaaccacatacacgcacataacccctcaatcagcgtttatgtgtcacatatgccatattttatctggctcatgtatccgtgtgggtctttcaactacgcaaaaccacgttgagcgggcgcgagacaaaggaaggcttccattccgatctctacgtttcccctggcaagcacgcagaccagcactgtcataacatacatgtctagtacatcgattttctacaaccgttaatcgcgggagtagcaccagtgcgctcaatcacacattcaccgccgaggcttttttctaacgtgtgaggagagcactaaaggggtgtcttatttttaagcagcgtcatacgccagcggtactagtagtcgttgggcactcgaacgtctcagacctcagctgctccattttggcccgcacagctccgctatcgatcgacatgcatccactgaccaatatg

SEQ ID NO: 2478 - DNA, 703 bp, Nannochloropsis_gaditana
tcttggagaccgctccgtagcctggaaaaaggacttgcaaaaagccattactaccgcgacctaccgaagatccatcaccgacgttgtgttggattgtaaatacgcggcctgtgtccaatgcctgctttccacgccctttgcaagccgtgaaggcttgccgacctcaaaccccccctcgcacacattgcttcctccgaggcgcctttccacaagactttgtccttcaaactcgctcaaatacatttggcggaaacgcgccactcgtctgataagttttccctcatgcatgattgcaaatggcagtttatctccacgttttcctcaatggtgatttccttcgcgatggatgatgtttgtattcgctccaagccaccttttctctgtgcttgagtgacacagggtcgatggcgacgcatcgctcacatggcaacacgcttactaacaggcaaagaggaaagggccaatgaactgcatatttcaatcttctctactgctgtaacgtgtgctagtgatgacttagcttgcgcattacctgccttgcattttccgcggccatctatcgtgttctacctcctctctccttccctcctccctcacctcgtcccatccgccgacggtttgaacttcatcggaccgacgtgcgaagggcctgattgtaatctgctattcgtttcttcgaattggttccccgtgcaaatacatg

SEQ ID NO: 2479 - DNA, 703 bp, Nannochloropsis_gaditana
agggagggagggagggggggagggcagccggggaaagcctgtccacatatgtggttgcggtgaagcaagacatctacacctatacattgatggaaagggaaggaggggagggaaaccggtaccatcttgcacccggggctccccttcgcccgttcgcatccccctctcctccctcccctagccttcaggagggggaggacctgagggaggacggggcggaggacggggcggaggaagacgacgagtccaacagcatcgtgggcgtgaccctgacggaggatgggactgtggtggttgccgccaaggtaggaggacacgcttctcgaaggagggagggagggagggagggaggaagggcaagaggtaggggagggggtctgctttgctccttctttgctctctcactgtctccccttcttcaaccttcccctgctcgatgtctcgtgactggtagggagggaacgttaccgccctgcgtcataacccttcccttgccgcctctacgcccacggcccaagccggggagagcgctctgcgcccggtggcctacttccctctctcccgcgtggtcgcctcctccgcccccatccacatttccaactccttggccgtgcacgggcaggtgaggactcccttctttttctttgcctctttttttcgcgccaaaaaagcgtggattgggaagttcgcacccagcggcttg

SEQ ID NO: 2480 - DNA, 703 bp, Nannochloropsis_gaditana
acaagctaatggaggttgagggggtgaatgtttatataaaaatgaatggcctcgggatggaggagatcacgacataactgatgagggtctttgttgagactccgtgtacttttacgcgggagaatgtgtgtaatttgcgcggtttgcgcaatttctactaaatagttttcacgcgcgtgacgcgaaatgctggatgtattgttcgacaacatcgttgctacttatccatctttcgctggtcactggggtttcattagcattcaatgcaacgataacttgcttttctgtcagagttactcgcttcacgattcttcatgatttttacatcatgattgacgcgaattttacatgaatagaagaaattgggcgcaaaagggttcggtagcccgaggggagggcgacgacgcttggacgtgtgagggggtggagcagcatcatgatacccggatattcagaggttcccgaagaaaaaagcgtgagaattgtgtctggtttggaccgtgctgatgtacgaatacgttcgataggtaggggatggccaacacgataataatacgctccatgaatttttatgttttttgtgtccatattatcgggaaagcaacaaagagaatactcagctgcctcacctcctgggtccccgttgcacacatatacagcattcaaaagctcacgaagacgccccgcatacttcacggtcatg

SEQ ID NO: 2481 - DNA, 703 bp, Nannochloropsis_gaditana
ctcttattactttcagctagggaagacttcacctgaaaaacattgaaaacaaaaagaatgtcatatcagcctgaccgtgttgacctcaggggacaggcgcaagattgtattcgcaagtctccagtatacgattgatctcccttacccttcataaccctaacaaattttacctacctgctccgcagtaactagaggggactggaacattaatggtgacaaaggaggactttggtggccggaattccttgacgatccgatattcacgtttggacgagccgcgctggcggtgacaccaaaccacatcacacttgtcattgtgagacacttgagcagcatggcagctagaggggaggtcgggggcgtcaaggtagggctgcgtggaaggcgagcaatcaacccgttcgtccggtgcagaaaaagacgtttcattcctgtaccaacaccgttataatacattgtgaaacgcaggtggcagcacggaaaaacaatgttgccgtgggttcagtgtcagctaaaacaagacgcaagctcatcgccaactacaacctgcgacccagggcaccattcccccacggcttgtgtgccttttcaacaagggtggcgtgggcacgcggtatgaagcatgcaagatagacgtcacgattgatttcacttttcttcaatcaagccatagcccgttgtcgcttcgctggtcaaccccatg

SEQ ID NO: 2482 - DNA, 703 bp, Nannochloropsis_gaditana
gggccaaggataaagggggtggggtgaaggaggaggaggaggaggaggaggaggcggaggcacgcgcgatcaccgccaagtccttgctggcagagcttgagcggcagctggaggagtctcgtcgagccagggagagctcggagccgacagtggtggaggtgggccttgaggtgtggcccatgcagcggcaaggacagggaggggaaggggaggggggtggatggagggacgaacgggcgagccgaagcagggctcgaaacgccttgcgaggtgcggagggcgtggtctgtgcctgtgtggtggaggaggataggcgcagccacttgatgctcgcgagggtacgcgttcgctgtaggggatcggaaatgcaagggagggaaagtgaaatagcgcgagaaggaagagctgtgggagggtgcgagggggggaaggccccggccttggtgacggccgtggggaaggcaggtttcgcggcgagagagatccccgccaaggaggcgagagcgcggatccaaaccctggaatgcctctcgaggtcctcatcggtaccctcgccgtccccttcctccccccgccggcgccagcagcagcccctgctccccggcaccgcccccacgtccaccgccccctgccctgctctcacggccccttccctgggaaaggccttgccgcgcccgcccggcccccgttcccggggggtggg

SEQ ID NO: 2483 - DNA, 703 bp, Nannochloropsis_gaditana
aagaggcgttacgtgagagtctgcttcccacgcaaaatggggacgattacccagacctgggcagaagacgaatcgcttacctcgcattaaacaccaagcgccttgcacacccatttttacctcctttctttgcctaggcagcccgtttataggattcggaatgcctcgcaaggcatggccccaggcttttggtcggtcgtttgcgaacgctaagtgcatgtacacgcacggaaaatgcgctttgacagtcaatattcgcaccgattatgtattcatgagttctttcaacaatattatgccttaggggtgccgtaggggcggagcagggtaaagtgactgtggctgatacccagaggcctccagactagtagccctgatggcgcttgaggcctgttctggcattcttccctccgcatctacagcatttcgagtagcaagctccacgaccccgggatggatcgtctttctttcctttggtgcgggggcgcttgccagcagctttctaccaagcatgcgaaaatcgggaagaagaaaaagaggccggcagtggccctcagaggccttggaggaggaagcggacgaaggcagtgacagcgagaagagcgacacacaggagtccgccgatggaatgaccagtgctaagacgattcgggatttttctctggtatctggcccattcaaaatggtattgtgtgtgaacatg

SEQ ID NO: 2484 - DNA, 703 bp, Nannochloropsis_gaditana
tatttcctgccagtacacggaaaagtttgtttaatatgaggttcggtcacgctaaagctgtaatggcgcacgtcagacatatgctccgcgaactggtcctgtcactttactacaggaatgggcttgcacctgcttgaaggaggtggtccacgcacgctttttcaactttcacattatttggatggaaacgatatccaagcgttgtctgcctgcacacagtgtgcgtgtgtgtcggcactacaacttacaggcttttcaaaaaagacttcattgtgcatttcgcaaagaggggggggggaggtcgctcgctctccgtcaaggacaaagaggcgttacgtgagagtctgcttcccacgcaaaatggggacgattacccagacctgggcagaagacgaatcgcttacctcgcattaaacaccaagcgccttgcacacccatttttacctcctttctttgcctaggcagcccgtttataggattcggaatgcctcgcaaggcatggccccaggcttttggtcggtcgtttgcgaacgctaagtgcatgtacacgcacggaaaatgcgctttgacagtcaatattcgcaccgattatgtattcatgagttctttcaacaatattatgccttaggggtgccgtaggggcggagcagggtaaagtgactgtggctgatacccagaggcctccagactagtagccctgatg

SEQ ID NO: 2485 - DNA, 703 bp, Nannochloropsis_gaditana
ccgcctctgccaacccaaaagctaagaaataatggcgcacacgaataaccctatctgattctccgacaataagagagcaaaaaagttcttaccatctacatttcgccttcagtatttatttttgcaataagggcgcgtcggacattttcgggggaagttcgggagagtcggcgaaagcccaccacacggttacagggcggcaaaccttgccaaacttcacattagcttggaacatcgaagcatgcccaccactttgatgagctgagtatcttgtcgatcaaaacgtgacatgtgttgattaccatatgctacccctacttggggatgagttcactacaagtaaataaatagctaggtgatgtttctccaggagtacgtatgtatgaagatatgtcgttgataactaaacaatgtcttatcaaggcttattttgtttcattcaatacaaacggatataaaatttgaatcgatgtatcaaatcatccaaaagctttctcctgtatttctttgtttagattgcacttcacgtgggcgcagagcagcgtgtagtgggcggctgaagtggttgctggtcaggacgatggaggaaccgagagggaaagaagtatcgcacgatgccccatcagcacctactgctcaagcctcgccatctatggcaaaagtcatctttctctcttcctttggctcaatcttagagttgatg

SEQ ID NO: 2486 - DNA, 703 bp, Nannochloropsis_gaditana
tttcccccttgtcgctaatgtcagtaatggcttgccagctacacatggattgacgtgataagtccgaggaatgagggcacgataatcgatttcaaggtacagaagttttatacataagggcacattcatgtgagtcgggaccagagatgggcccgggagaggatcgagacgactgcaacggggctactgagaaagggtttgttcactatcaaagcaccggacgcaatcccttggcagaagagagagtgtatgtcaagcttcgtttgttatcgagtttcttgtgcgtgtccaccaaacatttcggtgccgcaatgtacgacgtctgggagagtcgatcacacttggggggcacgtcagggaaattttggaaggggacatgccacgtaagtgagggaattttcgctttatgcacgtatttgccaccaacatctccgttaatgtgtgctcttatatgggacatgacatgtttttgctcagtccttttgttgattgactctttttgaggtgttatgagccttaatactcccctgtaacctccctgttctcttctgactcttctaggcccgaagcaatttggatgcccttcgtcactgcttcgaaactcaccctgagtgtactcttctcgtcggtgacgcgtgccgtaacgttttcctgtgtcgtttgtccgcctttccgtcccctctcgcccatcgtccttgccatg

SEQ ID NO: 2487 - DNA, 703 bp, Nannochloropsis_gaditana
acgcggtccgctggggccgggtccacggacatgtacgggctcttgtccagcccgatctgccccttttcttgagcaaggctggcatcctcccctccttggtgcctccagcggattaagtctaaggaaaggcgacatgtgtcggccacttcaggcacggagtcccggacgaaggtctccaggaccggcacggcctcaacctcgccaatagcacccaaggcctcagcggcctcgtgccggaccatagagtcatcattttcgtccgatagaacagcaatcaggttgggacacgccttgcggtcaccaatctgaccaaggacatatgccagctcatggcgaagtaaggctgagtcttgtttattccgtagagcctctccgatcgcagacacggcttcagattctccgtctgttcgcaggacgaatgctgcatgagtacgcttctgaataggctgactaacgtccaggaggcacttccttaacacagccacgtctggagccatacgcacgagccctgaatcgagatgtaggggaggtaagtgagtggaggcgaaggtcatagtacaactacagaattgcatcgacgacatatgtgacaagtccaggcgtaaccatggtgcattgcattctttaagagctatagagatagctggacgaaccaaaaagcacccagaggcgctaggccattgcgccttgtcttatccaggcc

SEQ ID NO: 2488 - DNA, 703 bp, Nannochloropsis_gaditana; identical to SEQ ID NO: 218

SEQ ID NO: 2489 - DNA, 703 bp, Nannochloropsis_gaditana
cgagaagcgcttcgaatccagggtggcgctcgtgacaatgagcttcaggtcccgtcggcgttgagcaaccttacgaagcatcccgaatagcacgtccgtgttcagcgaccgttcgtgggcctcgtccatgacgatggcggcgtaagagtcgaggtccggttcccgcaaggactcgcgcaacaaaatgccgtccgtcatgtacttgatgagggtcttgtccgaggtgcagtcgtcgaagcggatcgagtacccaacctcttcacccaactccacccccatctcgtctgcgacgcgcatggccaccgtggtcgcggcaacgcggcggggctgcgtgcatgccaccattcccaagtcggtgaaaccctcctcatgcaagtactgggtcatctgcgtggtcttccccgagcccgtctcgcctacaatgatgacgatcgggttctcgcggatgacggtcagcagttcgtcccgcaccgtactgatgggaaggtactgtcgttgctctgccatggatttgctccgggaaaagtcactctgcccctccttcttcatgtccttcagatgctcgctgaatttgctctctttacggtagtcgtactcctcctcctctttccccggaccctcacccgacgcacctgcacccccttcctttgcctcctcaccttcctccttcaggcccatcgcctggcccatgcgacttccccct

SEQ ID NO: 2490 - DNA, 703 bp, Nannochloropsis_gaditana
ggaggagcatggcgcctttcggcagatttttcgattttacgactcatttcgtccggacaaacatctacacatcgcacaccccatatgattcctccacccgcctacagaacttaccgcgtcgatcattgcgtctgtctccacctcgacggtcttcatagtagcctcctcggtcaccacgatcacgtccacctcggtacccgcgatcacgaccataatcgtcgccgctccctccgcgcccgtagtagctcatgcttttagcttgtgagtgacctttgtggatatggtatgcccgataatcacaggtaaaatttgcgtgagacgcgcgcgtgtgagggctccgggaagacaacggctgaggtatccatacagtagaccaggcgataaatttgacaggtgtgaagaagaggttggcaagaaaagttttagtacgaaaagaggacacgtcagcttgcgacacgaggacacactcgtgggagatctagaaatgattgagcacttccttccctctccgcttgtcaagttctctgaatgacagccctcttctgccttcggctgtacttcgtcggtgctgacgatgacgatggggctgtgatggtttaggtacctcccgcgtcgtaaaaaagacgacgcaaaacaaagccaaacaaaccactccttcttttatataatcgattatatcacgtacaatttaaccacccggaca

SEQ ID NO: 2491 - DNA, 703 bp, Nannochloropsis_gaditana
ggccttcgacttgcagcaagcggctcagcatgccgtcacgttccaccggagcgaatccatccgcacccgctaggtaccttaggcccccaaaatctttaaaatacgacaaaaataaagcagactcgtgtcccccaatttctcggtaatgtacttgcgctccacccacagcatcgtccagttcgacagtttttctggccgccgctgccacttcgttctgactggcctcgctaccccaccaaatatggatagcacgctcaaaagttgtgtccccggttttcttaaaagtgcttaacaatatgtaagcattacctttgtggaaatgaccatttatgatagtctgttttacgggcgtaaggtcctgaatgcgccacaattcaagccccggcatatggcccacatctcggaacgcgggctccatcgtaatggcactgctatgcgtacaagatggaaagattaataagaggctgcagcaatgtcatcatttataaaatgaacgttgtgcactatcaaatggacgtcatgcacggggcgagaaaggacgcagcccacagttttagtagtaaataacgcacgtccttgcttgcttcaactccgagtcgtcggacgcttttcagccggtagccggagaagcagcaccccagaggaggtcggaatgctgacataatcacccatcacgtacgtagaacagggcacgcaggccatg

SEQ ID NO: 2492 - DNA, 703 bp, Nannochloropsis_gaditana
atggccaaggcattcctagtgctgtggatgtgtcggtcgcgagcgtgaaaactgattcccagacgaggccgtcgccaaggccgccttggcgaggcctcaagttcaaactttcccctccttcccgctgggccctttctgccgcagctcgcaggcatctcaggcctctgcccgtctttgcttttgaggcatcgatagggttgagctctttttaggagcctttcaagcaaccaaagggtctcgcattcacgttcggagagccaatcaatgccattaactcatcgtaccggttaagccgtagtgttcaattttcttcctctacaacacctacaatgcgcagattccacatgaatcatcaatttgactggtctcatagcaataagggcgatccattgtggctttctgataatgacgagggctatattgaagctattcttgtgtcggtgcagggtgacaagattatcgtcgaagacaaagggggcaaggtacgtccaagtgatgacatgaagatggatttcaatgttcccacgcggactagaccatacttgaagttcggaggagtaagatgagaggattcgatgtatatgcaaatgtgccatgagaaatgcaacaggagagtcaacatatgaaataccgcattggcatctcatcttgattaaaggaagggatgttgtgcagggccccacgcgcccgtcagaatatttgt

SEQ ID NO: 2493 - DNA, 703 bp, Nannochloropsis_gaditana
atctttattcggatcccatgaaacttgcgcgataaagcgttgtaaagctatcacattagtccgtgtcagcattaataagctttttgacccaaaatgtaatatatcagtgtcaataagtttatgctcgcgaaatttcaatactgcaggagcaaggtcatcagctgaggcaagcgtatttaggtttctgaacttatcccggtcggagcagcgacgtaattttcgatagaatgaacttaaatctagcggtagactttcttgctggccatgctgctcagcaagatagagtgccaactctttctccatagaagcgtctgtgagtggtgcaagtatgaagtaaaatttgtcttcgatcgtttgagactttgatacttcacgacgtaaacacttccggtctacaatcgcgcattctatgtccagctactagctgataatgccatgttcccatatttccaggccgaacggagaccgtgaccgtgataaagagaagaaagaacgttcatcgcctccaacctcctggcgcccggcttggcccagccgttacaaaaccgttacgaagcgttcctcggccgtcccgcccccgcgtgaaaccaggcttgcgattctcttggcgcgcaactcaataacaaaccatcaagcacatacaaaacaggaatatcagcttgcgagtttggggaacgtcatcgtgcatttttcagtatctatg

SEQ ID NO: 2494 - DNA, 703 bp, Nannochloropsis_gaditana
cagcgaaggcacttgaaaaagtggttcttgtatattgaggacgatacgagcgtcggggtgacagaaacgttggccgtctgccagcaagagggcgggcgggcagggtgggaggttggctgcccgggaaggctgacgtcaagaaagatccgcacgtcaacaacgccacggccagcccgcaccgcgatcggaacctcgcgctcactgccatgcctgctctcgtcgtcctggggaatgcgatgaatattaaatagagacgatgtttataaaagcactaggacggactttgccatgcacggattttgggagttctctgatgggcgctggcactttctgcgtgcactcgtcgcccctccccagatgaacagcaaatctatagtcctcaagcttcgcttgcagagtacgtcttgtatttcacccacgggttgggcgcaactcgagatccatgtcttcatgaaaggataggggttactatccacagagaccagcacagcattatcaagcgagtcgggcaagttttaagtatggggacttggcacatgctttgagttgtttggtatcgaccccttggatcaccgctgcaccgcctcacggatgcgctttcacttttcgaattatctcagctcttactctaaactcatttctttgatgcataatcaataaaccacgacaggtccaaacacccccttctctccgctaaatcatg

SEQ ID NO: 2495 - DNA, 703 bp, Nannochloropsis_gaditana
tgtacttgagagatgtcgtgtggggaatcaaatgcctcgaaagctgtctcgtgcgctggcatctgtgcatgtgcttgtgagtgtgttgtgcccgcttcctatgccccctgccggcacgctcctcttataccctgcttgcctcttcctcccccctccccgcccatgactggtattaggacgtgtggccatgcttgcggtagttggtgtgctcgtgcaagaactttaccagtggaacgaaaactttccctccaagaacttcctggaggccctcaagaccgcccccgccctcggtctgctccagctcttcgtcttcctgggcgcctatgacgtaacgaccagcaagttcgaaggccgcgtacccggcgacattggctttgaccctcttcgcctctctgcggatggcctgcgcgagaactggcaggtggcggagctgaagcacgggcgcttggccatgatcgcctttttggcatttgttgtgcaagcatccatctccgacaagcccatcctcgagcagacctttgagtgggcgaaaagcttcgcctaaagagcggcagcctctacccagtaacagagcgaccacccctccactagcccgaggaggaggggacccactacctcaccctctcaccgcggtcttcagtcccggaccccttttttttttacaatcggtattgaccttggagtgagtgctgtcgagcaaatg

SEQ ID NO: 2496 - DNA, 703 bp, Nannochloropsis_gaditana
atcagacgtacggcgtggaggcggctcgggccacaattgtgaaggagataaaaggtgtttttggggcttacggtatcgctgtggaccctcgacacttgggtttggttgcagacttcatgacttatcaaggtggcttccgcgctttgaaccgtattggtatgtccgaggtctcatcgccatttttgcaaatgagcttcgagactactgccaccttcctcacagaggccgcgctcaactctgagaaagatgatttgcaaactccatcggcgaagttggtcatgggccagcctacggggaatggcacagggtcgtttgacattatgattcctgttgatatgaataggaaagccagcgagagctacgtcgaagatcctctgaaggaagaggaaggagataggatggaggaggcttaggatcgtaaaggtgaatggcaggatagtattcaatgtgcagaaagtagaagcaacgcgtgatcatgacattctcggtaaatttcacgagtccgggaatcatttattggtttgatgcgtttctttgcctgttatttcggaaatttccaacgagtcgctgcaaggggggggacggggaggttgtggtagggcctggagggataggaggccggtgtgttatcttctgtctaatctttggtgcggtacacgataaatatgtaataaacaacaggttgcgaggattttttactatg

SEQ ID NO: 2497 - DNA, 703 bp, Nannochloropsis_gaditana
tgaaaatgaacagattgcggggaatgtgaatgtgggggcatcacgttggagagtggagcaggcaggtgatgtgcgcagtgtggaatgtttcctcgaggtactttttgtgttcctgagacctgacagaaccctaccattttacgcaagcatttggtacgcaatatgcacggtgcctatctcttatgtacttctcgctgctcatgggctgttgtggtacaaagtttgtaagatataacgaacttatatatgtgttgcggaaatatggccgggcgtgcgtcaggctcactaaaccataatcccgcactccatcacacaggctgtcgactcgctccacatcgattcaggctggattgtcggacagcctaggcacagcagctcttgcgcagaagtgaaaacaatgcattggctcctttttcagaacagaagcctaataggcagagggggcgccccgcctggtgtcgccctgcgcgtcgcagctttcctcttcttcgctgggggcgtcgaaacttttgtgttcggtggcacatctttgtcctcgcacaaggtgtcgcagcagccgtcagcagctccagtggagtgggcatgggtagggtggagaccgtggtctgtggccccccggcgagcttgctgggtggcggcggggaggggaggcgaagagtgggacagtgcgggcagtagcggggccggaggtgggaacgagatg

SEQ ID NO: 2498 - DNA, 703 bp, Nannochloropsis_gaditana
tgtcactcatgctcatgcatttccctacaatgcccatctataatgcgcgaatagagaagagatggccgctactctccgaatggctgcctcgcgtgctgctcggcaagccattatccgagtcgcggcttcccctgcctctgtcagccctgtgcggtgcttggcgtcaggcggaggggaatataaccctttcacacactccttggaccggttaaacacgaagaaggtgaggatcctatgatgcggtgggtctgtgatgcataggtttcttttttccgaggcacatgggagatgaacgggcgggagttgagtgagagtcttcgatttggccgtgtgtgtgcgtatgtctagctttttagtgggagatcattgaccctcgcgccatagtcggactggttttgattgttttttggtatctaatcagatgctcggaaaagtagcctgttcttcctctaagcactcacacatttccttacgccaaggtcctgctcctctgtgcacttgttacaagtcaatagaagtcaaaagcaagcacgttgtgagcttttaagcccttcagcgcttcatagttaaagaatgatttttgggtagcaagacttaatatttctcgggtccctgtcccgttttctccgtcccacttgctctccctcgctctgttctcccctaggtggcccaaactctagacttgggcgatgggaagacgcag

SEQ ID NO: 2499 - DNA, 703 bp, Nannochloropsis_gaditana
gggcggggagtgatgaggcgtcggcggcaagaaagctggttgcttcacctcgcacgcgttagcaaactatgcacgctgaacaccaccataaatctccaccatgcacttgcccctaacccgattactgtacagcgtgcgtccccatgaggataacaccgggaactttttcccgtcactggaaagcgctgccattcaaacagttggaatttcgacttaaattttcaatcagggggcaactccgcgccttcccccacccgctaccacagactgccacgcccgcccccaccagtgttgtgaaaacacccaccgcccccacgcccgtgtggaccgggaagatattggttccatgcgtgcccttgggcggggtttgggtgttgtgtggaaaccagggactacatagtgcggtgtttcctcgtcaagtgggggtgctggaagtcgaggcctgtgttctcgcttgcataccagatgttcctccctccttttgaggggtgaggggttgtggggctcgcagccgtcagctcttctgcgtttttctcatcactgcagcattcactgctttttaaccaggggtctggcttgaaggcggcgttccggtttcatccacctgcgttcttggccgtcgcatcgcttgttgttgtacctcaactacaagaaggcaagcaaggccttacggacttcaaagtccgtcatcttccacagcatg

SEQ ID NO: 2500 - DNA, 703 bp, Nannochloropsis_gaditana
gttgccaccgcctcagattgcgaaagagtactatcaaacaggtatggcgagggttcaggctgtcacaaagactatttattctccgcgaggccctgctgagatttgtcgcgtctttgttaacctgacgcttcaagtaacttgtgtccccccaccatttctttgataatctaggagatctctacatgttcgacgagttccacaccaacagccctgctgaacggcgccgaccaaaaatcgaaagcttgtacgatgtttttgtaaacattcgcaacgatgaacgcgaacactttatgacaatggccgtcatgcaggggcatagtggagacgctggcattgtgtcgcccaacacgctggaccccctgaacaaccccaggcgcggaaaggactgaaagtgacatacgcttatctatcatcgaggccgtctggggctacgaatgtatttgttttcaaatagagaagaatcacgctgtttttaaaagctacatcgtttcctggctagcctagcgtcttatatttcttgttcatttgtagcagagcttgcgtttcattgtgatttccgagtggcatgggccgaaggggagaggacaggaggttaagacctgtggcctcgcgatcacggttttcccccaaaaaaaattatcggaactcactgatagccatcactcacaacaaaccagctcatgaatgcattttggagagaatg

SEQ ID NO: 2501 - DNA, 703 bp, Nannochloropsis_gaditana
tgcacgtctatacagggcagcccctggaagcgggatcttactggtcgcctacgagggtattgccaagctgatgaggttggaggaaccaatgtaatgggaagctggtgggcttggcggcgaggtagtgttatgtagatcagtctgtttggtggtgagagtgggtgtatcatcaagatcgtattgccctcgtctgcagtgtacaattccgatggggagatgatagttgctgccatgataatttttgtcataaacgtagtgtgtggatgtaaaaaagcccgcgttgaggcaaagaaaagcagacattgcgaaaaagcaatagagccatcgagaaagatgctcgttgtggccgatttataggtcggttaattggatgtttttgggcgatcaccacgcgtcctcagtgaagtgatcggcctccctcttgatcctcgctcttcccatcgagccaaggaaccaagagcttctcagcgccgcctcggtcgaccacctgaccgatatttacaatcgtttgcatttcaatcaaggtcctgctttacattttttgcacttcaatagagtccgccaaattagcgtgtttctccaagtgcaaatcatcgcgaggagacaagtggaggcaccgacggcgaagcggtcgtaggagagggttcggcgggactgacaagggcacgcatgagctgaatgacgaacttcctctcgttttctg

SEQ ID NO: 2502 - DNA, 703 bp, Nannochloropsis_gaditana
gcgatcgacagcgtcggctgtcgaagcgtttaagagtacccctaggcgagtctaggcaatatgggccggaagaacgagagggtgaacccacttgcttctaatggcacacgttggcgccccagacagacctattgcctcagtgtgtctatgcttatgagaaaatgttcgatgcatgagccacaataagagtgacggacgggcagacgtggaaatgacgttaaggtggggagaggctcgatcttgggcaagtagccccagctttactaaccgacacagagagggcaaacgccgaccacacggggcacacggcacgcacaagtttcctcgacttgcggtcgaccatcccccgcgaagccgcatggtcacgtgcacgcgcgtccaacgacgatgggggatggactgaaatagcctgttggacttatgtccggcacttcccctgtttttgtcgagcagagtgtctccgggggtgaatccagacagggaatgataccttttgttctggcgcgtgagatgacaacgagaacagatagaacttgacgttgacattgccctttgccctcccaccttgccaaccactcacattttaaaacaccctgcactcgtatagaaaggtcgcttttggtccagcctatcagaagtcagtgttgcagcgttcggaccgtttttctgaaaagaagcaatgcgccctcccattatcaccatg

SEQ ID NO: 2503 - DNA, 703 bp, Nannochloropsis_gaditana
cttgaatcgaacccggaagttcccgtgtaatcatccatcttggatgtcaggaaatagggcaacactaaacctcctgagagctttgcaaaattgacgtccatccaatgtcacctgacattacttcagatttccaagatgccgtacacatcattatcacggaaattttgaaaataatacagacctagcacataatcaaatgccctagagatggtagatatggagagaggaggacgccgcctcccctgtgtacgatccctgcgtacccccctttctgaacgaaggggacattccatggcaaaactgaaattttcgaatatgtggcctgtcttccaatcgctgtagcatcaaagtcatgaaacaatggtcgagcccgggtgccgtggtctcatgcctccgcgacatgtgatgtgcacgtaactcgcagtcggacgcagtcggcgagtcctcgagcgtaaagaatgcctcacttatacaccggtagaccacgccttttaacttctgctgatattccttattgcaagggcgcaacattttactcggggcacgagatggaagtggcaacacatgaaatgtgtgcttgacacgcaacggagtagctggttgctgctgctgatcccacacgagactcctcacacgcgtacgtcattccttttaaggttttttttttttgcgacaggtcgattctgctttgacagggaaaatg

SEQ ID NO: 2504 - DNA, 703 bp, Nannochloropsis_gaditana
atccacttaaaccatgcattcctttcacaggaagcgacaggaattctgtgggtgaatgcggcggcaagcgttccacttgcagttattacttgtcgtcgttctgctcccttctcttttcttgcatcgagctgcagcgtttgttcctttcccctccccaaggccacaccgcgcataaacccaagcgcgggaccccgacgattttcttggagtgctaagctttcgaagacttccgatacaatcatgtcaacgatgtcatccacgacctgtcccgaagctgcccagcatcagccacatgtgatggtgactctccatccaaatggtgtccttgagttgcagctcaaccgtcccaaagccctaaatgcactttccttatccatgctgcacgagatgaaaatatacgtggaaggggctttggtcggcaaaagctgtggtggtgaaggcgccgtgaaggccttgatcttgaccgcttctgaggattcccgagcattctcagcaggcggagacataaaagaagtcctggcggggcggctttctcaggatgaggccatcaaaaaaggtgggcagaaaaacgttttttgggcgtgtccttgcatacatcagttccatgtttcttgtacattaacatttctcaactgcatatggatgtacgtcaagggttgatctttcccttaactcttgattgatcctgtcccatgtgaaacat

SEQ ID NO: 2505 - DNA, 703 bp, Nannochloropsis_gaditana
ttggggtcatttgcacgcccgaaacgaacgccgacgagcgagcgactgagccttcaacctaagttgaggtacgtgcgagaccttggatgcacgcgagattaatgtgttagctggtaaataagctcacacgtccaaatttactctctgtgactgatcgggacgttttgctgcctcttcatccttttttgtcgaaccagacaaacaacggaaaaagcccgcacagctggaaaaccgatgaagctgtcgggtcaagcatgcaatgccctgagactgggcgcggtagtcttctgcatgatatcattttgtgtccaaggctttatcaccccgcgacctttgcctctggttgctccattttcctcgcacagaggagcgaccaccttccatgattccgacgcttacatgccgagcccaagcccgttccgcgcccctcaaagcacgcagcacccaggacaagacgtggacgggacttacacaagtacactgcaagatcgattatttgaaacggactcgcgccgggttattttgtttgatggcggtacgtggtgcttcgcgagtgaggaggcctaccccttgggccccggggatgatgtctgtctgtcggatgagtgaaggcgctggaagacgagctcatgttccgggtatctatttgtgttatacgctgttccctgtgttaaaggaccttacttattccctcttctccatg

SEQ ID NO: 2506 - DNA, 703 bp, Nannochloropsis_gaditana
cacctgtcgtggccaagcggaggccgtctccactgactgccagtccccgaattggccccaggtgggcgtgataatgtttcacaaattccaacccttcaggcatttttttccaaaacttgacgtggccatcctcggaggccgtgatcaggaaatctgttcgtggggtgaacgcgcactgggtgactgtgtctcggtgcatgtagctcttttcgtacatgtctgcgttgggtaaagcagccaagaaagcctcttcatgctccagcttccgccgtttcttctttttcttcgaacgtgcagatgagacatcgtttgcagctgacgagtcattggaagcaggaaggggggccggtccgaaatcgtcgtcgctgtcgtcttcactctcatcttcaggctgggcggggggcggagggacgctctcctcttcgtccgcgtgatgggaccgccccttggtatgagacataatggtgtccgaactattgtagtggttgaagttatgacgcaaggagcgtaagtcgatagtacaccgatggtaaaatggactggcgacagagatacagggcaggaggagggcagcctgaggaggcgatacgctcctcgtctgtttgctcttctttagcaaaaatcaacgatcctctcagctataggcgctaaccccacgcacattgctacttagggttcgaattgacgtggaaggtggacaatg

SEQ ID NO: 2507 - DNA, 703 bp, Nannochloropsis_gaditana
aatactagcacatgattagcattcttgtcagacaaaccgcgaaatcgtccgtccaccaggataagacgcgagcaaacgcttcccggtgcacttgaacccccagggtgggtgggacagaagatcggatcggtgacgtatgcgtattctgctggcaaagtttcgcgccttgggaaggtgaggtgccctccccgggccctggcgcggcaaaatgggacgcgcggggcaccgaccaggcctgtgaaagttggcgtcggtcttccgtcatgcattgcattcgaatgatgacggtatatcgtggcgtggggggccacagggttgcttgataggaaaaacagctggtgaaagtcacgttcaaggttgccgccgccagcacgcccgctcgcttcgagttagcagttgtgatctttgcgcttccgaaataattctgttcgatctgggcatgtcccggcgtgaaatgtttgctgagccctggaatgtgcatgtgaagggtattatagctcggaaggatggttatacttgtcccttaacgtattttttatcttttatgccaagaccaagcagacatcacgcccagagcggtcacctgcggttggagtgaaacgcgctgtggtgctagcgcggaccgtccgtgctatacgaccgcattccgaccttaaattaccacacataggtagttaatcacatcctcaacatcttctctatg

SEQ ID NO: 2508 - DNA, 703 bp, Nannochloropsis_gaditana
aggcaggagctcctcacataagaccgggtccaaggtccgggaggagggcggaacaccctatcgtccacccgctccactaccctcatcctcacaagaagggccgaaaacagcttcaggaaatgacagccaggggtggggggggggggcaggagaggagataagtggcattgactagggcggtggctgaagtgtacaagacgtgcacacagggtggaataaaagacagaaacaacaagcacatactgtagagctctgctcaatctcaccacgcgacttcaccatgaacttgcgtgtcgcccttggccggggcgcttttctttctttcagagggtgtatgtgcctacccggaccagggaaaggatcggaacgggggacgtcggatcacaattttggtcgtggacaggggaagcgggtcgtttccccgccgtaggaatgtcgacacgacgccatcaaaccgtgtgtagacttgagctcgcacgttttatagaattgtgtaccccgagacttagcagtggggctcttgattctcatctttgcgtgttttgccacgtaaggcaacccgtcaccaacctgcgatctccctcgtcgccgatgacgggttagcgccgtctgttactttaccacgatcatacgcttgaatgcacttaccgagcgcctctcttcttctttgaactactcttgcagaaacggcacctgtgccatg

SEQ ID NO: 2509 - DNA, 703 bp, Nannochloropsis_gaditana
  misc_feature (426)..(624): n is a, c, g, or t
ttgatacactgcctctacctacacccttccccttgctttccctccccacatttctctgcacatttgatatacgatttcgctacatcctcctcctaatccatggcacacatgcttctatgtcaccggaacattcaactgctcgacatgactcttgtggaaacggctcctgatcatcacgggtggaagtcattgccacgcgagcgcccccatcggccattgttgttctcatcgactcctcctgctctaatgctctccgtttcgtacctcagaccccccgttcccctcctcctccaaggcataccgggcattgtagtagttgtcttcggccacctttttcttactgtacttggccacgaaaagctcctgattcttctgaatcctggagacaatctcacgcaccgacaggtcacagtctgaggatatctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggggggggggggggggggaatgaaggggcagggccccatggacccggcggcatgggtgacgattccatcgtacttcatg

SEQ ID NO: 2510 - DNA, 703 bp, Nannochloropsis_gaditana
ttgaggcacgtccgctctgagggacctgaggatagccacgacaccccccgattgaacacatatttgcgtacataccatcgttatcatgatgcagatctacaacaacgttcacgtccgagcaattttccacaaccattcccaatttccgcgtcccgatctcgacaaattggacttgatagcggtcggggctggtgctgtccgctgagccgtgtgttcctgccccgtgctccgcgccattccgggtcgaagagccgcaggtcaatgggtccgtggaatgcgcaggcgctaaaaaagtcactggagggtgagacgcttcatggtccgcggcttcatcgatcgtgctcgtcgtagtgttcgggcccggcagtggggagactgcgccgaccccagcccctcctgatgtctccatgcgcccgtcctccgctccggccacgggccggcaggaagggccctctgtacaaagggaagcatgaggaaatgtcaatcattcgcgtagttatgacgggagacagactggtcagatggcttttttctgctcgcctcggcagggcagtcgatgttcccgctcgacgggctcgccgaagtcaacatacgggctaggggacgtacacattttggacataacacttttaagccccctggttaatccacaggtctcatggcatcaagagaggatagtgctggcgtgaagacctgccccatg

SEQ ID NO: 2511 - DNA, 703 bp, Nannochloropsis_gaditana
ttccgaccctatcggactgcctccgtgatggttcaaagacatggagctggcgcactgtaccgcgggatggtccctgtgcttatatcgatggggctcagcaacgccgttttttttttcgtcagcaacctcttaaaggcaatactttctcgataccgacagcggacgggaaaatccttggggtatttcggccatcttgccaccggcacgatcgccggagtgttgaacgtcgtgctaacgactccactgtgggtcgcgggcatgcgcgcgaagctcagcagcgcgcaaggctggaatattctgacgatcatggccaaaatttggaaagatgaaggtgtcatggctttgtggagtggaatgattccgtccctgctcctcgtctgcaacccagtcctgcagcatttcgtctacgatgtgctaaaacgccgcaccctggccacgcgccgtgtgagaagctcccagctgtcatttcccccctcctcgatgcctattggcaggtccgaagtgacgggggcggcggtggcgcttacgtctttggaggccttttacttcggtgcggtggggaaattcgtcgccacgatcgtgtcttacccgttgcaggtggcacagagtcggttgcggcagcagtctcagaaaagtgagaccgacgggaataatgctaccacttcgaaagaggaaggaaaaacagactgggagagggagcttt

SEQ ID NO: 2512 - DNA, 703 bp, Nannochloropsis_gaditana
tcgcttcacagcacaaaaagggggccggtaactctgtccggccaaataaacacggccgcatcccacctgcctgtctccaggatttctatcacggcaacaaagcacacaatagtgtgtgttttctatgtgattgcgcgatgcgtactcacgttggcggaatttcttgataaagaaagtgctacaccatcatcgttttgcacactgcgcctccccagccattttcctgtgcgcattttaatcaactcaccaaaaacgtccacgttactacatcaaagtgtaataacgcaggtgcataaagacaggagcaacgtcacacaaagcgaaagcaggcgcgactgtgggaagaggaggaggaggaggaggaggaggaggaggaggaggcatctctctctctagtggtggagttgcgcgcgggctggtcgcccgtctccttgctcgcattgctgcgcggcgtaaaaatatttcttgggcagtctcagcgaccggtagctccgccttaccacgcccaactcgaatccaagctggtcgagtcaaccgatttctgcaacgcctcaccgtcgcggccctgaaagcgcacagacaggcgtggaccgcctcttcacggcaaagcacattgcaacaacattgggtttatcgccgccgccgttttcccttctttcgagcgggtcacccgtggaaacggcgtgtttttcctcgtgtaatg

SEQ ID NO: 2513 - DNA, 703 bp, Nannochloropsis_gaditana
aggtacgagctggacgaaggaaaggggaaaaatgtgccgtaagaaacagtttaaggcgtgcgtgcctcccaaagcaccatcctcaatagcgcatgctcctgtctcgctcgagacggtgacatgcacgtctccccaacgaggtcgcgaggtagaagccgacctaaaggatgacgtcatcgcgttgcacagactgtgtggacacggagctttaccttctcaaagcttgcagcttgacaatgtctaggatttggtccgcgcagaggcgcgtgtatgtgggtgttttctgtctttgacatttctgggactgattgtttctttcagtttacataagaagatattgtaccggcgatggggccgggcggctgtcttcaagggttctcaaccatcaagaagcctcaactctcccaacagcaacttaccgtaccatcctgaataactatctcgacacacagagcccatggagcgacaaagaaggagaagggggaataccggtaattcgctgggcacagctgcagtttttagtgctttactggtagcctcaacagcgatttccaacccatcaacaaggacccaagcacaagccgcacctcacgcacgcgatagctcctctctctgctcttccttgccccatttcctacacaccacgcggggtgggacatcctcgataggcatccgggaaagatgggaaggccaagatatcatg

SEQ ID NO: 2514 - DNA, 703 bp, Nannochloropsis_gaditana
gggcatcagagccgcagatctgaagtctacacccgcgctcgagcctgggtacaccatggatatgttgagtggtatatgacataggagtaagaacgccacatatgtcaaataaaatgcaaacgtcgcgacgtgccatgcgagtctgcatctgcgcacgtagtcatataataggtatgtgacggcctaattgttcccttttccatcacaaccacccaacacggcactctcccttttcaaatctttccaccgaaaataatctcgaaaggagaaccgcccttcgtagtacaggatagcgttatgatatgtcaaaattgaaatgtcctcatgtcgtcgacgtgattgtccacggttagggtaaatgggaacacgaggtatttcaaatcgccggcatcgcccatgcaccgttgccgctacctagaagggcttatgggcgagtcgacaatattaccttcctcaaggcatgcaactgactacaatcgtgtaattgatatccagatagtacactcaggtgctaggaatctttccaacaggaggcgaggctctgacgctctcgtaccagcgtcttggagcattccctaggcaaccttgatagcagtacgattcttcaggaaataagagcaaagacgtaacaagaccaattactttacccacactttctgcggagcacaccatgatatcgcctaacatatctccaaaagatttg

SEQ ID NO: 2515 - DNA, 703 bp, Nannochloropsis_gaditana
tgacaagggctttccctgaaatcgccaaaagtgttcaaaaagtgacaaaaacatggccccaaagaaaagagagagagaggtatcgagagtcgataggacaccctgtgtgattccggcggtgaaggagacctgcagagttacctcgaagggcatattttgcataactccttttccttgtggaaaccgccggtttatgtggctcattaccacagcaatgaagatgggtggcacgacagggagcgactcctgtccatagccttgatgacctcgtgggtttatcggcatccgcacgcgcgctccgtgactagaagaaattatgacgagagaggcaattggcacagttcttgccctgttgtctctttgatgggttcatattgggaatgcgcaacgctttcccggtgtcgttctctcactcatatagtgcctgatgttggcaagctctgagagccgatccccacgttgaaacacacgtagcgcgaaacacagaaccagttttgttccacggcgaccggttactcggttccggcatgttaagttggaaataagttcaggatgttcgcaaccaaattcttctcttgcgcagcatcagttttgtttccatgaagatggcgacaagtatactttcggggcaggtcgtgaatagaggcaccgtaccaggctgcctaccactccattaaggggcagcgtacctctttcaagcatg

SEQ ID NO: 2516 - DNA, 703 bp, Nannochloropsis_gaditana
gggggatgtgactccaatctaatacccgtgctggcagggcgcggccttggcgcccgcctcgatcacgccggacttgggtttcgcttttggagaagaagaatcgcactgcctgctctacggcgaggctgtgccgcgccttcccccactacggaggccggacgccttgggcccgtcgtcccatttgggtgccacacgctcacttctgccttgtgctgccctgcctgcgtgtatctactatgtgccagggtctgacccgttactcccccatactgtttggctccgcctccgtgaatgcctgcagtctccttccgcgtccctggggtcctcgccgcttgtctcactctccctcccctcccgcccctcctgctcagatcctcggcgtcaagggacgcggtgtcttcagctccgtcctcgtggcccacgacacgcaagccgtccccacctctcccctcgggccctcgcccaggacggtggccatcaaggtcttgcggggcaacgacttgatgttgcaggcaggcctgaaagaggcagcactcctccgcgccctgacagaaggggacaagagggacgaggggcacgtggttcgctttcacgaggagttcaggctggggggtcacgtgtgcgtggtgatggaggcgatgcacctgaacctgaggaagcttttgaagacctatgggccctcgcagggactggccatcaaggc

SEQ ID NO: 2517 - DNA, 703 bp, Nannochloropsis_gaditana
gatgattgtgtcatagggggggtaatgtgcgcgggatatatgacggcctggaaaggagagcacttttgtaatgataaataaaaccgagcaaagacaatcacacacatgtaatttcaaatttcttattatttttgtttccagatttcttgtcgtactgcttctcaatgtggcttgtggccgtaggctgttggtatttggtcatgggccaacctcccggcaaacttgctacttccaaacaaacgcccttgagcttattgttgcccaccacagcttccatgtctcattttctcacctatgacacgtaatctatgcgattattaccatatcaggttacaaggctggaatgtcctttcgcataagcaaggcgagagtgacctttagagcggtcagaaatgccagtaagggtagcggcagattataccggtgctttcgcacagtctctaccagcaccaagcgtggtccatcattgagcgacattacacacccccatccgcgggtaaatcggctactccgcgaatacttggccaaaatggagcaagagagtgcagatttacctaattccctgcagcaaccggggtaccaagtgaagcaaagcctgccgcgcaaagaccgcatattcgtcaataactcgataaatctgggcaaagtcgacgtattaggttttgattatgattatacgcttgtgagttacacccacaaaatg

SEQ ID NO: 2518 - DNA, 703 bp, Nannochloropsis_gaditana
gatgtactcttcccggtacactcacgggtctgatgaaggcagcgctgttgaatggacttatacaattgaaagctcctctcctcagtatagctgatgcacttcgcatgcctgtctttctcagcactgtggtggtgaggaagagaaggagacctgacgagaaaaagaggcgctttgcggggccgcggtcagggctagagaccatcagcaacgcacgcgcgataatcccatgcaacaggggaagaggcgcaggatagacgagtgtcaggaatggcctgtgaagagatgatttaatggggttatatcttaataaaaatactgaggggataaaaagcgctgggaactagttcagcgcgcatgttcaaccccgccacgtacggacaccaaatcccactccaggcaaagtactaactacaacttgcaagtatctagcgttgttgagaaaaggttgaaattgctccatgacatattgaagcatcatacgtgtctccacacggcttccactcgctacttgtgtccgtgagtgctagagtagtactcgctgtctcccacttgcctctccccccgctgtgttcgtcacgccgccacgactctcttagaccttggtgtctccatagccgagcatgttggagcatttcaacgacctgacgaattccttgcatatgatacatactttttactcacagctgtctgtggttcgagaatg

SEQ ID NO: 2519 - DNA, 703 bp, Nannochloropsis_gaditana
acgacgacaatgacgaggagggcaggtatgggacaaaaaagccatgcgttatggtacagatgaccagcaagcccagcaaaagagagatgggggcaacagtcccctgtagaaggaaggggcgatgcatttgtgcccggtacctgaacttggaaataccgcgggatagaggacttaagcttcaaatatggacagccaccaggcatagtggcttctacatttccaccacacatgaaatattgcggtaatgcatcaatgaagcacgggaggcggcgtgtgctgggtgcgtgtgcccgccggagcgacagtcgtctgtcgttgacttacttccatgatgagagcgcgagaatccggcaccgagggttgaggccttttccatcataaaggcaggttgcggtcgtttccatcacacccccacgtcatcagcagcgggcggagcggggccgtacccttttccatcaaaatcatcgaatcgcccagctcccttgtgccgtcgtgggagcagaaaacagcacgttttgcaggtctcaccctgggtacatttacttttcgcgcacgaaatttgtaagccttttaattctcaaatgatatgatcacaggacacaatttttgacaggctaatggtcgaggatctttggagatttcagggcaggcagatcatgcctcagccggcattcttcgtgcgaaggtagagtgttggaagatg

SEQ ID NO: 2520 - DNA, 703 bp, Nannochloropsis_gaditana
agcacagagctctgctaccactacattcaattcctcttgccactgcctttgtggcaactaaggcggcccgcattcggtcctgtgattgtggaggcaggaggtacgtggcgtaaccaactaggtttggtgatttaagttcgtggaacggatatggaagccatcgcagtattaagtctaatacaccgcgtgtggaatcagggcaaaaagcaacctttcaccgtgacttcttcaccacgggcctaccctctccttccaaggaacaagttctcgtatcccccagcccgcctgccctccctccctccctccttccctccctccctccctccctccctccacacactgtcgcagcgccacctcccgatgcatggctctcgttctccctgccgcacaatttcttttagcctctctcttttacgtgaggcatttttcacacgacaatatgtatcgatagtttgcagcacagtgaccgtgatgcattctgttccggtgtggcttgttggctatgaatggcagataacgcgcgaggctgccactgtgggattccgtcgccctacattccttctcgttaccgcttacgagcacatgctcagccaaatgcacattgtatctgacccgtcagcggcaactttctctgcttacgtctcttatatcatttgcgatacatacaggcgtaaatctatagtctgtgaacttcgcaacaatg

SEQ ID NO: 2521 - DNA, 703 bp, Nannochloropsis_gaditana
agatcgttgtcatgtttattatgtcattcattttgctttcgttcttccatttttagtgtgcatgtattgaggtcgaaatttcttacgtacgtctgcggaggcgcttttctccggagacgacaaacaccttttgaacgacgcaagtcctcaaacgccctcatcgaatggatctgacctgttggttgtatccctttgaggtcgaggcctgtcaatcctgcggatatagtactgcttctcgttcgcgtgtggccgaggtttgtgtaataacctttctccggcgacgattccgacgacggagagccagaaatgcttctagcaaccgatttggccgcatgggccttaaatgcgggtagtcttgcttccaagacatgccagagactgcggttattgcctccgcaatattcatggcaaataactgtggaaaaatctctgacttgttttgaatcgtgattgattgtctgatgggtacgcccaatgaggggcgtcggagcaagtcattcgtcggagtgtggttccgtgaagcgagactacagagaaggcaacccaaaaatcaccctatttgagataatttcttgttgttcatgacttaaatgtcttcagatgctcaaccaacccgcccttcctggacaacacaggtgtgcccattctatcgcttgtcgcgtgtgctcagaggtggtgtttcccactctgataaacaaaaatg

SEQ ID NO: 2522 - DNA, 703 bp, Nannochloropsis_gaditana
cacatgtatggggcccggcgatatcggaggcgggtcttcttaaggcttaccggcaggcaccctgcgggtggccacgggcgcaattgcactgcggtcgtttgggccgctgctggacaaaatcttgcggacagttcgcattttggtaggtgtgcgtcttcgacaagctgaaatggacggcaattgtgagaatttcttggtctgggtggcgcctccaaagtgagggtctatgacgccatatcagtcatcagatccggactcgccgccctaggaaagaataacagatgtgccgagcaagaaagccaagtgtgtgcagtgactgtgttcaagcgaagtcgttttgagcgtgttttgccgatgtccagttgtggatcgagcctacgcttcgatgcagacgacctagtgtgacagaaaagagtgaaggtttggattgaaaattgccacatgaacaagccgtcgtggaaagcactgtgcacgctggccaatcagctcgttcaccggtcaaacagcgtgctacaatgccaattttttctcaatcccacatgcacactttccattgtctttatgaatactgctttttttcaggaattggtgcacttaggctcaattcaagaattgacatcaagtatgaatctggaggaggaattctgaggcggcgacttccctgaagtttagcctggtggcaacgcgggccgaagttgggatg

SEQ ID NO: 2523 - DNA, 703 bp, Nannochloropsis_gaditana
ataaactgtcaatccgccccgagttcatggacatgcaaagcgagcaatgacaagtcagggtgatacgttggttcatttcaagataaagctcggttggtcgcaatgtgccttgaccaccactatctttcaccgtcacctcccccactgccactcacatcccaacatgcttcgtacccaatcgcgggtcatcacctccagcaaagaaaacaaagccagtactctcgttctcccacctcaagaagtctacctgcatccatacggaacaattacgtgcgtggacaaaccaagaaatgcgctcccccgtttctctccaccaaaaaagcaggggccagccaagatactacgggcgggccatatcatcctctccactacgcgtctaccgcttaccacagtgtcccattagacctattcttcccattcccttcggcagcatacgcttgcacacacaaaaaggccattaggaacgatattcatccacattcgttggttttgggtcatttgagccatcaaacagccctcgattagcgtgacgaacacaagcacactggcaggagcgaggctagcttcatctcatccattccattaaaccatccatcactcacattagggtgaatgcggggactgaacgagacaggtggacggaatcgctttcgatttcaaaagctcaaaacccgcataaagcaggggcaacgtcgcgtagatg

SEQ ID NO: 2524 - DNA, 703 bp, Nannochloropsis_gaditana
ggaccaagcaaaagatactgtacggcaggggtatgtgcaggtgatggcagcactggttcgaagtgcaggcacgctgaggactcggacgccgactcggggtgagaaacggacggaggccccatcctggatctcggcgcacgccttggtctttcacggggatctcgcatgcttggtacgggagacagacgcagaagccgactttttccagaatatcatccacatccaagtccaccgtcgagcacgggccttgcaacgcctgacaaaactgttgaaggaaagtgacgacgagactgtcaaattggaagaggcagggctggaaaatacactgatcttgacgccagctctgtcatcctcttctctggttcatgtcctcctccccctcgcctcgcaacccgtgctttccgtggaccgaacaatccaagtcaaagcgccggatcccaccctgctccatgaatccatattggcaacggccgctgtggctcgtcgtttgtcttggtcacactacaacgggttgtttcgacggtttttgcgagagatcagtttagtagacctgactcctgtaggccaaagcccagcgtcgcgggagagagccctggtcaacggcctgtgccacgtcttggacgttttccactttcctctgacccctccatcttcctcagcggaccaagatgagaaaggatcgaccgacgcggtgtcgacgatg

SEQ ID NO: 2525 - DNA, 703 bp, Nannochloropsis_gaditana
gtacctcatactcagacaaagggggaatagattatgttaaggaaaactgctcgctagatttaagcggataatcttattaactagatccatgccatatcttccatgccgggaggcttaccaaaatatgggaaaatttacaaatcgggcttaataatcgcgagcgaaaggaagctagaatggacagcaaagtgggaccgcccaccaggaatgatagtaaaatcagtagaaggtttcgaatgtagagaatgcgggcctcagtcaaagaaagatgacctagcatctcctgtctaccagctatcgcgttcaccattatccaatttcttcctgacaaaataggtaggaaattacaaaaatgagtttcataatgccattgaaatctgcatgaaaggtgttcctcgcgagcctttatcctccagtgtctagaatgatatttttcccatctcccatcgtaggacgttgaggccctgcgtgcgtcaaaacgagacaataaagcgcctgggggtcgtgcgaatgctggggtaggaggttagttttctgtcgctcttggcgacgggatctgtcgaggaaatacaacgcgctcccctggcccgcccgcgcccgctgccatcttagggtctgtggttgtcaaggagcatgccagggtgtatgtgatatggtggatatggttgcatcgtgcgccagttaatagattacacacatcaca

SEQ ID NO: 2526 - DNA, 703 bp, Nannochloropsis_gaditana
gagggctcagcaaggcccggggggggagtctggtggggaggagcgtgggcgcgacccgattcttggtccccgtcgtcttgatcgcggccctggcctacaagaacctgcacatggaggggggggagggggcgcgggcctggcggggggccggctcttcaactacgttccccaggacgagttctggtcggccaccttgggcttcctctcgtaccgagtgccgatgctggggcgggaggtgggggagatgctggcgcggaggagcgaggggcagcgggggcaggcgggtaccctgggggggtcggtgagggcgggcatggccctggtcgacaggctgcagggagggagggagggagggagggagggagggagggagggagagacggcggccgcggaggccggggggggcgcttacagaaaggaggtgacggtgctggtggtgagtgggccggacgggatgggaaagcgcggtctggcgcgcagactggttgaaagcgatccgttacaaagatacgccgagcccgtgtgggtgaccacgcgggcaccgaaggagggggaggtggacgggcgggactaccatttcgtggaggacttcgccttccaagtcatgcgggagcaagggcgcttcttgacggcctatcaggaggaagcgggggagggcagggcctggttcggacttcggccgagcgacgtggtggacgtgatg

SEQ ID NO: 2527 - DNA, 703 bp, Nannochloropsis_gaditana
ggagtcaaagggcgtgacaaatgtcgaggaggacagtctaggggtggacgacgtgctggagcaggccatcgtgtccggggagtggggtgggaaagggccacagcgccgtctggaggtcagcaggaggcgtgtccgaatgcggtattggagtgagagtgaggggcggagacgtgaccgtgagggcccgaaaccctggggcgggaaaaggcatcgtggggtggcgatataagtcatttacgcaatggtatcttcatgtctgtaatgtatgctcgagtgcatttggtttgagggaaaaattgtcgagccggcgtgctcggagagagggaggagcgtcccccccacttcaacaatacctggtaataagacacatttacaccgcacactgaaggcgtttggcggttcggctgtgaggatttaattttcgacgatggtaaacaaagttctttttggacagaaaggatatttggtctggccaccgttctttttttgaggatcaatctcaccaagtacgcgcattatttgtatcgttctgactcaaggagaagttcttattgtaatgtatgatttgaaatctccgcatgagcactcctcttgtaaggatttcgcattccatgaagctacttacatcaggatgcacgttttaaacccaacacatgcagcagcatcgtggagggctggcgtgccattggccccaatcacaatg

SEQ ID NO: 2528 - DNA, 703 bp, Nannochloropsis_gaditana
tgtgcaggatgatggagtattaagtcagtttcacgtgacaaatattttgtttttactccccaatttcggggctcggaagccctatctctgcttcactaccctttttcaacctgtcctgttctattcacgtcgtacatcccactacaagattgagttggaagaaggagtccaacgtctaagggaggttggcgagcctggcctcaagcggtcccggttgaagcttccggctggatcataaaggacgtaagaaattccaattactcgggcttatttccaggtttgggggtcccggcaaggaaaaaatgtgtcaatatcttctgaatttacgcataccactgcgatgaacgagtgtactcaggtagcgacatgtgtcgcatgatgcttccttgctcacaggcttgactccttgccgtgcctgggttattcacatggatgcactatgccgcctttttcaagagcatcaacacgactgcctcgcatttaacgtttcagtacttatgcacggtggacacatcacacacaatcttcagatttggatctcaatgagttctgtctctccggcgtggtagacaccgcgcttggcaggaatatcatggtcaaagaccagaaaggcccatcgttccttcgctttggtgggaaaaagtcagaaaacaatgctggtgctcgtcatcgtaccggactgtcattgtcttgctcccatgcc

SEQ ID NO: 2529 - DNA, 703 bp, Nannochloropsis_gaditana
caagtgccgatgcaaaataacacgtgcgtaaggctgcatacgacactttggttacctttcacaatctatgcggctttttctgcgtggaatgggttttgttataggacaaatacagtgtaaaagatgataatgatgccgtgggttaaaagagaggaggctagaaacaggataagcagagaggaagcttcccagacaaaacccatgacagcgaacacgccagataaatggttcctgcgcgcccactatcctttcctaaacattactggaaccctctccctgaattgcatcgatgcctgcacctgacgtacgtgccatgctggtgcacgttgtgaaagccgccaacaggcataggcgagcctcgctgtcttcgtctgggcgagctcaaatcgtgggccgccggaacttaagatgtgacttaaagcgaaagtgggtgggatacccgaccatatgtgtgatttcgctgttgagaatggctcgtcttgtctttgtcatggcgtgggtacactttggactcgtggaaatggaatgggcgggcgttctctctctctccactccttaatttgacagcgcctgatcgctcccgctttacctcaccttatttttattcctcgaaatcacaccccacagcgcagccgcaggttttcttttcatacatttctttgaagtgtggaacatgggcagcgggcgtgctgtgacagggaaa

SEQ ID NO: 2530 - DNA, 703 bp, Nannochloropsis_gaditana
gggcggatggggggggggaagaggccgctgggtgcccgagggtcgcgaacaactcgttttcaatgcgccaacgcatgcgccactccctgcctgcaggctcaaattcgcggacgaggcattcacgtaccagcatgcctcccgaggcaccctctccatggccaacgcgggcccggacacgaacgggtctcagtttttcttgaccttccgcgacaccccgcatttggacggaaagcatgtggtctttgggcggctgctggaggggatggaggtgttgcaggtggtggagatggtggcgacggacgggagggaccggccgcgcatgcccgtgacggtagtggactgtgggcagataggggagacggcggaagaggacgagggggacgagggggagagaggggaggaggcagaaggagcagagatgggggacaagcctgaggaaggaaggcagggcaaaggggccaagaaagtgcagggggaggaggacagcggcgaggacgaggagaaggaggaggagcggataagggaggacgaggaagcggaggaggaggaagaaggagagaaggaggcggacatgagcgggatgacggagacccaacgtcgtttgtacaagctcaagtggaagctaaaccagggccggaaactgaatcgtcaggccgtgaaagaggaattcacgcgcaagaacacgcccaacttggaagctcgt

SEQ ID NO: 2531 - DNA, 703 bp, Nannochloropsis_gaditana
ccatccctccaccggggtatcgacgttcattacaacagcatcgccttcgtacccaagggacaacgaacgcaagcgcgcaagcgaaccatgggcgtcggagtgaaggaagatgctcgacgagcacaagacaaagtgccggaaggctggacgcagagctggatgacgggagaggcccccaagtctatgatggaatgcgaccccatcgtcatttgttcctcccgcacatgggagatatgcccgtgtccgcgtgaaatctaccggtggcgacgtcacataaggggatgcgcagagctatgacagccctcagagaaattttgcgagagcagctgggggagagaagcgttgcctggccggggaggacccctataaagactcaaatcgtgcctctcttcctggctttcaggcgttcaggaacgaaagtaagaacaagcgctacccactaacacaccaacgggtgccaaacaaataagtatgggatgcgtaaatgccaaggtacgtggggttgtatcattacctttatgtttttggaatagcgtccatttttgcgggcagtcagggtcggaatctttggtgtgtccgacattgttcctgaatttactttgtagcagatccttcctttctatcctaatgcttcacaatagttttaaatatacacgtaccctgagtatattcattcctcctgcatacttgcgagttttcaatg

SEQ ID NO: 2532 - DNA, 703 bp, Nannochloropsis_gaditana
acgaagggacggtcaagcagactaccttcataaagctcaacaccgtgggcggtaagagccaatgctgcctgtcaaaaaatatgcccgtagagttcgctagtacataaggaaatgaccttttgacaggaaagtcgatcatacgtaccttactcctggcgtttcgtgaggtagtacgcagccgtagacgattactgacaatcaaatcctggatgcaaccagagccctgtaagcccgtgcctccgattatgagagccaggggtaatcgcgattctggttccaatgctttgtcttgtgttgtcggttttggcatgtctaatccaaagcaattgcaaaaaaggagttgtgacttgtttgaggtcttataataaagcaaaaaaaattaaatatcatagtaagccttgccatcgttatttgagtgacatatggacgcctttgttcgagacagcctttttcgaacccaccaaaacttcaactgacttgtcttcccgggagagggaggaggttagcgacgttggatggaagccattgacgtgccaagtttcctgaagtgaagtatgtcttagcttctctcaacatcctttgtcaactttgtacagaaatggagctggctttgataacattttccagataagcggcggccagtcacttggaaaagaaaatatcttgctgtttgataatggtggtcgagcccactggcattatg

SEQ ID NO: 2533 - DNA, 703 bp, Nannochloropsis_gaditana
atctatgtcggcgacggacgggatcaggacagggagagatggcccgggaagggtgagagagggaggatcagtgattctcgaagtggaaggtcgatggggttcaatgggagggaaatggcctactttttgtcgcgttccccgcagcttgtcgtgctccgcgattgtctcctcatcccatctaaccctgaaaagacaaggacgatagtattgcggaggacggtgggcgaggacgcggtgtgggtatttgacatccccatgtgctttcaaatgcgcaagaaccagaatcatgtacagaatccccgtgacccacgacggggcacttaccctcttcttgacgcatcatcttcttggcggcatccggaggcactcatgactgtccgacggagacaaatgaatatatctgtttctcgaagacggagcgtacgacagtagcatcttaataagtttgattttaacccattaatcagtattacacagcgcacaatacaaagcgctaaataaccgaagtaataaaacatcgcatgcaattcctcccgttcggtttccttttgcaagtcgtgcgaaatagcaagcaagtcatctcgatctcaggcgtgcttcaattgccggtctcttctcggcaattgcagccccgtcccagaaaatataacttaaattggacagggcaattttccggctgacactttctaaaatccttgagatg

SEQ ID NO: 2534 - DNA, 703 bp, Nannochloropsis_gaditana
cagttcatgaatattgtgctagatgagacggtggacgacggggcgccagataagaatgatatcgggcttgtggtgattcgagggaactcagtggtgcaattcgagtgtttggagaagctatagtgatggggtggaccggaatggcacgggagcggaacagagcgatggaggaggcttacatgcaaactagcgggatatataaggatgtccttgggcacgccgcaccggcaagcgtgaaggcagtaactcacggtgtacagaagatagacggaatggggagcaatacgaagaggagaaagaaggagagcgattaaaagaaggggatgcaccatacgtggttggaactggttgtccgccggaggttggcgtggagaatattggtgagaatattggtgcgtatacgcagcttgtacgagtgtgcatgataggccgatcatatggagcctggtgcatacatgatgatgcatggagtactgcatcgcaacggtcgcaaaagggacatctatgtgtgaggagcacattgcaaggaggacgggacggccttggcaggggatttttttcccccccatcagaatactgttgactccatcgagcccgggagggatagggtggcatagagacgcagtcgccgagctatatgagttttatggaatactcgcaagtatgaagctgaaactgcatctttggctgcagcatatgcatg

SEQ ID NO: 2535 - DNA, 703 bp, Nannochloropsis_gaditana
tcgggaagtaagaaggcactatgaaataacgtgtgacactgtgatcgcctttccgtgcgtcaaaagcacccgggttgggtctgcttgttacacggctagtgagggaggcggagaggaggctgctggacagacaaggagagtgtcaattttaccaccacttacgtcggctgcagcgccttgggtacgtcgatttgagtcatgatggtaggctcgacagatactcctgcgatgtaaatagaaaagagagagtgcacaagccagatgagatgatggagagtttcgctcgccttgatctgctctacccttggagtaggaagtgagtttctcagcacaacttcgaacacaaatttacacccaaacggccgacagccaccaagctacaaccagtcacgagcctttaaacccaggccactcggtcctacgacgcatcccacacgtctgaccttctgcctccgtccaccgcgcgccggtcacaggcgatgggggcgatgtgtggttctcgcggggtcgaccccggcccgggaggatgaggcctcgagcccccccttgaggtcaactacgtacccaccttggcccgaaccaagagttgaagggtaggttctggtcgcacgtggacatgcgtgaaggaggatgggttgtggacggttgtaatttatctcacccgtcccgttttcttcctttgctcccgtttgtccacccgcag

SEQ ID NO: 2536 - DNA, 703 bp, Nannochloropsis_gaditana
  misc_feature (434)..(601): n is a, c, g, or t
gtaagcatatacaacactgcgtcgcacttgggcacattttctctccatataaggataaggcgtctttccaggagaaagtggctgtaagacgtacatgaagacgagggtggagtgacctcatcttgcgggaatcgggatccttccgctttgattgacgttgatgtgacacttatggagctcttacaacatgataaaattgcttgataaatgtctgtcttggctctctatctttttatatccatgcaaagccgcgatctaacccgaattcatgctttatcagcgccaggagatcgagcaaatctactttctccaccccgggggcacggagacggcagccttccgtcgagatctaccgggaagaggaggcagaggatgaagaagactttgaagacgacttcttggctccaccgacgcgacgaagtactggcacgcgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacggtggggagctagatgggcgcgaatacatgaaggcgagaggcgcccgagggcggaaggcggcccgctacgggcgctcgaggtcgcgagggagagaaatg

SEQ ID NO: 2537 - DNA, 703 bp, Nannochloropsis_gaditana
tctctcaagagatagtgagacctgagctcgtgtggcgaagattgctgagtccagaatgctttgtggcttataatgaagcgctttgccaagcatactttagaggacaaaaccttggtggggaagtttgcgagatcatcaaatgtgtggatcgctttgggctggagttgccctgctttatgcgcgtccgcattttcgcctcctctcatggttcaataacggcctcagtcattttacttcttccgcttcagctatcgcgattactagaaaacatgtaaagaaatgtatatgtaattatatgtagtaagtgttacctgatggatagtcccgacgaagtccagatgaatgattcgcacgaaacctttttgtggcgcactctttttcttttgatagaagatcatctcgtcgaacgaggcgagttcgcacatcgcacgtagtgcatcttacaatggaactctcgtctctgtgcgctttgtaggacgaacaactgcctgacagagcgcggccaacctcagctctctaaccctaacagcagctctatctccccccagcgcctgcgcaatcctacccggaggagcgaccgaggcgctcagaggccgcacgagccgcacgtcggcacacggagcttagttatgctatggccatcttcaccgcctctatctgatctcttccggccatgcgcccattctcacaaaaaactagcatg

SEQ ID NO: 2538 - DNA, 703 bp, Nannochloropsis_gaditana
gcaccacttgctgcttcactcttactttatctttgacccagcccgccatctcagccatctcctgctcggcctctttgccgcctgcacgcacttcttccagaataatgttgcccatgtcaaacaggcctcgtaggccggggtagaagtccacgttcacatttcccaccgagagccgggtcgagcgggagaagagggtaggagatggaggcagagaggacgagggaggcaagaaagccacgcaagtccgaagaaaaatgaccatggctacgagctggtaaccgcatgtacgcgccatcatttttcttgtttcctgatttcttcacctgtgataaagcgcagaaaaagagagtaggcgatcatcctcagagagtgttccgttgcgcccggcgcggttagaaagcatcactatccgatccccagcaccctaaaaggaccgcgacgtcgaaagaaagacaccaagcacagtctttacgccgcacgtcccctcaaatcgccccccactcatgctgtccgcgtcgaaacctctgcacgcggcctgcgaaagccagacgggcgagctggcgacagtgttctttccctcctttggcgcaatcgacgctctcagtgcaagaccatggccgcgcactccacgagaatgtcttcgcagcacatgggacatttactcattacatttcattgtcattcatataccttcgtcttccag

SEQ ID NO: 2539 - DNA, 703 bp, Nannochloropsis_gaditana
agaggggtctttcggtgcagcctcgttttcagtggcggcttgagcgggcgcaacagttgcgggtatggccccgttgctgtcatttcatgtaaaaattatgccatcagatacgtacaccgtgcagaaactcgagcgaaaccgtgacttcgtctcgaggcgcctagcgcgtgtcgtagcacacaagcaaccgtggtgaagacaaagccccaactcacctgggagtaattgaaacgccttccatcgttctcgtagactcttgtttttcaatctttctttagcagcttgaaagcgatgctgggatagacgtggacgcacgttgtcgccctaataaagcctgagggacatgccatcgaaaggagaaggaaatgagcacccgagggacctcctccctctgttggctttctgcctacatcaaatgatacgtacgacggtattcctgccgtcatagagcattagtccgcgcaaacactccatccttatccccagcaggtcacgcgatggaaaggcatgcagtagcattcgaggaaagcgagcgtcccgtggggcccggcgaggcgacagcccccactaggacagactgcctccagtatcctcccgtctcgaggctgaagttgtcgatcctgtagtctggcagggaaaccaggacaagttttcatcccttccgcacgcccacttctcctcccgacacagggcagcacacatg

SEQ ID NO: 2540 - DNA, 703 bp, Nannochloropsis_gaditana
acacgtaccttcataggtgtgtccttctttcgacgagccatcctttaaaggcaaaatgacaataaaaagcaagtctaaatgtgtattgtgaaattgaggaagtcagcaaacaagatgtgtagcgaaggaaaggtgagaacatcgttgtcagctcagcctgcaatggaccaaggtaaagaccaaagcacgatcaccaacccatggcattttcactcccataggacgaaagcatccaggccacagccgtcccctcgacgcgaaattgtccatccagaggctcaaagacagggtatcctctcgccgtcacgcgaggcgttccaggacatcgagccgcccacccctccatcccaaccacaaatcaccaaccctgcgtgccacccactgccgctcccacagggtgtcgaccagtacgatggaacacgatctcccagggtgtccggtattgcctccgtcggcttcgaactgttgccgcgtgcggaattcgggtgaaggcaggggccgacatgtcattgccacgaggccgctcccaaaccccggaatgacatttcttcgagacaagccctttgccgccgtagtggcggacctctatcgtaatacatgttgtgcagcctgtcttcatgtctgtaccgagcagatcttcgtgtgcggagcttgcaaagtgaccttctattgttcgtctgcttgcgtcgcacgtgacagtatg

SEQ ID NO: 2541 - DNA, 703 bp, Nannochloropsis_gaditana
tccggccatgtctcgagctgcctcagaaacacggggagaatgtctcaggcattcagcgccgtcagtggcggcagcagcagcagcctctgcaagctcgcacatagctatcatttcgtctacgggtaggtcctcgtcaagcggaaacagtggagtggcatgagacgctcggggggtagaagacgatggaggaagagcggccatgccaggggtgcgacgaatcccgccgcgcttgaaaaggatcaggctgccatgatgtgggcagatgtatcttcctgcctgtcttcttggacaaggtgatgattgtgcggtgagtgtgggtggtaagtcgggatggtaaacttcttgtttgagttcgagggttttggcgaggagggagcgaggggggagggaggacgggtcgctgcctcagatggtgtgtgataccggggagagcctgtcagcgcagacacgggtttgcatatggtacgaatcgtctagaactatgattgtatggaagtggtgcctatagcaggagaaggattgctggttttggagcgacaattcctccccaccgtgaggatacttgccctcatgaagtttaggcttgaggatgacggcattatgcatcatggagctaacactttgcaggtcctaaaactattaccaagcacagggtcacaggtcgatttcgagacgtattgacgtcgagcattaattcgatatg

SEQ ID NO: 2542 - DNA, 703 bp, Nannochloropsis_gaditana
aagtcgcaggacgagccaacattccgacttcttctgtaggctgcatctcgactagaaaactacgtctcgatgcttcagaatcactcaagtggcaaaaataatagacagcttcaacttgaaattcctgtacttctggtggacaagaaatgtatcccgcactctgttcctttatgcggcctgcggcggtaaggtcgtccgtcatgcacgacgatttctgtgcgggattccgacatctccagcatcggaaacacgcgtcttgcccacgcatccgatctgtttcagctgcacatgccgagatggctccatgcgacgggggcgctttcataacagcctcggcacccgataagcagtttaaaaggctagctgaaagcactgatcgagaaaaggcgcgaaagctacccgggaacgaggagcgagaagccccggcggctgaagaagaaatcgtagcctccacagaaaaagggcgtatcctctccgcaagggtcagagcccagcctctcctcactcgccgtgcgtgatcgtgtccacatgtttccgccactactcgcgctcgcgggtttcgtgcctcattctaaccgcgctcatgcattcgtgtctcatgtcgcatcatcatccaatccgcaggaagaaggcggtcacccctccctctccccccgcttcacggatcaagtgcgctttcccacaacaggctcgcgcagtcatg

SEQ ID NO: 2543 - DNA, 703 bp, Nannochloropsis_gaditana
acgcactgcacgccacggcagaccacgcccctggctatcatgccaccggcatttgaaggccaagttgatatatatatccgcgagatcaacccgattctgatgcctgacggatgaatggagatttgtctacggcaccattttggtcactttccgtcagtccatgctggacaacaatccagacgtttgacaggagattgtcatgaacatgtttgcgagtcaaagcatgcaccagggccaacatgagaacctaacgtaccatacgaagtttccaatatgcgtgacagctcatccccttccctttcctggcaattttttgattagaatgtttccgcgcagtggcaggcctactggccggcctattggccaagaacacacaaggaatttcaatccttcaggcagaaataccgtagtcttcgttatattagtcattatgggtctgtccaacgtctatctgtatcttggccccacacattcccgtcggggaatatttaccactgattcatcggtcaacgacggcttctcggaggcgaacgaacacaagctatcggccagacatccacgatcacgtccgcagcttgtggatgatccaatcgtcaaggaggatacaccttctctggcttatccgtacgctgggcgtggaaatcctttctcttctcataaaactagggatcgtactaaacgaaagaacgtcctcttcatcatg

SEQ ID NO: 2544 - DNA, 703 bp, Nannochloropsis_gaditana; identical to SEQ ID NO: 1090

SEQ ID NO: 2545 - DNA, 703 bp, Nannochloropsis_gaditana
aaaagtcaacatcaaagtgcgaaaaaagtggcggagcagcgtctgcggttacagtgagtatatactttaggaaattagtgcgtgtaggcggtttatgtggaagctacgctttaacggtgtactttttgaacgaataaacagaaaatacgtaacgtgcagcggacatatgtatattctggtgactgtatagttgttggaggttctcatgctcgactttctgagcgattaatccccctccccggcccatgttttttgaaatcgtcataatcccacagcccgtccatccgatgccgcgtctagccctactcttgtataccttgatcagctacctacattggtagatcttcacgaggaatggtgaccggcatcggaaacgagggaatgatgcctagtgttggggcgattttgaagtggcgtcactctccttgtacgtcagagctcttcctggccccggatcgtcctacgactgcaccctttcttttcgtagcactaacaccgtgtctccatgtcgacgaacagtatacatcagtatttaagcttctacccagaagcacgaaggtagcctcgctggtttccgggcaacgtgccttttggcgcacaagcagcctgagggctgcgtttacctccttgctacgaagcaactagccttcaaacaccaatatcttccgcaataatttccgcaactctatcgaattctgctatg

SEQ ID NO: 2546 - DNA, 703 bp, Nannochloropsis_gaditana
ggggcgtggaggttgccgctggtaactgaggatgcggaggtgacgggggggggaaataagacaactttggagagcgtcagagagatcctggggaaagatttataacgaaaggtatacataacgagcataaatacttgtgaaccttagaaaggaaacaagagactggaaagattgcaccgatggacgccgtaaggcctctgggctacagggtcccacgcaggatacccggttattcccggcgacgcgcgaggtgggacggcgcctcacgcatgtgggtctgacttgtgcactcccgtctcgcatcccgccgcctgcgcctgtgtcgcggcttgttattcgtgtgctggcctgtcaagccttcaggtcggaagcgcaagaacctggcctttaaattaacaaaacttttttttggtgatgagaagatagtcttctcggctgaacctgtaccacatcacagaccttcgtctccttgcctacacaaaacaacttgcaaaggacaacgacagcattgtgaagcaccaagcggggtttgatagcccgcggtggaattcaagaaaccacgtcgcctcgtctttgttttcctcgttgcctccaggcgtgataaagcgcccgccctgccccggacgacggctacagaacgccggcagcagaggacacttattaacacttaaggggagtccatccttgtaaatctgcaccaatg

SEQ ID NO: 2547 - DNA, 703 bp, Nannochloropsis_gaditana
attgaaaatttcatgctgtctcttccatctcttcgccgtgaacggtcaaatagaaagacaggaaagcttaagacgggaaacgacaaggaggaggtgtgtggtgtgtgtggctgggtcctcaagtcaagcgcgatgctaccgagaacgcgcagaaaaaggcgcgaaggtccttttccatcatatcatccttctcccccttgggcggccctcgccgcccgcctcgccccgggtcctaatccatcatatataccagagcaacggcgtgacggcgcacggccgtgttctatcaggaacttttcgaggcggcgtttcgccttccttgggatttacgaccagtcgcggtgaattgtccagctttcatgtgcctactgaatcactctgttgattagactgtggcatttgggcgccagctgaacgcatgcccacgccaacggtaccaggaaaatcgtattcataggaatcgggtcagtcataagtccgagtggcttcgagattcagccttgattcctctcctcagggcatgcaaattgcttccttctataattttcgccagtgaagatctcacgcatgtattcttgaaaaatgtgtaaccatctttggtggcctgattgagctacatatcattactgaagttgatttctttttctcttcatgttccggtgtcttcaggaggagaacttggaaggcgcgtcagcaagaaatg

SEQ ID NO: 2548 - DNA, 703 bp, Nannochloropsis_gaditana
gacgtctttgctgctgccccccgagccgcttccatggtcgcttttcccgctcccaccatacccccccgcgctgacgagcttagcggggtagatgcacgatatatcgatgtgggcaactttaaagacatgcagattcaaagcccagagcgagatgaacaggatgccaacacatgtacctcggaccaccgcgtactcgcttttctgatccaatcgcttcagcacactttccacggtctcgcccccaccaacctccataatttattctgaaccgaaagtcttgcgaatggactgcagtgggcacaacgaaagtttactgaaagagcaagccttcgttgtgctgcttgattgcgcgaacggggcgctatatggacctggccctggctttcggctttgaccggtccttagcagcctgttcgtggaaaagaggagcagtagcaaatgtgagctaagtctgatcatgtttgaaaaccatcgcacggtgctttcatggaaagcctcttgcacaaaggccctctgggaatgggctgggctgtgggcgccatcctcctcgccctcgccttgaagaaattcatcgcttaataaatcgagagattaaaaatgcgacgccttacaacctgccagacagcgccatcgcgtcccacaaggtttgcttcattaatcttacatacggtcttcgatgtgacaggcacggtgagaagctatg

SEQ ID NO: 2549 - DNA, 703 bp, Nannochloropsis_gaditana
acgcagcacctaggtcccaatcgccttccatattctgttaaagtacatggcatgccacgtgcggctgggagggcagtcgtcgtgctgggcaatgtcttgttttgtgcgcacgggaaggtctcaaaatcgtttcgttccaaacattcgatcttttcccccctgcccccgtgcccgcccgcacaccctgcgcctgggcgggctgtttgtcacacacgaggggttcccaacgtgaattggtgggtgcgtacgggtatatggtggtgatgtgatgtatatttgggctagtgcgactagtctttgggtttgtggagtgtccatacgcgtagaagcgtctggatggcgtctttctcctcgacagccacgagccgggagggagcgaaagagggcagcaaggctccgagaggggtgcctggaagcctttttccgttccttgtaaacagacagaaaggtcaaagcacccgcaaacatcgctcgctgcattggtatcggtgtggtgccggtgggaatgattgttggccggttggccgggctttacgcaagtcaggagttcggaggaccagcacttttgttctatgttttcttgatatcatcctgcactaccctcactcgtccagacacagggcttgcacgtcaacggaaactgccactgtgctctgtgtttatacgtgtgagtttacacgcacgcatctaggtgaagcgaatg

SEQ ID NO: 2550 - DNA, 703 bp, Nannochloropsis_gaditana
tcccaaaggcctatccgttagcatcatcgtccagagttttccaggccagagagtctgtcttgcccgcccgtcgcacatttagccacgactgttctagggcgcagacaatgcacaagaccggttgaaatatatgcgtgggttcgacgcctgtggcatgttggtagtagcctgggtagccagtccgctaaaggtcctatgagccgcgaccttctgtgggctacttttcacactgccgttccgcatcatctgccatgtggcatttgtgtgacacgcaagtggtccgtgtcatgcgtgaatgcggtctatgtgggcgctgatctatttaaagtccccacagcgtactgcatgtgaccgtctatgcgccatgtatcttaggataactccgtgcttattaaaggatcttgcgagtgtatcgatcgcaccgtcacttgtctgaccacatacaactgttgatcgaaaaaattgctcctaaccgatgccctgacaagcccaatatcatgtgggaatcgcccaaagtcgaaaagcgaggcttaccacgctcgacagggaggagagagtccttgtcgcttcaattccagtttttgttcacaagctcaaacgtctgtgagggctcctgccaggcctcgaactccttgctttcggacgccaggctctctcaccttccccctatctcactcctttgtctagcaggcgcttccggatg

SEQ ID NO: 2551 - DNA, 703 bp, Nannochloropsis_gaditana
gattctcttattcgatgtgagttcccgaacacagggccactccggatttttccaaaaagcacctcgcgcatacatcggcggactccgcttcaacgttcgactctcttaacgcttttggacacaggagaggggtgtcgggaaaggaatttttttcgtgcacttttccttccctctattggctgaatcgtgcacctgcttgaggaaattggtcatttgtcgcacatacacaacaaagtgcggcaacagttgtagcgtgccgagcactgtaggtgcacttgcctgcaatccgtccggaatagcctccacgtcttcgagccactggaagcttgtctagatacgcacgggtgctccccctagacccagttttattgagtttatttggtctgattattatattaattcattaagataagctccgacatgctttatcattgtcgatattgtccatgattgctcagtacgtctgagtaggagaaccacatgtttaacgtatgcacgcctggctacccttacgcgcacacagggtacagtacgcaccaggcacgactgcaaaaccatacaacagcccctttcatctcagtagtgacaatgtgtctctagaaggagtatcaagttgtgaggtttgcccggcggcaagccttgtggctcgctccacgagagaaaattgaacacgtgaaaagaacggacccaatagtgagggatg

SEQ ID NO: 2552 - DNA, 703 bp, Nannochloropsis_gaditana
  misc_feature (1)..(359): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtgtggggccggggggggagggagggtgtgaagaggatggagggatggagcgagacagagaggaaggcggtgggacgggcgtgcagtcttctccaacctgtctttgacaccggcgttctcgtctccggccgcgcgcttgcttgacgcccgtcctagagtccccgacccgcggcccctgagccctcccgcgatgtcccctcgggccactccctcatcgccttattcccctcacgcccacagggactgatgcggcctcaggcgtcctttctctcctgtgtggccttcttgtaggcccctacgccctgctggtgacagctcttctctctctcctgtcaaggacgatg

SEQ ID NO: 2553 - DNA, 703 bp, Nannochloropsis_gaditana
ctgtcgactcgcgctattgcttccctgcttaccgctttgctgaatgcaatgttgaggacgggccagggcttgagagcaagtatcggtagaactctcgagtcacgctccaaaaacacgaggagacaaagataggcctgctccccctgctccttgactttgctctgtttgaaaggatttggacatgagtgagtggtagacagggtatagtcaagtcaatgagggtgctagcgtcccgacaacttgcacgccctcatcccctcccgcgcgtgctcttgacttctctctcgcccctcctatggagttggatttctgccgcagcatcctgcgcatgtcacacaaatgttgccagcacgcgtccattgtatttgccaggccgtccccggatgcgaagcgcaaaggaaaaagggagggtagccaatgtcagaccgggctgaagatgagcatggaggggaggggacgcggctcccagggccgtgaaagatggggtggtcattattttcgccatgggggacgcttaaagactcggagcaaggcgtgcatggatgtgactaattttgtatgttaacctttccatgaatgcactactttgccctcgttggtgctcagtacgccccgcatggctcgtctttcctacctcagccagtcctgtcctcattattcgtcatgcgagatccctttttcccttttcttttgtcctcttaga

SEQ ID NO: 2554 - DNA, 703 bp, Nannochloropsis_gaditana
gggagggagagacggcggccgcggaggccggggggggcgcttacagaaaggaggtgacggtgctggtggtgagtgggccggacgggatgggaaagcgcggtctggcgcgcagactggttgaaagcgatccgttacaaagatacgccgagcccgtgtgggtgaccacgcgggcaccgaaggagggggaggtggacgggcgggactaccatttcgtggaggacttcgccttccaagtcatgcgggagcaagggcgcttcttgacggcctatcaggaggaagcgggggagggcagggcctggttcggacttcggccgagcgacgtggtggacgtgatgagaaaggaagggaaggtgtcggtgctggcgctggacgccttcgctgcagacaagctgctggccttgggggaggcccgcctgatcggcgtctgggtgactctcaacaccgtggaccagctgcgggagcggtatggaggggaggagggagggaaggaggaggaggtggaggcggcggtgtcgagggcgactgtggccatagagcacgccctcatgggggaggcggggaggaggggcttctacgagcacaccatctacgacgacaagggcaaggaggagacgctccggtcgctgcgagactttgcggacttcgccctcagcctgtgagggctcttcctcccctcccttctcggcgactgctcccggtccca

SEQ ID NO: 2555 - DNA, 703 bp, Nannochloropsis_gaditana
atgcgggcctcagtcaaagaaagatgacctagcatctcctgtctaccagctatcgcgttcaccattatccaatttcttcctgacaaaataggtaggaaattacaaaaatgagtttcataatgccattgaaatctgcatgaaaggtgttcctcgcgagcctttatcctccagtgtctagaatgatatttttcccatctcccatcgtaggacgttgaggccctgcgtgcgtcaaaacgagacaataaagcgcctgggggtcgtgcgaatgctggggtaggaggttagttttctgtcgctcttggcgacgggatctgtcgaggaaatacaacgcgctcccctggcccgcccgcgcccgctgccatcttagggtctgtggttgtcaaggagcatgccagggtgtatgtgatatggtggatatggttgcatcgtgcgccagttaatagattacacacatcacagcaacatcgcgagaccgaggtccttcaaccctgccgacaacctcaacatcagcacgccgcctccctccgctgcagtgcctcgaccccctgtacttatttcctccgacgatcatgaagcatccaccctttctgtcattacgattggctatagttttccagtttctagtaaattttagatctgacgtggtagctttccaccttcccggtggaaacctctatcgcgtcggtgggaggacatacacatg

SEQ ID NO: 2556 - DNA, 703 bp, Nannochloropsis_gaditana
  misc_feature (1)..(251): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaggcacggcgccagcgtcgtcttctccaaggagggggggggaaatcaagttggtcgggcccggtgtaggcacagaaggaaaatgcgagggccatggggctctagggaggcagatgcctggtcgcgaacaaggaaaaaaaatgacccaaatgcagcaaaagcctgagtctccctagatgcccggaggctctgtgtcgctgcgcgcctctcggccgaagctatggatgattcccctgggcaggtggctgcctaggtcacgccgcgcgcaaggctatcacacaatttacatcccaaagtacgagcggtagcagccaactcatctccccttctcctcggagagaccagacgggaacctgaacagccggtggcgaggagattctccatgtaccttgcctccccctatatctataagatatatagatatacatatatataccttgtccattaatg

SEQ ID NO: 2557 - DNA, 703 bp, Nannochloropsis_gaditana
catcaaaatggactttctccctctctctgtgcgcctcgcctctactttgtcgcactcacatgccgaattgcccaggattttgctccatggttcccaatcgatagtccagcttgtcgacgctctgctctagattagccaattgttgcgtcgatggattggaagaagaggacgaaggggttgcgaacgaggcgcgtagatctatggcagaagtcttcacccggccatattcctccgtccactcctgcgccgtaaacgccatagaaacgaccaactgaaaagctttggccgggtggactgttaggtgcaggattgcaattgagcgttgtgcggaggtaaaaatctgggtcgtatattcctttgaccgtgctacttgcatcgacagcctcgcttctctgcttcgcttcattgtgtgaaggtctgtgcggaggcaacgattatcatccagctgtgtcacttgtcaatgacgcttcatgcgtactatatcaatgcctcattagccctcgccatgcgcgtcgacgaggtcgtgcggcgcaggcataaattgtgttcaaatctggactctgactgtcgtaagccctccgggaccctctcgacctccccccttcctcccctctgccctgttctaaacccgtactttcttgctcacaaagcctctcacttatttaatcgcgtggtgctaaatttacgtcaaggtttaacgatg

SEQ ID NO: 2558 - DNA, 703 bp, Nannochloropsis_gaditana
tgcccgacgtttccagaaccccggtgctcaagtactgccctttgctcaggcctgccagtccttacacttgtaggcccgcgtggtcagggatcccaaaaatccattaaaaggtcgaaagcacattttttccataagcatgtcttagtattgtacctctccgctcataaaacacgattgtttttctgcttcgcctcgaacttcctgggcgatttgagaaaagagaaaagaaagaacattttacgggggaaaagcttttccaccggtatcatcggatcagccggaacggcaattaccaagtgagattccaaaccacggaaggggttgaagaaagtcgcctcaaattacaccctcaactgtgtgcgcatgtgacgaatgtcatttttatgctgaggccgccaccagttttataatattttccccctatgaaatgaaagggaagatcgaacgtccatccgaccttctccaagcgcattgctacgactaggtgcgatgggcgggggacggccgaggacgtgcttgcttgcctacgggcgtactttttctatcttcacaaccatacaggaaatttagagccttacacatcacggacaaaaagatcggtgtgattaattgacgtccagaaccatataagggcactcgaatcttgtgaattttcaacctcctcccgttctgttcaatatcacaacataataggtacacaatg

SEQ ID NO: 2559 - DNA, 703 bp, Nannochloropsis_gaditana; identical to SEQ ID NO: 2557

SEQ ID NO: 2560 - DNA, 703 bp, Nannochloropsis_gaditana
ccccccccacccgcccggccgcccgtacccggacgaaggatcgatagtccgcgagagggcttccgccccggagcctgaggcctccctgctcgcctccgcgtccccccccaccgccccgcctggcccctcggagcccccctggcaggcggccgacctgaccgtccttgacaaggaacagttctttgaggagctcaagcgcctgtaccgcaagaaggtcctccccctcgagctcgcgtccaagtacgcccagttccactcagcccccctgaaccctgcggacttcgaggccaagcccatggtcttgttgctaggtacgggggccgcggggggaggcctgcgaggcgtgctccgaaggagtagaaagactttctcgtggttcattcgccccttaccggcccctcgtccctccccccaggccagtactcggtgggcaagacctccttcatccgctctctcctccagggcgacttcccaggccagcgggtgggcccggagcccacgacggaccggttcatggcggtcatgcacgggccggagccccgcttggtgccgggacacgccctggccatgcaggcggacaagccctttcggggcgtggcctccttcggaaacaatttcctgaccaagttcgaagctgcggaggtgccggcgccaattttgaggtagggggagggatggggaggacgaggggaaggcgggaggc

SEQ ID NO: 2561 - DNA, 703 bp, Nannochloropsis_gaditana
ggagcaggtgaggcgggcgtagaggaagacgaggatgcacgaggtaacgacgtgctagaagcaggagtggaaggagaggggtaggaacatgtcgaaggcatattttcgcgggagctgggagggcaaacgccgtgggtgtgtccgaacagagggcttctagggttggcgaaggcatccgtatgctgtccgtgtgccaacacaagacaggtcagaatcaaagcggcggggttcatagatggcctttaccggtggccagtgggactgtttgcacctgaaaatataacaaattagcaggatgagaccccgaatgagaaaggcgcggagggaaagggagcgtgaaggtttcctggtgtcgtggtgtactgtacatgtcgagcgagtcgctgtgataatgtagctgcttgagcgcgcgcgtgattcacttttggagttcacacccagcaaccgcgccccgtcaacttcagaccttcccaaaattttcaaaatagttccaccctcgctatttttctgcatgcatgaagctttggtgtgggacatggccatatcagaactcccttgtagcgcgaatcgccctgtacgaccaagaacgagagagtgcgaatgacaacttttcttgatgaatatcgtcctgggagtccctagcccttcgactcaagctttaccatgacgtccacaggtgtcaaagccgcgagattgtgtcatg

SEQ ID NO: 2562 - DNA, 703 bp, Nannochloropsis_gaditana
tgtatttgttccatttttttgttgagtacaactcggcgcggaggtgtttttggaggctgcaacgtgaattttttgtggacattgcggcggtgcaaaggcatggatcgcgagtcggcgggacttggtaaagtcaagcttgtgttttttatttcatcatgtcttagccctctagcatatctctctcttgtatctttttgtgctttcttaatgcccaattgttcgaaaactgtgctatgagcgtcttcctcggttagggcacctggtggaattactcgtcttggcagttttcgcgacacccacgtccacttcttgtcgagatccattttttattgaccttcgcatttagatgtattttaatgaatcaagaatgagtgggaccagaaaaaaatgcgggggaaaggagggagcggggaaagcaaaccgttaccgtctccaaaaacaaattcaaaatctgctagtccttcggtgcctggctcgtcactcccaaaatagtaccactaaatttgtggagcactgtgttgtttcgattttcgcgtccgtatttctcactcatcaaactcctttcttcttcttatttccagtcctcatcgatcgtgcagaagcgtcgaaaacagtttacacacttgcctcaggacccaacaagtaagaggcggggagctcgaggttcaccatcgtcgcacgacccggtgaccccaacagcatg

SEQ ID NO: 2563 - DNA, 703 bp, Nannochloropsis_gaditana
ccttgcacctcctgctgcacttcatcctcagcaggtgtgtgttcgccgttggtcaccatagtacgcgggtaacgaggcaaatagatactttgccctcgatgatcgcaactggccggagtcagtcttcgtcactcagctctcagactgcgttcgccgtgaaatagagcagcctggacccgtgcccccgtaccaagcaggggtgaaaacctgagagacaggtgcgggaggaggtgggcgatggtacttagcaccaggagaagggcagggatgcacacgaaggcgggaagaggcttggatggatatgagtcgctgattgctcgcttcgactctacctccccaccccctaggaaacctctattattaccaggccaacggcaagtgccgcgtggcgaaggcatagccggggcctacaacaagaaaattagtgccagtagaggtagaaggacgcgtgattgggtacaacactttgtcatcggttcacgggctgcggatacaccgaccttgaaagtgcggatgtttacgttaggacttgaccaagacgtgactgttggacttttttatagacctgtgattcgagaaatatacatagtacgcttgaaaattttgactttctcgttggatgttgggttgatttagcgtcgtaacctcctcaccctccgccttcacttcttctttcttgaacactcgaaggaggtgtaccatg

SEQ ID NO: 2564 - DNA, 703 bp, Nannochloropsis_gaditana
ttccagccttgttcgtccgtctctcttcccgcgccgccgcgtagtcctccacggtctcccggacccgcaggccatttgccctggcaaacatcatgagctgctctcgggacggcttcaggccggctgcgcggattggctcatcctccgccctcagcgcccgcgcgatgacactcacatctccactctcccgccccgcgacgaggcctatctgtctccgagaaatgaacaccaccatttccatgtttttttttcagtattttactgcacaacgggtttccttcgaatgtaaaagatgcatttcacccctccccgcctacctgaaatttccccttaaaccgcccggcccgccccgcgatttgtttgatttctgcgtcgctcaggcgccggtccactttgccgtcaaatttctcgagggctgagaagatgacgcggccgattgccaggttgagtcccatccctgtgggagtgcccgtgtaaaggaaacaggaggaaccgcaattcgcacggtgactccgtgagaacacagatacacacacgcctcccccccacgcttaatcgctatgaatttagagtcccggagcctgataagtccctaccaatggcgtcggtcgcaaccatcacgttccagccgctgccttcctcgttaaaaagacgagcctgctcccgccgtgcctcaggggggaggccgccgtagacgatgcaa

SEQ ID NO: 2565 - DNA, 703 bp, Nannochloropsis_gaditana
aggaaggcagatttcgcgttaaaaatcgtccacaaatggtcgatattcccacatgcagatcgagaaactttgctgtacgatcggggctccaagctcgctttgcaagtcaggacagacgggggggaaatgcctcctaactacgtggatgggaggagaaagaatatccgcccccaaaaagttgattccgagtacaaatatagcacatatactgcaccctcataatgacgcctttttccttcagccatttgtatatcaagccccctccccttttctttcctttcccgcctctgtgctccggctggggctattccttcccctactggtactaccccgacattgccttcctttccaggtcttttcacgccgcctcctcgcactcggagcgaggagtacagaatgtgcacatcatggtcgagatgggacatgcatgttacatatacaggactagtactggtgtcccctctgacaacggagcaactctcgccggagtgctctcgagcgattccatcaacggacggtggctgtgaaagctctctcttaatttgcttgcataccccgggtgccattatcaggcacctttgtcccaaaatcggtgattgagctcgtttgctcgtgtgagcttataactaatcattctcagtcattaccaggacaaaagcagctcaggtgtcgtcgccgtcgtacttttagccgtgccagcatg

SEQ ID NO: 2566 - DNA, 703 bp, Nannochloropsis_gaditana
cgtgtagctcatcgcccttctatgagtgcgaagaccacgcggcggtggaacgatggcccgcgtgcaccgccctctttcgatcctggaaccatgtcaacgccggccacggcgacgggctcgatgatcgggcgtcaacctcggtgcaggggcatctgctccccggtcgtcagcgtgctagcacatcaacatcaccccgtctaccagggccctggacagcacgtgtgacaataccctgaatggacattcatgctacattgatcctctgtggattggacgcagcctcctgcgcgaccgtatgtggttgcgtcaacccctagagagacgattacgtaagggccccgcctgcctctcgacgaatcagagcgcgtctggcgcctgactggacgcaagcacaaaccgccgcacccggcccccttcccaagatgccccttgcgaaggttggtgcctgatgctggcctgtcgagtgtttgcgtacgacctgattccttctcatgagcagacgttgttggcggactgggcttggctggcgctcagagggcttgtagtcagcattttgttcccccgtcgtcaggaagcagaaggcggagaaggtcaagctgctctttcaacaactagcttagaatgttctgactccgcggactcctaactttggctgtacttactatgcaacactcatcctctattatcttttgcatactaggtc

SEQ ID NO: 2567 - DNA, 703 bp, Nannochloropsis_gaditana
aagatgtcaagcacgcaaacggaatggccgagaaactgagtttcaaaaatataggactcgatcatcatttttgcgtgcgttttgcttcatcgcttcatcgcttccaggacaaggaacaggaactctacgaagaagagcaacccattgacggggaggttggcttcaagacgccgcggcctgaatgcctgagcatgccgtataccatctcatctcttctttttcaatttacactgtatgtcaagcagcagtctaactcttaaacaaggcaaagagtagtcttttctgatgacgagatgactccggcttcgttctctttacggcctacatcgccatcgacccacctgcggccgttgaactgcattatacctcccagcagactgccttaaaacgtaatttcacgctcataccggccctaggatgctcgtttgtttcattttggatgtaaatgccagcatggggcaacgaagcccccccagtgggcctcatgcaacaacgaacctgcgcggggcaggactaagctcgtttgagtgggccaaggccgcagtcgagtacttcatcaaagcacggcaaaaaaccaatatgaaagatcagtactttttggttacgaccgaagaagggcctggatgcgtaaagatctcatggggtgattctttacagcgtttcgacgacaacctgcgccttcttgctcctttgcctgcagacg

SEQ ID NO: 2568 - DNA, 703 bp, Nannochloropsis_gaditana
ggtccccttcctgtctacacgccgaccgccatatccgagtaccgcatggtgaagacgcgagactccttcttccctcccttcgttttgggcactctggaacgcctcgatcaggtgggaacgcgcggcttctcccctcctccatgtcctcccactctctttttcgtctccgtccttgtgggggccatgaccctcgtcccatttgctgctgtctgtgctgacccttgtttgccctgcctccgttcgtccacctccttcctccgcctccccccgcaggctcgcgtcgccgtcaccagtctcttcgcgcctcagccggccaatgccgcaggcacccccacctccccgggcacctccccctcctcctcggacgagccgcaagaggagttggaacgcatggtcttcgcacggcgggccgcggcgcgccggagagaagaggagaagaggaaggaagaggaggcggaagccctcgaggaggacgggggcgacaacgtctttgtatgggccgggaaagcagtgggcggatgggtggggggcctcttcgggggaggtagagggaaagaggaggcaggcaacgaagtggagaggatgcgcgctccctcattgctgatggaggagaaggaggttgcagagtccatcgcagcgggagagggggaggcagggaaggagggaggggcctggggggtcttctcgtttttcttcccccttc

SEQ ID NO: 2569 - DNA, 703 bp, Nannochloropsis_gaditana
gcaaacgagttgggaggcggagagggacgatccctgccaagacggtcgtgcgcgccgcctcgtacactgccaaatattcgatgctagactaatcgtttttcttgtgatatcggaaatgtactcaaacaagtagacgaccgaccttgacaaggaaagacacggtagttgatccattttttcgggtcatattttcgtccttgggcgccatcggcgggcggcgacaggggagtaggcgaacgttttgtgcaaaattcaacaccagcccaatccgtgcaaatgcgcaaaccaatcaatttaaaactgtcagtcatggacatacatcactaatttgagaatatagttgtacgagtagtgtcggagtggctgtctcggtatcgagtggtatgtcaggacgcggtcccaatggacttcagccaccccgtccccatgcccataccaccgccgacatgcggcattgtgtgctcgttcctgcaccactgtcgtctgttttctctcaaactctttctcaaatgcacgaaaataggtgaatcctcccgtgtaatcacaagcggccgggtcttgatttttaaaggcgctaaggcctgtctgacaggcaacagccttagctgcctgagctcggaggaggactcgcagagttctgcttgctcccgcttcattaatttgccaccgttgacaaaggtgtcgtgacatattgagtgtcatg

SEQ ID NO: 2570 - DNA, 703 bp, Nannochloropsis_gaditana
cgagaaactttcatcattatttcacagagaatcgaaaagtgattgaataaaaaatacttgttcggccaaggatctgaggatcctgctccctggttcagcatttctgcaacactgtgaaccaaactagaacgtaccctctgaattggtcttgcccactttgccgctggttccaatcacagacgtcgccacaatattgagaacgtaggcaccaagattagcccacggaaggaggcggctcccaagtggggaggtgtcgggctccgaggagaccatgtgggagtgcttgtgatgaagggggagtatcttgacttcctgaggatggagggtaaaagggcgaaacgccacgaaagagtcaaaggtacaccacggcagttcagataagcaagataacgttttccaatgcagtggcaggagtcgaaatttgtgttccaaaatgggtctccgtgcgaaagacacgctcgtctcgccccataagggggaacctcgcgaatttcaagccgtcaggcgagggcgtcgaccttggagcatgggacctcgaaacaaacaagccagccctcgcccgaacaagtcatgccagagattgggaagattacagcattcatacagaggtgagatggtctgtcccttacgttccctcgtacgcgactacaggaagacgcagggtctggtgacctctccgcatcgctctcacggccccgacatg

SEQ ID NO: 2571 - DNA, 703 bp, Nannochloropsis_gaditana
acttgatcactcaaatgtcttacgtacgtaccccgggaagaagggaggaagaaagctgaagcgctcacgaaagcgaccaggagtaataaacagacgttcaggatggtccttgaagtggatgaaggcattgtgacgctgttacctgtgcctaagaccttatgtaggggggaaaggaaacagcggggtccaagccgggtgagtcacgctctccgatgacggacaaaaaagtttctcaacaccgccggtacgagaagccgcaatcgacgccgtcaacatcctgtaccttgtcatcatgctgttgttttcgatcacattggacgggtcacatgaccggaaatgacagcaaagccaagggggggccacgacctaagggcaaattggcttatgcggcggagggagaggactttgcgtggaaaaagcggacggtaggatgcggcacacgacgcaaacagagacgcacagcccccggcgtccgcacgcgtggtggatgaagttgaggctgtctgtcgtgtttgtgatttgtgtccatggtgcatagcggcatttaggacgagtggggcggccctgcaatgatttttagggggtgacttcccaaacggggacacatgaatcccctaggactcttatactcattcgcgttcctctcgcgtcccgcgcacacgtcttcgaacagcgtacgcgacatctcttcacagcgagtatg

SEQ ID NO: 2572 - DNA, 703 bp, Nannochloropsis_gaditana
agcggcaaaagtagcaacctcctgaccccacgagcatgaggccttgacgttggcactttccgtagaaaataccttgctcacaactttagccgcggactccccgaatggttttcctgtggccatcccttgtcccatttgtaaggagttttctaggaattcccctgccttttcagctatttgcccggcccacgaagcggaaatacttgcaatgacgtagtggactagaaaaacggacaaacttacgtggcgcatgaaattgcgtccccggactatgaggagcgggaagaagcctgtagcagtagaaacgaaagtgtcaggagcatcatagctggagacatgaaatatttcataaacgcacgaccattttatgaaggtcgcatgacttgaagattgagcgacgataccacacactacggacgaaattgtccctttgttccgatgctggtgtgcaccagcttgggcaatgatatgagaacaaaacgttcacgtcacagcccggtctaaattccaggcaatcgcgtagcatttgcgtgttttcagagaagattatgtacttggatcgatcgtagcaatctgaaaatatattagcactcgatcgaaagtcgtgcgatagctcactccctatccaacaaaggcgctcacataatgttaaaatcacacaaccatatacaggcctacgtgcgagaaggtggtcaaggccatg

SEQ ID NO: 2573 - DNA, 703 bp, Nannochloropsis_gaditana
  misc_feature (223)..(232): n is a, c, g, or t
aaggaaggaggaagggaagggaatggcgggggggaggaggaggggggcggggaagaagaggaggagcgggagagcggggaagaggcggacgagggaggtgagaggaggaaagttgaactggaagatatagggtatgagaagcaaagaaagagtgcgtcaaacagtgagagcggtcaggaggacgctggtgcggtggaagctgtctctgcggcagggggggggnnnnnnnnnntcgtccgcgctcgcctcccgctcccctgcgccgccctctccctcggtcgacttctcttctggtccccctttgggcgattcagacacctccccttcctctacttccaactccccctcttccacttcctcctcctcgccctccttttcccccttgcccttttcccccttctctttcacctccgacttttcctggagctccacgagtacaattccggagtacgccgccaacgccgactccatcaagtcccgaaatttctccggcgtccacctcctgtccaggttgctcaccttcagccgcttgttctcttcgcaggagcggacctccagcgctctcccatgcacctcgcaacccgtcaactcctccgccgcttttctcgcttcttccggactccgataccgcacgaacgcataccccttcatttgctttgaccgacgatctttcatcagacgcacgcccaggacctctccacat

SEQ ID NO: 2574 - DNA, 703 bp, Nannochloropsis_gaditana
tttcgtcgaggcagtcgtccagtccaggacgggtgccgggctttatcgcaaggcagaggcattacagagaagtacccattgaggcacgagtagtttctttccataactcttctcatatctctacccagtgccatcagcccccataacgtaccgtaggatgatattggtccagggcgttcagaaacggcgccagctctcttggatccagcccgtgattccgttccccctgtccaggacccccaatcccgcttccagcaccgctgcgtacactttccaacacttgagtagggcctgtttgctccatatcattatcgttggacctgtcgcgcactccttccgctttcactcctccttcctctacctcctcatgcctcccgtcggcccgctgaccgctcatcaccgaagggagccagccgtgtccctgcttcaatgtataatacaggacattaatcatgcttcttggccaatgcacccaagctctaaggcacaaaagcttgtttctcatcaaaaggaaaacttcaatgatttcggctccaaaaacgagcgtgggcggggtggctgtgtctcgccgggagacgagtcgtcaaacgcgttcgcgatgacgacgctgcccgtgcccggctttcaaccgccgcttgcaagcaatgtatctcgtgctttcacctcattttgcgccgtaatgtatcccaaacattatcataaa

SEQ ID NO: 2575 - DNA, 703 bp, Nannochloropsis_gaditana
ccagtacgaccctcctccttcgcgagcaatttatgcagaacccgtcccgtctggcccagcttttggagcgctttcctccaccgcccctcccgaaaaaggtgtcggcccatggagcgcatggccgatgccccctgcatcgacggatggggtccggggcagggtggggggcaggcgggtggcagcatcagcactacagccagggccacggagacggcgggtgggatcgtgaggcggcctgggcgcgcttgccaggcgccgcgaaggagggggtggggaaaatcgagctggggacgctgcaaacagccatgcacgcagctaccgccagtcatagattctgtgcggactgcaagcataacgtggtgatggcactggacatcctgacggagcgcgtcggcgttggggaggtgaatgagggcgaagacgtggacatggagctctaccggcctttcatgggccgcgtcgtggatcgaagcgctgcctatggagacgtaccgcctgagaaagaagggagggggggataaggagcgggtcggtgaaggaaggaggaagggaagggaatggcgggggggaggaggaggggggcggggaagaagaggaggagcgggagagcggggaagaggcggacgagggaggtgagaggaggaaagttgaactggaagatatagggtatgagaagcaaagaaagagtgcgtcaaacagtgag

SEQ ID NO: 2576 - DNA, 703 bp, Nannochloropsis_gaditana
cgcacgaagccaggcaaaatatccttctatagtgaactgccatagagtaattatcgcgtcttcaaaagcctaggatattgcatatcaattctctcgtgaaagtattagttgcggacgctcgtccagcacatgttggatagcctatctagatcgaatctttttctcgataaaactaccggtgaaaatcgtcaatgcgctgaatgccggacattaccccgagccgactaggtgaccttttcgagatggaaatcacggagcttccgcggtagaaggaggcaaggatctagtttaggcgtacaggacttaaagcgcgcgggaaagaatcagtgttggggtagactttcagggtaaggtatttggggaagcaagcatccaaggccgacgatgtcgaagaggtctcctggaggctcggtcattccatgccagaaaaaaataaggcttacacgcgcttttaacctgtcaattgattacttatgtgtcttgctaaggcctgtttcatgctggatggagccgtttcggacggcgcacacagacattcaggctcgaagtggtctccgtctgaatcggtggtattccgtccgtgaattcggtgaatagtaggagcagggcgctatcgcgggactgattatgaccatttacttattcacctctcatgcgccgatattctatccacacattcacctagatagtgaaatatacaatg

SEQ ID NO: 2577 - DNA, 703 bp, Nannochloropsis_gaditana
gagcgaaaaagtcgatgttagggtggaattcagtagcccggatacataggattctcggagagggggggaggtctgcctgaatcctctttcaaagcgcttaaattcagtgcatgtgcgatgcatgtgcgattcatatcttcctccataaaggaccgctgaaaataagaatctcttatcgtcgaatacatcgggtattccgaaacacacagacgttacattgatcagggcaaccaccacgccgatagtactatttgatgctcacccaatgggggtgttgatcacatgattgctggaacaacatacctgcgctcaaattgtataccttgcatcccgaaaacgtggctacttgcatgcgtgacatgcttcagtcgtctgggggaaaggtgggatggcgagggtagtcccagcagaccacgatggaaggcgcgggatggccaaaaataagagtcccctgacgggctacctcctgttcggattctcgacgtctcgcgtgctttcgctcttttgcatcgagtgccgtgcgtctgttggaggacgggaatgtgagttgccttgggggcgcggccaggggcatgggaagatactccagcgagagaggagcgaagatggggggagggtgacagaccggccggtgacaatactgccgtgggcgctccacggaccaccaagtgggcttggttgggtcctcacttaaaatacatgt

SEQ ID NO: 2578 - DNA, 703 bp, Nannochloropsis_gaditana
cgtgggagggggtggtgaggagggaggccttgaggaggggcagatgtgcacggaggcccgtcaggatatgaattcggcagcagcttcaggagggatggatggaagcgatggggaggggatggctcctgcagaaagattcgagcgtggggtgcctgggtgggcccctgggggggatgcggcgcccggtcagtgcgttcaatacccgccgccgctgcctcaccatgaggcgacttcgtgtttcggccctccgcaaccctgaaggcggcgcgggcggctcaggaggacgaagatctgggcgaggcgggagtgcgggcgggagcaggcgagggagaggaggagggggtggtcttctaccgctcggccggcgagaacttcgacctgggcggcttcaccatcggtcgtggcggactggtcagctccccccgcaacagccttcggaggcgcccctctttgaaccagggggataacttcctggtcctggcgcgactcgggtccgggaacagtggcgcggtccacaaagccttgcacgtgccgagcatgcgcctggtcgccctgaaggctctgcctctgtacgatgccgggagacgggcgcaggtcatgcgggagctgaaaattctttactcgaatctggccagcatcgacgccaagagaatgacacgagtggagccgagcatcgaggacatggaagaagacggggaggagg

SEQ ID NO: 2579 - DNA, 703 bp, Nannochloropsis_gaditana
gcgtccatcatatctgctagagaaccacgctcccatagtagaacgcacccggtacccggtggtatgcctgcatcagctgccggcgttacccttacatcgggcggaaattctgttgtccctcgccgctatattttgtcggaacaagacgaggcccatgtaaataatagtaagttcgaggcggctgcagacttccaaggtcccgtcaagaagcgtacatgtacggatccctgctttctcattttattgctcggggcttgggcagtcatgtcatggatcggacgggaggccatgttgaatgggcatgttgaggtcttgacaaacggatacgattggaatggcactgtgtgccaaggttccactccctttttcatgcctctgaacatcaaaactatgggcgtttgccttgaggaatgtcccgaaatctatgatccggctgtcgtcttctgcatcggggaggtggcccccacggaggacaacatccagaaaggctactgtattcctcagtacccgaccaaagagatcatgaatcggtgctacattaccaacagcacggcattggaggccttcagcatggctaaatcatacagggacgatctggatgtatcagttttgacggagttctacggagacgtgataaatgctcggaccttcattttcggaatcggcttcggcgccgcactgatcttgggattcttgtggacat

SEQ ID NO: 2580 - DNA, 703 bp, Nannochloropsis_gaditana
cttcagcatggctaaatcatacagggacgatctggatgtatcagttttgacggagttctacggagacgtgataaatgctcggaccttcattttcggaatcggcttcggcgccgcactgatcttgggattcttgtggacatggcttttacgtacccctggtctcatttatgtggctgtttggacagtcaatatgcttgtgtgggcgtgcttgggcgccctaggcgcgttcatgtatctgtgggcgaatgactggaagaatgatgttccccggacgcattcggaccgcgaggtttgggtggcgaaaggcctcggcatctttttcttggtaatgtgcgccttgtggctttgcacgcttgtctttttgcgaaagcggatcaacttggcagtcggattagttagggaggcggcccgggcggtgatcgacatgcccctgattgtcctgtacccctttctccaagccgccggccttgtgctttttctcgtgccttggtctttttactccgtcaacattgcctccatgggccacttcgagcctcgccttttccaaggcaccggcgtcaatccatttgcggaggctggccccgaagtaatcgtccagcgctttcagtacggcgcaagcggctcggacttcgcctggtacatgctttttgttcttctctggaccgcccaattcataatcgcagtcgggcaaattaccctcgct

SEQ ID NO: 2581 - DNA, 703 bp, Nannochloropsis_gaditana
aacttggcagtcggattagttagggaggcggcccgggcggtgatcgacatgcccctgattgtcctgtacccctttctccaagccgccggccttgtgctttttctcgtgccttggtctttttactccgtcaacattgcctccatgggccacttcgagcctcgccttttccaaggcaccggcgtcaatccatttgcggaggctggccccgaagtaatcgtccagcgctttcagtacggcgcaagcggctcggacttcgcctggtacatgctttttgttcttctctggaccgcccaattcataatcgcagtcgggcaaattaccctcgctttggccgtatccacttggtatttcacgcgagacaagggtacgattggaagtggtactctatgtaaggctgtgggcatcacggggctctatcatctcgggacagccgcattcggttctttggtcatcgctgttgtcgaagcaatccgatcaattatcgcctacatacaaaagatactcaagcgttcagagaataaggtcgcacagtaccttctctgttgttgtcagtgtggcttttggtgtctggaaaagattttgaaatttgttaacaaaaacgcctacattcaaaccgctgtgaatgggacctctttctgcacctctgggaagatggcatttttcctcatcgcccgcaatatcatgcgaatcggagcggtatccc

SEQ ID NO: 2582 - DNA, 703 bp, Nannochloropsis_gaditana
cgcgtggaaacagttcgagccacctgcggtagcgctgctcttggttttcgtgggtcaccgggctactcgacttcggatgatgagcagctgtccatgcaaacaagggggcgggcggcaggaaatggagcagtccttcgtctgtgtcggtactttgatactcttgatcgctgtcactttcctcaacccattcccaaggggtccttggagcgtctgcagcgtgagctgcgtgcccgggcagcaaacgcgaggtgggatgggggggttcatcacattctcgctcttcctcaaccccacacagctgttgatactccgagtctgaccccctggacaccggcgaggtcgaagaacccatctgttgatgtgaatgtgtgtgcgtgagtgtcccttgatgcgtggcgcatgtgtttaaagggggatgagccctcgaccccagaggttctgatgcattgcgccccctcgcttgccagccctttccaccgtccactccttgcgccccgcttcccctcacagaccgctcttcgcgcgtgtggacgtctcttggcacctgaacgactatctcatccgtcaatgcctcctctttccgttcagcagtcttgtgaacagtcctagccgataagtgaagaattgacaccatttgcgtgtcgcggaggaagaggaggtcgaccgctacatttcattgctgcttttccagaccaagagcatg

SEQ ID NO: 2583 - DNA, 703 bp, Nannochloropsis_gaditana
gcggtgatccctcttatgaccgcagtctttaccagcaatttcaactgcgacgttgctaagggtgcagacatatccctgcggggccgcccaggttgccggcttcccaacagctacttgagctcctgcagagatgggaattagggttcggtaacgacagtcagcatcgtcgatgtgcaaggctaccgctgtgccggatacagagacgacaaaaacgatactcaccatagaaactgagagccatttaagtaggtttgcttcaagtttctagcaaatgaatagcggagatgcgcttcccaacctcctgtagtcaacctttttcttgttcgaacgaggaccaaaatgtttctgcagccaccgtaaaaggacgattttccctgtaaataatgcaagaggtaggatatggtaatccccccccgcgaaatagagcacgaaaatggtcagtaagacgagggaatccacggggatccaggagcaggggggtctgccttgccaggagcggacggtcctcgcttgagcactcgccaacccctcgatgtccttcttcctcattccaccaggcacttacccacacaaacatccttgccttcacattggaaacagcggtgaagctgcttgtcgccagcggcctggctcagatttgagagttctgtcgacctttgcagtcctcacctggcaattattttctgttaaatcataggggatg

SEQ ID NO: 2584 - DNA, 703 bp, Nannochloropsis_gaditana
caggatctaagagagtactttgctctaaatatttgtccagtactttttgtagccattcgagctcccccgtaagagaggcggggggctctggccctgctagaagcgtaagccgagctagcacttcatctcgctccacaaaataggtcgactcgcaagaagtctcttcctcatccctgtcgtggccattgttggagtcgtctgggcagctttccatcgatagctgtggttgtgggggagctaggggtgaagaaaaggaggaaaggttcgccaaaactggccgaggccttttttgatactgccgacgttggccgggctttttcgcagccctggcgcatcgttatacctaagtagaaggtgttgtttgttatcaacgggttataaactaagaaccatgtctttaaatagcaccatgccattgtgcaagttgccgctggatccactcaggatctacttgagcaacaagaacaggagaagcacgaggaaccctgcagtcggacccagcgtgcctccgcagtgacaaaaccaagcactagggatttcagccgaacagaagtgaatattctttacatgcagaacttttaactcctcattcgctcatgttcatggttcccaatcttgtctattgtgctcaaaaggctgtgaatctcagatgagccaaagcgaaaccggcgccgtccacctacataatcgttcaactacatta

SEQ ID NO: 2585 - DNA, 703 bp, Nannochloropsis_gaditana
gtgtgcgacaggctttacggctcttcctcctcgctcgggagagtcgcgaggcctaaccgcctgattgatacgcacttcaacggcgtttccactgcaagaaacaagtcgacaccactgtgtacacggcctctttccgcgcgtattaatgcgcgcgcgaccaaaaaaacaatgggaggaaaggagtggtagctccgaaagtgcaagacccgatgaccgcggttccggatcaaccgactgggggcgggaaggctctagtacaccttgagcggaatccaaacattgttcctactgcaagtgcccctcctgaccttttctcctgaatccctatttggtaaacgattgtcactacttgagcatctattgaggcatttttgttgcgtagtagtttcactggcgtttcaaaatatgaaaggaatgcgtctcgatcgcgcttattttgcctctgcctcagccacacaccctgcgcactgtatctttgccttgcagttgggtgcagcactgcaagcgaggcttcctactcgccttcccccccgttgcaagcacatgtttagtgaagctgtgtctacatgtatagagcatggtcctatgttacgaccgagtagtcgtgtatattcttgctcacgcttgttgccttactaaatcaataccgtattccctgtcgccctcccacctgtccctgtttgaacaggaagccgccaccatg

SEQ ID NO: 2586 - DNA, 703 bp, Nannochloropsis_gaditana
tgataggtgcaaccaggaatatgaaaaatacatatcagcactgtagtattttccttgcggatgactaccatgagacttagtgggtatcctttatcaactggaatacgcacccaatattttatctgtggacagttgtctttcatttctgtccttttttcatggtagcattgtccaatggaggacaagagaatgggaaaggagcagtagaagcaatgagatgatgcaacgttcccgggaaacggctgaatttctccttccgttgtaatcaatgccgccacacagcactactgactcccattacagcagtcttggaccaggagtcacgtgtttacagcttccaaaagactgcattatagagaggtaagttgaccatacgtcaccgcgaggggcaattgagaaaaattgcgcgaaacagaagaacggcccaagccttgggcggcccaaggggggagaaattgcgcaaaaccgtgagaaaaggaaacctcaggacaaaaacatagcgacgagcgcaacacgcaatatgtgaacaatttttggggggaaacgccggccgaatgtgttcatgaatacaatccatgagtataagtcagtagaaatctctgtggcaaaacaccccattctttgatgcatggacgaactggatctcatcaatccctgaaaactaatctcgaccccttttattcctggagtagccacaaggatg

SEQ ID NO: 2587 - DNA, 703 bp, Nannochloropsis_gaditana
cgatgagaccgatgatgcctctacccgcgtcaccgatgattgggctttggaagctgcggcgcaagaattggaagcgaggcttgcaaacctacgccgatacagcaactggcggctgaatactcgccaatacccgtcttcccctgccctagagacacaacatgctttgtgggctctccgacagacagcatcaggagggctcagccttgtactgcctcctgctattgccgaagaagaggagagcgagcatgagggcccgagtatggtccgcgggcagtcactgtcggccgccattgacgaaattaacggcttcatgtcacggagagccacaagcgcttggagacgctctcgcacccttgcttcggggggaaatttgccataccccacctcctcgtctcgtctttcgggtccccttttgcccctctcgcagaggcagcccgggggggcggagggtcgtgtcagtttggcgcctggcattggcagcagcaccggctcagggagaagccccgaagcccgaggagggcgcgatggcaagggaacgaaagttgtggaaggagagcgcgtgacggcctcagctactcaggaagaggaacagcgtttgccacgtgacagccccagtctgcttcgagcctcgctcttgagtaaggccccaccgctgtggtcagcatgggagcgtctggggtggacgataggcgactacttcatg

SEQ ID NO: 2588 - DNA, 703 bp, Nannochloropsis_gaditana
atacaaaaatggcacatttttgggggatcgagtggaggggttagaggggggctgacaaagcagaacaacgccggaggctggacgccaagaggcatctgcttttgccttcacagcaaatatttgacaccagggtatggcggcgagacgcggtgcaatgtgttatttcaggccagaggtcttctttctctcgctacaacagtagtcatagtcattgctggatggttcaatggtcatgggcataagatctgatggtcgaagggcgagatgtaacgagtactcctgtcgaagccaacgtggcagtccccatgaagcttcacttcaccctaattttgctgccgctcgagatagagacagctttttgcgactgtggaaaattatatgagatacacatgccatgttcgcgtgctgaaaaattggtacatgttaaaggtaccacatttggatcatgtgagaagggataacggatacgcagcacggcaggtggagatggcccctcctttgtgagacgcgaatcccttcccgtctcacaggggcattgcatatgcaagtcctgtgtgtatgccgtggcatagatccagtggcatgtaagagctctttaagatgccctttcgtgcggaccttctcatttttgggcaacaaaatgtttcatccctcatagatcttgctaccttcatcgaaaaagttaataaggaagcccaagatg

SEQ ID NO: 2589 - DNA, 703 bp, Nannochloropsis_gaditana
atccacgcgcgttcaaatgcaaaaggaaagaaaaatgaagcaaccaaagcatgggaaaggagtggcttattgaatggaacaggagacaaccgcaccgatggttgcgtttgatgggctttaaatcagttgtagattgggatatgttacgccgggctcggaatattttgaccatccccatttgaagtgggaaggcggacaataaatctccacaccggggtgaaaccaaacagcgacccggcatgaattcataactcgttttccaatcgttctacatgtatggcaattgttttcgtgagttgcatggtatgccagtgtatatagaggccaatgcagggcacagacatctcaagaatgctttcctcgccgcggaactcggtaaatgcatgtctccggtcctacggtccaaaaggccgaccactgtgactcgttctgaatctctgctttggggagacggcgtgcaggccatcaactaggctcggaaaatcgaggtttcacattcttacttggtaatttttgtgttgcgtgacgcaggtctttgtttggaaaagccctttaatttcctattggctcttttctctcccaagtcagcaacgactgccgtaccggtgggctgatctcgccgcaggtacagcatcgccatggacactcaaaaaaaatatcaagaccttggtacatcatccaagaataagtcctgtcagaaatg

SEQ ID NO: 2590 - DNA, 703 bp, Nannochloropsis_gaditana
gcatcagaagcggacatgacacctcagacgtccagatccaattcttttctcagcacggagtcataaagtacatcgcaatgctagtcagctttctttcatgcctcaaatactctttattcatgacggtcgctgtgtccgttccaggccatgggccgattgtgtcgcttctacttagtaagaacagcagcgagactcgccaatcacaatacctgattccgaattcagacccctgtgcttcagtagacatgaattcaggctttgttagctcgcgaaaggtagtcacagcttggccatgaatgacaaccgctctataacacccgacatgctgcctcgtcgacaagacttgattgaatgcgttccgttaacgccacaaagcaactccgcttcattttgtcacatatgtctcgtttgttactgggagcatcctcactttcggacatgctataggacaattcatttttcgcccttaaaaggagtgctggctatttaaacctcctctctccccttggcaccccatgcgaagagtcaagtagattgaattgatgtatccccttctcccacattttgctgcttcccatggtacaccatgataagatttcctgccatggctcagtgttccacgtgcgcgtggctacagtgcacgctggtgcgtgacctttgcgctcactttctgcccacgctccctcctccttgtagatcgatg

SEQ ID NO: 2591 - DNA, 703 bp, Nannochloropsis_gaditana
gctcttgaccactatcaagcataaaagaaggctgagggtctgcatttttagtgcctgaaccgaaacaaaccatgcatgatcgctttcaacaaaccatctgaactccgaaagcccactgaacgtcggtcggtatacgggcagtctcacggtctttaccaatatgatcagcacgtcatcatgtacacgacttgaaacagacaagatgtttcagtgggtttcttaggagcgcacagctggatgcttgtatcgtgtttccggagacaggaggacgcttcaattgaggtcttgaactgtatgaggccaagtaggacccaacattaacttgactattctcaagagtgggtcacactggtaacaactgacgcacggctccgtcttcgtcaccttcgttcccacaggtatgcgtcacgtttgccgattgctcctggtgctaagcataatacatctggcagcttgcaacagaaaagccggcatcttcaacaaattcgagtctcaacaatctgtccaggagccgactgacagcacagtaagaccagcgggaggacgacggaatgatcgaaacttggtcccaccgttagggagcgcgaacggggacttgtccgtgctcaaagagaccctcttcgaccccttggcggactgggagtggagcttggccgaacgagcctttgccggggacgtgtttgcggtccttcgcgaggggatg

SEQ ID NO: 2592 - DNA, 703 bp, Nannochloropsis_gaditana; identical to SEQ ID NO: 2590

SEQ ID NO: 2593 - DNA, 703 bp, Nannochloropsis_gaditana
ccaatccttgtttcgaaaggaggttcgacgtacaggctgaattgaaaaccaaagtcagcgcttcccgtatcgtcatgggggtgctcgaggaagcatcgaatggcctcgtagaagcttgtcatcggtttgcgggggatcatggcttctacctgtggttgtggacgaacccgccacctccacccagcaagaagcctctgcctccgtcaaccctgatgcagaggcctgtgcaagcggattttgacgcgaattagacgcagcgtgagtgttctgtaatagggcccaatttcctaggcaagggagaagccaaaacagcgagggggcatcggacgagcagatgaggggcaggaggttaaaatcctatatggaagtaattgggcgctggaaaggaacgtaaatgcagttctacacaagtctattcaatttccattctattattgaatctttaagtaccgtttgtttaaacctttataagcggagtgtgtgtgtcacgacacgtggaccttctctgagggacgcaaccttttcaccttcgtcagactgctttgggtttcctttctcatgattatgacaacaatacttgcatttgtgcgaccactcaagaacttattatgacattgacagtaggaaaagacagaaaggggacatgtggacttcttcgctgcaatcatttttattttactaccgccgcgaatgatcgggcatg

SEQ ID NO: 2594 - DNA, 703 bp, Nannochloropsis_gaditana
ggtagctccatttcacatctttgccaccaaaaaggatgttggcttatgaaagaaatgagttcttcttttcaaagccaaactccgtctgaaatggcaggggagagaattttgtcggcgtcgggtaggtggatgggaaaggaaaagcaccctacctggggtgagaacgaaattgaccgagatcgggaggaactgccgctgctgggaatgccaaccaacgaaacagatgacgccacactcgttgcattcatggctggactccagcgggaggcagatacgctcaatgacacgagggacccaacgttgtggaaaccagcggcccgctcctctccatcctcccaacgaccgcgtagctaccatttgcatgcactcgagtccttgctggagtcaggtcaaggggcagacgtggagctccacccggctgtgcctccgtctttttcccctgacgccgtctctacgagcgccctggctttcccgccccccttggccttgcatgcccgcattctccgtcacgcgtcgcggattttccggcctcacgcacggctccaggtcccttggtcggcccctgtcacccacgcgctggtaacatttatgtacacgggaaaactgacgctgtccactgcccttcttgccgacgtctatttggcggctagggaggcaggggcccggcccttgctgtacttgctgcgcacgtacccctactatg

SEQ ID NO: 2595 - DNA, 703 bp, Nannochloropsis_gaditana
ataaaagtgactatttctttgtgcctttaacctcaccaaatcgtccctcttacttcatgctagggtgcagcaggctgaaaagcagaaagtgctcaattccactgatgcatgattttgaaatgtttcacttcgagacccataaaaacgcccataaatgcgcacttagacattttggaacagaatatagtccattgtacctttcagctcaactaaatcaaaccttgaatgccaaatacatgacactctaagcgctggatacgaggcgttgaacctcccaacggtggacgggggcagcggatttgaaatttaaatcatcggcgttgtgcctggatatttttccaagcagccatgcataccacacacaatgtcgcaccacgtcttgaacttacagctgacatcaatttattttcaagacctttaaaagcgtcatctcatggatcttagaaggaaatttagccgttgttttcttccccttctcatcgcgtgctgaatcttccttcaagaatcaccgcaggctagtccaagtgcccgtctacacgtgtgcatcaccacttgccacaacacggacgcatcatacctttttgttagctcgtttactcaaaagcatcctactcaatcaagattcttcgccgtagaacattgtccgggcgccgctctgatcgcttttcgcacgttcaccatctcctctctggcctgcagcatg

SEQ ID NO: 2596 - DNA, 703 bp, Nannochloropsis_gaditana
agactctagaggagtctttctgacggcgtgtcgtggtttgggtggttttgagcctcccgtccctcattttggagagttccgatgcccgcgggttcacaaatcatcacgccccctccaactctcttttagtcaacttcctcttctcttaacccctcacaaatgaaatgagcgtcacccccatttgttgagcatggactgagtagtgttgctgtattcttggtccttcttcatattcatggagggggagtgtggagggtagaggttgatgttgatgatgacgaattgaaaatgtgggcattggcctttacatcatacaacacacgccttgcaacgtgctactcctcttctcctcctcccatactatccctaccataccacacatgtcttctccagtttccatgtgttgaagcgttcctgatttgttgcattttttgccaagtgggatgcgtcttgaggcagcatcatcagcataatcaccttcatcagcatccctcccctgacgacgcaggaattatagttgaaagagctgcttttttaatacttttgcaggacattgggtgcgttgtgggaagggtacagcgtaggaaacctacgttttgagattggacaaggcaaaaacgtactcacaggcgcccaatacccttgattcttctttatcccttccttaaaatcagaccagacggataacaagccaggcaatatg

SEQ ID NO: 2597 - DNA, 703 bp, Nannochloropsis_gaditana
aaagggccgcattccggacttcgtcaaaaaccaacgctgcatcaaaatcgcattttgcgagggaaaagggtcacaaaagagacctctccctattggaatgacttttatgcaagaaaagattggtctattgatcacaacgcgtacgatatgcaggtattcgaagctatcacggagacgcgagacatccctcttcaaagccccggaggcagggcatgcgatctcctcctccgaaagtggcgggaagaagtcttccggctccttcaagtccaacaaatcgataagttgtggattaaggatgctcatatgtctctggcatgcacgcagaaggaagcagcagcatggaaagcagccacggtcgcggctactgaacgagcaacatgcttggaggagagttttgttcttcctaagcaagagcgagacaccgctaaagctcaagcaaaagcatttgaattaatgtcaacgacttcgaataagacatcagctgccatgattgagaaattggaggccgaatgtaatgctttgagaagggaaagggatgctgcccggaggacttccgagacaattattgcggatgtcgagtcatggcacaagtgaatgaaacgagtgcttgagggggatggtagggacatgtgtggctggggcgaggagggttgggaggcgtattgtgaggaagaaaatggagaggagagttgggtaggaaatg

SEQ ID NO: 2598 - DNA, 703 bp, Nannochloropsis_gaditana
cttctattcgggtgctgagcgctgcatgcattagtcgacgagtgtggacagacgtctcgagcgctgagggtcgtaaatgcccctcggctctgcgggtgatcaagctctggcacaccattttttgaaagcatgagaaaccgaacaagcggctatttgcctataatgaaaatgcgtacgcgcatgtaatggtaaggagtcacggcaggctttgcgaaggcctgcaaccgacggaggatggggaggaggttgttccgccgcccgctcgaaatggccaagaaaggcggcactgcgcgtctgaccactgattgagccttgaaacaccctttccatgtaccgtacatttatccgtttagcatgtgtacatttctcgcatgcacatgtaaagatacatcgcaatttttgacgcaaagcgttgtttttgttatttttttgcgcgaaactggctattttaccttcccccagctgcttcgaccacttcagccctttcctccctcgcgcagatctaaacatgaaacaaaatgatcgattgatgatctttctaacttcgcggagacagcgaatcagaacacagcatataagctttgaaaaattccatggcgaaatggacgtcatcaacaaaatatttctctgcagttgacccggtctcaagtcaagaaaccccttttttttccccacaacacccacaggagtgcagctgaccatg

SEQ ID NO: 2599 - DNA, 703 bp, Nannochloropsis_gaditana
tgtattcgctccctgctccacttccatgcgccgcagtttgagacacagcctgatgatgctgtcctcccatcatgcgcgacgatgtcgaaggaatatgctcagtaattcttgaggtcgtcgaggtgttaggtgagccagtggttgcggtcgtttgatgatagtagacgtgcatgcttacggatgacaagaacgcttggagatcttaagccttcatgacttcagctctctccgtaaaaatgacaacacgccagcacgaccctaaatctgatgtattaatgacaaaaaatgcaaggaatgacgtagatggtgaggtggagagagcctgcttgcgcgtgggcagggtggggcggggacggaaagggtggatcaggcggggctcttcttcttctacacgtcactggcttggccgcactcccgcgcccggcccacgcccacgcccagctgccgccagacgtgtttttcacgcgccagcaccctgccttgtctgaacttgtcgccgcacactcacacgccacgctgtgatcgaatctacgcaggtcgcttcctaagcgcgggcacgggccaggccgtgagacttgagactctgatcctacccttgacttgctgctggcccgcgcttctatctccatggcccatcctcgaactcgccggcaaagaggctaagttcgaagcgatgatatatgtgctttcagtggtcacaatg

SEQ ID NO: 2600 - DNA, 703 bp, Nannochloropsis_gaditana
acacgcacgcctgcgactgctatgcccaggcacctagactgctgccttccagcgtggaagccagtaatgccgagatatttggaggctaccgatacaacgtaacatttcagactctttcgaacagtgtgacaacttgtgaggcctcgaaaaattagacgagttgggtttacgagcgaaggatttttcttgctggttgcgacaaccatttacttaggctagaacgtttggcaaaccctaccatcaactaccaccatctcctacgattgacacatggtcacacaatttaaatgccggctccattcacactcatggcaaataatatcaccactttgacagcacaaagtgaatcagtagttattgcaacccgtatcctgttattcgaagggtggtcaatcttctggccttggaagtttaagtcagccactcaagcgtacttcgcacacggtacctgggcagagaatggtcaaattccaaactaccgttcgtgtttgtcaagagccttgagcaatatttgtattcagtccattcaatcgtgatggaagcgtcacttatgtgtcgtggacagtcaagcagtacgtcgcctgccacggctgtccttgctcaagggatgagaagtagaattttcactgggccagcgtggaacataagtcggccagtttggataggttttctcttgctttgtgcgttagtggtcgcaaccatg

SEQ ID NO: 2601 - DNA, 703 bp, Nannochloropsis_gaditana
agagtaacgtgacatgtcggtaggaggacaataaaatggtctcaccatcgtgctgtattgctctcctctcagctttgccgcgtctccccactctctgccaatttgacctgcggcaagataagattgcgagtctctgcaatttgagagccaaccctgctggatgttttctctttcatttaccttgatcttcagctacttacatttttttgactacaattgcatcacgtacccagtgcgagtatgttttctctttcatttacctcaattttcagcgacttacatttttttcacactagaactgcatcacgttgaccattgcgaagcttgtcggtatacaggccctgttggcctccatgccatggcctcagacgaaaggttgagcaggcacaaaactcctgcgaaaccgtatttatgacacgtgtctaccacatgcatgacctgcaagttttaaaaaaagggttgtgaggtttcgggcgcgtctgcctcctgaagcacagtcttaaactgcatattcttgtttggcagcccgtcggagcccgggttgtagcagaggagcgagagcgcgacggaggaggggggcgagcttctctgcgtagggttactcatcactgacggccttttacaccacaaggtacctccagggaggccgtaggtctccacacttacaagggcagaggtttctctgtttgaggtcgcggccatg

SEQ ID NO: 2602 - DNA, 703 bp, Nannochloropsis_gaditana
  misc_feature (1)..(500): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcgggtggcagccaggtaaaactttcttgccttatgactatgttgacttgaagtcaccccatctgcatcggtatcgtcgctgtatccagtcggatctgacgggggtccattcttttttatccctctctcacttaccttatgtcatctccttctcgctctaagcggctggagggcctggttacgaatacgctactccaagatg

SEQ ID NO: 2603 - DNA, 703 bp, Nannochloropsis_gaditana
ggagatagggcgagaagaaggaggggggggggagggaaggggaggacgcacccaatctggttatccatcctgtcatcatcaaaatacaccatctgcgccacctcgtcaatggtcgcagagacaccgcccttggccacctgatccaggaccatgtgctcggcggccgcggggttggccgagcctgtgtgctcggcgacatcctggagggacagcgccacgaaggtgcgggcgagctgccgaagcttcctgacaggaatctggtcaagaacctgacgggcacggtttgggggaagagggagggatggagagattgtgagcggataggaccgtgtcgggcggcggggcagaggatggagaccgggattggagaggccgggaggggggggggggagggaggggagaaggaggtggtccggcccctacctgttgggctaggcccatgttttggtgcgccgtcagtgtgtccgcatgctggctcaggaggcctcggactctctctgcgtcctctgcctgggcggccgtgaggatgtcgtggtagggaagggcatgttgacggatgctgcgggcgacaatgggagaggtcttggggggaagcaatgcgcgcatttgagcggcagcgatggtgctgctggcgctggggcccgaggaagacggggaggaggagggggaaggagaggcggggaggggcttggcgggcgtgggg

SEQ ID NO: 2604 - DNA, 703 bp, Nannochloropsis_gaditana
  misc_feature (1)..(354): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaaaggatcggaacgggggacgtcggatcacaattttggtcgtggacaggggaagcgggtcgtttccccgccgtaggaatgtcgacacgacgccatcaaaccgtgtgtagacttgagctcgcacgttttatagaattgtgtaccccgagacttagcagtggggctcttgattctcatctttgcgtgttttgccacgtaaggcaacccgtcaccaacctgcgatctccctcgtcgccgatgacgggttagcgccgtctgttactttaccacgatcatacgcttgaatgcacttaccgagcgcctctcttcttctttgaactactcttgcagaaacggcacctgtgccatg

SEQ ID NO: 2605 - DNA, 703 bp, Nannochloropsis_gaditana
atcctattccgcccgcccaccatgcctcctgtcaaaacccacacacctgacaatcgtgccctcttcgtccagtcgtatgtttcgaatggctttccgtccccatggaagggcggccgaaaggctcgcacagatttcgtgtcgcggggacagctttctctggcttagatgagctacggtgtacagatggaacgcagaaagagtgagaagacgaaagagatcattccaaatgccaactccacgagcacagagcccaatcccacccttccatcaccaccactgtccctatgtcctcgcatgtccacaagtatgcccttttcgtaaagtggtcgccccgaccccgtcgatgatggatcccaaaaagacgtggaaagccaagatcttgagcgccttctctcctcccgggtcatggcgcctcatgcccgtctcacaatgcttttccctccccacccgtcctataccgagcctcacgacccccgccgtctccttggcttgtgcgtggtgtctgcatcgtaatcgatggtcgtggggacgagagggcgcttttcgcgagatatttggttgttctcggaaggtttgagaactcacggcaagcccgcatcgctcaatcctccgtgcagcagtctccgtcttcgtcacttttcctcattccttcccaaccataccaccgaacacagcctacccaaattcaacgtttgcacagatg

SEQ ID NO: 2606 - DNA, 703 bp, Nannochloropsis_gaditana
  misc_feature (572)..(581): n is a, c, g, or t
ccgggcatgggcatgcctgcggcctgtaggcggcaccaaggacctgttggccgtgacctcggacgcaggcatgctcgctttggtggaactggtcgcccgccctgcgaacacagcctcccatgcagtcgcttaccacctgcaacgcatcgcctccttgtcactgggtacatccgggtgtcctcggagcgtgcccgggcaatacgtcgccgccgacccgagtgggcgggccgtaatggtcagctccattgacgggcatcttacgtgcgccgtggtgctgcgaaacgcggccacgggggcaattgagcttcgacggagccgtgtgggcggggatctggggaaagtgagtgggcaagccacggtcttcgacgcggggggcgcgcacgtcggggcggggcctccccgcttcctcctcttggtcgggggggacgaggcggacggagcgcgggcccgagaacgcgcccgggccaaggaggaggatggattgagcttgcccgaggagagtgtgaagcacgtgctcgtcctggagttggacctggagaccaacacgttggccccggcggggcgactccctnnnnnnnnnnctccctcccacccacccgctccctttccttcctgtctgaccccctttcaaactccgttaggccgtggttttgccccaaatcggcttactcccgtctctttgccagcactctctcacacaatg

SEQ ID NO: 2607 - DNA, 703 bp, Nannochloropsis_gaditana
agtcaacttaacatggaccatggttatagcccccttcaagccaatcaaaatctcgaagaacgccgtacggaggctgtcgacgaagacggtgcttgaaatacatagcatttatgcaccggggtgccctgttgctttctatgcatgcttttggtgcacggaacacctgttgtcgtattgaaagatacctacacgtaccactcccctcactctgcaattttcggtctcaacgcacacattcgcacagacaagccgcccttgggcacacctgcaggttgaaagggcaaaaaaccaggctgaggacggaggagaccatgcggcggccacggcaaggagcgagcagggaggacctttctgtacggggggagcaacgccagtcctcgccctccttcttttcttcctcctccatctctgtccttaccttcctccttctaagcaccagtggaactttggcattgccaattggaatgcatcctggtcatgttgcctcctgcagacaaacctacgcctttcatttcgttaagcccatgacgggtatatctgaaggtaggtaccgtcgcgttgttccccctgcacatagacgctacctgcgattccttcgtgaattaaaccattccgcacgtagtagcaaccattccatgcatcgcatctcaacagcttatttcgctcttccacacctctggttccaccctttcctgcagccatg

SEQ ID NO: 2608 - DNA, 703 bp, Nannochloropsis_gaditana
tcgtgttcataattatcatccactttcgtgtgtcatgcaatgtgttagtgagcgtactgaggtcgcgcttttgcagacactttccacgctgtatttcgtccaatgttacgttcaagcgagtgacggcatcgacgaaggcttgttgattcgcgtccatacttaagtctatggtgagtgcagcattcgaagaggaagattgatagacggggtgatgatagagaattgaaaggaagcgttggggacgtacattatgagacggccaaagacggctcccaacgaacggatacagacacttagactggcgacacgatcaagcactcttagaaaaatcgatttgaccttgaaaaattgtcttcacattcggagatataaggtcagagcatagaagggggcagtgaagtggtgatgtgccgggaggggggaggttggggacgtagatcgaaagtcaagaaagcaaaacaatgcaaaagtggcaggacatggacgagctacacgggctgcgtgcatatttttaagatcgctttgaatgtgcacgaccgccgcgtgtcttgatgttgtcatcgtggacagtgagtgaggcggaggaggccaaggaccaggagggtgatgggagactgagggatgagaaagcgaggggctcggggcgagacttgttgtcatgaaagctggagatctcagtccatataccatatcttacgatatg

SEQ ID NO: 2609 - DNA, 703 bp, Nannochloropsis_gaditana
tcgatggaggtctcaagtctaagaagttggggtttgtcatggagcagctcacttgacacgaggactttcgactagagtgcacccacccacttgatctgcattgatccctgtgaaagccacgattttcaggcatccaagagaatttgataatttggaaggcatgactggtcagctccggcgcgtacgttgcatcagagttaaaaatcggttgtttgtcccttctaaattgtgaaagcaccatcgttgtgtgagagcgttagagacctcagctaatgcacaccaaataatggcatggggggccaaatatccagagaaaagtgtgcctttcgactccttgcgttgctgcactcggggcggagcatgagcttgggcccgtgtaattaagtactcgtggacggagaggctaagcgatgagaggtactcgccgagagtcaggtctatatctctgctagaggtgaaggaaagaggcacgaccaaaggggcaaactctgagcattgtcccttttaactctcgtttcatacggcttgcttcgcggtgcatcaacggcccgcagatttgtcctttacattttcagcatgcgggtagcttatgcctttgatgggaggaaggaagcagtggggaggttggcctgctcgacaatgttcagtactttcagcgtataccagctcaccagtacgcaaccacgacataaagcatgaaatg

SEQ ID NO: 2610 - DNA, 703 bp, Nannochloropsis_gaditana
tccactgccagaaatcgttatccaacttgcctatcaagcctacagtccttgtttcttggtcattgaaacgtatgatttctttaaaccccctaaaattcccgacacgatgcgtttgtgaacgtgatcctgatttacccaaaggcggttttgacccgtcgctgatcccggaagcgaccgcttatggcctcgttgatgcacgtataccctacgttccttggaatttcgatagccacatgaaggaaaaccttaaatgttaggagataagaaaggttgttcgtttatgtgttcttcactcggcttccctccttggatctgataacactgtggatgggtttcttccatcctgtgaaataccattcgtcctcactcctttccccaccctgcagcatgcaaaagctttttctccgccagctcctcgaggctactcttcgtcctccttcttcctcgtctacctgctcacactctccatccctcactgcctcttcctccacgtcatcgccttcgattgtttacgtttggagagggacggagataccagagcgagtgtgggtgcaggcacgtatcgggaacaatgcgccaaaccaccgtgcacacaccgtcatgcacattctctatacttacattgatgatgtgccttgcgtttcacattcttccacagggcacagtggtcgatgtgcaacctgaccggctacgcttagatgac

SEQ ID NO: 2611 - DNA, 703 bp, Nannochloropsis_gaditana
ttgtaaggaggtgcggcgcgaaatgcggacattgacgcgggacgatcgtcagacgtacctggagagccttgacatcttttaccgaatacctctagcagacggtcgggcgcgttacgggcctcgattcgcaaacaatgcgcttttgaccgctgcgcacagcagtgaaatatggtgcttgcatgatcccaaccagtttatggctgtccactctgcttttatgcactgggcggagcagaacatgaagcggatcagtgccgtggagagtggggaaaaaagcgaagccgacggaaagaggcaaccggttgtgctcaatgagaccgctccattacgttcggtcggagaaaaatcagcacatgtccctcaccttgccttgggcgctatcccctactgggatttccatattgacacccagacgcttggttccacctggtggtggggcaacccgttctttcaagccgacgacaacgaagggttcgggcccatagggaccagtcccaccactagtcatgtcgtggagggaagcggtcgctttgcccggatgccgatggtgcgagcggaagatctgccggaagacgtgatgcgggcgtacgatcccggtgtggatgcttatggatttgtcacgtccaaatcttttactttgaactccagcccttttgtcacccgcagtgagactgtgtgcggcttgcccatggccctgccaatg

SEQ ID NO: 2612 - DNA, 703 bp, Nannochloropsis_gaditana
tttttttttttttttcccatctctgtaggtgagatcatgtaggacagaggcaaaaggggggaaggggagtgtggagacaggtgaagattttgatccaataccattttaaaaaggcgtactctgatgagcggtaaaacaatagaaagcacatgtacataagtgtgaatattgtgcaaaattgtgtatttttctttgcgtctggagagggtcgagcggactgagtgcgctggcgtatgcgtatcgctcagctcgccattaattcatgtcgtaatttattttgccagctggagcaacaccttccatgcctcgtgtatgcagctatatctctgcgaaaagggatatggcagatatccctgtggctgagtacacaaacacgtcatttatgtttttaacactgctttacgaacccttcaagattccaaacttcatcaacgcaaccacctcccgctcctcacgctctaataattatttctacaaataattgaacgatcaatgatgctccaaaaggccccttgatcggtttgcgctgaaggaacagaaatgtgtcgtcatttgtaacaagaatgctcgacgtaagtgttcggacggatgcccggacaggaggacttgtattgtcaactccctcactacctcagctatattccacccttttccttcacggtcacagaaagctcaaccttccctaacggagaatcgccccgca

SEQ ID NO: 2613 - DNA, 703 bp, Nannochloropsis_gaditana
tattgaagaagggatcaatgcgggaaagcatgtcgttattttcacgagccgtcaggtgggttatgatctcatccttcttttttaaaatatcattattattaggcttagcgctaggttcctttctcattatacctttctttcaatttattaaaaatcagcttcgtcaagaagacggtgcaggtggtctcatctcagggatgaaggtgtctgactctgtcgtcgagattgttaaaaacttgcgcacaaggtgagagacgcggaggaaatgggagcagatggaatatgactgtagggtcatgcgcgtatggagacatgaaaacctaaggagaagcaaaaggaacttgcagtacaagggaaacaaggaagtccgtttgtctatctctcgatagcaatgctagcgcctaggatgcactaattccctatgtcctgctcctgcgctcagtgtatgtaagagagactttacaccatcatttgtcgttgatcaggaactcgctatggcgggcaagggcgtcagagggatgtcatgcctatcgataataaatgccaagtgttacattattcctagacccccattgtcattctgtacgtcttctcacattgtctgatgatctgtctgtgcatcagacccctttttctcattgccaaaggagggattacatcaaatgacgtggcggtcaagggcctgggtctcaagagggccatg

SEQ ID NO: 2614 - DNA, 703 bp, Nannochloropsis_gaditana; identical to SEQ ID NO: 1826

SEQ ID NO: 2615 - DNA, 703 bp, Nannochloropsis_gaditana
gcaaattcgcacccagaaataaagtcccacgaatacaataggaaccactaaccaatagaaatagctactgcactgacgcacggtgaaataagtggataatacgtaaaacaccattgatggcaaatatcagctgtggtgcgtgctttcttcctgtgtggacgcgtttaaggtgataaataaagtgtcaaggcgcaatgtcgatattcaaaggcgccataaatcgtagataaagtacacgcatcgtctgacaggtcccacaacaagaaggactggaacacggtatagctcaaaattttcacggggatcgtgtggaaattggcagttgacggctcgaagatcgaagatcgacgcttgctggcacggtcagggtgcttgaggaggctcttgaagcgggtctgatcggataagacagaaaataattcatgtaaacaccagaccgcgtgcttggaggcacaggtatccctatctgaactatactcagcaaaatgattgcatcaggaggttagggactgcataagcccttcatcctttcaatgtctactctgcgaagtctcatcacttgctgatcttttacctcctctcatcataaagctgtacttttgccggacatttaagagttacaaatcgcctgacgcacgtgtccctacactatcacaatttctcatatttcaataaaaaggaaacagtttttgttttcaaaatg

SEQ ID NO: 2616 - DNA, 703 bp, Nannochloropsis_gaditana
gacgtgtcattgctttaaaaagagagctaccacatgagctgcttttcatgtgcgaacggatttaattgagtacttcatccagctttcaaaatattgcctttgaggcactgactcaaatccttccacattagaaggcaggaacgatgtctagtttcctggtccagattctcatataatctcgagcatgaaattaaagcgctcggcccgtgttggttggatgccgtcgtttaccgagattcgcgtgatttttgtaccacacaccctcgtgccatgaggcaaaagagtccaacttcatcgagggtgcgtgacggagggcagaacaggaaagcgaaggccaggtcagggcttggttccgcaggcttccaagaaagtaagagaatgcacggtgcctagtctcgcgggcctcgccaagaaaggaaagggatacccggcgattgcttcccattcggagacttcgctgctgccgcctttccttccgaaaccccaggcctgcccggtcgcgtctttaacacgcagttcttgggtgagcacagtcaccctcatttcttatgcactttaagttgtgcatcgggcgccgtttcgaaatcagaaagagtgtttcttccatgctgtctgagaggcctcgcatctggtttgaatccctgtggtaatttcgtacggcacacacgcacattcaacgcaggatttctgataatccagcatg

SEQ ID NO: 2617 - DNA, 703 bp, Nannochloropsis_gaditana
agatgcgcgcctcgttcaataacgtaaagacgaagggcatgccaaagaatccacagcgtcaaaattcgagcaaagcacttttcaggtggacagcttttctgacgtctacgttatgccttggaaccagcaccccctggcttgtcgacctgtggtgctgtggagcttcgaaaggtatccagagcggtattcggtaggtacatgagtgactggtgacactttgcagtgactcgcctcctatctggtggtttgcatcgtgccatacgccgactgagtgcaacgaaaccatactctgggagcctccttgacgtcggcccccccgcgctcccaaaaggaagtcttttccgcgaagccttcattcattgcttcaccacgtatgtgcacaagtttccccttgcgcgttagcatatagtagacacggccggtttgagccaggatggagcattagtgccacgccatctttattgaagcgcttttcatcggccccctcctcccgcccctcgcgcctcggagtcgccgaagccaggagggggggcagcaccaaaacaatgcgtgcgctcgaagcacgccacactcacaaggtggaaatcttaattttcatgtttctcattatgcatgcatgacgcaggcacatttatagcggagcgccttttggtcgccaaattccttgttcggatcatattcctccagcgcgcggaacaccatg

SEQ ID NO: 2618 - DNA, 703 bp, Nannochloropsis_gaditana
ggacaacaaagcttgagttttttttaattaaaattcatgattttatgaagacattttccatgattacatttttttaattttacgtgtcgcatggaagatgagaaatagttcatttcctgtctgggaggcttgaaaaagacgagcgtgagtcttctcttttcctcggaggcgagggctttcgctacctctcttgcacccgacaggaatttttttcctagaagcctaaaatctcaaccatcgagttatattgtgctgcattattttccaacgttacgtaagtagttgtccagatatttcgttggtatatctcgtggctcacgggagctagacaaggataagaccatgcatgcaaatgggggcgaaagggcgtactcccgcggagattgcgtggcactgcaccaccatgcggacatgcaggacatataaatggtaatgttggtgtttgcatgcacctcatgcgattgcgtggcactgcgtcagcatgcggacgtgcaggacatataaatggtgcagtaggccggtaccgcttacgtcgtcattcccacctgggcctcgcaacagactgttgacgtcatactttagccctggctttagcacggcatgcaagtaatgaattttcttgccgtacacgaatggcgccgacggaatgtgttgatggctgggcgatcgattaaagttcttatttaccaggacaggggccatg

SEQ ID NO: 2619 - DNA, 703 bp, Nannochloropsis_gaditana
aaggcacacgccctggaagccccgacacctctgtttgagacactgcttcaaatcacttgagcaggactcacaatgagagtacatcgtattgggtttgcttcgtatgagcgttgtgcctggtgaagttgcagagaggcctcggaagaaggtgctctaacactgtcgcgaaaggacgactccgtgagatcacggtgttgcttcgcgcccaccttgttaacaatgttttctcctgaaaatatgttaactagttacaaattaaattgctgtcctatcagtggcgataggtgttctcggacacggtcgccctggttgacctcagctgtcgcatcgagagtctcctctcctcggaagagaagagggacgctggaggcgggagcattcgacgatagcaatctggttgattctgccagtagtcatacgcttgtctcaaagattaagccatgcacgtctgagaataaagagttttctctgaatctgcgaatggctcattatatcagttatagtttatttgatagtcctttactacatggataaccgtagtaattctagagctaatacatgcatcaaatcccaactgcttgtcggaagggatgtatttattagatagaaaccaatgcggggcaacccggtattgtggtgaatcatgataactttgcggatcgccggcctagccagcgacgaatcattcaagtttctgccctat

SEQ ID NO: 2620 - DNA, 703 bp, Nannochloropsis_gaditana
ctctaacgggtaacggagaattggggttcgattccggagagggagcctgagagacggctaccacatccaaggaaggcagcaggcgcgtaaattacccaatcctgacacagggaggtagtgacaataaataacaatgccggggtttaactctggctattggaatgagaacaatttaaatcccttatcgaggatcaattggagggcaagtctggtgccagcagccgcggtaattccagctccaatagcgtatactaaagttgttgcagttaaaaagctcgtagttggatttctggcggggacggctggtcggtctcgaaaggggctgtactgttgttggttcccgtcatccttggggagagcggctcttacattaagttgtcggcgtcgggatccctatcttttactgtgaaaaaattagagtgttcaaagcaggcttaggccctgaatacattagcatggaataataagatacgaccttggtggtctattttgttggtttgcacgccaaggtaatgattaatagggatagttgggggtattcgtattcaattgtcagaggtgaaattcttggatttatggaagacgaactactgcgaaagcatttaccaaggatgttttcattaatcaagaacgaaagttaggggatcgaagatgattagataccatcgtagtcttaaccataaactatgccgactagggatcg

SEQ ID NO: 2621 - DNA, 703 bp, Nannochloropsis_gaditana
tcacgtgcacgtgggcatgcagcaagcgctcatgccacatcgccgtcggtgcaggaccgaagtgctgggaacagaccgtacttgatggcaacacagagcgaagctggaaggctttcacgttaaggtgtgctactgcaaccaatgtgagatatttcaatgttcgcaaaagactccgtgacttctttcgccatctagcatcacgctgtcccattctcggaagcaagagggatgatcctggtcctagcccgaattgcgcgacgccgcaagccttatgtggtcaaaccatccgcaggagcttgcaatgtcgtcaccgaacacaatgtccaaatctgatggtgtggaaagaagggaagggcgcgcgaagggtgtaagagggaccgcgaggggcgtcagggtgcgtgcactggcagggctcgtccagcgccgcttcaaggaggctgctcctggtgggaggtatgcgtggcgtccgaggccaatgcactgcccccaaagccgtctctcagggtttagagggctctgtcgttaatgaacgagcaatctggacattggtcacattttcatggctcgttgcagtgctacgtactgcatccgttttcccaggaagggcacaaccccgttccgactcctcctcaggtcttcgtgcccgaggtcgccttcctatggccgcttatacggaggcgcgggtccttataagggcatcatg

SEQ ID NO: 2622 - DNA, 703 bp, Nannochloropsis_gaditana
ggactctatgactatcttaaaaaaaagtaggaaggtcaaagttgtccaggcgaagggagagatcgacggtctggtactatctgacatgtatccgcctcgcttaccttcaactgaccctctcgccctccatctcacccgtgaacgcgcacaggggccagtatagactacacatgggcagccatccgagtacataaacctcgtctaccacaaatcattcggcatgctcgtgaaaggcagaatgcgtggccgtcctgccatctggcctacctacctcctgacatttactctccccatgtcgtttgcctggtttccaacccccttgcacccctcccatactcctgtcgcaagaggacagatacggggaacgttttcatcccggtctaccccgtcggaggacgcctgcccgacggagtatccgaaatcatcctcgatcccagccgagacgccatcagacacgcctccgtcaggccgtcctgcgcgtgcttggaatacgataagccggcgtggagctgtggctgcagcttccactttaattcctgcacttataaacgtaggtatcccagcagcaggcggggaaggaagggcacaggcggccttggaagaatttccatgggtgaccaagggaggtctgttggatggagtcctcccggagtcggtcctagtggaatctttgcccttgaacaatcaagccattaaaggaatg

SEQ ID NO: 2623 - DNA, 703 bp, Nannochloropsis_gaditana
ctacggtacaccgcctaccactcgcatgttccgtcacgaaacaataagataaacatctttgacattcgacttttggttcttcgcgccggtgttgtacgtcttttgaaagtgtgaggacgaggaggcgccgcacgtcgtttcccgttgcctggcctcgccctcgccaagtctgcttgagcgcttgaattgccaagataggccagggtcaaacaacgcgcctggatgacactaatctacgcattaatcatcacagggaagcatgcctctattaaagaaaaggaagtgtggtcgcggctggtttgggcctaaagtcctggtcgccttcaccgtgtcttcatgcacttggccgctcgctgtggccttcagctctttcaatcccctcccgcgcggtggctatcccactctaccgcctgcaggcttgcaacgcaacgccagagggccgagtttactgccacagacattttatatcccagctccaagcgtttcaaagtttagtggccatatgaatcatgtgctgcctccgcttcgaagtccgcagggctctcacgaagttggacatcgtgtcggaaaccaggcgcaagtcgcttgtcggactttgtcgtatttggcagttactgggtcttttctagcccgtagaagaagacagcagcgatgcttatcgcgtgtccacccattgcaaagctcggctgccgcgtctcccatg

SEQ ID NO: 2624 - DNA, 703 bp, Nannochloropsis_gaditana
ggaatagaatagatattctcatcaacaaacacagttgggataccaccacacttccttacagtctgtaaacgctcatgcacgtcgtgcatatatcatatccacacaaaagctcacaaatgcctcatcctgacagtagtcgggcaaccttcctgccccttgatttgcctcttacctgatggtcttgacgatgtgtacgtaatttgtgccgttcccccgaagcttcatggccagcgccgtattgacaaacgacttcacgggcactaactccggggcgtggagtgcgggcgccatgtgtctcgttttgctggctgctgcggtagtgatgcccgtttccactcgagccgcagaacacgcggcccacgatacccgtcgacgcgacactccccctccacgcctgcccagccacgcgggtccaatgctctgtaggataaaacgacggaatcgtagattgtgagcctagagaagacggtgccgaccgccccaaagaaaaaacgggttggtcattggcgggcaaggccgcgaccgtgacctcgctgctctcgcccctccactcgtcgctatgccgtccttggtgatggccgacctcccccatggcctggcgccccgcggccgaaacacgcagagaaggagcgcgggtgatgtccgcgacagacgttgtgttttcaggaaattgacttggcatttctcatttatcccagggatg

SEQ ID NO: 2625 - DNA, 703 bp, Nannochloropsis_gaditana
gtgatacacctgagaggaaggagaacggctttaagatccagcgagtttacgagagcgaggaggaggtggacgatgggggggggatgggggaggacacgagcgacggtggggaccaggatgaggaggaggaggaggaggatgaggaggaagatgaggagggcggagaggaggatgacgaggataaagtggcatttgggcgtcgcaatgacggtcccatacacttagaattgaacatagtcggtggaggtgacgaagaggacgaggacaggagtgccgaacaagtgagtaatcgggtccgtgaaaagggtattgataaacaccagagacaaaaattggggcctacaaaacggccacgaagatgatgtatgtaaatgaaacggaacactacttcaagataatgggtgaatgcatctttaatttacttttcacgggtagacgacttagcggcggagaggggaggttaactgctagcgttcaacgaagttcaagagcgcctccgactttgttcgccctggtggcgtgccgcgttcagtctaaattgatgccgacctgtcgatatcacgtttctccgcgtcctcaattacatggttgctggtgtagagcgtatttgctcatttgcacgagtgctttgaaaatagctttcttttctgatttcttgtgttctacaattcctcaagccgctgctcctctcaaaagcgtcatg

SEQ ID NO: 2626 - DNA, 703 bp, Nannochloropsis_gaditana
  misc_feature (409)..(629): n is a, c, g, or t
aaagggccccagaaacaggaggagcatcgggaggccggggcggaggacagacgcggttcccacccgcccctgcccccggaaccgcggtcgcaagggccctcgcagcaaccctcggtctccacccacggagaaggaggcacaggaccgccatatgggatctcaggggagccggtgggtggagagtttctcccggcacgggcgccatcggatgagacaggcgggttcccgcagcaccctgacacaccggggcctggtcccactcttgccgccccctcgtctcccgacctttctctcccgccacccttagacgtccaccctgtcgacgcctatgaagaggccggcgagggggagcggcgagacgtgtctcgaggggcgacttcgccctctcccctcgcgccggggggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttactctcccgctggcggttaccggccagccgcgggggggtatcctcccgccacaggagggtatgccccgatg

SEQ ID NO: 2627 - DNA, 703 bp, Nannochloropsis_gaditana
acgaggatctgcacgggtcgcacggccataaagcgcacgatgccagccacggccatcacggcgggaaggaccatggacacggtggcgaccacgggcatggtcaccacgatctgacgcccgaggagctcaattggagatgccggctcttccttacgcttgaggagcccgattactcgctcgcggcccgattgttctccgcttttatcaatgcctgtctcttcatgtcgattattgccttcatgatgggcaccatgcctgaattcaagcactttccctacgtgtgccccccgcacatgatcgtgggctacacatgctgggatggctatgggatgccgacgaaggtgatgcccgtggacgtgtaccacaagggttcctatttggaggggaagaaaatgtacgatgagtacctcgagaaaaagaaggagaaagaagccgcagcagggggcaccaaaggaggctacggtggtgctggcgggggaggaggaggctacgctcctgctggtgccggcgctgcaggtggggctggggattacgcgggggctggaggaggtcccgcggctgtgggggggtatgctcccggcgcgggtgggggcgcaggctacccccctgcgggggggactccaggaggagcaggaggggctggagctgggtacacgtctggcactggaggggccgcgcgtggtggttatcctcctgcgggggg

SEQ ID NO: 2628 - DNA, 703 bp, Nannochloropsis_gaditana
ctgcggagtggcttgcaggggacaaacattctcgacatggcttgcctagctttgtgataactttgtacgtgaacgtagcacgggtaccgtcggaagcggctgacattacgggagggaagggaacgagcctgtggcaagctgtacgcaaattgatatcataggatggaacaacatgaaataagcggcttaaaatcattttggtcacgcggaacacccgaacattactttttttctatgatttacactctacttgcatgattctcggcattatgctatctccggattcctaatcccgatatggaatcatctcactcatcacttcggtctgaacatgcaaaccacatggcaaaggagcggagaaaaaggattgcggcaacgtgtcagtatactcactcgcttttggacaacagataaagttttgctaaaggcatattttggaatataaagacagtcgaaacaggtatgagcgaaatattgatggcaaagctccgcgagggcaaacctcctaagaacgctaagatattaaacatcctccgtgagcaagtgcatcaacttggccaagacacagaaactatatcacacagtctagactttgcccaagcattggctgagctattgccacgacttcgagacacggacaacgacagcaggaaactcgctcgcttggtatatttttttattaccgagatatgcgcacatcatg

SEQ ID NO: 2629 - DNA, 703 bp, Nannochloropsis_gaditana
ggaacaccctttgtgccccttttttcattataaaggtatttataagactacaagacttttattgtcagtcctcaccctcctagcactcggggctgcgggaagccaagagtcaaccgtgtttggacaaagagagcctctggcatcgccgtctcagagtatccctcattgtttacgccactttactccatgctcttcacaggcagacagtgcctacctcgaccgtatggcttcatataaggcacacaaggatttttatgctgtcagagattgattagcagccttgtcggtttcggccctataggcacattaaaagcgcatgcacttgcttcgagacaagcggagagggaggttttctcgaagcgtcgtctctgagagacacgcggagcgagataagaaagagccgtccactgcaacgcaaggaaaatcgtggaaaggatgtgctgtttccagtaagagtaaaaaagggtgtttctgccccttggcaagctcatcgagcactgcacagggccccctttcccgccgagtccttgtgccctccctgcgcccgggctacctcatcaccttacttgccgtcgatcttctcctgaaaggcaatttaccttgcgctgacgcctttctgccccgtgttcactctcaagctcgtctctgggcacaatgcacccgctcagtcccttgcctgactccgcttcagccgcggtcgccg

SEQ ID NO: 2630 - DNA, 703 bp, Nannochloropsis_gaditana
catcgaccccacatttcccgctccacctcaagacttttccactccgaacgcatgcctgtcgccctccccggtcatcccggtccgtcgcgcgcctgtgaacctgaccacaccctgcgcactcaccctcgccttccctgatgtggagaggaggagcaccacggaggggactccgggctacccggaggcttccgaaagacaccaagtacccccaacccatatctcgcaggtgtgttccacgccctccagctcttgtctactcttcagcattatgcatgcccctccaccctccctcccttcctcccaccctccctccccttcctccttccctctttccgtccaatgtctccccgctgccttctagagcgctcataattggccttcttacataatccgcttcgatcctgtccaggcaaagtttctctcgcgctgcctccctcctacccctccgcccgccctccctccctccttccctccctccctcccttcctccctcgaccttcatctcctccccccgcggcacttgggatacgtactcaagaagctaagcgctccgggaagaagaaggcgggaaggggagtgggatgacgggaaggagggaattctggaggaagtatgcgatgcagtggcgcagagcctggcctcctatgcctttcctccttcctcctccttttcttcctcctcctcctcctcctcctcctcctcc

SEQ ID NO: 2631 - DNA, 703 bp, Nannochloropsis_gaditana
ggagggcagccagttctttggctctgtcacatacacacatgcatggcctttttctgatgtagaaattgtgcgtggccgtttgtcattacgagtcacattcgcacgtgtggctcctttgtttcatgtcatccacgttgtgtgtacttttaatgtccgtcagaggttgagagataacttcgtacgttgttctgttacacgcattcccttggtgcctgggagaatgagatgaacgctccgatgttagaaaatcaacaagtggaaaggtagtaaattgcttcagtggttgggacagccctgttgaccacgagtaaagcgaagcacttcattatcatcaaagtgcgtgcgaaatggaatgggaaggaggatgaaaacaggacaacgaacgtacttaaaacacgtgcctaaaacctgaatccaacatctcaacatcatgcaagacaggagagcgacggactcggagccaccatctttgtagatacccaacgtatcgtgtcgccgctgcgcacgtaggaagaatctctgtcgagtacaggtagtatcacttcttccataaactccgggcagaccggcagccacgggaaggctccacaccactctggccgccacaaggattttaagctcaaagcgatctgtggtgcttccgtcgtcatcttgtgtagaagccacctgattgtccctgtgcgccttacccagtgcaagcatg

SEQ ID NO: 2632 - DNA, 703 bp, Nannochloropsis_gaditana
  misc_feature (1)..(496): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntacaaccacgcttgtgcaccccacgtgtccgagacctcgcgcagcagcttcgaccgtgtcttcaggtgggaggagggcggggtggaaaataaacgggggagagggacgcaggaagcggcgaagggaagggggagacggaggtcgagcgcaatggggaagctggtcgcctgattggtgccttactttccgcattgacagggaaaaatg

SEQ ID NO: 2633 - DNA, 703 bp, Nannochloropsis_gaditana
tacaggcgaggtcgggaaagtttttggtcgatactgtactgtagaggtctgtgcgaaaaagcgtgttacaattcgtaggcacaaggcgctcagagcaattaatgatttgtcattgtcatgtttaaaacgggttgctaaggaatattttgagcagctaaatgttaattctacgagatcaacaaataatgccgtattaaatatgacttgtatgaggccattaatgtgttgtattgatatttatgtgggtcgtatgtattaacctcctcgatgtttgccaattcaaagctactccatcaagaattagagcttgtcattttttcaaacatggcagtccatgaaagcacggaaacgccacccattgaattatgcagaagctgctcaggatggatggtacaatctcagatgttcactccattgatgaataactaccagtcggacgtgatgtgtatgggagcgaatcagggcaatcacgctatcctcaatcgtactgcataaggacaacacgtgcataattgcttttccaggcaagcaaccacccgtacgatctcgcgaggcgctcgcatggcatgtgtgacgcaatctgaaggcttaagctactcacggctcaacttatgtcgttttttaaggccttcttgtaaagccttcataaccctcccattgacctcctcccttggttgcacaagcctcaggggttggcattatg

SEQ ID NO: 2634 - DNA, 703 bp, Nannochloropsis_gaditana; identical to SEQ ID NO: 382

SEQ ID NO: 2635 - DNA, 703 bp, Nannochloropsis_gaditana
aggagacccttgcgactttcaactcacctccatcccatcctgtcacacattgacaggccccgcttgaagagcgacacaaccacgtggttttcaatgcggtgaaaggggaaaactaccaaaatatgaagcggcttttccgtcgcttacggagagccggcctgaaagtcaccatgtgagatgttgggggatgggaaaaaagtaaaattgtgctgaggtcttcttggattggaaaatcaacgatatgtgtaggccagaaatgaataacttgtatggaactttcaagctcggtttctcattgtgcgtgttgtaccaagggcagcatttcgaagcggaggaatgcactcgtcatcttcttaccacaatcttattccacagcaacaagcactcagacctccaatccattctcgtccgggaagggcagcatgtcgggatacgaccagacgcctcgcatggggcttcagcactgtcactaccctccttggccgtctttgcgtgtcctcaatcggctttcaccactcacgaggtagctgggggggggacgctgtagacaaatttcccacggactgcattaagtccacggcgtgggggcacggctatgtggccgccatgctgtgggtcacgcgtttcagctgtccttccagcgggcagtaacttctacccccccccttccccttgtgccttcctaaccccctccctgcaggaa

SEQ ID NO: 2636 - DNA, 703 bp, Nannochloropsis_gaditana
ggcgaggctgtcggcgacatagtacggtgtggcagtggcgaggctgtcggcgacatagtaggtatggcattgggcgaggctgtcggcgacatagtaggtgtggcagtgggcgaggctgtcggcgacatagtaggtatggcattgggcgaggctgtcggcgacgtagtaggtgtggcagtgggcgaggccgtgggcatcccagtcggcgaggcagtgggtgtgccagtcggcaacttggtgggcatcgcagtagggaaggaagtcggggaacacgtcttaggcaagagcgcttcgtacacgttggagtcaggatcgaagaccaggggtgtgcacactccgacgcagcagaagcactggctggtcacggtattccagctgaagaggaacggtactacctcgcccgagttcaatgagcagtattcatagcaagcctgcggtgtatcgattgactgcaggtgtcggtgtccagcttgcccgagagccatgatgcttccatgcttgctggatgccggatacgccgagagacgacggtcctggaagggggccaggcgccctccttgagagaaccgctggcccttgccgagaagcacaaaaggctgcgtaggattgatggtaggggctggcgtcggcgcgcaagtcgcggcatttttgagtttcgagtatcgcacttttacgatggcggggctggccagcggcgtgatgc

SEQ ID NO: 2637 - DNA, 703 bp, Nannochloropsis_gaditana
gatgagtaaatgtgcttccctgttttctctcttgcaagtaactcaagatttcaccaacagtctatcgtacgagtcttccgaatgttaggccattgaaactctcaactccgcaatctctctcggacagacatgcaagagaatatgaccgagtattcttcgcgctaatttctctctggtatgtatttaaaataatcccatattatcaagaggataggtttacaaattttctctttgggtcgaactactaaccccaatcggaaccgcaacctttaccataactccaacagatccgcctaagaacggtgaagtctaattctaagtccagccaagcctagaggggcactttcactaccaatcctggagaggtggccgtgctgtataaaggataagaccaaggtcgtcagcaagtaagagcggatgaggttccttttttgaggattgcatttgagcgtgtgcttacccaaaatatccgtaatccccactcacgacggcagtacgtagtaaattttcaccgtcatcgagggtttgggtggtgtcaagactcaatgggctggtattgatcttcaagactttccctggagaattaaaagtcctggtaatgggtaccggcaggagatgaggaaccgagagaacgtaaagggcttctcgctcatatgcatttctcttgtccccttccttacccgaaatacacgtagccattatg

SEQ ID NO: 2638 - DNA, 703 bp, Nannochloropsis_gaditana
cccatgtggaaacacgtaccaagtgaaagtcttgccgtacgccccgacgacggcttgaatggcctcagtagacaagctttcggtgtctagcaatgtaccatcaaggtcatacacgatggcttttatcttgtttgttatcgtgccttgtctcacgcttccgcttgtgctcgcactcccgcccggaggaataacatttttgtacatgaggactctatcgaacccttgtaaagtgtacgtgtgcgcctgctctcgcttgctggcttctggcgccaagcaagagaagaccccgggcgggcaaaagtcggtcactcaccgcgtctttacgaacgttgcggcccacgtctacgttttcaggacgagtcacctagtcgaatggaatgagcagtggatttgtgcaggtgtacggcggtctgtccccgcttatcggacatcgctggcgctttgcctcgctgccgctgccgtgtgttccttgcccaccggacttcccctcgtacactccttcctgcccccatacacaagcattaggaccactttccttccaatttggatgagcagatattatcgaaatgctaagaattgatgttatcatctcttccttagttttggccctgctaatatcatgcccgtccccttctcacccgccgccccaatcgcaggaagccagagcaccgcacgctctagcccacctttatttattgccatg

SEQ ID NO: 2639 - DNA, 703 bp, Nannochloropsis_gaditana
  misc_feature (605)..(614): n is a, c, g, or t
cagcgtcctccgacaatgcttccaaatgctctgcgtcctcgccggcgaagagtgcgaggaggcggtaggaaggaggaagggaaggaggggaggaaggagggaggagccggccaaggtccaggtacagggccgggtggggcaatgaagtgctggagagggatggggttgaggaagaagatgatgccggtggaaggaaaccaaggatgtcggcgtcaggcggaggtacgggtgggtgagggaattccaagaaaacctgtcgatggtgacgagcaaatagatatcgagggtgctaagcgacgtcgcgttgttactcatggcttccctcatctgccccatgtcatccctatttctaccgccagatgagcagaaatgttgtctgtttttcatctcaatctcaggaacgagaacgcttgttctataaacccactgtatttctttctcgttcccctctccctccctccctccctccaaccctccctctcccccctctccatttcgccatttccaccttgttaaaaacaccgacgccgattttccccatcgcttccgtcttttctgccggcagcggcggctgaaacctcaaggaagccttgggcccgctcaannnnnnnnnnctcccctcccgcacaccagtatattctctttccactgcgagctcaaaaatcagcggggccaggtcatcttcaccgcggagaagagcatg

SEQ ID NO: 2640 - DNA, 703 bp, Nannochloropsis_gaditana
cctcaaggtttggcgcctaccatccctgcgtgcttttgtccacgtgcctaatcgaccctctctccctccttcctttccttcctccttccccctctctcttcctcccacaggcccaatgtgccatcgcccgctacaatcttcgagatttcgaggaagcccaggaaggcttccgggcgcttcaagagcaagacccttaccgactggaaaacttagaaaggtgagacccagagaagagggggaaaggggaaggaggagtggggaggagcacattcaggtgccttatagcccaaccctaacagtgacttttaccctaaccctagctcacacacgcctttactccttcccttgttcgcatcactgcccacaggtattccgacgtcctctacgtgaaggaaagccgggcggaactctctcaactggcccatatagctgcgcgcaacgacaaatatcgacctgagacctgttgcatcatcggcaactactactctttaaaggtgcgctccccctcggtccctccaccccggcttttgctctcgttggcatgttttcccacccttctccaggcttcgtggcgccgatcgtgtccgtcttgggtttttgtatgccgtcgattcataaatgtcggaagttcatccctatttccctccttgatgcccttctcccccaacctgaaatcctggatattagggtcaacatgagcgtg

SEQ ID NO: 2641 - DNA, 703 bp, Nannochloropsis_gaditana
tcaatgaccacttctaattacgcgtagcttaaagtggaagataaataaaggacacacatgaattttgagatgtttcccgggagtagaaaaatctacaaaaacactttctatttacgcagctttttcgagcggtaaacgaacagcttatcaagttacgaatgactttttgtttctcatttagtttcttcatacgcgacatcctatgtttacttttctttcactttttacacatacaaaaatccgatagattgtgaaagcttgatgatgggacaatgctttggatactttacatggaacatgaaagttgtagaacgacgcccgtaaggtcaactttggcggccgctttcttgtcggacgcaaaggggagctagaattgttgcatcatagaatcggatggaagaatgtgaaaccctcaaacaagaacaaattgtgacatgatttacgtcataaaagcttggaacgtaatagtaagacgagcgactttcgaacgaaggtcatcgccgttcctcgctttttgcggcaggacccttggaaggaaaaaaaaatgcctcgaagaaaaagcacagtctccacacacactcgttcagcacaaccatcgatgtaattacattgcttaccacaggcgcacagtgagtccttacccgtggaatttttggaattgatcgacggttcccacatcgaaccttttctccccgcagtcatg

SEQ ID NO: 2642 - DNA, 703 bp, Nannochloropsis_gaditana
  misc_feature (601)..(688): n is a, c, g, or t
aagattagtgttccaagaagtgcagaagcacgaatttccatgcaccttccttccttcccaagaacaatttggacaccgcaagactgcaagacatccgggtatgggataggggggaaataaaataaaaaggacatgagggatgggggggaggaaagtaattaccaacctctgcacgtccatttcgccgtctccgactgtcggtgccttccgcctagcccactttccccctctcctccttcctcctccttctccgcctcttccgtcgtctgtcgcccccgccgtttctcttttcccgcggcgacgttcatctttctttcaggacgtggcaacgcatttacgtgataatagtaaggattcaaaggcggcagtgccaggtccaccgtgcccgcccgcccttcctccctccctcgcttcctccctcccagtgacagacaccggcggacggcttcctccatccaggcctgatgaagacaagtgacatcatccccacatggggaaagcaacttggcgagggacagaggggagagggcaataaagggcatggtgagatatggactctgaacactcatgacggcattcctttccatttctttttttcttnnnnnnnnnnnnnnnnnnnnnnnnnnnnnnnnnnnnnnnnnnnnnnnnnnnnnnnnnnnnnnnnnnnnnnnnnnnnnnnnnnnnnnnntaggaaaatgtaatg

SEQ ID NO: 2643 - DNA, 703 bp, Nannochloropsis_gaditana
  misc_feature (1)..(76): n is a, c, g, or t
nnnnnnnnnnnnnnnnnnnnnnnnnnnnnnnnnnnnnnnnnnnnnnnnnnnnnnnnnnnnnnnnnnnnnnnnnnnntaggaaaatgtaatggaaagccttgaattctccgtcactttcacgccaactgttgtccatgctgagggaggcagttgggtggaagcgctcccgcggaagtggaagaccctcagcgtctccagcaccctctcaacccacttcccctctttgtccgtccctttcccctccccttcagggaccatctggtcgtcctccctcttcccgggccgggccccccccgactacaacatgctgctttcctacatcggaggggcccaagatccgggtatcgcggagctgagcagccagcagatcgtcaaggaggtagacagggatatcaagaaggtcttgctcaagcccgacgccccggcgcccaaggtaggtggtgtttctcgtgccccgcctcggtgtgcgtgtccggagctggtgaggatggaatagggaagggagcgaaatccgtggtatcggcaaaggcctgactgcgctcgatccgtgccaccgccggcatggatgcttggttgggggtctgatcagcacggcagtgcggggactcgagccctcccagcccgctcgagggccctgccgccactgcagcggcgaagcactcctggcaaaggcgggcttcgttggctctccccatggaaaatg

SEQ ID NO: 2644 - DNA, 703 bp, Nannochloropsis_gaditana
tgatggctcgtaaatatgcctaaagtcatccatggtcaaatgatcgagatcaggaagctcggcttgagggctaggaggggcgctgagggacgacatgaaagaatgggaggactgcagtggcggtcaatcgtcggatggtaagctgcgtcgactcgctcagcccggcgctgtctaatttttgctcaactcagtgcttcatctgctgtggggtaggaaatatggctatgtgactccataaattttcaaagaactttgttcacgcataagacagaacgaacggttcgaaacgggcaagatcccgacgcttgcctactggtgaactcacaatgattgctaattaatgagcgttacggttcttgaaatttttacttatgtatactttcattttaattacaagttgagcgtgtcattgacaagtcttaccgctctcaactctcaacgacaattgctcgcctagtcctagaagcagtagtatcttcctgctttgcggcgaagggagaaggacgcagtagtcactattccaatcccatttatctttcattccattatgaagcgtctggtctttctcttttgcttaacatgtgctgtgcaaataggggtgagaaaagcggtggttcgaggttggcgtggagtaggacgtagtgctgtgtcttaccgatgccttttttattttgctcaaatcttccctaccccgaggcaagca

SEQ ID NO: 2645 - DNA, 703 bp, Nannochloropsis_gaditana
gcagggagggagcccctcgtccaatccggggaccaggagcaaaggagcggtggaagtggacattgacctagccctttccgcgtacgcgaactcgcgggccctgtacgaggccaaaaagaagacgggcgagaaggcgggaaagacgctgcagggtgagggggagagcgggggggagggcggcggcccgctggcgcgatgcctctgagtgcgctctctcgtcccaggtccctctcacgcacacgccccctttcccggaccacgcccccttgcaggcatggagaaggccgtgaaggcggcggagcgccaggcggccgcctctctgagcaagcagcagaggaagcggaccctctcggtcgtccgcaagccctactggttcgagaagttccactggttcatcacctccgacaaccacctggtggtcaggtacgcggcgttacggtggggggttggcggtaggggtgactgtctcctgtgtccgcccacggcccgagcctgcgagacgcggtccccatccctttcctcacgcccccttcctcccacgcgggccgctctccttccaacccttcccccctagcgggcgggatgcgcaacagaacgagctcctggtcaagcgctacctgcgcgtgggcgacgcttacgtgcatgccgacctccccggggccgcctcctgcgtggtccggcacaagggcgccttgggcggggt

SEQ ID NO: 2646 - DNA, 703 bp, Nannochloropsis_gaditana
aggaccgggagctggcgctgcaagcgctgggcgtgatagcgccgcccaacgggccgaagaagaaggggcaacggcgtggcaatgggaagaaggaagggccgggggccgggtcagcggaggcggcgggcgccaggctggcgggggaggtgacgaagatggaggaagtcgggtgggaagaggcctggggagggctgccgccctgggtgcgggagcggattcaggagtggctggagaaggagctggtgcggcgccgggaggatttgggcgcgatggagctaagggctctggctgctcttccgacagattcccagcaatgggcagtcatgcgggccttcgaggcggccgtggggccggggccccggggcggagggtccggagcaaaagcgcgttactggcgcaggagattcaacggcaggtggtcctcgggagtcaggcccccgctcttgcctctaaggggaggagggagggctgtggcgaagaggttgggaaggaggatcaagaagggactgaagaggatgcgacgccagccgtgagccgacgggcggcggcccgggaggaggaggaagggcttctggcgctgctggaggaggaaggggtggcgggcggggggggcgaggaggaggcagaggtggaggaggagcagcgggagctgcggcgactgacgggcaggccggtctcggaggacctcttgctcttcgccatg

SEQ ID NO: 2647 - DNA, 703 bp, Nannochloropsis_gaditana
attacacagcttcaaccgatcggcggcaggtgactcgtcgctcccatgctcaatccctccacctgagaaatcttttggagatcattatttttagggaaactaaaggccatttgtcaaacctgtgaacacttcaagccatccctccaaaaacatcggcaggaggaacatgcctaacagttttggcgaccacggcaagcctatgcagcgagtcaagcgaaggtgatacgagatggaaggaaggggaggaggggcgatgatgacggctgcatgtgatgaaatacgacccctcgatttcatcggccccttcgagatgacacgggaatgatgatgacggctgcatgtgatggaataggaccccttgatcccgtaacatgagattttcaccttccatctccatatctcagtcctatgtaccttgtaatgtggcgaacatttggagaacagagtttgggcataacatggttggatttatggaagctgtaataatcaattgagcaagcaggggcggaagatgattccatcatgtcgacggcttgatactgtttagtttcctctccaacctgaaatgacatacttttccataatccagcccactgacacccggcacgtcgatttttgtgtgggagggacaacacatatctcattttgtcacttcatcgcatcctcttgtaggccacactggaccgtctcactcgtgcggatg

SEQ ID NO: 2648 - DNA, 703 bp, Nannochloropsis_gaditana
ttatcttggaactctggcgctttttgcctcctcatcccccccccaaagtttgaaaaaccgttttctgttatttccggaagcaagtctaacggtccgttgccgtccgtgaaacatgcgtacatctcagaccttttcaatcttctcacgcgtaacattgttcaaaccctttctcatctgagtcgctagagttcgggaaatgatatcagccaatcatctctttcatgaaaggactcgaagcaacgtgattggagcaggaatgagccttgatggaaacttgactgtttgtgacgtttttttccgcatgacttgaatagcaagcttggtgagatattgagtcttcctattaatggctgactccatctaccggctgtcgtacccgatagaaatcaagcaagcattttacaaatcttctaaacatcttttttcgcattgcacggacgaataacagattttcacacaatttagctgacggcaaatggacaaggaaggcaatttcaagcataatctaccgccccctgcggctgacgaaggtaccgatgtgtaccactccgaccgcataaagggcatggcaagcgtggatcccatcaacatttcctgggaaaatgtctcccttcgagtgcctgtcaaaggtagcaagatgaaaaagaatgtactcgcgaatgtgtccggacgcctgcaggcgggtcacatcagcgcgatcatg

SEQ ID NO: 2649 - DNA, 703 bp, Nannochloropsis_gaditana
tgcaattgaaatagatagattacatgaatgaacgagctatctatgcttggattaacgagaaagttaaaaaataaaatatagtaaaacttttgttgcttgcgccccccaagaaacggttacgctcccgggcgcctaacctcccggcccgggccgtcgcctcgagcttggtcttcgcgccaaaacctgcggccccggcctgagggacagcatcgaagtagctggactcattactgccacgaccatcgtctgctgaacgtctatctcccatagtcctcgatcccgctcttctgcgttgaagcgtgaaaggctcatctccgtggtggaaccgactcatcacaatttaatcacaaccatctctagcaaacagggactctcgctgtccatcgtttttaactcttcgacgacaattttcaactttcgcctttcaaggcgcaccgtagtctttagtacaacctttcaaacgcatcgctgaaggatgtacaatgggatcggtttgcagactgcgaggggctctgccacaagcgggtatgtgacaaaaaaccgaggatatgtaccgccgcggcgcgtccggcaagaaacagccttagtaagtgggcacggtggtcctcaggatacatttaaagcagcggtactagccaaagccaaccaagaaatattggagcacaagagaaaacgtcagattgaagcacaagtgtacgaaatg

SEQ ID NO: 2650 - DNA, 703 bp, Nannochloropsis_gaditana
gaggtgggagttgcagggagtgtgaccgccttaccgttcaaattgccgagatctttggctgccaaacccgctcgaaacttcattggtttggtgacgtttgggcctatgggtatgacatatatggcctgcgattagttttcggaggcagggtgaagtacggactcgtgtgcgtgctcgccgcctcttgccccttctcgtcctctcagtcttggcgatcctccttggccgggaaacgccgtgcgtcgctgcaccaggtgttgtaatagcacatgagaaacacgaatgtaaagtggcctgaacgagctcctctatcgtcatagtcacactatttggaattaaggctcgacagcactctgacaggctatccccgcagcttaacctcccgatcctaatataataaataatgagagatattataccacaagtccttcaaataaccctgcaacatacttcgggcttccacgatgtactatataaacacatgcaacggagagaatcgtatgactgccatcgtccaggagcctcaaatgaagaaatgatgctccaggactccttcacttcccccgcatcatattctaccacaaggcaaaagttgaaaaggctttgaacttgatgagagattgagcatttatgtcttatcctattttcaaagcgcaaatacagatatcaatcatttttcaaacatgttcatgtgctctaggct

SEQ ID NO: 2651 - DNA, 703 bp, Nannochloropsis_gaditana
ggtgcgtaagaaagcagtacaggcatggcggggaggttggcagcaatttgctcgaaggaaagagggagaagcacggcggacgaggaaggcaactgatgagaaactttggcaagtccgccttgtcacacgttgcggcattctgtgagaagattcctgttctgtcctgtacggagttgaaaatttaagcttcaaaaagtgttccacgatttgaagctgtcgtcgaaggctcgctggccctatcgcttctcgcccctgccgctcagaggtacttctaccgctcctctgcttcgtcaatttcacgcagtgttgagagggaacatgcagttgcagactccagcagcactggtacttcaagaagcatcctcttccctgaaggttacaaagcagaacattggggcgcgtgcaggtaccctgaaggagtggccaaagtggtgctatgcaaaccactttttacacctcacccaagcctatgtgcggcacctgtgtgacattgcatgcaaccatcttgggcgttcatatctcgacacagcgagccgcggtcaagttttcaagccaaacgaaagcagacgggttcaagagtaaagggacgactcacacgaggtgctttgatgccttacactcgagaaaattgacgcggtatccaatttgacaggaagtagattggatctcctggtgataagagcgggtcaacataaacagcatg

SEQ ID NO: 2652 - DNA, 703 bp, Nannochloropsis_gaditana
tattctaccacaaggcaaaagttgaaaaggctttgaacttgatgagagattgagcatttatgtcttatcctattttcaaagcgcaaatacagatatcaatcatttttcaaacatgttcatgtgctctaggctgcgctacgcattctgctgctgctacagctgcgacgagtaaaagtcacggctctagtcaccattcgaccccatctgcagtctcgctcgctatctatccgtgtatcggccgggattgtaatggaaaccagttgcgacgagcgttgtgccgtcatacagggaatctcggtacgtaatgccgctctcacccggaaatagtgagagtcacatgtattccagtaagggagcagcactttcacggctcatggtcctcaatgggtttctcaatcaccacatgaatcacacattctcacagcaccgcagcgaactccccaaactgctctcatttttgcgggccgcatgcctggaccctcttctccaagagtcgtgggtaagcagagaaaaggtgctggcaccggcctcgatcgatagaaggcggcgtgctgtgactctacgggacgagtttattgaacgcgtaagcagcagtactgaaagtccgcacttgcatttacgcttgaagggatcttgtcggcaacaaaacggaggcagtacaggttttgaggggggagcagggttgggagggcggagagggatg

SEQ ID NO: 2653 - DNA, 703 bp, Nannochloropsis_gaditana
cgtaatgtcttgctccagacctgtatgcgcatgatgcaagcgttttttgggctacctctcttttcttttgaccatattcagaattcgctcgttacaatgtttcacgatttttgattttttaaatgtcctcgcagacccgttttcacgaagaaaagatgccgcactgcggcgcatggactgaacccgcgatgagaacatgagaggtaggttttggacgcctaagacaaaacatagagttagcaataaaaagcttgtgaccaacaatccgcacgtagcccgactaagcctgggatgcgaatttacaaaacaaaagctgcgaataacccaatatccaattgattcttcagtacagtatatattctccctgagaatatataccaacgattcactcaagaatcttatactaagaaagaagacagaagaagaagacaagacactggtcgaggtcagtcctgttgtttttttaaaggcactgttttgtttgtttattcttgaactgtgtgccgtcacggcaaagagagggtctgtcggcggagggagcccgccaggcgaggggggcatatgtcctccctcttgtcgcccgggtcgggacgtcacggaaaggctgtctcatcgataatgctggcattacatacattaaggacactatttcagcatatagaccagtagcgccccagaatttcaggtccacttctgaaaaatg

SEQ ID NO: 2654 - DNA, 703 bp, Nannochloropsis_gaditana
caaagatgagcagtcactgcgtatgtcagcgctgacaaagtcttttgcgggtttatgtgtcgacgagtctgaagtgctccggctagtgcgcgcgtcccttgcagatgacttcaggctgctggacctgctcgagggctttctcttccatcccccgtccttcctagggcagcccttcgtccagctgccaagacaggaacgaatgctcatgttggaggtatactactcgctcgaccccagcgtcgtccgcgaattgttgtggaggaagccgctcggcaaacggatcggaaaagacttggaggacgttgagggagcgacaggtgtctccttaagaagctgccgccggcagttcgacaatttgaggcgcatctatacccatctagaagaccagcgggcctttcaatgccacgtcgcagtcgtggtggagggctctttccatatctctacggtgctggcgtgccagtatacggtctgctccttcctcctcttccatcgcttcgtcctatcgcccccctcctacgaccaccctcagggccagccacacagtcatcaccacaaggcatccgtggcccacccgacttctccaaagccatcacctgtagaaccctcgtcctccctccccccgagcccccacctgcttcctccttcctcctcccatggtctggagcccacacgcgcgctatccttccaggacctggagttcatg

SEQ ID NO: 2655 - DNA, 703 bp, Nannochloropsis_gaditana
agattacgcctctatcgccatgctccaagaaatttttttcatcgaagtctcgcaacaggaacgagaaccgacggagacaaagttaaagatgcctacggggactcgtactttgggcggcaaagtggtcatcggcaagcgagcgacaaaggtggacgcgcagccaaaagtgggagagacaacgagagaagttacaaagcagaaagactggaggggggatctggagatgctgcgcacgaggatgagtggcatttccttccttttcggcccgcacgtttgttcactgtcctcctactagactgccaaaacacggactgtgccagcggcttcaattatgctaatgccaaagaacagcatgatggtacgcaactcccagatattcatcttgagtcagggcaccttccagaacaatcctgtcatgccgtgcatgctgtatccgcgcggcaaatcctgcaaagcctaacagagatggcccctcggatcagattcatccaaatagtgcgggacgaggtgcaccgtagagtccatgcactgatcacggtggattcaattctggcggtggacaggttgatagcctttcttcgggagccggatgcattactccaagggcagatcctattcgtctcaagcatcgttctggtgaacgaccaaaaaagtgaggaattgctttcttccctcgacctagtcattaaagatgtcacgggaa

SEQ ID NO: 2656 - DNA, 703 bp, Nannochloropsis_gaditana
ttaggaaaatggcgtagaagacgaagccaggactgtgagataggaacgtatccaaagcagaagctaaccaagtcacgaaatactgcgcatcaatctttcttcatcgattgtcgcggccgctgagccaggccatgctagactaccaatcatctcaataatccgccgcaccgggtgcatcgtggcatgcttcaccctggtaaagagagagacgagtgttgggtggctgagacaagcagacagctgacatggtccggggagagaacgaacgcgccgtccttccctcccggagacttctactccgggtcaccgccacttgattaggcagcagccgggtgccgtggcgcgtgcatggcgactctgaggcggtctatggcttggacatcgtcatgcatgaggtcggtcgagcgtggtgagtcatcggacaaggtaagaatacgcatgctttctctttgctgtgtgtggcgccagcaatgcaaggggcaagaaaaggcgagggcgaggggcaaaaaaagaaaaacgagatgaacacgacgactggtctgatttcgagactccctcacactcacattaggaaacggccaaacagtcgccgcgcacacgattctcgcgtctatcgatccatccacccacggatcccggaaagcctaccagacggaacgggaacacaagccgcggcccataccccccacaatgccgggccatg

SEQ ID NO: 2657 - DNA, 703 bp, Nannochloropsis_gaditana; identical to SEQ ID NO: 35

SEQ ID NO: 2658 - DNA, 703 bp, Nannochloropsis_gaditana
acgccggattaaggctgtgcgttccgaggggcttcgagcaagaggctggctctgcaccttagcccgaggagaggcataccttgcctgattcggcaaaggatgcactccgtgaaatgcctcgctccatcccagagttgagaggaaaagaagaagaaggaaacccaaacgctttgacataatgcggcacctgcaacaggaagtggtgtgggcactggctgtaaggggacgagtggaaaaaaaaacgcgaaactccatccatcgcacacctaccaccattccatcaacatttaatgcgttacacaagcctcagcttcatgtggacaaggtacttgcaaaacaagtaagaaagttatacccgccaacgtttcttccccttgacacgcgtgttccgggtggccggtcttggcgtcatcgggccaggcaacattcatgacgaatcactcaaaatttaagctcttacagtccccttcgacacaatatgatcacagtaacacgggcaatcatagctagctgagctgtgagcgggggctggggcggcacgggctcaacgcacaggtaaaaaacggtgtcaaaggcataatctgcgcctcctgcccccactgtgacaaaaactagccgcgcgccctgctgctgttaaaaaaatgaactgccctacctctcacttgtcaatgtcctttcatgtctctaaacagttgtggccatg

SEQ ID NO: 2659 - DNA, 703 bp, Nannochloropsis_gaditana
gggtggccggtcttggcgtcatcgggccaggcaacattcatgacgaatcactcaaaatttaagctcttacagtccccttcgacacaatatgatcacagtaacacgggcaatcatagctagctgagctgtgagcgggggctggggcggcacgggctcaacgcacaggtaaaaaacggtgtcaaaggcataatctgcgcctcctgcccccactgtgacaaaaactagccgcgcgccctgctgctgttaaaaaaatgaactgccctacctctcacttgtcaatgtcctttcatgtctctaaacagttgtggccatgcctccccctattcgagggggccgcctcatatcctcgtcaggcgcatccacgtcgaccactctcgcccctcctgccgctcctaccgcggcctcctcctccagggctgcaaccccctcttctcttgccgcccttactggcacgtctttgcccggagccaacacaacgtcccttcagatggaagaacccgccccgctgtcgccgagcatgccgcataaagtcctctcttcgttcgaagtcaccatgtcgccgcctcggcatccgtcacccgcccaccgcagcacttctaaacacaaaataagcagtgcttggcttcccctcggggtcatgtgcgtgggtgtggcctgcttgttcgccacccagaacctgatcgccccgaacctgaccagcatg

SEQ ID NO: 2660 - DNA, 703 bp, Nannochloropsis_gaditana; identical to SEQ ID NO: 36

SEQ ID NO: 2661 - DNA, 703 bp, Nannochloropsis_gaditana
  misc_feature (1)..(664): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccccccgcaggtgctgtcatccactcgcacgggatg

SEQ ID NO: 2662 - DNA, 703 bp, Nannochloropsis_gaditana
cttgccgacgagcccaccttcccaccgctactgctggagtagttcgcgtgttcggccccgttcttccagcttttcttgagttctgcctgtgtttccgcggcacatggattgctggcagcagtctcgcggccattttcgattccagaacctcggggatgcggggactcgataacctccacttgctcctcgtcgtcctcgtcactctctagagtcaggtcgtgcacgggtttctccgcgattccccccgtcattacaatgctctcactgttttcatccatacacttgccatggtcgctggtattcaaggagtgctgcggtgcaagcagagatctggccgcggcgggaaggggatcggacttcgcgaggtgcaaaacgagtctgcgccgctttttgtcctggtcctcaggtccatctaagctagacatctccaagtccaggcagtcgtatttctatgaccgctcaacagagctttgtttttcctgttttgtgatacaagagaagttatgccaggaactgtacaggagggaaatgagcacaccttcagtaaggagtaagcgatatggcgattccatgtctgagcaaaggctgtgacaccactccgttcgtgaagactgcttacatggtaagcatgtaatattttgagagaggaagctacgcatctctgcttttcccgtcattaacatgtcgcagttgaccacaacaa

SEQ ID NO: 2663 - DNA, 703 bp, Nannochloropsis_gaditana
ctaatccacctcttgcagcagcagaggaaacaccttcggcagcaaaaagagagaggaagtcccggagaggaggagaagtgcatcgccctccttatcgacggaggcttccttttcctccttgacgccggacggtgaggcactaaagccaatggattcggtgcccctccccccctacagcgccgtatcattactacgtttaaatcctcccttccctgtccgtcttatcgctccctctcaccctcctttcctttccttctttcttcgagggaaaaaaggccgtcgtcctctttcctccacaccgagtgctgcaagtgctgacaaactgtctccccactgtcttcccgccccccctctctcccttcctccctccctccctagtacccgctacctgtccgccttgcccttgcagcacgtggatgtcgctctcgtctcgcaacagcctcgtcatcttaccgtcgtcacctggatcgaccctgccctccctcccttcctccctcctccccgccttgtttcctcctccgccgccgcctcgaccatcccattgtggcgccttcgccgcctcctccctccctccaccccttcctccaccggttcctcttccactcacctcgcttgcccttccccccgaaggatgagcagggggatggatgaggaaggaggggaggttgtgcaacgcgtcctcgacctagaatttgaaaatatg

SEQ ID NO: 2664 - DNA, 703 bp, Nannochloropsis_gaditana
agtcatgacaataggaaaggatgcggttaaagccatggaaatagaccacataacaaaaataagatacgtgcatacatctcgggaaaaccacgacaaaatactcaggaaaaaaacattgataagcggacggcgtccaatgtccctgaaaataatgtttactcaaaataatttcgaaaaacgcttcaaagattgtctctaatctcaacaggcaatctcccctctatccccccggggatatgataaatgataaccaacaaaagatgaagacccatgatcgtggtcaagtgtcgatagtcatacacatcaaggttgtctccctatttggctgcctggaataccctccttccacctgattattgttctttgcaatgaaagatctcaccatggctatccgtctcggttgagctttcgccgactctggaacaaagcgggtccgaaaaatgggcgaaacaccaaatacggaacgcgcaccagggtcacacagcccaccggacgtgggcatgagcttccggcatggagctctgtgggaaaggctttgccatctggttgaggaatcgtggcgacaaagccaacagtatacaatggcgagttctgaacaagatcttccatgttaagtcaagcaaccctttcctttttgcaaaattaaagggtacacctgcatctaccgccctgaaaagcgactcgacctttcttcctcctcatg

SEQ ID NO: 2665 - DNA, 703 bp, Nannochloropsis_gaditana
ggcggagagaaattaaatcatactaatccgttcagagtagagccactgcctcaagaatcagcggacgaaggggtggcttccataatcgctacaacaacacgcaagtgccccagccgttgtgagaaacgcgaagccttcctccgtcaggcactggcggataaacaagccacacttgtacgccttcatgaatatgaaatactggtaaaagagctcgcagaggcgatcgacaagatcacagaagaaaaaggtgcgacatattcacacaacttgtcccatactttttttgtagcgacgatacaattaatggagcataaactcgccatgtagggcttgcagcaatacccacaaagcgcacttgtgctgcggcatgttccctcgatacacaatctatgcacgcatgggtacatacacgaagacgagtgccatgcgatttccttttttccttacttccccgtatttgtccgccatggtagtgctttgtctgcaaacaactcataaagcccctatcgatgctcttcccacagaagaaatacaagataagctacatgcggttcatcatcagaataggcaggggaatgaattgcacttgctccttgacgctatgatgactctcggtacttcccggcgacattcctccttcggaagcttctccgatgccccagagggacgagtcgacgcaacgtcttcaagaggagaggcaatg

SEQ ID NO: 2666 - DNA, 703 bp, Nannochloropsis_gaditana
ggtggcaccgcttctcgaagatatcttgcctgtgtatcgacccaggaaagtctaaatcaatttcgtcccctttgaagaagagactcgttaaacaaatcatggaacaaaagagggaatcttacctccgaacacaagcccaaaacgaacgcatctttatgtccagtgataccctagcagtgtcgcctgcacaatgtgcatgtgttttcgcgtgaaaaagagcttgcggcaagtttctggcttgtgagtgtcggcaagcgatacgtatgcgtccttcacctctcgctgtcgaatagcgagtatacgaccttggcatgcagcctctgagccgtagtcaggacgtctgccttaagacacaaagaccacgcgccccggccatgcacccacagcggccaaacctaccatggtgcatcttgcggcgcacccagcgagtcgctgacacggagcacgcgcgcctggccgtggctttttgcaccttgttggcgggatgatctcactcccttcaaggtggtcaaccggcacgtcgaaatggaagccgcctgcccgtcagtacgccgagctcaacactcactgccttcctccgattcaacctcccacctcagtagtgggcgtcgcgcctccacttgtgcagggcttatgccaatatcagcccccgcacccggtcgtgccatcaagtgcgtggaggagaccggtataagaccagatg

SEQ ID NO: 2667 - DNA, 703 bp, Nannochloropsis_gaditana
aacacctgtagcgccagcagtggaatcaaaagggaacgtgaatgaggtatcggcagcatggcctgcggacgcgagggttgatcagggtagtgacaagactgatggccttgatgcctctgccaggccccctgggggtgcgctttcctgtcctcagctccctccgcactgggcacccgctatagatcccgctacgggggctaagtattactatcacgagcggacgggtgcatgctcttggaagtctcccccctctctcccttttcccccccttccctccctccctctccctcccgccttcctcagaaccctccctgtacggttagggttagtacggggacacgcggcctctatctgcggcccacagctaccgcctgggctgatgaagctgcatgcagccctggaaaaggtgatagagaggagtgggtagcggggatgggggttaagagggagaggagaggaatggtgagagcgtaaggggcgcggtgtaaatgacgccggtggcgatgggagcgaaattggggtggggatgaccgaacaggcgagcatcaagtgccgctggcaagagcccggggccagggcaaggcccgaggggacctccaccgcctgatccttgcgcgcgctccaccgcatgtccacactatgtcccgccttatccaaccgggccgccctcccctttcttccctcccactcccacccccaggtt

SEQ ID NO: 2668 - DNA, 703 bp, Nannochloropsis_gaditana
acatatagcgcacatgaacttacctccaacaaattcccatacaaaacaacgtcccacgtacagtcaattcccttttctttaaacgcaaggttgaagcatggacgatggccgtcacgctcagtgtcagccaggacaccatcgcaatcaaaaagaagcgcccagttggcgttggagtcgcctgccatcatccgcacatttccacgacgtggagttctcgagcctagcacaggggatcgcatgaacgcccttgcagtagacaacagaaggatgaagaccaatttgtggagcagaaggcagcggaaggagaacgccatggtggatattcctgtacacttggtgttagaacacataaatccaattagcgagtgcaagactcacgtttatgtgaaaaatgagggtaggggcccggggcttgcagagtccggacaggaggcaggaggttatcggcacggctaagactaacggtctggtcggctcaaggacgcgcgcatttatatcatcttgtcgtcataaaaaacgcgcatacatcgcacaggacatgagacctatgtttaggtgcacgaccggaggcagaacgttggcatgctggggttttcttaggacagggcgggagtcacgcaagcgcctgttgccctcttccacacgctcccttcccacctctccgttccattcctcgccatctcgattaataaacgtgcaagac

SEQ ID NO: 2669 - DNA, 703 bp, Nannochloropsis_gaditana
  misc_feature (1)..(347): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccctcgcgccctccccagcccctccctctgcgcctccgccatcttcaaactgctccatacctcgtcctcccggccacgacgtgcccctgaccctgcgctggatggaggggcgggtggggaacctggagtacctcatggccattaatgccgcggcggggcgttcaatgattgacgccatattccacccggtcttgccctgggtgagtgacctcaaggttcaaaatggcggctggcgcgacttgagtaaaagcaaatttcgactgaataagggggatgcccagctggactcggcgtacaggcattccacccctccccaccatatcactgagtccttgagcgagatcacctactacat

SEQ ID NO: 2670 - DNA, 703 bp, Nannochloropsis_gaditana
gggaccaaataccggaggcaccccgtctccaggactggcgggcgttggatcaggatattacgcacctttcgataatcttgtcagcttactctctgcgatgtgaagaacaacatgctgactatttgccatcgtgtcatcgcccttttccctctctccacagaaaggacgctgagcatctgcattcattgtaaatacgactttttacaaaacagaaggatttggggcactagaggattcctaacattgatattggtacgtggttttgttcaatgtttgcgttcgggattcggaactcagggtctcccgaggtcctcatggcttctagagggatgagcaaatcatgtgtgttcgtgcgggtgacatatcaaaattcggatcgaacatcgaacaagaagtcggcatggtctgatatcgggtattggggagatgagcttatgattaaaattttatgcattggagctggactgaaaattcgctcgcccacaacggccagcattccgtgatgctcatatgtaattttcaacatgaagctctttcttattgtcatacctcgaggagtgcatgctaggtaaatacttagacgtttctttgctaagctcactctgtaagtatcccgccgttgtgttgctatactatctatatccagacagggcctctttttataaccgcatgaccgccgcctatcctcctatcgcctaatatg

SEQ ID NO: 2671 - DNA, 703 bp, Nannochloropsis_gaditana
ggataacctacaaggccctttgagacaggcctccacatggtcaagtagccagctcgacgtctcgttctcggggacaggggaagtgacgggtgtgacggacaatggaagggcttgcttgcggggcagagaagcgcgaggtctctgcagacagttttcaggtctagtcttcgaaaatgaaacgaaggttgacgtcgcttgtgcacccgctgccgggcatatacgttgagcggccgagaattgcaacatgagcaagaggaggagctgaagcggatgggatagtttatctgtacgacgcaccctccccgtgtacatgtaccccaaaagcgaagggagggggcaccgcagcctgctaatcaatcgctccgctgcattaaagagctgactcgaaggtcggtaggacgatacacaccctgtcgtatcatgcgggttttgggggaaggcatcaaagggatgctagcgagtgcaagcgttacagcgaacacagcggacaacattgcctacgctaattcagagtctgaacgaagttgcacacgctcttctattgtatcttgacaacttctcccgcaggcatggcttcttggccttgctggcgctgtatgatgatcaccgggcgctctgtcgctaagaggaggaacactccactccccgacctcccaggtattcctgtaaacgttttggtcactcaattcttccaccgttcaca

SEQ ID NO: 2672 - DNA, 703 bp, Nannochloropsis_gaditana
cgatggcgtgacttggacgttcgacaagctcttccctgaggccttgatgaaaatggaagggttgaccaatgagcagcgcgggtccttgctggcatccattcccagggacatacaagacggcccaagcttcaagaagcacatggctgcattcttgagcgatgtacgttatgctcagatggtacagcaaggagcggtagggtgacttcggaaagtctgcggcaggaattgtacccttcgaactgcccgaatgtatgcttgtaaatttacgtaaagaatgtgtgaatagagagcaccaagaagctatgagtagattttgtctccacatctcttcccgatgtctaatatgagggaggcactggttacttttccgcccccagacttaaagtaatccccaataaatacccccctggaacgtatgaagagaggcgcttgttctttttcgcgtgcagcgacacaagttgcacccggtgagtcagtgccccggtcacttttgactgcaaccctccactgagacggaaccctgtcgtttggaccatttcaagcatagctctgtgctttgagatggtgatgcaaagccagggtgctggcagcatttttttgtttttcggagtcggtatcatagaagggttgcctgacgcaccccctttgacaggagcttccacacaccgtgacattcgaaaaacaggcaatactggccaaaatg

SEQ ID NO: 2673 - DNA, 703 bp, Nannochloropsis_gaditana
  misc_feature (1)..(699): n is a, c, g, or t
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcct

SEQ ID NO: 2674 - DNA, 703 bp, Nannochloropsis_gaditana
tcctctgcgttgcacctccctccctccacagctctgcccacccccatacccaacttgcagcccacccagtccgtcccattctccctacctacgcattccagaccagcagcaacgccggaagacgcctgtttcgaggttctagacctggaattgtggtcgctggaggcggagtacatggcctccgtgaccagtctgaccagagccgcgacaagcatgctggagggaacggcggggaaaaagggaatggcggaggagatggagcaggccattgagaaggtagataggggccacaactggtgaggcggggaactgtgggcagcggatgatgctggaggagaaagactgcctgtcctttctttgtcctccacgcgtgtgtatcggtgtctggggaagttgcgatagcgattgccatcgtacctttcccagagacaacatcagtaggcaagggcatggcgcaagagatgcactgaaagcatacgaggggaagttcaacgttacatgaaagatttaggatggcagaagtgctggcgccattgaatatgtatagcagtctttttgttgatcgtacaagctcgaaagcgatgagacggaaacgtctccatcgagaaaaatgaatttcagaaaattcgatatggtacatatttgaagaaaaaatactaccagcaaggaatcagacagcttaaaccatcctcacagcaaggcg

SEQ ID NO: 2675 - DNA, 703 bp, Nannochloropsis_gaditana
  misc_feature (382)..(391): n is a, c, g, or t
aggagagcgcggcgctcatacatctggacggccatggcgaggatagagggtccaagaagcccgagaaggaggtcgccccccccaagatgcagggggcagggtgcacgggaaacgtaggcgtggagctggtgggtgagggactggccgaggaggcgagcgtggagggagaggagggcgagggtcagcccagcgcaggacaggagggggtggacggccttgcggagcttgagagggaggcgagcccccgtcacgtaggaaaggatggtggccaggaatgtgaagagggtccttgcgagggaagggagcagaggggagccggaagcggcaagccgggcggagaggaggacggagacggcccctgagacagcggtggcgatggcgnnnnnnnnnncctttagccaccgccgcatcctggcgggaggccctgcactcgctgacagtggggctgggcgggggctgggtggggttggaggctctgaaggtgttcgcactcggcgctgcggcctggcacctgcagcgacagcaactcgagcagcacgcgcagcacgcaggaaccgtagaggtgccgggggaggcagggaaggaggtcgggccggagggacacggcctgcgcccagccctcccggcggaaggagggggaggccggggggaaggtcggggcgggggagaaagccgcaggaggcgcttcttcttccaggtaatg

SEQ ID NO: 2676 - DNA, 703 bp, Nannochloropsis_gaditana
cttggaagtggctaacgtggtcatgtcccgtcgagcgcggagatcaacgctcgcgtcgttagtgccatgaagccacgcacgcgtccattacgacataaaaacttcttttccaggagagagaatggcaattcgatgacgtaaagtctaatttcgtatgattcgttcctctgctgacaaacattaatgtatgcctactttacttgggactacgtttttattgcccatcgctttcggagagctgtctctctccctttttctcacttcatctcggagctgccgtgctgccttttttgattgccatggtcaaacccgtattgagatgactttgagctgaccaatatgtcacatcgcatgtcaaaagcgccgaaacggcggctttttggggccgacaactggtaacgactgttctcgtcgtgcttgcatattaccaagagaagctcccaggacgccctccgccttgacggtcacgaggagggaaggagaggtatgcgccactgacacgactgatgtcgtttcctatagacacaattttcctagattcagatccttgctgcgagctatgtcgtggtttttcagtcactggctcggcggcggaggagacgggggaggaggtggagctggcagtcgacggggagagatgcgaggtgcaggggaagcactttcctcatcctccccgccaagcagcacgtctcaaatcaaaatg

SEQ ID NO: 2677 - DNA, 703 bp, Nannochloropsis_gaditana
ctcccactccgaagatgagcgcatcctccacttccctcgtgtgatgcttatcctggctattctccccctcatcaccctcgacgctgagaccaagcacggcttctaagcgggtttcctccgcctctgccatttaccagctcacaggagaaatgggcgacgaaatgctgttccgaaaagccccgtcatggtaataactacacgcattgcagcctgtattggtaaaggaagttcctcaatacgctgtgtgcccacgtgttttgagcataatagcgccctcgtttgaagcgatgatggcgctctggaatgcttggaagcacaagaaagccaagcataagcacgatttccgtaggaggcagcatggcatttaagagagggtttgagtcatcattcaaaactgttggtgagggtgcacgtcaatttttctgcctaacgtgccggctgtacatactaaatgcagtatcatcgctaagaacttcactcgttgaacgtcacgcccagacccggtaattgcatagaaatgacagcattccgtctgccctcccgcggccaggcaccgctcacgtttgcggtgcaaatcctcacgagtctacgtttgtaaacttttggcaggccgttgcgtagcggaaggaaacgtagggcggtgtcttcccatcccgtgcgcagtcacgacttcttccatcggcacgaaggtcagagcaccatg

SEQ ID NO: 2678 - DNA, 703 bp, Nannochloropsis_gaditana
tcagctttgtttagcatctccgtgtcatgtgcacattcttccatttaggctgcaattaagctgctttcacgcgaataagcgacatgtatttcctgggagtggggtggcaaccagaagcacagaagtcggttgatatgaggaaagtcacgttcgacgacatgtcctgaaaatgcaaaaagcaggcaacacttatcatcctcttggacatccccaagcattcaagagtcatgggtatgaatgactgtgtaaacgtggcgggttgtattctcgtacttagtgatttttttcacggggtgttttaacctccccacccccttcaagcttgtgtggagtgtggcgcgtttgtacacgcatcacgtttatgtgaaatggtatattccctctgtttctaaaaacaaagattgagatggtttgatgatccagatgatcacaagtttgttcccggtatgtggaaaatcgatcggtcaggaaagctaaagccgctcgtctgcagatccttgcttcattttatcatttgtccaaaccgtttcgaaaactactaggacgacataatgaccatttctacgtgtttttatttttattttcatgccaatgctaagacatacacgtccacaggcaacgactggaccgcaggacaccgtccctcatacttgtggcaccgtccatgcccgactcccgacgattcatcgtgccgtgggcgcag

SEQ ID NO: 2679 - DNA, 703 bp, Nannochloropsis_gaditana
acagccggtgtgctaggtaattttctcactttattcaccgtacaacaaattggatgggcgctgctaagaacgctggccatggcgacaaccaccgacaggagccctacagccagcctcatgatcttcttgaacgcaagcttcttttcttgaaatttagcgcccggctgtggagcttgaaaagcagactcccacttcacagcaattaaggtctaaataaagtatgactgggaattggaaatttgaaaaggctttggttaaaagaaaaggggagtaccagggggacggagagacgctctggatactgtcctcgcgtgcaggttgaacccgctttacaaggcatcaaatatgacagggaaagtggattaaatctcttagaatatcaatcagtaaagatagaaacatgaacgccatcgttcttgccctgtacgtctaccgaaatgttaattgacgagggattaagttgagccgtcggtagtgtgacgtccgtcgccgaaagtcaggggcagacattatttgcgccctgtcatgtccgaattacatcagtgcctctattcacgcgtgctcagtagaagtctttcatctttttaaaaaaaattgaatagcacgtttgttatcatttgaagcgttgccgttgcggaggccgacgcctttcaaggtattgggagtagcagcagcttcaagggaacaggatcacagaacgatg

SEQ ID NO: 2680 - DNA, 703 bp, Nannochloropsis_gaditana
acgcgaccggagtcgaggaggacaaaacgacaagggtgctaagggcccgttgaaagacacgcgtcatgagcgtcaggccgcacggctcggtacaattgcgatagctatgtgatgtgtgcctgtgataattgaacaacatgcacgggaggtggcttgtgactcgaaacatggatgggatgactcattaaggggaggggaggctcgacaaggaggacggaacaggtcgtgcaacctagcaagcacccgggctatgatactgtatttttcgccactttcatgtatattttcctccatgcccaacctcagggagagaggaatattcggactgggtgccatgtggtggcggcgtccaccgtcgacgcgatttttaattgctgcaaattgcaccgtcctgcgtcgccccggcatgtgctgcctgtcagcgttacctccccacccctcccttgcctggacccattcgtggcaaaaaaagtgctcccagtccatgcacacgcacgtccatgcctcgaacgatgagacttcaacacgtccgtttcgagttgccttgattgggagaccgaatgtgggtaaatccacgctatttaatcgtctcacgggtaccgccaaagggcgatggactggaggaaccgccattgtcactcccattcctggcacaacacgggatcgaaaaacggggccgtgttcctatgcaggaatttcaatg

SEQ ID NO: 2681 - DNA, 703 bp, Nannochloropsis_gaditana
acgaatcatgcttcaaattgatgtgttcggtgtgcacaagccttctgcacattgaggcatgaatcgaaagagaacatccctgtgaggttacagcgatagcaagcgatatgggctcagaggtatccccgtcttaagacgcaagtcacatcacttcccaccatgaggggccaatggagagatatttgggaattgaacaggcatatcgcacaagaagggtgctccaaagtgtatcagataagcaagttggaaggaggatactttattaacctcctgacccctggcctacttctttcaccactgagttgttcttgttgcctcttgttttgcgactaaacctcgagaacatccccccgaaaatgcttaaagaaagggtcttgatatatatgctgcgagtataggcaactttagtttaccaaaaccaagattttgtaacttcggcgttgcggaaatattttgtcataatcacgaaagcgctccaaccttgtctcatgtgggtgcatgtccattttcctgtttccccgcctggtacagacatcttgccccggaaagcggcataatgaggcggtgcacgcttttccctgtcatcgtttaccttgccctgcccctgtctgtacatgcattccggcttcgtccggccacctcctcctccaggcttccgtgtcgccccatctcccgtcgccgcccacgtcgtcccctagctttg

SEQ ID NO: 2682 - DNA, 703 bp, Nannochloropsis_gaditana
cgggtaatagaagtgtggatgtgcgatcatcagtatctcaacgcgcaaaatatggtttcactagaggtagcgagaattttcgatgagctccactgggtttgaaaaaaaacggtgcaaaaaaatctcgagagatatctcagcagtaacagaaaagcatgtgcttgtatgttgtgtggaccataatttcttcttcatgctgcgcttattaaaccacgcaaacggcggaagatgttcaaagattgttccaccgtcgtcttttctgaaaacaggatctaagttaagtgcgaaagtcaaaatgttgacggcaacccccacaacgcagccgagtaagtccctcaagtcttgaagggggcccgggagcaccggtttccgcgacgacccagctcgctgttgctccatggcgtaaggcatatctaccgatcttgcaaggattcactgcttgcagtcgaagccggtctatgctctttccaggctcgctttcccggggacatctccctgcccaagtggccatcaagttgctcaatcttcatacattatacttcattcttatattcgttattagttcactgctcacattttttcattttcctctcgcattactgggttgtcccacggctcacctcctgtgaattgaagaagaccttgcaggagcaagccagtatctctcgggtcctttacaacaccccaaagctaataaacaatg

SEQ ID NO: 2683 - DNA, 703 bp, Nannochloropsis_gaditana
cacatcattacccatgcgcgcttgtttctccacacctaggaggagctctacagcttcagccagcttgcctgcatcggccaaagatttcgcttccggaagcgcggcggcgactgcagctgagcaatccttcttttcaatcagctgcccgtccatagtttccaaaaactgtacgttatagtaagaaatgagtgctgatcatcagacagggaaatgaaacttggcgaaagaggaacgctggaggaattcgatgaaggctttgaagcagtagaggcgtaggagtccgacaagcaaaatttgacgcatgaagagtaattcagtgcactgtttttttacctctgtggtgctttttcacagaaataacagccctgcggggttttgcatgtgacatttttctttgttgcgtagtcctgcttcgcccgatgatcgacggacgacagaaggtgatgggataggaccctgtctgcgatgacgatggactgtacgacgcggaagatgacggggtgtgtgatggaataggaccccatcttccctcaccgtcctttcggcctcggtctccgtgctcgcccacgccgcgcttgccctccctgattcttgcttgcactccgctgctagcaggtgaagcaaaactccgcctttgtcgcttactctaatctcgcatcgttatcattgtatctcatgaaggtagacccacagcacaaacatg

SEQ ID NO: 2684 - DNA, 703 bp, Nannochloropsis_gaditana
actgtttaagaacaaaatgatggaaataacattcacttgctttgttcaaaggaaaaaagtcgacaaagcttgcgtaaaatatttcagcaaacgtaccatcttggagcacacggtccaattcgtctagtttcgcattcacgcgtgctactgcatttgcggcatctccgccagcgtgctgaggcgctggctcgaagtgcccagagcccgctgatgctgaagcattgttgcgtaaaaaattagcatgcatgtcaccgggatgtcgaacgccttgtggagggatatctgtttaatacaggatccttgcccttgctgcctcttttacccgcaagaaaaataaggcaattacggaacttattacgctttccaacgggagctccaagcaccacgggtcctttgtcttcgccccagcgtagtgcactgctgtagcatggaggaaggttgcaatttgagagaagtcctacaagcagtacactgctgagattaaaagtgacaatagctcggaaaatcgcgcttttgttgcggtcgcattgtgcctcctgagcaacggcccgtgagagcgaccgatcatcgcctcgaagtcttgatgggggtcgtcggaaacgtgggatacgctcggaaactgtgtccgttacctccaatgcggtctcactccctcgtccatcgtgtgatgcgcgtcatttccagggtcttctcgggagccatg

SEQ ID NO: 2685 - DNA, 703 bp, Nannochloropsis_gaditana
tacgctgctggttcagggtatgattataggtctttacattttcatgtaatatataatcataggctctttaatttatatactcttgaacgagatatgggccgtcgcttccaagaggggttgtcggaaggagctccaggctttctgctacgggctttccgaccctcaaaagaaaaaagtaagggcacaattgccctttagctcaattttgacgtgtatacacgtcattatggaagtcgccgtgcctggtaacgcgttgcatgcgaaacggatgatggggtcgccatcagccctcgcttaggacctaaaacaatcagtgtgtttcatttgcctagcaggaagtggaagacttttgtccagtacggtgtgctggcacccaatgatgtactgattataaaaataccttctttttgggcttaattcgaagcttggatggttcaagaatgtgcaaaggcggaaagcaaaggacgtggagaatctcccgacacgatccttagtatagaaatgcctcgatcacgaaacacgtctaaataagcctaacgagtgagtgccggcctggaaaaacagtacatattgtttgtatcctgttgattgtaaatgaggggtctatattctgcgcaatgtagaccaattgccatacattctttttcacatattctttccagtcgtcgggcaggtaattcttgtagaagaaaaaaaggtcatg

SEQ ID NO: 2686 - DNA, 703 bp, Nannochloropsis_gaditana
agcagcgtcacgcactgctgttgctgctgcagcgcttcatgttgctgctgttgctcgtctcgttgctgctgatggtggccttgatcatggacgaggtggttgcgaggcgggagatgctgcgtccccgctctttccagaactggtgatgcaggactggcgcgggctgaggcacatttctcccctagcgcaagcaccaagaggaaccagtaaatgagtctttttacctcactcttcctttgctgatcatggttggcttcattcatggccgcgggaaaagcatattgcaagccctcctcttggcttaccagggcgtactttttgtatgcgtttcgactagcctgcatattggtcggttggcatgggaacgtattctcaattaaatgtaatgacgaattgtcgaaggagaagtgcccacgctgagagcaaacaaaaagaagtgtgcgggaggcagggaacagacaaataaaacacgtgggagggcacttggagagagggagctcggccgaggcgagagacggcgaagaacgcgtttggtctaaaggcttccaccttggcgtgagaattttcgatatcaagaaatttgtttcctcattgcacgtgcatattaagtttcaacgttaaattcatgcccacaacttctgaagtaccgtgcgagcctttcttttggtagagttttccccaccgtgctcgcccgtccatccaa

SEQ ID NO: 2687 - DNA, 703 bp, Nannochloropsis_gaditana
cggtgttgatgccacgtgttgtcagggccagaaaggaggggaggttggaggggcgacgcacgcgagaaaagacggacagcatattggttgacgtgggaatgcacacggagtcgtatctgtcagtgggatggtgcaggtcatgtattcgtgaaaagtgcttttcccggtgtctcatgcaccccccgaatatgacatgcttgcgtctagctggccttcagcgagtcttacaaagtaagctagtagcaaatgctcctctctaccagaggcgccgcccgcaacgatgaattacagaaatccttcgcaacttttcgcattccattcacaggtattgcaaggcgcgtctttgtttcggtctactgcacgtatcggtgagttccatgccccttttttatcattgacgaggaggcacgatggtcagacacgagcacggctttgggagtcatgatggtgcccagtcacctgatttaaggggctacattcatgttcgaccgaaagtgatgcatgcatttcgattgacaaatttgaaaccaaatgcggggttgctgttggtcagacgtatcatatagtgccttttgcattgcgagggctccacttgtactacagtttcttatctgcagttttgagggaacttcgcgctttagacgtttaacactggcatgtatcatctcaaatataggcaagtgggcgcatactcagcactatg

SEQ ID NO: 2688 - DNA, 703 bp, Nannochloropsis_gaditana; identical to SEQ ID NO: 329

SEQ ID NO: 2689 - DNA, 703 bp, Nannochloropsis_gaditana
  misc_feature (533)..(542): n is a, c, g, or t
accatgaagaaaagggctgtttacgcgtgcgttgacgttctagggctgggaggaagcgtagggcggggcaatcgatgcagagatttatctatacatgggaaatactgcataattatagagatgagtgaagctccagcctctgccctgcttcaaatattgctgtccaactctcggcctcccgctcactgttgccctgctcgctttcccttgcccctcccttgcctccaggagactacgcggtcgttcgcttccgacccaaaggtcgctctacgatcaaagtgcccggccgtctcaaggtctcatcgcggagtcttgtcttcgaccctgtcaacgatgtctcccaggtgcggcgcgcatttcctccttctgcccttcccttcgtctcctcattcctattgcaagcactgccactttctccccttgcctcctcccttcctgcctcccaggcctctcgtctctgcttgagtttgtttctttttcaaataagcttgtccgccacgtgcattgcggagcgttgaaggcggacagcttcnnnnnnnnnngggtcccacgccatgcgcctcatggtatggaagcagcggaatggtccacgctcactttttcctccccctcctcctccttctcctcctcctcctcttccccccctccctcctcctctctggacggtctcttcgtcttctcctgcgcctgcgtcaccgagatg

SEQ ID NO: 2690 - DNA, 703 bp, Nannochloropsis_gaditana
  misc_feature (17)..(419): n is a, c, g, or t
gtattccacctgctttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatggtgtagaaatggagagggaagggtggaggcgatggatgctgcgcgtagaagcccgtcgcggacccatctctctctctgacgaccgtacaaggggaagaggcctgccgcataagtgttggtttttttgcgttgtacgcaggctccctctcttgtcgtcccgtcctgggtcccgctctccctctgtcccccatcccccctttgccctgcttctcccctctgttcaccggcatccacccctttccttcccttccggtcgaatttctttctatcttcagaatct

SEQ ID NO: 2691 - DNA, 703 bp, Nannochloropsis_gaditana
cggggaggggatggtaaaataatttctttgtgcttccgtgattttcgtcgtttggcccgtacaattcgcacgtagactggttcattcatgtgtgaggccttgtgatctttcgtctggaaggaattttattatctcctgcttcccgcatctcgaacgtcacgggcctcgcgaaggagagcaatcagaggaccggagtcctcgtccgtgtgccggccggtgcatttgctgcccgaataagtcggtcgcatacgactgtcctttttcacatggaatgtctcctggatgatatctcacggttcgatgccgttgtacgaacacaggtaccattgtcagtgctgtcctagccagtagacggcccagggtggagcttgggcttgagaagcacgagatccttgttgccttcttgggaaagtcgaagtagctcgaataacctcacacgcagtgagtaagccgctccaccgtcatgtccagaacccacgttgcttcgaaattgctacgaggggtagctctgacatcgtgtctcagaggaggaggagcaagatcctccccattcctttccgcctcgtcagtcgcctcagggagtgcttttgttcgcgggcgtacttccctttcgagaatagccacgatccgagagggaagaattccacaagaggggggaaaagcgcgccaaatgcaacataggaaggcgcgggcttccaccatg

SEQ ID NO: 2692 - DNA, 703 bp, Nannochloropsis_gaditana
agctaagataagaaatgtatggtactaagatactaagataagaaatgtatggtactgaagaactcgcttgacactaattttccccacatattaatatctcgatcggtcgttctgtcgggccatgaaattgcttggagacaggcgttaaggaaagatagcgagataccttcccagcgcccatacgataaacaagttttcgtaaaataattagtctttgacgcttagacatctgcgcaggcatcgaactttgttttaaccaaaggttttgctggtttgggaggaggtatacgctcccttactcccgtcctcctcacagacctgaaagtcaaaaagccgcagagtccgcgcagtggttccctccgccttccctctatttttatgtagttgatgtgtcatgtcgggcacgtccaatctgtgtgaagaatacgcatgtatgtgtcaaaaagtgcctttcatgttgagggtggagggggagtgccggctgctgctgggggagaaaggatttttaagtagggtagtacgtactcctgtctacgacggattacattttgtttccctgtatactcaccagccacggccatctttctccgtgtcaacacaccgatatgatgtacagacgactatcctggcaaaggacgcgggtgattaggacgagttgccctggcctgaaggcaaagctatcgtgcatccatctagtagcatg

SEQ ID NO: 2693 - DNA, 703 bp, Nannochloropsis_gaditana
cgagcgagcggatcggaacgatgttcaacgaggaggcatgcgtgcggccctgggtgctggcttggcttctaaacgcgatggacggcgttcgcttggcattcacgaagtaccacaaccttgacatgatagaggtcgtattggatgaattagggaagtggaaggctaaaatgtgggtgttttagttgatgtgtgaaagcagagcctgagtatctttgcatttccttcttacctggacgccgaacagttttctcaagaaaggttacgtgtctgatagtctgcgggactaagcctccgaaacaggccatggcatttcattttctttgtgtctctgatgttggtaggagttcctgacgctgccacggtgtaatttccaattttgcaggtcactcgcatgatggtagtacgacacgcaagtcgacttgagtagaaccgatgtacgcgctttagtcatgtacctgtgcgaagtgtgcggtaaccatctcccacgcagcaagtcaaagacatccagattgctcctcaatggaaatgctgaactcatgaggcattggaatggcctgcacaagcgactgactgtgtgcctgatgcatcatcaatcgagtgtccttctttgtgtactttaaggtctcataatttcctcacgtcattcttctcgcaatcaaaccgtagagcaaggatgccaagattagggcggtcaagaatcatg

SEQ ID NO: 2694 - DNA, 703 bp, Nannochloropsis_gaditana
atctttacttccttccaaggtatcgaattctcatgacattccttgagtgctttcacgcaaacgagacgttgagtggggacatggcgcatgaggtacacttgaccgaatgcaccctctcccaaaagacggatagatctgtaatccttgtccataccttcctgtaacgcgttgtatgtattatgaacagcgatggaaagaccggatgacgatttcagttagacccgagaattacgaaatcttgaattacgttcaggacacaaacttggccaattgccaaaaaatgccactagtatccttgctgtgtagattttgtttctattcgctgtctacccctacctttcccggaaagaaaaaaaaagaaagagccgaagtaacggttcgaacggctctaacggatgagaaggcgagccgagagaaggtcaagacaggcttgagcggcaattacgacctcctgtgacgctgcgcttacagcgcttgtggatccacgcctgtggtttgaccttcaaaagacgacacatgatacaacacatgtcttccttgatggtgcgttctttctcgacgtgtgaaaatgccaaaagatatctgtgtacgacatcgatcggcccctgattctctcgccaacttaggtatcttacgctcacacaccgccccaccgtgaccccagggcacaatcaaagctgccacccacatctcttccaccatg

SEQ ID NO: 2695 - DNA, 703 bp, Nannochloropsis_gaditana
aagacaagcgcttcttatgtctatgccgccgaggcctaccaggaggcggtggggcaagagcttcctcagcggcttgccgggctctctggaatttacgacctacagcccgctccttggcccgaagcatggctcggagctttccccgtctcatttgatcctgcaatgcctgggtcatacggcgcttccgagggcctgcgtcgacaagggtatcgttgccaacatcctcacctggccgtatacttgtgtcagctaccggcagggatgctgcctcttcggccatatcttgaaagcttgctccttcatgcgtccagcctttgtccttccggctctttttggtgcctttgccctttttacccttctttgctcctttatttgcaccaccgcgcattccccggcccatcactgaactaggggattcaaggaaataaatgtaaggacgcgattcatagcttgcttgcgagtgtgtccgcgtgcacggcttggggggcctcgggtgttggagggcaggcaatggtcgtggcccatcattgttgacctccccaccccaccactccccaaacccaacctgtagagacaccttacatacccacatcggtggcggcatttcccattcacatgtacgtatgctcatattgtccagtcctgggcgctttatgtcgaatagcacgccttcacaggggtttctttaccggaaagccaccta

SEQ ID NO: 2696 - DNA, 703 bp, Nannochloropsis_gaditana
caaaagcatcaccgccctcctccaacaaaactcgaaccaaaggggaacgatcgtgaacgacgcacaaaaacgatctcaagaagtcgaggaggaagaaaacgaagctgaagaacgttcgctccttgtacaaaacctcatcgatgagctcacgtttaaagttgcaagtcttgccatggacagacacgctgccccgaccttggagaaggtagcacgcctctgcacacggaagcaactcgcacatcttctacatgggtgtctcggctacgcagcatgccttgccagtaatcgatattcttctcatgtactgcaaaccttcctatcattgacggggcccatgctggaggctgagttgcttggtatcggggaggaagaggacagggatgaaggactcgacgacaaaccgcctttcagcacaggatcagagatcgatgaggctgcacctggagaaggcatatcattggctgacacagccactaagcttgcagaggagctgcgagcctcgtggttgtcgttgatctttgatttgtgcgggacgcacagcatgcgtgcttttttctgcctcctagcagggatgcccgcggtggcggaaaaacgcggccggcatgccaagcacaagcacggtattgagactgctgtagcagtaggttatcagggcattggtgcagggcccggtgacgtacgaagtaaaactcagggggagact

SEQ ID NO: 2697 - DNA, 703 bp, Nannochloropsis_gaditana
ggggggggggaggtatgacggaagctccattccatgctttgagttcacgcgcatccaccgggcccatcagaccggaagcgcgcttcgtctttacctcagccattttgactgcgaaatttcatccctccaacccccacctcgtgattgggtaggtggacttcgagagggagggagagagggagggagggaggaacgagaaaggagggagggaggaacgagagaggagagcgtggcactccgtttttcaatacttggattgtggcgagaaatgtagatatgaaacatgggagaagaggcataaggaagattggagggctttcaaacttctgggttcaacttagttgatcttccccccctaccttcgtctcgtcctccagcggcgcctactccggccaagtgctcgtttgggacatgcgcgcccggaccctgcccgtgcaacgatcgcctctctccatgaccggtatcccctccccaccccttctccctttctctctcgctcctgtccctcactcgcatttataccggcctattagaagcggcctctccttctccctctcgatccttcgccggattccctgtgctggcctccctctatcctcccctcaatccctccctcacttcctccctcaattcctccttcccccagggcacacctatcccgtacatgcccttgcgaccgagactgcggcaggcggaaacgctc

SEQ ID NO: 2698 - DNA, 703 bp, Nannochloropsis_gaditana
  misc_feature (610)..(643): n is a, c, g, or t
cgtcgacatgaccgtttctgtgggcgtacagccatccccgctcttccttcctcccgtcgcttcaatcttctccccgcgtgcactcgtctgcacatccaacctacccggatattcgtttatgttcaaaggacccggtgcggccgaaggaactttcctggagttcacacatttctccctctcgccttcccctcctccgcccttcccttccttctcctgggcctctagccccgcgatgatctcccgtgccttccttcttcctacccttcttgtttgcctctcgccggcttgagtttcggatctgacatcaacgtgaacggtgttgacaaaaaagagatcaaggacgatgattgctgcctttttaaagccatccctccctttcttcgcccctcactcagcggcatacagccgggagagcacaagcagaaatcgttgcggacctgcgtcgtggtcctcctccccttactccttcccggccccggtcccctcctcctctgcagcatcctttcccggcctctctgatgagatggagggccttgtccttgcgtggtccttgggcttgccatctaggtgaggcacagacggagggaagaagggggagaggggggggggnnnnnnnnnnnnnnnnnnnnnnnnnnnnnnnnnnacaaaggtagcttgtttagggaggtgggcggagtggtgaagaccgggaaagagagcaatg

SEQ ID NO: 2699 - DNA, 703 bp, Nannochloropsis_gaditana
tcttccaaaagttcttcgacagcagatgtgacagggtcagacatatgtcattcctgtatttagatgtggaaagcggaaagaatgaagtgcgcgggttcgatacgcttatgaggcaaagaggactaagagcattcaggagaggcgacgtttgccgttgatttcagttcctccccttacgccccaatttcacacagggcaggcgccgtaatggacgcagtatcataaagtttctccacttctgagcgcacaactttcattgttctccgcaagaagggcttatccagaaggcctcgcggcccgacgtatgtgatgctgtccagtctcatttatattaccttttcagtcgacctcctgctcctgctcaatgacttattactacctcgcttattttacctttttttcttcgctccaaaaaatgttgctcaggtactccatttccaagatatccgtagatatgtgtgcatggacccgcccgggatggaaacgtcctaataccagttctgcagtctcttcattatccctctgtaagtcgttcaacgaagcggacgtgagctctggcctcaccagctttgcctctgaggccccaggagaaatacaaggcgaacatgggcgaaatgtatattgattttgtgagagaactcaaagagcattcatgtaattccctttccaactgaacacagcggagctaatgagtgagcagttg

SEQ ID NO: 2700 - DNA, 703 bp, Nannochloropsis_gaditana
gaccctttttacctcgacatgtttggggtgctgtgacgacagattgagctcccttgccttcctattaatcatgaaagcctgggagcattaccgcgttttacgaagtagctatgtattctttccacatttttttctggcgctgccagaattgtttgaccttcctcaccttcctataagctatgaaagggaggaaacagtaccgtgttctacgcaatagcctccctgagtatcgtatctcgacacgggtgtctagtaggacgatcaatctcatgcgcgctcataaattaaaacacactcatgcgcataatttcaagcacatatataaggaacttgctgaaggccacctctaacatggatgaagcccgcaggaaacgggccgcggctttggaagagaaaaaaagaaagttggaagaaatgcggcggaagcgggcggtgcgtgagaatgaaggggagggcctaggagaggaacgtggctcagctgcagcaggagacagagctttaacacgagggataaagaaggaaaacgctgaaaaaggcggcaacagaagggacgaccaagaacaattggatgcattgattgactcgctcttgaatgtaccggcgccttcaaccgagaacgagggagaggataaaattgggaaaagagaaatccacgccagcgataattccaatacccaaaaaacaagtgaagcagcggcgcatg

SEQ ID NO: 2701 - DNA, 703 bp, Nannochloropsis_gaditana
gaccccctccagggccgggctcaatcgtatctcgctgacgccgtacatccgggtcagcgtcggaaaacatttcctgacagcgccttggaacctgagttgaacacgatggcaggccgcatatcctctaaaaggcgcaatggaagcaaaatctggtttccaattgtgtaatgacagaaattcgtgttcattcaatagcagaaaaggtcttcgaattccgttgaagtcgtttagcctcctctaaggtgtcacggctctagactgtcaaacgctgacttgcttttctgatacggcacaatttcttgtataaaacaaatttgcagaaggaattaataaagtgtgggtgtgctgtatctatggagactagaaaattgagttttaatccgggcggcccaagtgtctgcagaaacgaccgcggggatttgcatcatccaccttggcacttatactgaaccattatttgatttttttcaatacacagtaatagagacaagaaactatgtaaatttaatgtctggccaagtaatatacgtgcagaatgagctgtagcaggaaaaatgtcgattgcgtcaggagcctatattatatggaccaaattccgcaagcttggatgaatttacgttctatcccttccggctgatttgcacagcgtccacaccacattattacagctttctgtatcttctaccgggccatcgacgaaatg

SEQ ID NO: 2702 - DNA, 703 bp, Nannochloropsis_gaditana
aaggacgcgacgtacaggatcgccatactgagacatgcggccaaggctagtgtgagggaggagggctgtagcccggcatgggctcgaagcagggagggcggaaggaccgctgggtgtagcaccattaaaaatggagcgttgcctctcttgaacacgcctctccgatcctgaggtatatgtgtgtgtaggaattagatatcatgcctgagggaagtgatacacgaagggaactatgacggcgcggctactgaggatcgcctcgtagtccatcaattaaaacgttccgcacatgttttctctctgtctttgatccaagcaccagaaatgatggaaaaagggaacatattacacatttgtttttggtgtactggttctatcgcttatttctctcttcagcgacctccccccactcggcctcaagccgatgccagggtcgcgttacgtcaagcgcccccagactgggcattgtggtaagaagctgtgagattctggagctctctcatatgacagatgccgagatggaggcgatgacaatatttgcgtgcgaagtgctgtcatatgaataagctttgtcttggccacctcctccccttccagtgcaattttgtccctctcgactcccgccggctgattggctttaatttcccccccacacgacacagagaggtaagatattgcggtaagtgatcggtgccttgtcatg

SEQ ID NO: 2703 - DNA, 703 bp, Nannochloropsis_gaditana
tgaatcccaggtcaaacccatgcagaacgatttggtgccctcctcttccgtgtcctcttcttcgcatttcgccgacaggatagcgcgcttgggcaagaggtatgtcctgcgccctcgaggctgcctgctcccgttgcagtctgtcgggacgtgttgccgcgctcgggaggacctgtgccattataacgccgaagttgcccgcttggaagggcagtggaggatggcgcacgtatgggagatgcttggagtcatcttgtcgggccccggggtgggagggaaggaagggcggggggtttcggaagatgaagacacgggtatcaattttgccactggcacccacggtcatcctatgatggataaagaggacagcaaaggcaaacgaagcggtcggaaagaaacgcgtgacaagctgtcgcaggaggcctgcatggtgggcgccgtttccaccacttcgtttccgagtgttctcttgcacgggccgctcgacactcctaccacgtcctccacatgcttgcagctccttcgtcgggagatcctcggccatgtggtggaggaactgctggaggagggggaacttcagaactgtgtggctttattcgaagtgatccagtccactgggaaagctcttcccggcgagtccttgtcagacctgatcggctttcggccggagcgcgtccgcgagatctatgtggggtacctggag

SEQ ID NO: 2704 - DNA, 703 bp, Nannochloropsis_gaditana
ggcatgattcacatctagccgcagtctcctccaatgtattaatgtggaaagtgccagggctagcgccccgcgataaaggctggggcaaggcgcagaagccacagtagtgccccggagggaccctgccaaacgagacagtatgtccgcacgtaggccgaagtacataccccggccaacatgatatcgcagccatgcagcctgaaagtaccgtggcatgtatgagagtggcccctcctattttgcctggctgaccgcggggtggtcgaggcgggacgacgggcggggcacacgcttggaggagagggatggctggtacgtcatcgccagaacccttcaacactttcacttgacctggcaactgcccatcaatgttattgaattgaaaaatcgtgcgcagccggggatgaaagggcttctcattgaaaatccgccaattttttttcacagccttgcaatagtcggagacagtcggtttggctttggttgttgcacgattacgcccgtggcctgttcaatggctcgaatctttggtttggctttggtggccctggctgttagcagcactacccgtgcttttgccacaggcccacaaaatgtttttaaatctacaatccatggtgggctacgaccttggaaaactcccatgctggcctcgctttgctccgcgccacatcatcacgtcttgaatgtcggaacagggatg

SEQ ID NO: 2705 - DNA, 703 bp, Nannochloropsis_gaditana; identical to SEQ ID NO: 257

SEQ ID NO: 2706 - DNA, 703 bp, Nannochloropsis_gaditana
atgcctgggcggacgtgaccacaagcgtggaccccgtcgcgcagctggtgtgcggcatcgtcacctccctgagtcccttcgccctcggcaccgtcatatcgccgacctttttggcacaagcctacttgaagtccctggtgcaggctccgggtcgccggttcaccctcctcttggacctgctgttcttggagcggcctgtggaggacgtgatcgtctcggtgggtgaaaacaacatcaaggacggggtggaagacgcaggaaggccgcaaggcgaaagaagacctgagcgggggggatgagaaggaaggaatggttcatagctctgtgtatgattccctcacaaccggacctcgcggctccattcccacacttgttcccctacagtgcctgctgggagggaatgccaccgtccaaggacacgcgacacggcttcttcagggtcacagtacaaaggtgctcaagcgtgcccgactcggtgacgaggccctgagcttccagcgcggcaaactccggcccaacacgtggaggcccaagtacgtgcttgtcggtccgtccctgtgcctgtctcttatttattatatctcgtcgctttatgtatcgtctcggttattgtctcgcgatttgtttgattctctctgagcgccaggcaggatcagatacttgagtcgtcgttttctattgtcccttcgcatggcatgcccct

SEQ ID NO: 2707 - DNA, 703 bp, Nannochloropsis_gaditana
aagaagaagcaacaaaccacgccactgcctttcctgtcagtactagcaccgccgtcatgcctaagagctgccgcagtccctggggacctctggatccccctgccttggccgaccgctttcgctcccaccaactgatggagctcggggaaatttttgagcttttggaccgggcacgcgacctactgaaggccgaacccaacattttgacgctgcaagcccctgtcacgtgtgtcggggacatgcacggacaatattttgacctgttggatttgttcgccagggctggaggagcgccgggtacccgtgagcacgcctctccctccccccctgcctcccctggctccccttccccaaatccatcccgtttcctcttcctgggcgactatgtagaccgcggtgcttattcttgtgaagtattgctgtaccttttggccctaaaggtggcgtacccggacttgatccatttgttgcgaggcaaccacgagactcggggggcgacgactttcttcggtttcaaagaggaatgcaaggccaaatacggcctgcccgtgtactatagatttttgctggttttcgagtctttgcccctgtgtgcggtggtggaaactgactacgggcgcctgtttgcctgccatgggggcatctcaccagaaatccagtcgttggcggaaattcaacggatcgaccgtttcgtagaacctgg

SEQ ID NO: 2708 - DNA, 703 bp, Nannochloropsis_gaditana
agtcaccgattgattttgaagacgttgccgcacgcacaaaggcaatttggacggcggaaacctccggacacgttcaacctgcacataggtagtgtgccgatgcaatttaatcatcatatttaccatgtgttttgtgcagtgccggctttcggcatggatattagtgggtggcggagatggcttggctggcctctgttgaaaggagcggaaaccaaggcaaaggaagagaagccttgtcccggccaggatgactggcagacatatccctttttcatcccacgctcaccgtgttgcctggacgaatatgctacatgcgcatgtgtgtgtgcggcggtgcgtcatggagtctttgtggtaaaacgtgcctctcattccggcacccatggcaatcgcatggacgtgctaggggggcgcggtgacgttgacttgtatgcttctagacatcctggtaatagtttttttaaccacagtcataataaactctccctttctcattttggatcgatttcaaggctccgtgcgcaggcatttgcatattcagacctgcaacggatgacataataagcagctggaggacattggaaccgagcgaaacgacttaatttacgcatcaaaaacaacttcttcgcacaaaagcggtgatcaaaggtgacattcttctggacatagcatcaagacttgcgtcgcgcgcttggattgaatg

SEQ ID NO: 2709 - DNA, 703 bp, Nannochloropsis_gaditana
tcgtgcagtccctattgatgtgtgtgggcgggaaaatgcggtcaatgttcgatcctgaagcaaacgtagactgggcgacgtgggaagatcggtggccgcggcccgtgctatctcggaatcagccctttagaggacgtcgtgcccgcctgtcacccgcattttcccaccgcaataacctgccatgcatacaatcgacacaggcttcgggattcactgcgtccattcagagctcgcagacaacggaggccaatctcgacattctcagcaaggagcggctctgggcggtgtggcggtatcatccctgtctcccctgacgctacggcaccactgccgcgcaaatccccagcctctggagccatcgcgctcacaagtcatcggaaaaactatgaaaaacctacggagggtgtttttcctactcctgctgatgctccttgcagctgagcatgccgtttctttcatctttcccctctccactagcccaagtacaagcagaagagacgccgcgagggcgtcgtggcgtcgctgctcccgcgccccacctcaccaaagcgccttgtcacgccttcaagccactactgaaggcgctaaggtggcggcgaaagttgccaaggacaaagagtcgggggatcgcgagaggaaggatgacaagaacaagccaaccgccatggccacggcggcggagctggggaagtacgacgtgaag

SEQ ID NO: 2710 - DNA, 703 bp, Nannochloropsis_gaditana
atggtcacgaaacacgactgaacgtgggttgcagcaatctgtgaccgtaagggcccgcccttccaatacgaggcagccaggcaacttgcgtctgaaggggaggttgactcgtactacgagtaggagggaagtaccacctgcgatcgtcttttgcgccttgctacgggcatatcattcaaacattctctgaattattacctctcaatttaactttctctttacaggcaatcggggttggtctaagtgtgctgatcgttgcaagcaactggaaggaatggcatccgctcaatcaggggcagcaggaagtgccacctctgctgttattccagcgccatcctcccccttcatcgcgaacacacgaggatgcagacgacgagtttgtgataccgtgggcggcaatttctgcgggcgggacggtcaagaggaagaaactggcggccgccgaccgcgtgggagaagaagaggagggagaggagggagaggagggagggacgggtcacgacggggaggagggagaggaagcgagcgaggccgccgagaggcgcatgaccaaggagggcagaaggagagacaagcagaagaagtacaggatgggttccgggagagcaggcctcctgattgcccgtccgagcaggcaggcgatgagcggacaaggggggtgtctccatgcggcagggaaagagtcgggggggccagggagcgc

SEQ ID NO: 2711 - DNA, 703 bp, Nannochloropsis_gaditana
  misc_feature (630)..(639): n is a, c, g, or t
aagcttcgaagccggtggaagctgagcagccaaaattgggcaaaagtggaaaaaaaatctgttgctcgtgccctgacacaaaaaaggtgtgtatgtatgggaaacattttgattctagagtttatatcaccaagagaggtaaattatttggtagaccataatccgtagtttttgccccttccgctacgattgtaagctcgaataattgcttgcaggcgtgcacccaccaaacgtgggactggaagaagatgattttacattaatgaggcgtcgaaatggtggagggacgactttttccccatcaccgttttcaatgagggcctaaaggtgctccttaaggcaccctaccgtctttaggaagaggatcggtgtagtgagggggagagcgaagggtacggagtgcgtacggtacctaaaccgtcagaggagtcaatgcattggcactttctcacgcaaccaaggctatcacgaagcttcgcaagtgcccagagttgcgttgttggttgttggtctgtgcctgctttttggccattacatgctcatacacccacgcgccgtacgaagtgcgttcaggaaaaggaacaaggcatctaaccctctccctccctccccccccctttccccgcctcnnnnnnnnnngaaggtactgttcacgattgccggcgtgctgggcggtgtggctctgttgtcttccctgttgatg

SEQ ID NO: 2712 - DNA, 703 bp, Nannochloropsis_gaditana
ctttctttggtcgagcacggtcattattttctggtttcagtcctcgactgctgtcgtcgctctcgtgcgagaggcagcgagaagaaatttcccttctagatgcttcccgcgaggaaaatagctaaccatgataggagaccgtcaccatgtctgacatataggtcgtttgaaggaaggatatgaacggcggcaaccttgcggcagcgggcaaatttgttgcagcgttgtacttgctgcggagagggccgtgaacaggaacatcgaactcttgggagcgctctcagtggactaatcaatgaaacgctaccttgccatttggcatctttatctcactctcctcaataaatgtacccacatgccatcttcagtgacatcgagggcaacttctcttcgattggcacgtctctttcataaaagaggtgtggaaaggtacacgttggcgaaataattgcacagagtggggaacaggaagatagcatttgcgggctttaacctgtcgtaagacaaagtaccacagtccaaagccataccgacgccaaccgaacccagcaaagacaacaacagcagcagtacgaagagaaaacggccgcgcgattcaaccggcacccctcccccaaagaaaggaggacatcgaacaggagacgaaacaacacggactggcacgggaagcggagggagcagtgcaaaaagcgaacagagcatg

SEQ ID NO: 2713 - DNA, 703 bp, Nannochloropsis_gaditana
cactaaagaagatcccaatttccatgaacaaatggcgataaaatgacgtttttttggggctcagtacaatgacttctctgaaaagtgacatgctcctcaggacgattcccactcagatacccctcttttaattctccgtcgctcacaacgtctgactttgtcacgaaaggtatataatggacgaaataattttatacttttgcttgcttaccatagataagtgagcatcaaaatgccacggagtagaccgatcaaaaaagtacctctgatcgaaaacttccacaagccatcattgataagtaattgatgccgtgctaaaagataagatgatttcgtgacttactgaatgagattccacctgatctgtctgtaattccaacgtgtagacttaacttggcgaaaagaggcacagctcttgcccttccacagagcgttcttagccctatccctttcttgcgataagaaagaaaagctggtgcaactgtgcctaaaacaccatgtgacaggcgagacgtaccatctctgactctcttaacgtgcaggcatttttttaattggtcatttccggctctgggcgcggccacgaccccgtcaagtcagcgtcctggccctcttgccgaccgaggccggggttttccgagctttgcttgcctttacttaacggccgaatattcagtcatcagccatcacaaaatcaggaatg

SEQ ID NO: 2714 - DNA, 703 bp, Nannochloropsis_gaditana
tgttcggtggcagtgatgggctctgtagtcccctgcaagctctgccaattttctggaaaatctgttgcaatcggcaacaaatttaggttcatgtaacatccatcctatctgatgtttgcacctgtttttatcgataacgtcttcgacaggcagacgacaggatgagcactgcagacaacggcgacgggccaaaaagcgtggccgccatggcgaaagccttggctgcccagcgtggcgaggagtacgtgcatgacttgctcaagggcgagttttatgacgacggggggcgcattactacgaacgcgggtatgcagtcggaggaagaccacgagcgtgagattcagcggtacgtcgaaagtggcgaccagggagcagggatagaggaaggggaatgatgtaatcaggcatagaaagcacaaggtcgcgtggacggagagggtagggatgctgcgcgtcagatttcttcttgttaatcaccctccctacattaccacatacccacgcaccttaataccacagcacgatccagatggtgcgaagcgccacacacgctctgagcgtccggtcgcaggggtcggaacagcgctcgatgagtcggatgcaaagtctccgtgccgtcttctccagccgggaggacaaggaggaggaagcaaaggtgcctttggacgacctcttcgacgagaacgacgtgcctgtcaccatg

SEQ ID NO: 2715 - DNA, 703 bp, Nannochloropsis_gaditana
  misc_feature (669)..(678): n is a, c, g, or t
caaaggccatcaacggctcgcgctgctttcccttccctctctccgctcgcacgaccaccgctcggagggaaaagttggacagacgtgcgcctactttccttttttccttgtcccaaatttgaagattcaaacatttaaatattcaaatatttacgtctgtctattagaaagtgtcctagcccacgtagaatgagggataaggcattggcttctcttcggaacctctctttccttgaccatcacggcctcgctctcatgcaatacttcgccatcccctcctatgaatgaatgtatgttagttcttttctcgactgtacatacttactgttgtcatcatcctcactccccaccttggggcacacacaaggcccggagggaaaggaggaagggggagtgggtaaggagtaggaataggtgtgttttgatcaagctcccttacgttctcgcgtgcctacggtcctctcaagaagcagcaatctctcgttcgtctcccgggtcatctccctcacccaaacagatatatgacatgtacggagaggatggcttgaagatgggtggcggagaggccccgcccgagggccccggcggcacggggggcatgggcgggttccctgagggctttgcgggctttgcgcgtggaggcgggggcggaggaagggggggaggtcnnnnnnnnnntacggcgttgcgattcgcggcaatg

SEQ ID NO: 2716 - DNA, 703 bp, Nannochloropsis_gaditana
gaggtagggagatgagtttgtgtgtttcagggcatgaaagtttcgacaaagcatacgtttctcggtctgtcagcatcgtatacctgcaatcgagtcacccgtctctgagggtgggagggaaacgctacgtgtgatagctcattcaactctacttgctccttgtatcgccgaatcgccagcagaaagttgaagtttttgtataaacggtcaccgaagtcgcagctcaattgtgcaccaaagaaatgtgcttttccgtcccagcacccgacatgcctttcagctggtgatggtgagaatatatatacattttcaactgtgaaaatttatttgaaccgattaccacgaccgatcatcctttttcaacccacgcgctcttttctctgtacatatttgctactcaatacagcgacgtttgcaagacagtacgggaatgagggcattggttcccaaaattgcgccttttcctcctcacttcaaacgtttccatcgggaactcttcccccagattgttgacttttctactgttgcttctgattctcctgcaccggcattaccgggtctcatgatgcattcgcctcttttgatctcatctttgctgaggcatgcggccaaacaccatccggacacgcttattgtaagccaacgacacgaagaggcgggcattggaccacggaagctccatcggtacacttacaaagatatg

SEQ ID NO: 2717 - DNA, 703 bp, Nannochloropsis_gaditana
gattaaatgatttgcacgttaccagcggcaaaggacgatagaaacgcccaaacagggtataaatcatggaatcacggcaaactttcgttacatgctagtgcttgtatcccctgcatcctctgaacaagaaagttgagttcaaaaagggactttttgctcgggaagagcaaagaagcatatgccccttcagcctgcgtcggctcgagaagataaggggaccggcacgtcacactcctccaaaactttccccaacatcgcgcaccacccgccaatttatcatatatgacccgctctacctcattttgtacgtgctcagcgcggtcgaggggcatggagttgacagcgggcagggaatccagtgggttccaagaatatcctcctcgcgcagcggcggagtgggggcactgagtcctatatcgtcttcaaatacctcgcgtgcagcgaggtgggcgagtgtctccaggggcatgcagcctggtcaaacagaggggtagttactcaagcccgtctttcatcgttgggtcgtgtggacacattgcgatggttgagaagtcggcatgtgcgcagttgctggtgtttatcatcgcttaagatactcacctcttttaactctctgtcttgagaaaagccacagagcagggcaggaacaatgctgtatcccttgccgttcgaaagctggcagtagttcaagtggtcattcatg

SEQ ID NO: 2718 - DNA, 703 bp, Nannochloropsis_gaditana
ggtgtcattcgaggagcacccgttccgatatccttctcacccggtctccctctctccctttctccctcgcctcctccctgtggggctctccaggctattgaggagctgcacgagaccgaactcgacgggtccaagataacggtggatcgtagcacgcaaggcatgattgaaaaaggtgggaacagacatcgggaggaagggaagatagggcgggagagtcatggttggattcggagaagggggggagggggcagttgaagactctccccgggccgaggtcgtggaccgataatttccttcgttcaccattctttttgttgcaccttggcagatggcgggggtcgaggggcggaggacgagaacgtccggctctttgtgggcggtctccccgacaactgtgtcgaggaggatctgatggagtgagtgggaggggaggtggggttgaaatcctgcctgttgccccatgcgtacgaagctcgctcttgtggctgcctgacttttcccttaacttttctccctccctccctccctctctccttccctccttccctattttccctcccctcttccctccctccccacagtcttttcaaggactgcgagcccgtggaggccttcatgtgtggctccaagcatcccccttgtggctttgtcaccatcaagaggagcaacgacaacctggagaaggcccagtcttacgatg

SEQ ID NO: 2719 - DNA, 703 bp, Nannochloropsis_gaditana
aaagaaagggcgacaacgacacgtgaaaggccatggcctgaggtgggaaggctctttcgcgctattttatcgtattcgcatcgggaatgcggcctccaaggacaaaggcaaccttggtgcaagaattccgcgtctcatttgaagactctgagacaggatactcccctgtccctttccaggccctaagccaatgctcgcacgcgtgctattaccactctcgtcccattgtaataccccccagcgcctactgaaccctccctcctgccttctcaaccgccaccaccggtggaagtgcgaggaagacgccagcctcggtgcaaatacctttctggagttgtacgttggaggggggcactgggcgatcggacaagctcgctctaaccagtgactccattatctcccctgccacttatccccaatagtcctgccttgtccagtgctcgcgctcagggtggctttcaacaaaactgagacggaagtagtgttttgttcgtattgcggaattctactttgagtgttagacgataaaattccttcttgacgcgatgcacgacacctgtaccacagcgcaaacctccccacctacatcgctgcaactcttctcccacccgctttttcctcaggacacttcctctcgaccaccacgcgcacaagatcatctcctgcgcgtccttcgaactcatcgcggtcaattgataggatg

SEQ ID NO: 2720 - DNA, 703 bp, Nannochloropsis_gaditana
  misc_feature (654)..(663): n is a, c, g, or t
cgtctgtgcctttttgcactctatccgttcggagcgatataggtcaagaaagccgtcacaatcgacagaaatatggagggcgacacatcaggaggtcttttgaggcagtccaccgctgtggtacggcctccgcggcggaaaactctctccccaagtaaagccttgggcttcctggtcgcctcggtgcaagaagaagaagggcttaactcgtgcctccaggacggcgagcacatagtatcgcaagatcagcacgagggcgtggagaaccagcactcgacccgggcgctcccacagcagcgtcggaacggtccttttcaaggcttgacgatgcccaaggggggccagggcccgggggaaggaaagcttggcggctcccgcgcttgggtacccgacaccccccgcgagacgcctcacgccaccaaaagcacggctccctcgtccacggacgaggcaagaggcagcgtcttgtacgccccggttttcatgactcgggcgcgcacgggcgtgagggaaggaggggagttgagggttacacagggagataccttctggtggtgcccggccgcctcctcctcctcctcctcctcctcctcctcctcctcctccttctcgtcgtcgctgacaagcacgccgggtggcatccgggacattacnnnnnnnnnncagtacctgagcgtgcgggcgcttctggcggatatccatg

SEQ ID NO: 2721 - DNA, 703 bp, Nannochloropsis_gaditana
gacaataaatgataaagatgaattttgaaagagaaatgctgatgtccaagctcatcggtgctttttgtaaactattaagcagtcagcatctttgtatcgctgagggatgacaagaacttgaaacttttacgccattttatgacatgcaattgaaatgtagaaccggttttacctctacaaatgtctcagagccgaacagcccatcactatgaagagggcaacaaaaattcgatcacgtccaagcttcgcaaatagcttgatagttgtaaatttcattttacctgtaaaacggcttaaacattaggctgttataaatcgatccttttcttttgccaaagctatgtgatgtggtatgtttcgattcagaaattctccctcacactgcctgtctattttacatttcgccaggattctacgcctcttgtggtataaaatcaaagcttagagaatgtgtacagggttcagccatttgtcagtatctatcgcgctatccatggccttgacacgcgggcacggctgcattggacaaataaatgctttggactgtaagggatggggggaggttagcctcaaatggttgaagttcgcacttgttctctatctacgtcgtgccccgtcattggtctcgtgccgctccgcttctcagttatttgcctcataaaacaatcgcgacacgtacctcttctacagagcgcagcgcatg

SEQ ID NO: 2722 - DNA, 703 bp, Nannochloropsis_gaditana
ctcccttgagttcgaccgatggctgcgccttgccctccctccttccctccctccctctagccctccttcctttcttccctccgaccctccctcttccctccctcttccttgccggcccacgtctccctttcttctcaaccatgaatcttaagtatgccactgctcaccatcctcctttatgaccccatgacaaccctccttccttttcgtcctttgtcacttgcctcctcattttttcttcctctcttttcttcctctttctccttaggacgctcatatgaataaccttgtcctcaccaccctcgattcctccttccatatttggaggctgcgtggtcgcgatccaccggaggcgatggaaggcagggaaagggggacggagggcaatcaaggagggctatactccttggtcaagctgaagactcaccacaatgtacgtgggagcgatcttgttcgctctttttcgggttgtctggtttgtaccctagcctgtcgtacttagaatcatttcatagctgcatttgactcgtttttcaagcgagagactgcaagcttgcgcactccctcttttctgcctcctcgtcctgtactccgcctagtcgcaccttaaccctcaccccagaaccctccgacctacctcctgttgtccttccctcttcccaggcggtctggagtgtttgacacctacctcagaattgggatg

SEQ ID NO: 2723 - DNA, 703 bp, Nannochloropsis_gaditana
ggcaaaaaggacttcataggacacatattcttcccaaactagctcttgtccgactccccgatctactcacatccagttccggtagtacccgcagatcggcaggcaaaccatttgcgtcgactttgaacgtcgaatacgccaaagtagggtagtgtgccatttcgcacgaaaattgggctcgcgaggctactcaggtgaagaagtgtgcgagtgaattttataaggcaataattaagcgagccttggaagacgaatggctgccatgcattttaagctgttcgcacttgaccgtggatgcgtgcgttagtgcgcaccaagaggatgcgccactgcgcgcggccacccgcgtgagatggtgcttatcccgagtgcccggggcccagcgtgacgtcgctctacgccattccttacagccccgtgatccctcccccgcggttgcgtgcttgtccacatgaatttatgtagcaatgtacgttcgatgagatcagtcccacttattttgagagcggaatttctggtcacgtaaactcatttgcaatatataatcaatgcactgatgcatgttgcatttctgcgtcggcccatctcttttctccttcttccgttgaataataatgcactattctgaagggaccacacccgatctcgttaagcctggatatttttatttcttccagtcaggacatagtatttagaaaccatg

SEQ ID NO: 2724 - DNA, 703 bp, Nannochloropsis_gaditana
tcgcaagccacctcctgcaccccctgcattgccgccgctgctagaggtcctccctccgcgcgccccgcgacgttccaatgcctgaacgcgccgttcctcgcgagtggacgggacgaaagtggagaaaaacaagcctactacattaacaagtccccacgctgcgtccataatgctctggatcatcgtcttcttcgccgtcattgtgcctaacccacaggattgacaatttttgcaagggtaaggacgactcctactttggcaaggaagacggagcaaccgcaggactgcgaaaatgcacactgacattggcttcacacaacttaccgtcacgctccacgtagaccatggctgctggcaccgctggcttcaaagagcaaagtaagtcgaaaactcagggagtatatcttctttatcacctgtttaaaaccagaggaattgaggtcgatgaagcatgcaatgcaaagaccagagctggcgtggagctttacaataataaacatacgacttgcttacgccgcgcggcatgtctacctagttaccagagtctgagatgggcgaggcaggcccatgcactccccgcgaggaacgttgatgatcgcggcgacggccctggtggctgcactgaagctaaacccccgtaaagctcaatgaaagccttgatcgcgtacatctcatgacacagagagagctgtgattgtccatg

SEQ ID NO: 2725 - DNA, 703 bp, Nannochloropsis_gaditana
catattcatcatctgcagcggtcagaacgctctcacggtacgtctcaacactttctcgtactcgccctaaaagttcccgctgctgacaaatctgccgtgccgccacaatccacacattgagtatcacattgactaccaatataccgcgataaatccacttggccacttcaccattgccgccgtcgtcgtggctatgctcctccagggcctcgccaatcacaagcaccgtgacacaccccagcaaagcaccttgagagagcagcgcgtccttagccacgaatatgaaattcaatgaaccctgccgcagcctgaggatttcagctgaggtggcgtcgtcgcacacctgacaaatgcgctgtcgggcagtgctccaatccaggcccctgggtggaggcgatgccgtctcctcgctcgcttctggcgcccctccttcccgtgttacgtgtgcctcaggtgtcatgggcggagtcttgccatcattatccctgcagacgcatgccgaacgtctgattggaacatttttgtgtgtctactgtgttgagtgacttcgatcaaagcagcaaatgtgccgtcgggtaattgcctccctgttcttgatcgccgggatctcttcaccttgagggatgcatcgtcatgcaacaattattcccttttggggggctttacaatcgacagccactgccttattacagacaggtaaatg

SEQ ID NO: 2726 - DNA, 703 bp, Nannochloropsis_gaditana
cgcacgacatgaatacttacctcgggggggtagccctcccgacccggaggcggttgtccaccccgattcccctggatggaccagggaataggacgaaaatatggaaataagcacatttgaagcaataatccctggctagatgtgagatgttcttacttgctgttgatgaaaaggcggagcaggtgcactgctacgtgacggaggaggggggggaggcgggggatggtattgaccatgttgttgctgctgcggctgccatccattttccgcccgcaccatgctcaagactcctccggcaagcattgtgatggcggcaaaaggatgttttttgggcagataccttctttctctccttgaaggagctgcgacccctccggatgcgaccatcctgcttgtcgctcgtaacgttcagagaggtcgtccctgcatgaaagggtaccagaggccgtgaaaagtacgttttgttggcatgtatcaagccggcataataatgtgaagcctgcatcagtatttgaggggctggctgacaaattaagggtttgccttccccctagtacctcgatgatcgcctccgtcgcccctccgtcccagcgaggccgtcgtgaaccccctcactgcctccgttccggctcaaaaggacgcattgcatccactgatctcccacaactctctcgagacaggctgtggacaacccattattatg

SEQ ID NO: 2727 - DNA, 703 bp, Nannochloropsis_gaditana
aggatgcatggcggcaaagataagcggcccttcttctcacatcacgcatgacatccgtcgccgcattcggcaccagcagcaccatccttatccttcgtccccacctcctacttcttgtgggatcgagaaaggggacaggccgatactggaagcggggaggccgtgctccaaggggccctgcgaatccatgaaagaccagcgtcacgcgaaccacatgtacacatacggttccagcttgtcaattcttggggccacatccacaggactgcccgcgtcgctgagcctgggcgtcaggcacgacgcaggaggggcgcggccaagccacgaaggcatccccaggagtccgaagcggcctgcctcgacagagagacaacacgccgaagcaagccacgccgaagaagggtcctcacaaatgaacgagactacgcatatgcaagacgacggggctgcctcaaccctaagtcacccgattcaaccggcagcgcacggagggggagatatgtgcccctccgaccacgacaggcagggaggggcaatcgatgtccgaggaacatgcacgcacacggcagcccatctattcgcggcggcttccaagtttgctgccgccaaggcggcccgacgggtgctttttacgggggacgtaaggtggggaggcttttccttcacgatccccccccgcccagcgcccgcccaagcagagatg

SEQ ID NO: 2728 - DNA, 703 bp, Nannochloropsis_gaditana
gcttactcttcttagccggacccgtcgtagccataaatgtacgattagcgttgctgctggtgatgatcagggtgctttggacgcttccgtccttcgcgcgcacgcaccctagagcgcacaggaatgtagcacgtagatcaaagtagagaagaggaggagagtagtcatgagaagccgatgaagtcctgctcatccttgcccgtgcaccacgatagaacatgtcacgcgtcggcactaccacagtattttcaaatacgacacctggcatatataccggtcgacgaggctctttcaggggatgactgtggggttctttcaggggatgacagtggccgtgagagaggaaaaggctgaagcccgtcgccccagttgcttcatatcgcctgatgatacgcaaggagtaccgacctttattttctggactgtcggcacacacacacacacacacacacacacacatacgaagtaaatttatccctgagaccaacaatattgttcccattatcctttacttgctgacttcatcctctccttcgcatggtcacaggaggagcggcggagtcacgaacgaggaggccttcctcattacactccatttgcttcctgtctccccgaccttgtcgcatgccacgtagtcgcagccgaagccgtagccgtagcttacatcgacagcggaagaggagcgggagtcggagcagatatg

SEQ ID NO: 2729 - DNA, 703 bp, Nannochloropsis_gaditana
actcctcgctgtcacttccgcttaacctatcatgcaagtccttgtctttattgctccctcctccgtccctgtctatagcgatgtttcgctccaccatctgcaattcctgcatccgccgcgcttgcatcagcttttgagctgtgaaactcatttcccactccatgctttgaaccgatacgtctgagaagggtgctaagctggcctcaacctctatcgaagaggaagcaagccgggaggttaaaaccctggacggctaaaatcctgtcgatttagcgcgtcggccaaaatctaccttgtcttgatgctcgcgcgagacgttcgttgtctcaagcatggtctatcggtgtgtgcatatcaaagtttcaatccattaaaaaataagtgtgagtccatgttccgttcgcaaagagcactcgctgaacactcatcaagatgcacgtagtcaagacgcgccaggtaattgaagggaataaagcatgtgctttcttccgcccaggaggaaatgccataccattgtgcccaggtagtataagtcctgtccatgcgcaggctactgcttgagaagggactccttaccttcacgacgacccacacggtctcactagcattcttttccgcttgccctccactttgcgtccgtatgttgctaaacatattggctattcgacagagcatgtacaatactggcaacagcgccaccatg

SEQ ID NO: 2730 - DNA, 703 bp, Nannochloropsis_gaditana
cccttaaactgataagatacagtcgggagtcattgaaaccccgcgagcattcaagggctccaccgagtcgactgaatgaaaaccacaatgattacaactgtcttacctatcttgcaaggatgcactgccatcgtgttttgcgctgcagtttcgtcggcttgtaagcccggcaaaagggtggggaggtaatttgaaagtgaaacggttgccctccgcgcccggccgccatgttggacgggatcctttcatcttgcgtaaccagctccatcaagtgaaggaagatcatgagccaccgccacagttccacatatgataccctctcagcatttgtatcgtgggtggagggtgactgtcttttttaggggtagcaattgctaggatatggttgttgaagcaacaccacttctggcccacggcgtcccacccataacgtctgcaaccatgatcctctttctcttatgtccattttcccccctggccgtcgcaaaatttacgtcacttattacaggttgacatgtatggctccaaaatgtcagatagtacattcaacgcgtcctcctctgtgcagatgcctccctctggaacccataccgagtggactgccgataagtgttatcaggacaccatggacatacccaccgttttacctatggcacatcttagaccacgagtctcaaatacagccgcaatcaccgcaggaatg

SEQ ID NO: 2731 - DNA, 703 bp, Nannochloropsis_gaditana
gccttcggctcagggagggattgtaccgaggagaaaggacaggcctgtctgctcatttctcgcaccctgtattattccacagcgcatcgagaagcaccaaacgtccgctgaactagagctggaggatgaagatcaggtgggtggagggggtgttgaggcgtgttcttgtcctgggagaggggggatttgtagtttctcacatgcaccggcctttgctgcacagattgacgtcatgctcgagcagttgggagggtgctaagctcgcttcggaaggcgtgtgaagagggaaggcatatcccttcaccggagtctaagaccagggaggaggatggggagaaagcgagggaggaagcgtgggagggcggggcgtgaaggaagaagggggcgtggcactttgacggtacggagagtagataaggccacggaatggagggaaaagagggaggcaacgttggagtcatgggacagggggagagtccatccgggagggagacttgcaggggtgtgtgaaggcgagaggcagagcgagaggatgtgcgagtgatagagaagggaggaaagagagattgcccgtgtggaaagtagagagagaaagagagagagagagagagagaaagggagagagagagagagagagaaagcgtgcggggagacacagcctgggaaggagcgagagggagagagaggaaaggaagggcgaatg

SEQ ID NO: 2732 - DNA, 703 bp, Nannochloropsis_gaditana
ttaaaaaggggcgtgacaaaaaggacaacgatgtcttagcagtaagcctgtctgctctctaaggcactccatcagcccattgcgtggacatgaatgcacgcaccctttctcttgcagacccggcggtgcgctttgcccctcagcgtatgcatatggaagcgaacccgctgtccagacgtgatggtgcgagtcgatgagcctgtagggaaatccgtccttattgctaaccgagtcgacagaggaggttgatgccatcctcagcaagtgacgcggcggctgaatacgttggctgagtgagaaagcagaggacgagtgcacacgagacactaaggcttcgacaaatgtgtttgtacggcccagtgtcaacaagatcatgaacagcagtactgtgttacgcggtggctgcagagtgcaaacgatggggaagtggcgaccaagacgcttgagcatggaaatgggcgactatcacctaccacaagacctgtcgcagggtctcaaacgcacaaatatgtcccttaatgcctgtgtgaccatttggggggggtgagagggtgtcaaatccatgcaaattgaagcttactgggattggacgtgctctcgctcatagaccgtgtagaaagcagcccccaacggcccaacgctcttcgactgagaaaatggcgtttagaaaattcaacttcgtataacgagccatgtattacag

SEQ ID NO: 2733 - DNA, 703 bp, Nannochloropsis_gaditana
gcaacagagcataaagaacaagtttacacctcaatgttggacaatattgccaactcgcacggtcatattcttttgtcggaattcgctggttttttatttcgttagcgctcagaaataacccgaccgctcgatgatgttgcccctccacctcctgcgccccaacaacattttttccacaacgcatagtatccattgtcccaagaccgacctaccaatgcatctagaaatatcaataatttagtgtgccacagcaagagaaggtgttgcgcatcgtgcggcccaaaaagggagttttaaagggggaaaaagggcgccggatcctgggcaagagagtgacgtcgctgtcaagcctgtattgaaactgcaggcttagaatccactctccttcccctttccggtcattgtcttgatcttttgggggtgccaatctttgcataccactcttaaactcatgtatgtcgtagcacactacggtattggcgtgattgtctgagtttaagaccttagttttggttgccgcgttgatgtcggagcaccgggcaagagaatctctctcgccttgcgcgcacgtgttgcctagtatgtcggtttccaaccctttttcaccatcagctcgtcttgcgtcgaaatttttaccaggacgcctccagcagtcagcattgttatttgacattgttgggggtttgcttcttgctgcaaaatg

SEQ ID NO: 2734 - DNA, 703 bp, Nannochloropsis_gaditana
gccgaggacgacaccgcacgaaatgctggacttcccacgaccgccgccgcaatccggcgcccggcatgttgctgtagccgtagcatggtctatttacctgtggtaccgttcaaaagagtacgaatcgtcgaatgagaaagcaagttaccagcgactgtcgacggaggggcgcccactccaagggaatctcctccctcatcgagataaagccagaaagcactgcccgtgtggccaaacacgcaatagcatgctgtacagagacaaaatctcactcgatcgctgccttttggaggggcatgggtgtcaatcaagcctaaaaaatgggaacgggaacatgcacgctgccccacgtcagttgaggttaccctttgggtcaggggtaggagggcaaggggcccgaccaaatctatcccaccagaccaaaaccccaacacaatcaaagaatgaccgtgtcccacgcaaatgaccgtgtggcaacggcgacaagcgcggagtacatgtcggtgccttgcatgttcgccgtggtggtgatggcggtgattcatacgacttttgtcccttccctttttcctgtcgctgaagaaacttgaaagggccccgccatcagcgaggcttctctgccctggaatatattatcatcctacccgtgacacgacccacatccgcaacgacagggaactcaaaggagcaaattgaagcgatg

SEQ ID NO: 2735 - DNA, 703 bp, Nannochloropsis_gaditana
gtgtgtatattggagtgagaccggccgcagccggaaaggaaggagggtggcggcgatccatgagctagtctttggtgtcgtgtcgcgctgattgttcttattttgggttttgcactcgtgtggggcgtggtgccaattttggggtatgatacattcattgcagcatgcttttcgtcaccgttgacgcctttcattgacccacaggtatttgtgaacacgcactgaccgctccactcgcagcttgaaaggaaaccgcgcgcttaggcttcagaggatgaggcggcgacgaccgtcatggctctacagaggcatttccgccttttcgacggtgatgctttgcgtgaatgtggtgcatgccacaccatcaagagggttctcgaggcatgatttgcctccccacagcaggtaggtcggaacgagaaagacgtgtcacttaaagcaacttgccctcaagcaagattctccagagccgggatggcctcttttatgaggacatgccctgtctgtacacactacgttcgcgcttgtccgttcttttaaaatgcacccctgtctgtccctctgtctgaacttgtttcgcaccccatttcccatgaaacacagcgcgttcatcccccgcctccccgtctcaagggcatgccaaggacccgatcgaggccccgccacggacaaaaacaccagaaggagcagcattcgtaagatg

SEQ ID NO: 2736 - DNA, 703 bp, Nannochloropsis_gaditana
tcccacgcagcctcaagatgcttcatcctgggccttcatcttcagatttcctcgtctcaaggaggaggatgcaaggagatccaccacaagtaatttaaattagcacgtccggtcttgtttgcgagcgtctggtgccaaaagtccgcacgaacgccagtacgaaaaaggacgacagcgcatactcagcccaagtcgtctcatgcgtcgatatctacgttattctccgaaaaaacaacgtctgcattcttctaaagcccagggcaaagcgtgtgtttttcctcaaggtgtctgtctccgaagcagcgtcgaggtaaactgtgacgtcacaggctccaagcgccttcaaattgaaaggaaggctttgcctgttccccacatcatatcctccccccatctatcagatcagagcggggcgaacattgataatgcaacggctagggcctcatatacgttatgcgggtggcatatcggtaatcttcctgggtccgcgtgctcccaaaccggactcagcgacctgcttgctgttgctgtttctccccggcgagcagtatcttctgctgttgttcgtatcatgaggctccacgttgcttgtcagtctttgatgatgctcgtcaatcacccacttattgtcctgtaagctcgacaccagacttctaatttaatcttttactatgtgctttcccgcgcaaaacattttcgtagg

SEQ ID NO: 2737 - DNA, 703 bp, Nannochloropsis_gaditana
tgataatgcaacggctagggcctcatatacgttatgcgggtggcatatcggtaatcttcctgggtccgcgtgctcccaaaccggactcagcgacctgcttgctgttgctgtttctccccggcgagcagtatcttctgctgttgttcgtatcatgaggctccacgttgcttgtcagtctttgatgatgctcgtcaatcacccacttattgtcctgtaagctcgacaccagacttctaatttaatcttttactatgtgctttcccgcgcaaaacattttcgtaggatcgacctttctcccccgcagtccatcgcacctcccgtgcttggcccttttctgtttcatcgacaaaacttattccttgagttttgaatagggatattgtatattcaggaaccaaaattaccgctagagatggcgaatgccttgatttttgcagcacgagatggggatgtcacggaggtgcgatggcggctcgaagccaaagctactctagctacctacgcagatagtcacgggcagacagccctgatgtgggctgcggttcaggggcacaccgaggtggcgcgctgtctattggatttcggggcagctctagacggaacggaatgggaaatggggcgcaccgccttgtacatggcagcagggcggggccacgtgactttcgttgaactcctcctctcgagaggggccaaccctagccta

SEQ ID NO: 2738 - DNA, 703 bp, Nannochloropsis_gaditana
agggtatcacatggttgacagtgcaaaatatgtcccatccgtcgaccccacgcgatctaattcctttttcatccaccagacctacacgttgtgcttctcaccttgctgcattacaactgagagtcgcaggaagagagctcgatggcggggtcccaggtattttaccgggggctgcaaccgagggccttggaggaggaggtgtgccaaatgcagcgagcgatggagggcgatggtgccgcggggttgcgaaaagagagcccgcggcttcagtgtacatgcagtagcaaaggatgagggctaggactgagacaggtcgagagccagaggcgaggggtcgacgccttttgtgtcctttaggcattcgatcgagaggaggcggtgacgtaatgacctcacgtcctcgccaaggaagcgtgtacctacgcggaacaagaatgcgagtgccgcacgaagatgaaatcaatcgcaacctgcgtcgggcatgtataaaattggtgcggtgaggtgcttcgatggaagggaacagacaccggggaaaggtctggaaaaacaaatgccaaggcaggctgggagggacggcgggcatgcgtcgccgcgtgagacgggacgtgtcacgccccccctgatttttgccagaggaaaatgggggccgccggcggaccaaaattttgtcccatccttctttcttctggtatttcccata

SEQ ID NO: 2739 - DNA, 703 bp, Nannochloropsis_gaditana; identical to SEQ ID NO: 1340

SEQ ID NO: 2740 - DNA, 703 bp, Nannochloropsis_gaditana; identical to SEQ ID NO: 1342

SEQ ID NO: 2741 - DNA, 703 bp, Nannochloropsis_gaditana
tggaggtcgaagaaagtaaaatattcgctttcggatgcgaaaaaagaagccaaaaaagtgtcttttcgagacatagtggtataaaaaatttaaaagtacagcccccccatgcgtgccggtgtcgcattgtagcacgtgtcagagcccaatgaccagtctttggccccgcgcatggggcctccctggggccctcaccatgtgggtgtgggcgatcccacgtcctcctcgctttgaccacacgcccgagcttcgcgttttcccacaccgtagccgtccggacggccgctttcgggtctgtggtttgggggaggatggtcgtgttgaatgtttgagacgtggttttgtttctgatttgtgagcactctacagtgaatgatacctctttggcagtttttgagaacgggctggggttaatcgttagaccaaagagtacgcgcgccgtttaaggccaactccccggggatcacgccggtttctgcccttcgaatcaccaccctgcaaaaatctcatgcacactcacacccatgaccaatttacgtgcatacagtattgaacgcatcggttacattctcgctgccgctgatcgcggcaggctttcggaggaaggatagtagagtcatcacaattctggccgtccaggttctgtaaacacaggctttaaataagcctgatattcaagtctacgtcgcgctcgcaaatgatg

SEQ ID NO: 2742 - DNA, 703 bp, Nannochloropsis_gaditana
gtggtcttgaagaatgtattgatatttgatttagaaaagcatggaattgcctaataatgtctgatatttagaaggcaggcatcatgattgaaaatgcatgtaataatatgattgtcatgaattgtggcaaaatgagccagaaagcgaggggataagagcaagttgacttcagagctatccgacgtccgagtgaagttgtttgggaatttaatcgaacatgcatgagttcgaattcgtaatgaaactcgtgtaaataatgatgcaataaattgtcattgtccatgggaaatatttgcgccttctttgcattctataacttatgtccttgactcaaaacatctgcggtctgtcactggtcgctgtactggcccgtggtccctccttccagacatgtgatacctaaacaggtatgtcgcgcccaattaatccgtcatagaacgaagaaatacattgtacgcaagctgggccggaataagttcaagtcttaaatcggcctgggtgggcctggctgacgtacccccccaaggagtcgcttaccgctatcgctgccctcaaaaaggctttttcacatgacacgtaaaagcaggaaacttggcatgctcggaggaaaatttccacgcatgcaatagaattcatgaaacatcaccgctcgtatgcacaccatgttcatccaagccaatatcaatacgcaacagtggtgatg

SEQ ID NO: 2743 - DNA, 703 bp, Nannochloropsis_gaditana
ttgtcgtagttccagtggctgtcatcatcgtttacgatcatacaacagtgatacgagcgatgacagccatgattttgtgcgagttaggacagaagtggctatggtagctacaacttctcacaagctcgaaaggtcttccgggcattgcccttgttcttcacttccccatcctcctctgtaagcacatgcacagactcgagcggtcgtaagataatcttatatgtagtagtttgctttgacccatctcataaccaggtaaacgtcactggctgatacaggggaaatgcaggccgtcgtggctatgagaaggaggaatgacgccatgatgatacagacggaaagatgagaataatgtgggattttagagccactgaccaggcttgtgcatgatatgtcagctggaacgtttttaattgctgacgattaaggctttttagctttgttgagctgctaaacgtcatgcattacagtgcagtgcacgtgcgacgagtcgaggatagcctgttgctgctcttgctgttttgcacacttacctgtcttgatgcttgcatgctacgtggtagtcactgtaaaaatcggacatttaaaggactgtacatgtagtctgttgcctgcattttgatcatcaatcatcgattgtcgcgtgttctcaagcgggcccttctaatatccccactcaagcacgccagggggcggcagaatg

SEQ ID NO: 2744 - DNA, 703 bp, Nannochloropsis_gaditana
gtcctcacgccgcagtcgaaaaatcggcatgctgaaattgacgcacgctttcgcgcacatcaagaagcccgattgcaagctcgcaaggacacgaaagccaaagaaaaagactttaaggacccaaaggaatctgtagggtatttttggacggatttccgtcgggcgtatgacgacgtagttcaggtgttgaacgcgctgctttcggaagaacatgcagatacgaacatctcatctggccctggccgggcagataatgtggacgacacactttctcgcatggataccaaaatcaagtcccttgaccagttggtctcaaatactgccctttttctgcccccgtacgacgtgcgacgggcccaggaggaaacagagagcctccgtagcaaattggaagaagtgcgcacagcgctgatgcctcgtaaaagattcacttttgcaggacgacggcgcacggcaagcgtcacaagctctttaatggtgagtgagggtcacgggcgtactgacatggtcgcagaggccggagggagggggggaagcagaccgagagaccggggggccctggataaaagaccggccacacctaccgccccattgcctgcggtaccccccaaatatgctgcagatgcctccctgtccgcggcaggtgcgtccaatttatcaggcgcaatgccgggttttggtcccgccgcagacgccaatttta

SEQ ID NO: 2745 - DNA, 703 bp, Nannochloropsis_gaditana
atccacggtcttcttcatctaagcaacaccattcccgcctcacattcacgcctcgacccttcccattcaggggggtccggaggcaccttcgaaatggcgggcttccgacggttttccgggtggccggccttggtggctaaccagtaaggtaagggaatagaaagtcttctctggatactagctttgtcatgcagagagagaggagggggggggttgacgcgggtggtagacctctgagatggaaggggaatggtatcctttggccggaggaagaaaaggaggaaggatccgatgaggagaaaaggaggagcttgaggaggagaatatgtatggaaggaagggcttgggatagcccgggacagagagatgtgtgcgatggcaaggcaggcacgggaatccggcctcggcactaggcttggtcgcggaggaacacagtgtgggcagaaagtacgatggccgagcacgcgtacaggcgaaaggtcgagagcttggaccggacaatcagatgaggagagaagtcgtggtcgagggaaaacactccctcgcggtccacatcatcccgaaccacactttccagctaatccttccctccctcttcctcgtccctcctcggaccttcctttgatcaggctggatcaccgctatcttctccctgggcagcatcgtcggctcgctcccctcgggcttcctgaccgacttcatg

SEQ ID NO: 2746 - DNA, 703 bp, Nannochloropsis_gaditana
gaaaatgtaggagaattcagaggcatctggctggcacatttcgtcggtaatgcgtccactattacaagtggaacgtagcaatgagacattcagcccctgccttctttatgctaagtaactacgcacagcagcacaaaagaagagggggcccgctcgtcattttcgcagaatcagctttttcgtgcgtttgctcatccttctttctcgtttttgatccattgaggtcgcacacagtagagcccagcacacactatctcactgactctcatcgaatctcaccacactcttgaccctgttcgatatactcgcgaagtcggacgccctagcaagtaatgtagccctgtgtccccgtgcggaaagactccgaaaatctggccttggggacgtttcagcgacccggagcgatggacacgacaaagcaggagtaatgccggccaagaccttccgcattacaaaaggacgacctttccaatggcatgagtagtcctttacatgatgttaggtgcgtgggcagtgtttgccagcctacattgtcatcgtggagacggctgtaaagggagaaagagggctgaaattaacctcctcactgtccgccccatctgtgtgagtgttcctgacgagttcaacaccctcgctttgggatttcaaactccctttgaccacatattccataaaatttacagatttatcggataaatcgatg

SEQ ID NO: 2747 - DNA, 703 bp, Nannochloropsis_gaditana
atcaccccgaatttttcacacagaaaacgcagagcacacctctcctctcacttcctctcagtgttcatgatactttccggtgcatatccggtgtgctaagggagtagccactacggtcatcgtctggtacttcctcccgctccggcctttttctttcactttccactctcagaccagcagccttttatcgaatgccctggccttttctctcagccatgccatcgctgcattttgtgtggcctcgtcgtcgtcgccgcaggccccttttcctgacatgaaatttgtggaaatatgtacctagtggtcggccgccttacttgttctgttggttttcatatttgagagtaacctccctccacgctgacgtcgaacgactcattttctgggtatagggagcaccggcgtcgtgcggggtgcggctgtgagggcacgacagctgggcgtggcgattaggtgtcggggaaaaaaggggggatcatagtaaggattggggagctcaagtgccattcagtcacaaagtagcgaagaaaggacggaaagcgtccatatcggggcgaagtcaagcacgcaacaaatgtaccatggcttcgaggccgagtacggcggggttggcgaggagctgacatatcctctgtgcagggaagaagaaatggacacacaccccgcgctgggtggtcccttagatggggtttcaacagccatg

SEQ ID NO: 2748 - DNA, 703 bp, Nannochloropsis_gaditana
ggagacaaaggacaagcgccgcggcccttgccgccctccttctgtgcatcttcaaccgcctagactgggacacagtaatgatgagaagtgtttgaaacgaggaggcgcgaatcagggcagacaagaattcgatacgatacgagaaagcgttttattctctgcgtcctatgcttgagatgggccctcggttctttttattactgggggcagagagtacggagacatcgaccaacgagcgctctagaatcacgccgtccacttcagaagtgtcgctgcacgcaaaaaaatctgccacacacgcatttaagccgtgatgttcccaaattcccgtccgtcggctttactattcgaaatgacagctctctccttcttcatgaaaaaagcgagccggcggtggcgagtctttcgcaacccaaaaacccagcgggcgggccgcaattactttgcgcccccgggaaacattagatgaactgtacaatgcggtattggcagcaagactgcgccacgttcccgagggttcgtcctttcaaactcgtgaacggatcattttcgatttacctcctgcctcgccccattgacgtttcctactagtagtactacaacgtcgctgagaaaggcgagtctccaaggccaatgtgacacacgcaaaaagcactcttaagatgcgacttccgtgtcgattacgcacacaacgcagggaatg

SEQ ID NO: 2749 - DNA, 703 bp, Nannochloropsis_gaditana
gagcatcttgctgagcgcgcggagaccacactgaggagtaattggcacatggattgttgtcggacatgtgcattgatggcctcccagactttgcatttaaattttatccccaaggcccgatttagtaatttgaatcgccaacttttaaaagtccatttaaaatagatcaatgagactgtagagagaggaacgttgggttggcggagcgtagcgctcaaaatcgaagcggtttagaggtagcttgggacgaatgaaagatcgatagggagctttatcctttttggacgaataatcgtaagcgttattctgaaggcaacactcctctcattcactcatcagctatccctggttcgaggataagcgctcccacagcctccgtgtaccacggtcaggggacctattcttcgtttagtatcatggcatcttctgacgccacgcgcccaagacgacctcaaccacaagtctgggcaacaagcgcggcggcagcggcagtactgcccacttcagtgaatttcgccgttggcatggccagcggggtttctggatggctcattgtccatcctgccgacgtcgtgaaggtaaaaggagcgggtgggcaatctcgtggatagtgagcttggtctttgtcgaataccttgattgtgttcatgttatgtcgatcgcgataggtttcttcccttttccgcccgaacaggtacgcatg

SEQ ID NO: 2750 - DNA, 703 bp, Nannochloropsis_gaditana
actgagcgggcctgggaggggggggacgccggtcgcgagggcattggccccgacgtcggggcaggggcaggaagcagcagagggcgggagggagggcgggagggagggcgggagggagggcgagtggcgggaggaagaggaggaggcagccgcggggctctttgcctccgtccacggctaccccgcctcctcgaccctcttccctccctccgtctccgcccgctcgccctccgtccgtgcgcgccggcccccctccctcctcgcccgcctgcgtcgctgcctgggccgtggcctcttctccctgaccgccgctttccgccagtgcttctccgacctcctgaccccgcccttcttcttcctcgtggtcaccaccttcaccttctacggcgccttccagccccttgagaccttcgcggtcagctacttgaaagcccaccagggctttacctccacgcacgcctccctctgcgcctccattctcccctccctctccgttctcctctccccccctatgggtgccctggtcgacaaggagctggcccctttctcctccgcccgccctcgctcctggcgtcggacctacctgtggccccccggctccacgctcctctggtccatgctcctgaccgccctcggactcgtctgcctcctccccgccccctcccaggccctaagctggatcccgggcttcttcctcgtctcg

SEQ ID NO: 2751 - DNA, 703 bp, Nannochloropsis_gaditana
gtctatccctataaagatacgaagacattttccatgcacatttaatggccatattttacccatttgatatcctttggacatagcggtccccgtgaactgtgaaattcagccgttgaattggcccatattgtctccgtcggtaaaagacattacaattctttggtcatttttccatctcatcacgggcgtgtgaatttcattttttccactttgcgatacgtactttttcataggttcaaaacgaagttttttcgacgcaatgggcacgattgactgcgacacgaggacgtggccgtcgagagaaggacctggtattcttgtcgtcagcgagggaggcagagcgacatgagaagccccgagaagtggaagggcggaaataccctatgcatcacacgaaataatgttccggggacgcgcttccaccgcgcgtcaacgcaagagtagtgtaatcgactcatccattgaatgcagtcgggtgatgttctgcaaattacctgtatttctggtgattttaagcttttcatgtcctccacctccccactcggggactggccctccggcgaatgttacatcacatctacagcttcaccttcatcggattcatgcaaaagtgctcacggctatctaccatctcccatatataacaaaaacaggatttgtagcgcaaccacagaggtggaagactgtagcgtcactcagaatg

SEQ ID NO: 2752 - DNA, 703 bp, Nannochloropsis_gaditana
gagactcacgaaggagaagggggaggtacaataaacactcacctcgacattgatggtgcaagggctgcttctgccctgcccgtggtcctcctattccaagcaatcccggcccactgaatccacgcgattgaaaggccccaacaccggcacgattcaatgcatacagcgtcctgatggcccacaaacctagtaaggaggagcaccgccgcttatgcatcgctttctcacgcgtcgtcctccccacagccactgcggacggacaccagcgaaaaatggcacagtagggtactcaaatcttgtaaaggtgtgttctgaatatcacattgttacataaatgaatgtagaaagagtactccatcattattgatcgtgacacttgcctatgcattacgcttcaactttcaccgccaccctcaattttgtccagccccccttctttacatcaagaaaaaatcaacgttgtcagtatacactgccgtccagcaatgagccgtattctgacgaatattgttgttttgatgcctcttgagtgctacagctcgcattatctgtcggtgttgggctcatattgagcggcagtacgctcttgcagtcagagtatcgccgatgcctggagggcacttcgcatgtgtaccttgaatgacacaaatgtaattttaacccgctcccacgctcctcacacgcagactcgacgaaataaatg

SEQ ID NO: 2753 - DNA, 703 bp, Nannochloropsis_gaditana
  misc_feature (329)..(338): n is a, c, g, or t
agcccgctttttcctctcttgcttccttgctagattcatcattatcgtttcccccttctccatccattgtcccttcctcctttccttcctcaggaatttgtacggttgagagtctcacggatgagatagccgccatgatccagggggtacgcgggctttgcccctcttttcccccttcctcccttactccctccctccttcccttgtcccagtctcccttcccgccctccttcttcctttctccccttccatccttcccataacattcggtctctctttggaattccatgcttttactctgtgttctggtcgcctcgtcactttctacnnnnnnnnnntgcgtgcttgacttgatttttaatggcttttgtcttgtttttttggatttggtttgctcatgccatctttcaatggctagattttaaagaagtcgtattcttaatatttgaaaatactttttgtgggctttttgtaaggccaacgagcgcgacgccataaggtactttgtctgactagccttattgttccggaagagagagagaagaagacacaccataaattataaatctgttaaaaggacgtggatctgattatcaatccacatgtcaccgttttcaaaatccttcatacttacattagtccacctactttctgtctcactcaggtctcaataaagctttcatccgcaaaagcgtcatctatg

SEQ ID NO: 2754 - DNA, 703 bp, Nannochloropsis_gaditana
gaaatgggaaatgggacaattcttggaagaacgaaatgggctctgcgcacaaaaaacttttcaccttcgcgcatcaaaattacgggctcagagtcgatccaccctgaaagaagcgccatccatgcatttttctctacttcatgtccatcacgtgctccaaatttagagtatcgtggcttgagacttactttaccctggtgctattcactggtgcatgggccactgatgtcaccccaaacgtgtcagtctcaagtaggaacacataccgtattcacattaaagcgatgtcagaccgatttgtaatgcttcgattcttatccactatctaggcaaagaccatacaagcgaaataatttggtttgttttttttcttctcttttttttttaacctccccgtaccgccgcgcctgcggcgacgcaaggctgccctctggatattacgggatcgtagacacagagcactgggaatacttttcatctccttgtcggactgagttcatcgtggacagatttttctacaaaataggaaacgccttgggaaactttaagagaggtgaaattattttgagttttggagcctccgcatgccttccattgctttacaacaaccttcaattgccccatacccgaggacttttctatttaacagcgctgtcttttttctcactcgtacgcaatgataataaattccaccgcatctagg

SEQ ID NO: 2755 - DNA, 703 bp, Nannochloropsis_gaditana
catagccttccaggtaggggggaaagggaagagagaggggtggaggagggggagaggatgcctgggaggacggaacggactcttgccgatgaaaggaggggggagcctgcgctatgtccgcatgcagtgaggggacagatggtccctccgtcgtgcccgaggcgcggcctccttctcctgcccgggcgtcgccactccccggcgccccttctccctttggcctccgtcttctcctcccgaggcgacccccatcttttggcccgagcgatgagcgctctcccccgttccccgctgactacgtacttcctcccctccctctctacttcccacctgtccctcggggagtgaggcgtggtagtaggcacaaaccaggacttcctccttgtcccaatcccacccacccacgggaacgtcgtgaacccccccgctttattcctctactttccccacagggagacggcgctctggtcgtgactggagactatgcgggtattgggcatgtctgggacctacggtccgggaagagcatctaccagctgcatgtagggccggggggaggaggcggggggatggggagaaagggagggagaggggagaggatggggagaaagggagggagaggggagaggatggtttctggacaggcgcttgtgtatgcgtgagtccgggtgtagggaggtattgttggctgagctgtagcgtg

SEQ ID NO: 2756 - DNA, 703 bp, Nannochloropsis_gaditana
cggacgcttgaaggccacgaagggcgagtggtaggagtggactggacacccgacgggaggcggctggtgtcttgctcgcacgacaggaccttcaaggtctgggcggatagtaaagagttttgaacagcttgcatctaaagtaaacttaaaaccactggcaaagcaatggatggaatctcctttcttgttgcgggatgactctttctttaagtttgctttgtgaggagctgagtggacgacaaagtgctttgcaggacatcttagtgaggaggttatgagaggagataacattacccaaaataaccaatacgacgcgaggcaggcgccttccatcgcttagatatgggctattgtttgcatcgttaaggaattacatatctttatgcatgaaaggcgtgtatttgtgcatgacagactcgtaatgcagggcaggagagagggctatggagaagacaccttttgaacgaatgctcctgcgtgcatacccgtatgacctacagtgaagctcgaggatcctattccaaagacctgacgacgccaattgtctccttcgactcactagtagagtcctttgccaacctctacgggaaaacgggggacactggttacagtgctcgctctcacagagacatcttttccttctctcccctcctccccatctcacccgcaggagagacgatcgtcgattgacgggtgcgccatg

SEQ ID NO: 2757 - DNA, 703 bp, Nannochloropsis_gaditana
gcggaaccatcgtcgtcactcgataatcccgtgcccgcctcgagcagggggggttgcctgtgtagcgccagacacgcacaagccgaggcgagggcagcgtgcgatgttccagctcgtgccagccgtcccctcatagcctgtcaaacataggaaagggacggaataagtgggctacacctcgtggacacggccaggcgttccgggtgacgacggggtcgacgcgagatcgaagcagaggaggtgggccgtaggggccgaggggcatttgttacgccgattttttcacgtgactatgtcccttgtccccacaaacaggcaggcccccttctccttgttccgtcgtcaacctggtggattccgttcttagctccggacataagaagttccacctcaccgggtgggctccctccaactgcccttcaaccccctcaatcctcgtatacccgcccttcacattggccaaaggatcatgatgcctccgcccccatcatctgcaagcacgtcgcgttctgttgtgttgtccctgtaccgagcgtgcttgcgatggactcaaattcctctggtggtaaaaagcaaatttatcgcgggcgaccacctcccctctactctcgctgcccttcagctttcccctcgtctcctgacaaataaggagggtattgaagaagccattcgcatgctatttcgagcacacgccaaagaaatg

SEQ ID NO: 2758 - DNA, 703 bp, Nannochloropsis_gaditana
tccgagggaaaggcattctcctccacaattattttgcgtcgaattggggtggggcggtagaatgtagcaagcataaggtggatgttgaggctcaggctgttcatggccacaacttcatgtgaatcctttgctccaattattgatgccaattcatcaagaactgattcatctacattggcgaaaggcttgcgcccccgaaaccaagaagtcacaccctcttgtccccatttatttaagacctccccgacgtcgtctcggagacgccggggttgaagccccaagctgttagtacacaaatagattgcagagccgttcaaagggatgataaactggcttctgaaacagatgtttctctcatctaaagcgtttgccaggcttttgtcggccagattgtgaatcccaacctcctgctgcaacttggccaaatcacgctcgtacgtcctcgtgacctccatcaaggattctttccgatgtccctggttcaacgagctctgtaagatacggtcaacatgtatcttacaatatgctgctttctagggaggaaccaaaaagaagtttttgcggcgtaaggttggacgtcgcatttggtaacccggtaacctcccctgggattgggtcgtagctaccctcccagaagtaacgggttcaagcggctgggcaactgagaacgtaaacttgtctcatcctcccgctatatgataca

SEQ ID NO: 2759 - DNA, 703 bp, Nannochloropsis_gaditana
atgctcgcctcgagcatggtgatctacgaaggaggtcgtctgcacgccatgaaggaaatctataagatgggggatgagcaaaaagtcgcacgttgggcgaggcggcgcttaagtgcacgaaagagcattcgacattcagttctagtcaatccttttcgactcgtaaggcgagaaatcgttgctcataccatgatgagcattacgctaatatttgtgatcacttctttaccctctcctattcgaaaatagctaagtggaaatggaagagagcttgacgggtgcagtatactatcaaatgtaccatagacgctcagttacaagatatgaaaggtcaggaaatcgtgtatatacttgtgctccatacatgttgacgggacgtcgctccaggtatgaaatatcggttgtaaaaggcggacaaaggagatcgtgcgaggggtcgggtcgacgaacacagctgactcgtgaatggcgtcatgcttttccacttgaacagcaagtagatactgccccgggtggctagggtgtgtggcgtgttgaataaagctacgacatttcatggcctgattccttatgattcttcaaatagagttttattttttttgccgaaaacgttgttaacgccgttcactcttacataaatataccgcatttcgatgaagcagaaacagcccaaacaggcgtcttataaaatcaagtattcatg

SEQ ID NO: 2760 - DNA, 703 bp, Nannochloropsis_gaditana
gataaagggggatcaactccgctttctcaccttcgtgcagcgctttgaacggggagcctaagctcacattaaatcgctagggcatgtcacaaatcttaaaacgcgataataaatattatcgacaatgttttgagcattgtctaaaagtatcgcttactatgttgaaagttatgctaaacaactgatttgccatgaaattggatctacgttattcctcctcgtttattgacatagataaggtggctgttaagctttttttatgacatgtcattgtcttccagtccagcgttttcgtatagccaaataacgctaaacgagttgcaaggaaataacctccccacccccttgttgccgaaccgctcgcttgcacaaagaataggacgcctgtttctatttatgcgtactccatccgtggaggaatgaacaaaaatgcgagagtttaagaggtttgatagcatgaaaatatgttggggggcaatgtttgagctttcgacgtacttggggcaatgcacgaagtatccagcacgctgacctatccctccctctgaatcagcacggacacagcagtagcaggcgcgggcatccctcacccttaggttctgccaagacgacacacatgcatgtgagaagaagacagcaactgggttaccctacctctttctggtcgttcccgtcgttctttcgcgtgatagtggtcgtcatg

SEQ ID NO: 2761 - DNA, 703 bp, Nannochloropsis_gaditana
ggctcccaatcatctttgcgctgtttttcaatgttgtttccaatgcccgctcgcaatctttttcagtcaattggtaaagtttgtcaagtagtgcatcgcaggcatcatggaccatgcggactcccgccacggccagacccaggtctatggccggcagcattacgatcacatcgtcttctcttgaagatttctccattcaacgtggggtcttgataccttttaaaattggctccacctgagaaaaccgtccccctgctatagaaatgaatcgggccgaccgaatgagttattgcttttcgaactgatgggtcggcaagagtgaggtagccagctccttgtgctgcgtctggaaattcagtgccacgaacgcttttcaactacctgtggcaaggactgggcgaccttttcagggatagaagttcttcctgcctgcgtcgcactgctgtaagcgatagtcggtggctggtttgctgggctcaggaccgtcctccttaggacaaccgtgtttttcacaagataagaagctttccacaactcacactcactttgtcttacccaccagtcctgctcaggacgtgcattaggcgactaagtccgcgggcgcctcgtcgtcaccgtgttgttttgtcgtccacccgcgggtcctagctacagagtcgcctccaacctcctggctggtcagcacaacttcacttaaaaaatg

SEQ ID NO: 2762 - DNA, 703 bp, Nannochloropsis_gaditana
gtacaatatctgaagctcgaagccctccatggccttgatgtgggcttcgatgccttcctttccgtcgcccggccgaaacccctggatggccatactactgctaccatagggacagctcctcgttcgaaggagtggagggaaagctcccgtcacccaggcccaagagcggctaagcatatggagcgcgaatagaagcaagaaaatcttgtatagtatactgttacgcggggcgtccatccaagtggcgcgagaagaaagctttgactgggggagtagcactcctagtactcctactaaagtagggggggaggttggccggcctgtcagacgtgatgccgacacactcccaacaatgcagtgttcggcccaggcacgtgttccctgtgtatgtcgagtgctaaaggatgattatggtcgacttcctcataggataagcatgtgtatagactttcaaggtttcgcctgtgaaacaggacgcatgcgtggaatggaaacaggcaagaggccgagcgccttgctgcagcctcgccgctttcactgtcaacccaaactcaccatttcaccctgactaatgactgtgtgacgtgcagaagtagggggcgacgccttcctgctgacttttggggtgagaagacactggaggcctgggcggttgatctgacaacagcgcagaggcccatcggccccgttgtattccgcaatg

SEQ ID NO: 2763 - DNA, 703 bp, Nannochloropsis_gaditana
gtcttcaaagagccgcgtgatgccttttccgaaggaaatcacagcgggtctttccctcaatcctgacaccttaccactttccctgggaggaaatgggagccatcgtcgtgcgaccaagaaatcgtgtgagagcatcatcatgtgccagaccgtaaagtgcttacatacgggacaggaaaaaaagccgtaataggcgtggtgtgctatggttgccatctttgtcatcgcgagcccccccctctctcgctcgagcccccggcccgggttgttgagttctttaatcatgtactccgaggctgtcatccctcaaaaaacgcaggcaaaaaaagaatagctggttttaaaagtcagccatatcgattcggtagacgaaggtggctgatatggcacaattgatttccgtgtggggcgctgtgttgagttcagccgaggctccctccacacggcttgccagctcttccagcgaggcgaggtgatgttccccgcgcacgagacgaatgacttcgaatgctcaatcactgcaatgtaaatttgttttttgttcaaaatctgatgaataaacatacacttcatttaatgccagttatgtcacccaaaaatgcccaaggttgacaacgcagatcgttttaacctccccacgcctgcagaaaatcgttttccaatgatttcattattcatttctttacttcgacaggaagaaatg

SEQ ID NO: 2764 - DNA, 703 bp, Nannochloropsis_gaditana
tcgatgcagtgagggttgacgagccggtcgctccctgagagggtcttcaacaggagggacagcttctcagggaaatatgccgaaggagacgccatggccgtcgtaaatatcagtgatagtgtcaacactattcctattttgctggatggtacataaggaatggtgaatgcagtgacagggttcctcgagacatacttgaagagagacaccaacgggcagaaaaaacgagagttgtccgagagcgcaagctctccaattatctgcatctctctgagtagaaacaattcgaagaagcaagcatacatcaaatttgtgggagtggcagtgtaaatacctgttccgaaagacttgaaagtaggccgccatgtgagaagaaacggaagcgcgtcaggcgacgagcgagaaaattttgaagacgaggtcgacgaactgcgattccgggtgtgcgcccgcatatgcaagagggtgtcgggaggaatgagtctcatgggtggtagagtacagatggtcgtggagatggaaagaagaatagccaaacgagacgtgttttggggccacggccttgtcgccttgactcgccgggtatcataggatgacgaaacctagtcacgccctccgaggtctcctttaacgcgcgtcgcgcttattaaccattaccatgtgtacacaggctgaggttgggcaatcacttgagatagcaatg

SEQ ID NO: 2765 - DNA, 703 bp, Nannochloropsis_gaditana
atcagatgatgtcacccttcctccgctctcagtcaccctatcaagtgtattctgtcccgtgctgcaatcgcgtcatcttcgcacagctgaatgcctcaatccaagcgggaagggacttttgatctcatctccagccatcgatgccggctatctcgtgcaatgcgccccttttgatccgattggggatggcctctcttacggaagtgcagggtatgcagcattgttggttgcaatggagtacctaacacgacatgccccactgcaacactgtcaggcttcgcatgtgacagtagcttctcggggacatgctgtcgagacaagggcggatgcggcaccgagtacatcacctggcacagggttgaatgtcgaagtcgacggagcgtcaacaggagctgcggcaggtacttctcttcgaagcattcatccgtgcagctatgaactgacctgctcacctgagcaaggcattttgaccctgtccttttatcgagccctcaatctgactgctgcttactctgaggcgcaagatgttgtgcgatcttacgcaggaggtagccttgaggtcgatacacgtgcgctagctagggcaaaaagtgccgttttattcgagtatttagaccgcatctggactcgtcctgccgcagcgcaacaaagcttcttgaattacttccgaggaacgcggccttggttttgcacggagacgatg

SEQ ID NO: 2766 - DNA, 703 bp, Nannochloropsis_gaditana
ttcacatttccattgtgtgcatccaggtcagtgaatgacagattgtgcgctggcgtgccagggcgggcacaggagtcggggagggaaggggctgccacgagacgcgagttgaagtttgcggtcgagggctctgaacccggcgtggccgcactttttcctgtacgttgcctctgttatccatgacaggtatgcatgatatgctgaacatggaagatgcaaggcagactatttggcgttctggtgtcaaatttgtcgctttcccgcacatgcaggtgcaacccatttacccgcgcagcactccacatatatgcctaggtcgtaacattcccgacatcgagttacgcgtcggagacacgggtagccgatgaaaattgaggagaatggagtcttctctagtcatttcaaagaaggaaaagactccgacggcacatgtgtggagacacagcggaatgtctaccgcgacactaatgctgtcccacgcaactttgactccactactctgcatctggggctcaaggaaggccaaatcgcctcccgcatacttacagtgggctgcccaggtcgcgcaggcctcatcgcaaaagtattggataaatcgtctccgattttttcccatacatctccacgtggctttaccacgtatactggaaccttcgagagaacaagggtatcaattatcgccataggcatgggaatgcctatg

SEQ ID NO: 2767 - DNA, 703 bp, Nannochloropsis_gaditana
ccgtcgcagtaaagtccgggcccctggcctccatcagagcactccgcccgtcggagtatcaccgtgcatcgccacaggaaacgtaccgtatacaccagtatgcccgccccgtaacccccgccgaggtgatgaggcacacaagtgcacaacccttattacatttatgcgttaaagtccaatatctaatcgcgattcgatcatgtaaaatccccgcggttcggttttgtggaagtgaaagcaagtctgaaaaacgcaatcgagactaccgaaccccggtgggtgcaatttggtgtgtcacgcgcacatgcccacatttacattcttgaatcttatttaaaattgtgtctggcgaagtctagagcactgtctacatttcatgccacattgtggcattgtttttttgaggttctagctcacatgtcaggacactccgatgcaggcatggatattggaagatgctaatttcagcaaatttggataagtccttctcgtatctgagaggcaaaaagcattccggaaaaaagtgaggagtcgctgcaaatatttgtacagtttttgcgattagtgagatgtcgaagaaacgtgcaaatcttttttcttctaacgcatctccatcccttgctcatcacgtgatgcaggaaatctttgctgcctggcgacacaagcttcctcccgaacaggacagaagagacggagcagcatg

SEQ ID NO: 2768 - DNA, 703 bp, Nannochloropsis_gaditana
gtcgcataaaatgcactgcgcaagtaaattgcgagcgcacgcaccgtgcgcaaaatttagaggaaagaagttggagaaataaaggaaatattgagacatagtgagaaggaaggaggataggagcagcagttggcctcggaaagatcaaatgctcaagcaaccccgccggcgactatctcctcccagcatctttccgtccttggaatgccatttcctaacaaaacatggtaccaataatcatatagagtgcgcttccttgcgaaaaaaagagtctggaaactgcttgtctcagattttcgcacagggctgccactcactccgcgttcgagtgcgacaaagtgcctaatgcagggcattgcagacgccgaaggcgcatgacgggcttcgacacttgccgttactgggaatgggcccgccccccaactcgattcgcacaagactgcacacgttgactggtgtgtgtcaatgtgtccgtgagaagaggtcattaattgaatggacatgaagaaccagtatataatgcttcgctgacgtaagttaggaggccatctatgcgtcagcatcatgcgagggaaaagaggaagcgagagcgggcttaccggaccaacggcagtctcatcgaaatgccaaattccatgccaatacctttcggccgtcaacggcgctctaatcttttttctgcattccgaaatgtaggcccatg

SEQ ID NO: 2769 - DNA, 703 bp, Nannochloropsis_gaditana
tatcctgtcgcaggtagccctggggcatagattatattcaagacagggaacacaattcctggaagaccctcgcacaggcctccgatgccttctcgcgcacaatgcaccaaccaaatcaccagcctgggcacgcggctgtgcagtcgccccgccctgcgtgttgatcgcaggttcctcgtcctcgcggcccccctcgaccgttactttctccccaggcaaatgttcaaatcgaggccaacggacatctcccgtgtcccaattacacgggggacggttgccagactcgcgggggttggccgacagtcacacgatgcaacttgtaaatgatggggaatgtggtatggatggggcgggtgcgatccttatgtgagattgattcgcgtggttgatgcgggacagttgagactaaccagcacatacggtgttcttgaggttgaagaagtgcaagtattcgcgtcggttcctgagccaaattctactcttcactgtatcgcatgcttgttacacccgcagtaaaagctatgtgtatgaatgaagacgatgccgcttttttcccgcagaggcgtaccgttgattccatcattacgactgacaatttaccttctatgcacctcgcgcacagggttgcaatattaaaacttgggaagatcgatcctgtttacgtataacaaggcaccagagggcagttgtttgacatataatg

SEQ ID NO: 2770 - DNA, 703 bp, Nannochloropsis_gaditana
gtagcgatgcatgctaacgatgaaatgacatttgagaggtgacggggggaggccgagtatcctgaaagcagactagcgggcctcgatcttcgtggctttcatggcacgcctcccgtgctttggctaacatgtgctttaaaaaacaatacagacccgtggaagaatgagagcaacgaaacgcgtgggggctagttatctgggtctcattctgttgtcgagcctgcaccaggtcgccgccttcagtccgcttgcagtgccaggggcttcgagtgggatgctttcgacacattctcgcgggacactgaaggtgaagccgtcgctgccatgtagaacgcttctatctacagtctcgtaagtggttgcaaaaattgtacgtgtcgaccagtatgaaacagttgcccgcgcatggagacctcgcacgagacagttcatttgccgtgcttctatttcaggggggaagtccacggtctttcggggggcaaaacatggtcattgacttgaggagacattttatatattcatttcacctgaagacactatggatattagaacttttgctggctgttcggcatttgaggtttccgtaatccgtgcttcaatcctttgtccaaattcattgacgtatttctctttctcttctgttcactaactttgtagggaatcgacagatgcgccttcgtccaaaaagacggcacccacaatg

SEQ ID NO: 2771 - DNA, 703 bp, Nannochloropsis_gaditana
gaggtccttttcttattatcatcgcaaaaatgcaggacacgtccgacccgtcaaacaccatgcactgcgtgtgtgtgtggcaccttgttcttgcccagctcagtcacccgtactacgtatcatctgcttcgctgaggtatccctcctctgcgtagtaagtgacagtcatggtttgaagccgagtatataatggcaggacagattcgaggattaaggacatgaaatttgatatgcgtcgagagtgtatgacataagggcatattattggcagtcagacccgagatgggcctctgagaagatcggaacgcttgggaacgcgaaggagctaccaagaaagggctcctgtctgttgtacgcaacacacatgactctccggcagaaaatagagactatgtcaagcttcatttgcttgcatacttgtcgtgtgctcatgcgatatattatagtgcctgactggatttgaattttagggagggtccatccatcgtacaatgcatacaatgcggcaggccctctccttcgtagtcccgggagaagctagtttccattcccaatgcattgtaatcttccttatttgatcttcgaaggcggaaatgccgtggagattttacctgccgtcatgtgtacgagcacttctgtgttctccacgtgatcacatcggtcactcatcttcttccatgacctatccaggcgcgacaacatg

SEQ ID NO: 2772 - DNA, 703 bp, Nannochloropsis_gaditana
cgggaggagaagattggactcgacagggcctgagggcatgggcaggctgctggccctttgtaggatccagaaggggaagacagttcgcgtgatgaaccagttgagagtgcgcgcacgtttgagagccttggtgcgataattatgctccgcacgggagacaaaaagagccatgtacgacatccgagggacccatagcccttgaaaataaaagattagcaagcattctgacgacgcgcacgaaataccattttcttattctgcaacaaagcacacatttccatgcttacgctgtcttattcactttgagcgtgcacttgccaaaaatttatactcatcatcccatggagctgtctcctcgaccttttaatgaaggaaaatgtgtcctcgctcgcccagacctcgccagtcctccggcagtatccgagcggacacgagccctgtatttcaggtaaagaaaaacacacgaggccttcgacacccacgcaagcaaaaactcaaataatagcagctgtatgtggcatgccttgtctttttcgtgatgcttacactgacgcacgccactcaagcaggctgaagaacagcgcacaggcgagaggcagatacttcacgctctggagcatgcttgggacttactgaatacgaatatatgcccgttattatggtggaaagatcatctagtaaagcaacactgatatgcgcgatg

SEQ ID NO: 2773 - DNA, 703 bp, Nannochloropsis_gaditana
tctactttcgagaagatcctgccgccgtgagagcagcgggagggacgacggggttattagtggtgcaggacatggctgaaaagcagcgttgcaattggaggtgtcagcataatatcctgtgtagatgattcgtgagataaagtaaactagtatgtcctgagcacgcttccgacctacctatacctgcggcccgaaccccactcgcaaaaaacagcaagacataaaccaattgcgaagaccaggtgctgcatgcgtccatcctatccatgctgcaagtgttagaatgcttctttgctctacctgtggatgtacatgtgttcccttgggttctttgccgttcgtctcgaatgcgaacaggaaaaaagcctgcgaggccgtccaggacccgggaggttactacctagtaggggcatcctccatcgtctgtgcccgtgactcctacttcaggactccagaagccggcactccattcaatcccgcgggtcttcaagagtgtgaccagtgtttttcatgacaattgctcgggaatcatcacttcaaatccacgcgtcacgtgatgcctcctgtcgaagtggcatccataaactcggcggtcgaatggtgggaagctacatctgacgggttttaaactctaagcttgactctgaatatttcttttgacacgcacaaggtaaggaaacagctttgacacgagatctcgatg

SEQ ID NO: 2774 - DNA, 703 bp, Nannochloropsis_gaditana
cactcaaatttcctgtgcgtcggagtgttgccaccgcaacgtgatcaaaaagagcactaaataagaatcaaacccccatggtcaacgtcgacgcatgctcgtgcccgacaagtcaggccaagctcccttgctgctcgacgtgttgcgggacctgtctttaatcgatcttctcgttgtgtgactttttgctcgtcccctgcaggcgagcgcctcaaccactaaccctccctcgcccagcccctcccctcccttctttttcgatcgcatggaagccgtgccggagcaccctcgctttcgctcctcccttcagggttttattttgattggcatgttgcctgtggttttacctctctgcttggtcccactggtttgtggaaggggcagcttgtgacagaaggaggctctccatcctacgagttgcttccatcagcctgctttccctcagtgcctcgcagccgccacggccacctatattttccttaccacattcaaaagcatggcaaagcttcgatgtcgatggctttgagaatagggcaccctttgtgccaaacgtttggcccccaaagtgctcttggacgtggaagagtatcattccgcccgtgttctctgtggtcttagtatcaactgccaaattcactcttgcaggcctacgtacactctctaggccaatcccagcagcagtgacagcagccgcagcagtatg

SEQ ID NO: 2775 - DNA, 703 bp, Nannochloropsis_gaditana
acgaggacgggcggaaagggggcagtaacctcaggggcagggcctgccgctgccgtgccagaggacgcgttatgtgtgggcgtggagccatgcattcctgagggtatatcgtccatccccagtcgggctagcaagaaggccgtcagacgccaagatggtgagatatcagaccgacgacgttgttcgagcggggatattttagtgttcccatccctgttcttgctggggctgccaatagtgctgcgggaatgatatggcgccaatgtgctccgaacccttctctgctatctgcttaccacacacctgtgcaacatggtggaaagataggccggttaacggtggtgttgatgcggttttcaattgcttcaatggtaattggcgtgggaggaggcgtcagtaccatcgccagcagctcgctcctagttcacctcgagcctggagcggtcggaaaggaatgcctccatgccggtataccacgcactaaattatccaccactcttccaataggggtgcggacgtagatcctttctactctgaacaccttcagtccaggtggttgattttcctcgcgaatcacagctgcaaacgggatcatataattgtctcgggctctgggaacgtgcgaagctttccttcagtgcatctaatccattcgacgatttcctggacgcatccgcgtctactgtcttgacaaaaagtcatg

SEQ ID NO: 2776 - DNA, 703 bp, Nannochloropsis_gaditana
cgcccctcccagccatctacgtgtgcggtggtaacgtcttccgcctcctccgtgagctccgccgccgcaacctcctccaacccctccaggacgccgtcctttcccaccgcgtgccctacgtcggcatctcggcgggcaccgtcctagcctgtcccaccgtgtgcaccagcaacgacatgcccgtggtggaccccggcgactactcgacctccgccggctcctcccttcaggccttgggcctcgtgaaatttcagatcaatgcccattattacggcggtgaattttacagccgggagccagggaccggcgcgtacgaggcgcacgccgggatgcgtcgggaggaacggattcaagagtttctagaagaaacgagcgaggcggcgccggttccagtcttgggtctccccgaaggttacctccttcgatgcgaaggcgagaaaatcggggtccgtggaggtcccagtacccgcggcagtgccgtcaccatcttcaagaaagaccaatcccccctggaggtggaagggttgccgacggaggacatcgcagctttggtctggggacaagccaagccgtccactcggacgccgggagggatggtgccactccatgtcctgttcggaaacccggtcaggagccaagcgcggctctcccccgacggtatctacctgtcgttcttggcccccgaccccaccacggacgtgtt

SEQ ID NO: 2777 - DNA, 703 bp, Nannochloropsis_gaditana
ttgtgatataagaagaccagcacgcgcgtgacgtttggtgttgtctcgtaccgtgggcaggcggaataacctcccccctactactgaattaaacggcgcatgcgtgtgcggtttcggattttttaatgtattcatttactgtcatcttgcgcccattccggtcgaaggaggaaagaaatgtatgtgaaaggaatatcgagactcattgtgtcgttcgtggtagccactgttgtacgaggtgacagttggttgttcctccatcggtcatcggacttgcaaaacctcccgcccggcgctacttcttccctgccttctgcttgttattttttgaattgtcgtctttcgacctttgtactccagttcgaccaagaggcacagtgtactgtgagtgcaagtgtaaagcatttgctttgtgatcatggcccggtatcatcaccccatgcctcagactaaacgggtttcgattgcgtacccggcaaactttagtgcatgtcccgattgcaggcgcctacctccaataaggaggagatggaaatacaagcgaaaaaagctctattaccatacggtggtttacgtgagcctttaaacagtagagtcggctgattttcacctcggcctttcttcctgcactgcccagcagtctctctgctccacggcactcagaagaccttcctcaaggctcagcattttcggggccactatg

SEQ ID NO: 2778 - DNA, 703 bp, Nannochloropsis_gaditana
tttggggctgcccttgggcccaatttttcaaaaaagaatcggggaacggaacgccttgctacttggctgtcttctgatggccacgggagtgtttttgtcctccttcgcgacgagcttgtccatgttcatgcttttctactccctttttttcggcgttggtgtgggcattgcctacacggcgcccatcgtggcgggctggaaatggtttcctgacaacaaaggcttggtctccggcgctgtcttgaccggcttcggcgccggtggattctttttcaacctcctcggtaccaaaatcatcaacccactcaatgaaaaacccatcaaaggggccttctcgcccgccctgaccgcgggtttcgcgcccctcttgaggaagttggcaggatgctacgttgccttggctgtgttgggttccctcttggtttccgcccccaagagcccagccatccaagcaggaaagagcaaggccaagcaagctgtcattggaccggactacacccctggacaagccctgacgtcccttcaattctggtggatttgggcgattattttgttgatgtcgagcggttccctggcaacggcaggggtcaataaggcctttgggctgacttttcctgagcttcgctccgattcgttcctgtccatggtcttggcgctgtctgctttgttcaatggagggggtcggcttttttggggcagtatg

SEQ ID NO: 2779 - DNA, 703 bp, Nannochloropsis_gaditana
ttcacggcctttgccttggcctcggtcggcggcagcatcctggccaagcgtttggtggcctactttggcgggtatgaaaacgtctttaagatattcagtgcatcctctgtgggtgccttggggcttgcggcattgttgccggaggtttagagggatgggcgtggagagggggcggatggaagaggaagaaccttcccctcgagcaagcgtctttgtgtgggattggaatgatgcatatcgagggcagctgtacgctggtgaggacggaaacagaaagccctttcaagcgcagcggaggtgttgggttacctttatgttttggtgagcgctatcgtcactcagttgacgaaaagtgtatgtcgagaccgaggagttgtgtgtgagccactcaataagtcttgggagattttaactattcgctgagtcagtacggttggtattttagtggcctttcttccatggtttttgctcagtacttcgcagtgattttatcttgtacgggtgacgggggggtacgtcacgccaacgtgcatctatccattccactcaaagaacaagccccaaaacgcttttatacatggctcccgtacaaaaaaagtcttttcctgaaacatcgctgcgtcactacctgtgcacggggcgccgcgaaggcgttggattcggcttgtgtgtgccttgtaaaaacgcgacttacgcaaggatg

SEQ ID NO: 2780 - DNA, 703 bp, Nannochloropsis_gaditana
taatccctcgagcctaaggatgttaaaaaaggcgttcgtgtatggaaacccccaggcatcccctcctcaccaatttcgttcgaacccattgaaaaccactctgcagcaaggcactgcgtgttgcgcccatccttttgtatctcccttccttcgtatgaacacagttcctgtccctctccgccttgagtctccacgcgggacgtgtggccatgcgagaggcaagaaacacgctaaaggacgacagacaaaacgctcgatttttgcaccaaggccattgcatcctctccaccgtgaatgcacgtcctcaaaacttcgccccgtgtcgtgtcacgcccccagcaaaaagtttcgtcagaagaagatcgcagccatcgccgtacgtctctccctccatgcgtcacctcaacgggtttgggcgacgcgaattaaaaaaaaaatgttctccttcattcccatgcaccctccaatcctaaccgcagaggcctgtcgacgaagcctgtggggtgtctggccgcagctgaaagcaaattgggcgaggacaccggggtgagacggacattgagtcgaagcgggagtttaagctcaggtcgtgtctctggtgggaaggcgggcttctcctccttgtgccgttccgggagaaaagaaggccaaattcggcttccgtctgcccacaagctgcaagaccagtgagattgttaccatg

SEQ ID NO: 2781 - DNA, 703 bp, Nannochloropsis_gaditana
cggtgttgatgcgttgggaggggccagagacggtccagacgctgatgttttcactcggcgttgcttccaacagggcacgaatgtctccactttcaaggccttgatcgcacaaggttgtaaaatcatgaccttttaccactaatgggatcttttggtcgtagtgatcacgcacgaaggcggcgggggagaggggagctaagagctgggtgaagatgtcccgcgtcacgcagacagggcgtttccgatgagcggatgtgatcgagcggaccccaccaatggcattgcgaccgtttgtatgtgagtaagaggatgaattggccgcgtcgcgttttctttttttgcgtcccttggtgtgctgcggggaaaaagaggcaggtgccatactgctcgggccaaggggggggaggtcgacggcatgagtgcgtttatcaatttagcaactcctccacaaggccgcgtacaacacagcgtgtttacatgtacctgttaattcctctttcacatttgttcgacacgggatacccagctcggactcttatgccatcgaggcacagcgaaaagaccctgtgtacgacgcgagtttcatgaggcactcgcggatggcaagtgttcccgtatctcctttttcatacctttaaaaagagacctttacgtttttttctctcacatttaccctcatgtacatgcataccatgcagccatg

SEQ ID NO: 2782 - DNA, 703 bp, Nannochloropsis_gaditana
caaaagaactgcaaaaagcaaaccaacaacaacccaaaatacatcatcacggaataaattgtctcggctaagctttgtcaccccgtttcgtttgctactcctcgagaaggggggaggtgtccttttcgtgccactcagtcccccacaaatgccataacatcttccaatctcatgccttatcctttgcatcagtccgtatgcactaccatatattgttcagatcaatccagcgtaaaccaccgtgacacgccatctgcccttttcttggtttctgtcctggagcgtcgccaatatgggccacggcgctagcatgctttgtgtggcgcctagggcgatgagcggttgccgaaagcagtggcagggacaagcaggggaaaagactaggaagtgcgactgtggcgtggccttgtgtccacgcctgatttcctgtcttgtaaaaatgaatataccactgggggagtgcgtgtgagacagccagggaaagcaaggaaaggcagtaagatgaatggctggctcctcttctgcctccccctcccaccactgctctgccttcgtcgtccttgcaagcctcccttccacacctgatgttgtcatcgcgccaacaacaacagtcactcgatgcctagtgaccttattaaaagaggcgtcacggcaaggtgccgtgcatagccttattctgctatgtgcttccgccctgtccatg

SEQ ID NO: 2783 - DNA, 703 bp, Nannochloropsis_gaditana
ctcccgttttcattcccgcaggtggctcgacttgcgttcttccaggtggccttgtccctcagaacggagcaaggtaccgtggtccttcaagggggggagaagagggtcaactgtaaaacgccacgccaacccagcaccattgaacgcgtcacaccatccatgcatgaatgaccaccaacacaatagcttccatcgtcatcacatttgatcgagatggcaatgcgggcctcttgggagcatggaggaggaggcaggtctctccctcctccgagtcgctcgctttttctcgtcgcgtcgaggaggttcgtgcccttaaaatgccctcttgactggacaggcatacgcttttgtgtaccaggcttccgtgaccatatgacaagaacacgatgaacaaaatacgcctggaaaaactacctcggtctcgatgcatggcctacataaaaacactttctcctgccccctgctactcccaggggatacttgttcttcatgtcgctcccgtcgttggcatacccctctttatgtcccgaaaaatgaaagggttttcgtggtgaatacactatacaaactgctttctatagccccttgtatgtgtgcttgtatttgctcgtcaccctgttgtcatggctgttgcatgagtcacggtacttatcctcgtaccaaaccccgcccattaatccccaccctcatttcgcacaggatg

SEQ ID NO: 2784 - DNA, 703 bp, Nannochloropsis_gaditana
cacgagaggaaaaagaagaccaaagaaaacccttaacgaacaaatcgaagtgacgcattccttattttctaaggaattagcactcgctttttgcagacatttgctactcgagagccagggaagcctgtgaagaggttctgggggatgagattgaacggatcggatcgaaagtcgaggcggcatgatcctagaacgcggtaccgttcgtcatcgcatgaaacggagactgaagaagctttattcacatggctgtcttgtttaaatccccccctaatattgtccctgatggaagtgacttccctataaatctctatgtgcctaaatacttgagtgagacgaagagggaaggacgcggtgggggggagattgaacggatcggatcggggctcgtcgccgagagaaagccccgcccatggcgccttcagcttgttcctcttgttgtagtgcctttggctttatcaggatcataggccctttggcaccggctcttgccatgctgtgggaacttcttcgttgcgaatgcgttactcacttgtattatttcaatgctgggctaccatggtgctgatgatgcactttttagtattagaattgagaacgaccacttctctggtggcacccatctttgcactgtaacgtgaactcacgacgttgtctcgatcctctcctttgcctccacaggacaatttcagcccggaggatg

SEQ ID NO: 2785 - DNA, 703 bp, Nannochloropsis_gaditana
ccgaggcgttgtctgcgggcccctttctttggcgagccctggacctaggtgcgacgccgagaaggggaaggagggtccttttccatcatcgtcatccttctccgcgtcatcaatccggcccttgtgagtcctttctcgtcattctccccctccgcctcctccccgcgcccctcgcatcttcctcgcttcgctctgcacgggattctcccgctcccgccttggaacctcatgctcataccccgcgaggcgggccagaacccaccaacacgtccacgctccggggcatcgatcgatcttgcatgagacgcgtcgtcaccaccgacacgcatacaggcatgaccatctgtgcactcgcgtacattcccgggcgccctgtgtgcccgcggcgtgtgtggtctgcggtcgtgtcgggccacctttcatgcatgtttcttcgctcgacaacggatgcctcggcacacatttagcagccctgtaaagcccggtagaacatcacgcgtacccatcctctcactggttctattcatagatataggatatagtaacaaaggatttgcatccctacactatgtatagtgtgccgccgatttttgatcttgaccaagaagacgacaaagaaggccttgttacaacattagacatacaagagtgcacacggcccttccctcacatatcgccccgttccacgctcttctttggtaca

SEQ ID NO: 2786 - DNA, 703 bp, Nannochloropsis_gaditana
cggccagcacaaattccttgtgcagcttgtcgaagtaccgctttgccatgcgcgcaccccatgtactgacatcgtcgtcctcgcccttcctccacgcaaatcgaaaatgtcgtttcagaacgtcgtagtccgtcactattggaggccgtggcttcattgctgagcttccatggccggccagtcggaggagcgcttgatgatcttccaaattcatccaatccaccaggtaatcggagccgacgcgaaaggaggaaaaaggaaaaggttgccctgggagggaaacataagcaaaccaggaggacacgtgtcattgcgcaccgatttatgaaggcattcatgtgacatgactaaatcgcattccatcaagaaataccaagtgtgtcatgggtttgtcttgctgtgcgactggttggcaagccacagacaggtaaagctacctgcccagcgttactacaacctcaactacacgcagaaagctaacactgccaaagccatcctcgctgcctgctatttattgacatggctcgcagtgcccgacatgtgactgcagacaatgacggtggtaccctcggcatactgtcatcgggattcagaatttgtgtttgttctagcatccacttttggtgcgttaacggccgcagaaaagaggaatcctataacatgcactcatgtcggcccaccttttgacgcttctgtacccacc

SEQ ID NO: 2787 - DNA, 703 bp, Nannochloropsis_gaditana
ccctcaaaaggattttgattttcttggttgataaccacactgtgaagagttcttgtacgaaatctatggcaccatgaagaagcgtgtccgtgcgaatttaacattgtcagtagtgcttctgaacgagataaggtcatgtccatttacaagtaatcgaacggagaagcctctcttcctacgttatggacaagcgatcatcgctcttggtgtcctgtcgcctttcgagaggcgcgtctttgctcatttgcttgctcgttttccacccaggaaatcggggagatcccctggcggtgcatcatcgtcgacgaggcccaccggcttcgaaactggaaaggcaaactgcacgaatgtctgaaagttgtctcccagaccgggttgcaacggtatggctatcaacaccgcgtcctcatgacgggcacgcccctgcagaacaacacgcaagagctctggtccctcctccattacattgaaccgacgaagttcccggacatggaaaaattcaacgaacgttacgggcgggttgaaacggtcgatcaggtgcaacagttgcagaaacggctcgagcctcatttgttgcgccggaccaaggaggacgtggctacggacatcccggccaaagaagagaccatcatcgacgtggagctcaccaccttgcagaagcagtactaccgcgccattttcgaacggtgcggacatagggatg

SEQ ID NO: 2788 - DNA, 703 bp, Nannochloropsis_gaditana
gcgtccagcattgagagcagcaccagatttgaggcccgtcaaggtacctagatgcagacgaaggcaggaaagaaaggcacaattggagcatggtgcaagcaagaaggggtaaaatggcacacgattttaccttttgaagaggcgccccatttttgaaacgcttgatacacagacgtctgtgctcaagcacaaaccggaacttgtctggaacaattagtggctattcgatgccgaagcaactgacactcccactgccgacaactgccgcttcttattgaagttattggacgtttcctggcaccatgtgctgactgttgttttgaaggataatgggggtggatgccgcgaggaaggaggtggacatcacatctctcaagttcttcccattgcgtcgtttaaaggcaaacaaaccaagcttctcaagaattctactcatcacatgcaagctattgaacacatacttgtatagtgtcatgtctgctccgtaacacactgatttcagcgccgcaaccccgcagattggggggtgtacttgaacagatgacgcgatgccgtggatgtgatggaatatgccccttcgtctcccacccaataggatccctatattatgcaccgcacgttgtcctacgactgacttttaatggaaatatacatgtttactccacaggaaagcccgttgttgcgtcctttccacggaaatatg

SEQ ID NO: 2789 - DNA, 703 bp, Nannochloropsis_gaditana
gcccgtcaaggtacctagatgcagacgaaggcaggaaagaaaggcacaattggagcatggtgcaagcaagaaggggtaaaatggcacacgattttaccttttgaagaggcgccccatttttgaaacgcttgatacacagacgtctgtgctcaagcacaaaccggaacttgtctggaacaattagtggctattcgatgccgaagcaactgacactcccactgccgacaactgccgcttcttattgaagttattggacgtttcctggcaccatgtgctgactgttgttttgaaggataatgggggtggatgccgcgaggaaggaggtggacatcacatctctcaagttcttcccattgcgtcgtttaaaggcaaacaaaccaagcttctcaagaattctactcatcacatgcaagctattgaacacatacttgtatagtgtcatgtctgctccgtaacacactgatttcagcgccgcaaccccgcagattggggggtgtacttgaacagatgacgcgatgccgtggatgtgatggaatatgccccttcgtctcccacccaataggatccctatattatgcaccgcacgttgtcctacgactgacttttaatggaaatatacatgtttactccacaggaaagcccgttgttgcgtcctttccacggaaatatgtcgatcgggggcatgtttttagcccatgagatg

SEQ ID NO: 2790 - DNA, 703 bp, Nannochloropsis_gaditana
cttgctgtcttggcggaagccaggcttgtgaggcccggggaggccgaagggacgcatgctgtcaaagactttgattgtcttgccatttttttttttcaagcagtggaataccaggcacataaatcatattttttcatttttgccagagctgacgcacgcgctttgctctccaagcaggcgagctcttcgcttaatggtcgtgtcggaagttctgggctagcagcgcaagggctttttgtcggcgatagcacgcgtacgtaacggatcccgcattgaggcacgaaaacgggatgatgggccgtgtgatctcacactttgacggccggagaacgtcaaaaagggatcaagaaaggaccacaactttttaaggcattttctttgctactgttattcaaaaaatacatcgtgcaacactccacttatcgtgtggtcgagctcggagaggtgattgatcggtccccccgtctgcacacgtaaaaggtaatcacacggacaaatgcaccgagcataccttgaggcgttcatgttggaaagctacaagaatatttgttttttgtacagcgcgcctgcaccaccctcagggtattacttcgttaatcttattacgacaaggcacgctcatagctcttgttttcagcaggcttgatcctgcggcagacatatcttcgcacatccacgtacgaaatttagaatcgaaatcatg

SEQ ID NO: 2791 - DNA, 703 bp, Nannochloropsis_gaditana
cacgggtcgtcggacagcgcatgggacgagggatccgacgcgcagcatcataaaattgcccagcaccgggaagacacaaccaaaaaggcaaaatttgcgcgggaggcgcgggagaatctgttgaaaacagtgtagttgcaagcgaaagtcggtgaggtggatagggtgcagatgatatggatagaaatctgaacgccaaaggacaaagtgcggtcaaatgcaagggaggatatataccctcggtggaagtctcgcaatccccgccccaatccagggttagagtctgttcctcacgaccctgcctccagccgcccccgttattacgtcaagacttaaaagaccgcacttgagaccagctgacaatcggtgactaccccgttgcagcgtgcaaagtgggctgaggtctggggcacgtacgaagactctgcgggcgggggaggaacgctcacagaagacgagaacaaaagcggcgattataatggtatatatgatccgcatgtcctgaccagttggtgacacacaggtacgagctgttgactaacgtggccaacaagcaatgttttctccctcgtatcaaataatttcgatgcgcgggaaaatcgcacgtaacacttcagttgcgggaaacgactcggtggcagcgagaccaaacaacacattttctaattctcctcaggcagaacgtagccgcgaaaaagacatg

SEQ ID NO: 2792 - DNA, 703 bp, Nannochloropsis_gaditana
tcgcaggaattcgtactggccgaacttatacgaaggccgttttctccactgagtccgtctctatctctacttcgtgatatgcggacaagaagtttctgttaaaaattcttttaataaaatccctttataatcgtgatgattggacaacccgaaccgtgataaaagtttttcaaggcccatctaaaatcgtgttgtccgacggatcctttgttcctaagagaaaaaaaagggggccacaatcttcgcctcgatcatgatgtgaatgctttgactctatatatgtccagcagtacgttgctgcgagctcagaatcattaggattattttcgcttgattcttgcttagatctcaggagaagctgaacttcgcctggggcggcggccgaagacgtacgacagtcgccgtctcatcgctaaaacaaaatactgctaggacagtccacattcgatactcagaataactctctctcagaggcggccgtgcccttgtgcggctcgaacctcgcttattacacttggcacttgtataattgctgtgatatgctattgagatgtgccaaatatatatttgtttatcccaaatctttttaccgttgctctcaatacttatacagactgcccctatacttaatctaggaacgtttgtcttcgagtgaggcatgacaagcgggcaaaccaaccttgcggccaatgttgctgcaatg

SEQ ID NO: 2793 - DNA, 703 bp, Nannochloropsis_gaditana
atcctcttcatgtcctgacgggattcggatggccataaatgcctcaggcgttggacacgtttatctacgtttacgctgtatcttggcagctaacggggtatcttgcaggtcggccgttgggagaagctaggcggagaatgacgctttggatcctgaagggtccgagatagatgacgctacgggccctttccgtcatcctccacacgccggcgggccccgcgatcacgcgcgtctctcccccggcacacgaaccggggggcaaaggactgagactacaagcgtggactagtcttcctccccccgcacatgcagcctgctttccactcaaggacaaccttaaacgatataccatgctgctcggcgaggcacttgagcttttagctttctcagggctgttgatgcgtaagcccacaaactggcttcctccgctccttgtcgcccgcatcttgcccgctgcccgcatcttacataccgcgaggcggacaagaatgatgacacaacacaagaatggcgttcgttggcgctttgatgtcatcccccgatcgaaactaaaaaaactttattcctataaatgtctttgtcactattacgtatcaaacaggagggctcacggttggtgcgctctttttcctgttggtgtgcgagagcaggctctgtttgtggtggcattgttagtccggaagcctatttcgtttccaatatg

SEQ ID NO: 2794 - DNA, 703 bp, Nannochloropsis_gaditana
acttttctgaaaagaaacattaataatgcatgattgaatataaaggaccacagataaatcaccactccagccttagacatactcactctaaaagggtgacaaactacatccgagaccacaagaagtcttagaaggacaacgtgtgtcgtctccaagcttgtccaccatgtgcctaaccaacgcaccgattttaaaaggtgacaggacttgcgtgtcacgcttttcggtgatgtgtggcaacgagacaaatctcaccgcacgcgactgtatactttacaaaaatgacccggggtggggcctgaaggttctccgactattcttcgctcagccgctcgcgttgatcccggcgatgcatttaaggtcgaagtcccagcatgccaggaaacacaaaccacgaagtgagggtgcaccacagggatcattcggaagagtgattgatatagagggcgatttgctacatcgtgcaataagtgggaccttttcctgcagtccgctccatcgtttcgtgcttttgggctcagcctcacggtcacttaaacgttcgtctcttgggcccacaagtgcgccactgttcctgaatcatggcgccaaatgatacgaagacatgctcatttcattttctgaatggatggcatcctgcgtcatttaggaagcaagataacgccttactttatgaaatgacttctccccctgctttcctcag

SEQ ID NO: 2795 - DNA, 703 bp, Nannochloropsis_gaditana
gacgaaattccacagcgcatccagcggcaagcagcgacagcagaagaaatagaaatgacgcatggtgagtgcggatgcagcttaatactccacgtcgcatgatattccggaaatccagggaaagctgtgcatgagtgggggagagtgctggctcgtgagtgcagtgtatgtgtatggggcgagacgtccgcgatgagcgaggcccggccagccgctgaccgtcgaactggcgcgggcggggcagggaatattacgacttactcaaacaatcgcgccattcaacacacaaatgaccctttctggaggcttcaattaactcttcacggtctcagtagatgagcatttgctccgcgccgtgcagtttgcatgcacctgaacggtacaacctccccgtctgcttagcagttctccctcgccttttcacctgcaaacaactacacttacagatgcatctacccactttcttggttttaattgcttctttaacgtcgacatccagcttcatgatgaccccgctcagtcgccatgcggcgggtcacctggttaaggctgctgttgcctgccgccccgggatctcgcaggtgaagatacgttattagtttgtcatcgtgcgatacaaccaacggaactagatgtcaaaggtcgcgacatcctaaatttcaaagagcacgattccttctaacacgtatatacggattagatg

SEQ ID NO: 2796 - DNA, 703 bp, Nannochloropsis_gaditana
gtaccgccagtaaccaggcaccttctgccactcaagtctaagaccatattgtggcttgtaagaagtgcctgtaaaggaaaaaaaaagtaaaatatatatcaaatcgtacttcggattttacatggcgctttaaaatacgtttgaccctgagaaaaaacttttctggctgcttaggaccgtattctcggtcgtcataccgatatcaagaaatctatgtaaatagtttgtgccgatcccgatttcaaggatggtcgctgatcaagagaaagttgcaggcggttctaggctttttgggacatcttgcaggtcctgatccgagcccacccggacgatgccgcaccacgcagtaggtacacacggacactgcggcggatctccaacctcctgccccgtccagccctcgctctcctcgctcgcgccgggtcaagcacgggcagcccctagactttcctcgagaaagccgagtcttgctcctgctccccgggcctgtgagatctcccaggtggaatttacctccccgctctcagcaaatctattccagctcaatgatgtttttcggtttggccccggaggaatgcagattttaattgtcgctctgttacacagaccaggttcttcctccactgctttccaatctctcttttggacgttttgaagacgcaccccgaaagacaggctcaggtagtcagcatcgatctacatg

SEQ ID NO: 2797 - DNA, 703 bp, Nannochloropsis_gaditana
aagaggcgtggcggactgggacaggagaagaaaatgggaaggcggggcgagacaaagcaatactttgctgtgcagatttcgcgaaagaaatgggaggatggcttcccacaacgatcccctcctgtttttgtgaaggacacgtgcattgtagctccaattagatgcatcgcacgccgtaaaaggttttttttttttaccgcgcccgccggagaacatcgcgggcagactcttatttcttcccgcctgagcgatcgcgccatcagcggtctatctcggcggccgtacgacaggatttagatacgcccactcggttcgatgaattattatcgaagcgtgatgtcggtttgtgctggaggaaaacatagctccttccgactggtcaggcccttggaggtgtttagtatccctccccaggggggagggggaacagatggggagtgctcaagaccaatcactcttggcaatttagtcgccttgggctgcaccaccgaccgccttcgtcacgttcaagagagtcacctttgatagtgaagcatcactgtcccaccttattataagcgcgtgattctttggtgtcagcacgttcacctcctcaccctgctccacctcatttctcatccgatcatcctgcttgcttctcaggtgggagccgaagcaggaaaaacccagccattcctaagtgatacaagccataggaataatg

SEQ ID NO: 2798 - DNA, 703 bp, Nannochloropsis_gaditana
cgttgctagttatagaggatgagcaaagggcaaatgcaaatcaggggctagatgcttcttgtttcccacgtccatcttcgcttcttggatccgaatccttctcacccctcctcattgccgcgcctttcctatcttcgagcaggaggcgccgaagagggcagtgggctaggcggtagcaccagcgggtccacctctggggcagcaggtaagcggtgggatggacggctatagcaggaagtagggatttgtgtgcaaaggcggccttcagagcgggagaagcaggggggaaggtgagggtgggaaaggtgggggcgggaaggacaggaacgggaaaagaggacgagggaaggaatgccgataaaccagccacatgattccagaaacagaacaatggaacagctcatgttataagctaagatttctcatgttacggtttgtctcccttccatccccttgtctggacagctcctcgcttcgagattaagaaatggaacgctgtcaccatgtggtcctgggatatctgcgccgacacctgtgccatttgtagaaacaatctgaacgagccctccatcgaataccaggtcggaagattcgtctccgaactcaggcctgatctctcccttccccctgccttctcctctgctcctcgcgttgcacgtcctcgcctcttcatctaccctaatataccgttcctgtcttgatt

SEQ ID NO: 2799 - DNA, 703 bp, Nannochloropsis_gaditana
caatgccttgggtatataatggtctcgagtaggtcctctcacatccggcactctctgtggtttcttgactaccccttggagagtgacccttgaatataccttgcttgatgtggggaggctggcgggtaaatactcatgaatttgggggagaaccaaaccaggttctgagcaaagtcgataaacggtttctcaaccgtgtgaaatggaatggaatagctaaggcatacctgtgtaagtctatgaaaatgcgtaaagtgataacatacaaagaaaaatagaaagaaaggcagcatattttcgaatgcgtgtcgatcaatatcgtttcgctttgtttgagtaggtgagccccgtgacccgatctcttgcttgatgcccgcctgactcattctcccagggtgccctgattgacaacaattattaaatttgtgaatccaattggaccataaacatctccgataccgagggaggtgtgctggacaattatgcaacattctatagttgataagtgaactttcctcacatttgatccgagaattcaaaaatcgaatttcaaactttggacagtccttcggagcccacatggctatgacccaccaggcaaagcgttgcaccagctgttttccccaaatcatctccccagaacttacctacctatcattttaccccataaagaaaggctttaggctttattcccacggaaatg

SEQ ID NO: 2800 - DNA, 703 bp, Nannochloropsis_gaditana
cagaagtatatccggctagcttggtgaaacttacatgtgcaacattgccattctatgaggtctactcctaaactctagatttactgaattaaagcaagcatgtgacgaaaaagctaaaaggatagccaccggccagtcaagcgactagaaccaagcaagatgactcctgagtccggagtgtggactcaggagctgggaatacgcgaatcagaccctgcgccacaagcaccccatctaccgaatatttcattttcaatcattttatgcaccccattatcttacttactccgccggttttgttcatgcatgggatatataaagttctagctatgaggctgctattcccgggctcacatattgggattgccgacggcatcgccttttgcacaccgtcgtatgaaggcatggtgtatccttctcatttcttgcttatgggtgatgtgtgcgagcttgtaaagttcaatgggccttgcttactctttaggatcactttgcgtcaggtgtgcagacctccgagttggtggcttttcacgataaaaacaattaccgagggtgaagccatttgtgcaatctttcttctgtaagccatcagcactacgacactgaacaataacattgtgagcgtttctggcctcatgcggattagttcagaaataaagcgggcaatgaagcacactagcattgaaaggctgtggtaagcatg

SEQ ID NO: 2801 - DNA, 703 bp, Nannochloropsis_gaditana
ggaactggtatacattcctactcagcatcaacttgcggatattctaactaaacccttattgagtattcgattcgcaatgatacgtgatcgaatgatgggttgtgagtcttaattggaattagagacagctgtgggataagctgcagttacagtagagatgagtaatatggttgttagcttaagtgtgcgtgctataaggttaactgcaatggagaatgtttaaatgattaggagtacgagtgggggtgacgcgaatataaggatgacatgatgatgctaagggagcatgagatcggcgataggaggttaagcgagctgttttacagtgttgcatctatatcctttatggatcctgcagcgtgtaccacgtcatgctattcgcgactgtatcatgtcatggtttgcgtccaactaatcatttgtatgttatattattatacgacaacaggactggcgtcgaccatgtctttggtcgtctttgatctatctttggttatcttagtacacgattcttgggtgaatcgattggtatacattctcagggagaatagtaattgtactgaagaactaattaggtattgggttacctgtggcattagtttgtttattcgcatcaaaaccatggtcagacgtttttatcctttgaaacacaagaattgacgcatctacatcgtttggacatgctctcacctcaacagccatg

SEQ ID NO: 2802 - DNA, 703 bp, Nannochloropsis_gaditana
cgggaaatgatgaggaagcacgggatggcgctggcggggccggggaggcggctgctctctggacagtgggtggacgaggttttcgtgtgtttcgagatattcgagaaggagagcgggaggaggctgtacgtgggcttgggcgcgataaacttgtttcagcgagaggacccggaggacccggtgagggcgggggggagggcgggggagagggcgggagggagggaagggaaagaaggaaggggcaatgtcgtgcttttccctcccgtaaagagggtgtgagctctttatttatcgttgaggtttgaagcagcaaatctcaagtgttttcgcgcgctcccttccctccctccctccctttctccctccttccctccctccctccctcctccctccgttactcgcctttctgccggcctgccctcctcccgctccccgcccttttttgacgggacaggagggcgacttacacatcgatctacacatgtggagcacgcacagtcgggagttggcggggggaacgttttcggcgggtatgtacgatacgagggagggggggaggaagggacggagggggaggaagggagggaggaaggctctgaagaacattcgagacttcttccagaagcggcctaaggtggtagaggaagggagcgagacggaaggggggagggaaggaggggaggggcatacctggagcgctatg

(The sequence listing continues in the following parts.)

What is claimed is:

1. A transgenic algae of the genus *Nannochloropsis* transformed with a purified polynucleotide sequence comprising the *Nannochloropsis* control sequence of SEQ ID NO:7604 operably linked to a polypeptide coding sequence, said purified polynucleotide sequence further comprising a selectable marker.

2. The algae of claim 1, wherein the polypeptide is a lipid biosynthetic pathway polypeptide or regulates a lipid biosynthetic pathway.

3. The algae of claim 2, wherein the lipid is triacylglyceride.

4. The algae of claim 1, wherein the coding sequence is SEQ ID NO:8719.

5. The algae of claim 4, wherein the control sequence is SEQ ID NO:7604.

6. The algae of claim 4, wherein the control sequence increases or decreases the number of copies of coding sequence transcript during logarithmic growth and/or when nitrogen is not limiting, than during non-logarithmic growth and/or when nitrogen is limiting.

7. The algae of claim 6, wherein the control sequence increases the number of copies of coding sequence transcript during logarithmic growth and/or when nitrogen is not limiting.

8. A method of making a transgenic algae comprising:

a) transforming an alga of the genus *Nannochloropsis* by introducing a purified polynucleotide sequence comprising the *Nannochloropsis* control sequence of SEQ ID NO:7604 operably linked to a polypeptide coding sequence, said purified polynucleotide sequence further comprising a selectable marker; and b) contacting the at least one transformed alga with a medium.

9. The method of claim 8, wherein the purified polynucleotide sequence is stably integrated into the genome of the algae.

10. The method of claim 8, wherein the introducing is by electroporation.

11. The method of claim 10, wherein electroporation is performed at high field strength.

12. The method of claim 11, wherein the field strength is 12,000 V/cm.

13. A method of using the transgenic algae of claim 1 for obtaining lipid or biomass comprising:
  a) growing the transgenic algae in a liquid medium;
  b) allowing the transgenic algae to grow to a stationary phase and/or reducing the nitrogen concentration in the liquid medium and/or a gas environment in contact with the liquid medium;
  c) maintaining the transgenic algae in the liquid medium;
  d) collecting the transgenic algae;
  e) separating the algae from the liquid medium;
  f) extracting lipids or biomass from the algae, thereby
  g) obtaining lipid or biomass.

\* \* \* \* \*